United States Patent 7,468,248 (METHODS AND SYSTEMS FOR INFERRING BOVINE TRAITS) - sequence listing, part 2

SEQ ID NO: 4527 - DNA, 600 bp, Bovine  MMBT07392
caaagagtcagacacgactgagtgactaacacacacaccccagaaccttatttcgggcttccctggtrgctcagtggtaaagaatccacatgccaatgcaggtttgatccctgggccggaaagatctcctgtggagaggaaatggcaacccactccagtattcttgcctggagaatcccagggacagaggagcctggacacgagttagtgactgaacaacaacaacaaaacatgacgatgcccatgtgataggcagagcatggtgtcatagggcctggattagaatggtgaaagtatgartggagacaaaaacaatataggatttgataactcattgtgtttggaagtgagaatggaaaacatagaatcagaaattaggctctggtgatttttttttttttttaataataagacattaagaaaagaaaacaaagtttcagggggaagttaatgatgtcaggtcactaaattgtcctggggttgatgagggttacaaagaagaattccaagtggcctaaaaaacagaagtcagatttcaaagatagtctgcatgccttctccaaatcaggaccatctgcagggaaggctggagtgacattc

SEQ ID NO: 4528 - DNA, 600 bp, Bovine  MMBT05317
gtctccttgtatacactatgttatttaatgtcatttttaccacataattatactctacattgtgtttattattcccatttagcaaagttaagaaccctaagcgacttaatgactgaacagcaacaaagaaagctattccttcttaatttaggtttgttttatttgtttaatgttaatccatgctatatttcagtatgatacagattctgtacctgtgactccagtcagatatccagcagtacaaattagcttcacattacacatattgaacaaaagacagacgttgaacgagcaaggagkggaggggcagggcccagggggagaggtaaagaaaagaaacaaagaattgaacatgcatgcaggcttttccataccaccttcaatgctaacctgcgtcagagggagagtaaaagtaggcaagaatgagcagccatggactgttgaactgttaccagcaccatgcttttcagcaacatttcagcagagtttgaaacacagcaaaactattacaacaaactccgcaaacaaccttttaccacctcaagttaacatccaattaattttaaacactggtataaaattcaacttaaacaattagaa

SEQ ID NO: 4529 - DNA, 598 bp, Bovine  MMBT04304
  misc_feature (1)..(21): n is any nucleotide
nnnnnnnnnnnnnnnnnnnnnattttcattttaagaggcccatgttctaaaaggaagcttttctcttgtcctcccaattaagcaaaattatttcttgcatcagaattaccatgaattactaatcatcctaaaattgcaaaataaaggtggtgatatttgaactgagggaatataaaaaatggtgctcaaaaatgaaaatgatccatatattagttcattatttacttaaatacacaaaagtggatagaattctgttttggatagttaattttaattccaataatttaaaggagtgaaaaktaraagatttatttttgtcgtataagtctattatcttagaatccttaattggcattttattcatttcatttttatcattatgcccaagtcatgcaatgtatttccttcataattattacctgtatcaaaactggtttggaagatctttgaactcctgttttcattttcttttgaactctacttgtctctttgatcagcgtattgctcttgcagcttccgcctgatgtaaagcagtttgtatggctgcataccttgtttctgtggcccaaatataaaaagccaaatgacagaaattaag

SEQ ID NO: 4530 - DNA, 600 bp, Bovine  MMBT11077
ttaattgcataaaaagttcaaccaatgagtcattaaatagtaaaaggttattttaagttttcattgcagctctaataaaaaacctttttttactcctccatatttattattattttattatttcccatgtttcaaataagtgagatgtcatccaccaaaaaaacagttgtttgaggacattattaccaatgtgatccctaccaccaccattacttctaccaattgctacaatttattgagcatttactatgggtgaggcaggaaatgwaatgcttcatatacatttcaaacacaatccckgaactaggagtgacaaggtgaattktataatgcccctcaagagcagtaaaacattagactagttacttatctctggtcctgcttttctctaggcttggatcaatattgattktacatcttagaagtttccttccagacttcagtattctattactttgttagggtcaatttcatggtacaaattctcacatttatgtcattctttttttttttttttgctataaagtgaggcatatgggatcttagtgccccagctagggatcaaacctgagccctgtgcaatgaaagtgcagtgtctca

SEQ ID NO: 4531 - DNA, 600 bp, Bovine  MMBT12293
cttattataggtggtttattgatgatttttgttgacattacgaaaggaaaacaaaagygttgccttgcctttttgggaactattgcttttcccacttctttaagtacaagagactattccttctctctcttgcctggatttttctgggctttcttacttcatcttgacatgttattttctttgggtttatcaccggggctcctccccctgctaactattttatgggaggcaggcaaagtcagcacaaaggaaacagaagccagtggtctgtgagaggccttctgstgctggccacccacyggaggcactgaggctgagaccagtgacacttcctttgaaacagagctatgtgcctgctatccaaatcaaaggtgcttataaaaagaattccctcttttgggtctagggttttttcttcctcccagcttcaggtcctgctgtcttcctgctgtcacaaaggaaggacccacagtctcgttcctgctttgaatggcaaaaactttaaatggtagtacctgttcctgctcatcttgctaaagccaattttgtgtgtggctacaaaatctggcctggagctgttacctacaactttctttcctg

SEQ ID NO: 4532 - DNA, 600 bp, Bovine  MMBT13166
tcttgagagtctgttggactgcaaagagatcaaactgttgctgaaagagggaccgctttcagagcttgaaagtgggctcatgtctaacactcagaaatgaattgtctgaggagacacatgtgcagacaaagcaatatattttattgggaaggggcacctgggcggagagcaggagggtaagggaacccaggagaactgctcttccacatgactcgcagtctcaggttttatggtgatgggattagtttytggattgtctttggccartcctctgactcagagtccttcctggtggagcaygcattgctcatgagaagaattctgggagtggttggacacctggtgtcaccttttgacctttcctgaactcttccggttggtggtggcttattagttccatgttccttaccaggacctyctatcataaaacaactcatgcaaatggttactgtggtgcttggtcagggcaggtggcttcagtcagtgtgttttccctgacaaaaccagtcaatcctagagtaaatcaactttgaatattcactggaaggactgatactaaagccaaagctccaatgctttggccaaatgatgtgaagagtc

SEQ ID NO: 4533 - DNA, 600 bp, Bovine  MMBT12624
tatatttttaatttcagaaaaaaatctttgattaacttattaaacattctactaagtatatctatttcattcattcatcccactccatttatattaacatctaaacatcatagctcataatttgtagcttattataatttaaccttaatcttcttttccaactttatataatgtcattctcaaccccttgcattattattctagagctagggagctacattgttccctagtgacaagggacagtctaatgttctcttgctattaactcatgctgtttctcctgtcagagtgtgctttcaytgtttggtggtaaaatcctattcatctgtttagacagcttttaagtcgactcttttgtgaatgcacttcctaaacctagctcaaacatagacagtaaaatacacagcagacctgatccttccctcctcagtttctaacatgaattcccatgtaccttacaagtgaaccaccctaaccaatttcctgaatgcaccctatttccataccttcatgcccttgctcagaacaaactctttgcttaagaaggtccaacccatacctcaaaaagaccctatttttctttttctttattccccacaa

SEQ ID NO: 4534 - DNA, 600 bp, Bovine  MMBT13445
ggggaacaatcctcactcagaaagactcaagggaaggaagtgacagcgtcgtggggacagggcataacctcatctcccaaggaggggctggcttctggggagctggtgacttggaggtcacagcccaagagggtacccatccccctggaggaggctaagcagaccccactggggcaagtctgggtcagagcaggagacaggctgggccagcccctgcctctgtctgtaagcctgtgaggcagctgctcacaggctctggtttgccaagaggggcaagcaaggaaaccaacattctctggrcaccttctgggcaccaggctaggtgccagtcctatgacatcatcactatcatcaacattgtcctattaaatcaaatgttagggcaccatttttttttttccaaaactgtggattgcagtccgttcctgggtaatgaaaacagcttagtgggygacaaatagcatttttaaaataacgtgataaaaaatacagaaaatttcagtgtgcattgcacagagcaaggattggtattgtggaagtttcatttcttaatgtgtctgtgagtgtttggaagctggatcgtaatggggaaggaaacag

SEQ ID NO: 4535 - DNA, 600 bp, Bovine  MMBT15400
tgcctctcctgagacctaaaggtgctgcaaagaaaattaacctcacacttcaaaggggagcagaggagacccccatccctggtgatgggaggaagtgagtactcactgggaaatccctgaagtccattttaaatgatttaatgtgatgaggaagaacacagccccgttcacaccrgaagaacctccatgggctctaaggaattaagtgatcctgaaaatgtttgctggaggaacaagaagagtcacgggggagcaagcaaaatgtcacccagagtaaactgttccctgacatcaggtgayggctcagcccctgtgcctttcatcaggtttcaggaaggcaggcttgacatcaaaatcctctggctgccaagaggaggaaagtgatgactgtgactacagggacaagtatggccagaaaaataaaactgctcaataactccaaagcacctagaaaatgtcatgattggggacagagactgggagtttatcacatcagccttagtaaaggaatagtcaagcctatctgttccaggaccacragctgctgctgctgctgctgctactgctaaggcgcttcagtcatgtccgactttgtgcgat

SEQ ID NO: 4536 - DNA, 600 bp, Bovine  MMBT16289
tcagaaaaaaaaaagtgcttcttaaaccctattctgcagggctcaaagggattattttatgtgcaaagttcagaaataaaaaagccaaactccagcaaaattgcttctttttgcattcttcattttgatgatgtctctaaggtgtggttttccatattctttatgctyctaatatactccaaattaccttatatttctgttgtacctaatagaaaggaggtgacatgtaagggtacagggcccccggtcacctagagtcatataccaaaacctgtctgagtgatctccaaaacagactgygccagacattttattaaaggcttttaccttgtgccataaagttaatccacactggaaggaagcaacaggaattttgagtgggttgaatgtaaatcagccagttgggacaatggtgattgggactactgtgggtgaaacaacactacgtcattctgatccaggcattatttgaaggtcattgaacatatgttattggagatactgttacactcagggaagggaggaaagggagaaagtagcagaagattttgaatggtctaaattctgtgcctgaggtatttaaacctataacctttccat

SEQ ID NO: 4537 - DNA, 600 bp, Bovine  MMBT16237
cctcacctcaacaactcaagcatttttaaaatccagcaactaatttaagtacaaagaaactgccacatgcctgagagagagattttcattatcatttttataatagtcttaccagttctactcttggttttaaatattctctcaaatcttttctccagcatacttatatcgtctctcaaatcttttctccaatatacytataacaatacccagtcatttaactcaatccaccatttgatctgcatacaacttctcctgcatctttgattcaagttttgattctgccatctaacaagccaygcgatctttgggaagatgtcagttaaccaatttcagccttgtcttccttagctttaagatggggataactacacctatcgccagagttctttatgaaattaattcagttaatatataaggaaatgtttgacgtgctaacccaaacgttagaagcggtcatcaccaccatcatcactgttagagatacgtgaattcttgacatggatacacctctgatttaacttacggagtttccagcatgactttacaaacacttgtcatcgtactgaggcagtctgtggtgttctctattggcagggg

SEQ ID NO: 4538 - DNA, 600 bp, Bovine  MMBT18152
aacgtttggtccacctggggctctatccatccttctagttccagttccaaccagagttccaaccaatgggctccagactctgggttctggccaatgaaaaacctcccttacagtctcctcttctttttccccaagctccgcccaccatcgggagctctggctaatggagctcacctggagctgttgctttttctctactcaaagcaacaaataaaagcaatggtggccttagcgttgtgtttgatggttattagtactgaagggggagaaggaggaaaaagctccggcagttggccactrtrtgacctcaaggtggcttgtcgtctctaggcaagtcctagggctacacgttttatcccacctctaaagtgaaagggttagtcgctcagccgtgtctgactctgtgcraccccatgaactgtatagcccgccaggctcctctgtccgtggaattctccaggcaagaatattggagtgggtagccattcccttctcatcttttcccatctctaaaatgaggcaagttcagggtacagcatctayctgcgatccagaggtgtgtggtccagtgtcacacactgagcttgggcccttcccaac

SEQ ID NO: 4539 - DNA, 600 bp, Bovine  MMBT17818
gtctttcatgtgttcatctttccctgtcccacatcacaggaggtggttctcatgggtggtttcaactccagagtttctgagtagtacaagatccccgtctgataagtggggagcatgtctaagtctgctcttgggctggttcctgttaggtgtttttcccatgagcccaacaccctccctcacttgtccctggaggaacaagcacccagaacctcgtggcgcccttgggccttgggtccccattgtagtaggtgccgtgtcccctggaagccatgctgggcttttccctgactccctcartggaggagtagccttgcctcagtgggaggagggagactctagttgaccttttccctcaagggatgaatgaagacatttcaagtgtccctcagaggattaagtaagaagggcctcactggccagaactgaaaggcaggtgaaggcagagaacctgacctaggctgcttcacttcctctccttcctcatgccaggagctctccatagagaagaagaaaaccctagagatgctggaggagaatgagaaccagctgcagacgctggccaatcagagcgagcagcygcctcccagcggaggtctc

SEQ ID NO: 4540 - DNA, 602 bp, Bovine  MMBT12717
  misc_feature (1)..(2): n is any nucleotide
nntttttaaaaatcacaaaaackgggattctgtggaattagtgacwtaactraagtttggggccgatcagtgacagggccaggtctttggagcctgtattttttttcccctgcctctgtcttaaaaaagaaattcactggcttaccagtgctgagttcattacctgaatctgttagaataatattggaaataaatttcaaaaatgctgcaaaaatatttatagctctcaaatctatggagatgccacaagaataaagtgggatcatagcagagtggaaatattaatagcatgagatttaggmtctgrcaaacctgtgccaatccttactactgtgtccaaagtattcaacaacccgagactgctttctcttttttaaataaatgtatttattttggytgtgtcaggtcttcatcgtgctgcacgggcttttctctggctgctgtgagtgggggcttctctacttgctgcatgtggacagcatgtggggtcttagttccctaaccaaggatcraacccatgtcccctgaattgcaaggcagattctcaaccactggacccccagggaagttccctgctttctcgtatgtaaaatggaggtaat

SEQ ID NO: 4541 - DNA, 595 bp, Bovine  MMBT14699
cacccaggctaggcggtgaaggacccccgttgtgagcgctgggaggtgagattccaagaagccccgggtatctgaaagcaatttaacattttaaaagctctgaatggtaaaggttaacctctccattgattcaccagtcctgtcttgttgagatgctagaatttacaagcgcaacgggctgagccccagtgaaagagagggacagaattcatctgcagcaaggactggagcctcagacacaatattccatggcacacggaagtagttcagaggtaacaggacaacagattgctcttcagsaccaaggagagcaaggctacatccatatcactgaggaacagcgagcctggtttctccgagtgattggcctataaaaggaagactgctctatttattaatgtaagaatctagcatcatgagaggcttagggcaaaatcctactgtgtcccatgggaaaatgtttgcccaggaaacaaacaatcaatagttctatattatatttagctgaagttttatgcatgatgacaaacacagtccataaatgtcacttggtaatttgcacgggcaaaaatatagccaaaagtcacacatgggg

SEQ ID NO: 4542 - DNA, 600 bp, Bovine  MMBT19637
caatacactttatttgtcttttctcttattttaaaaatgaggaaaagtttaaagacaatttaaaaggtaattgtttaaattaatattttaaaatttaaagcttaaaaaataaatttaaaaaattatacctctgttcttgcctcctaaggaattctcaattttggagaaaagaaaaatgcaaaaagctcttgaatagatatttttataamaaaaawtttgtacaattttaaagtaaaaagggcccctgataagcagcccacctcattagaaggccacaggcattgtgctacctgcagccayggagtgctgcctcatggggcccacaccaggtcatccctcctcccgccactccagttatctcatcggcaagcagaatccaagaggtcatagcacatcttcccttcagtgtagaaaaccttgaaagatactgttctggaaacmaatattttgtgaaaggtctgtgttaggcactttagaaatcttttaaaaaatatttctgagcatctggactcaataccacagtggatcagagtagacaactacagtgcatcttgacagaagtaatttttgaaatcaaagtttttattacaacctgcaggt

SEQ ID NO: 4543 - DNA, 600 bp, Bovine  MMBT21064
ctaaagaaaatgtaaagacatgtggaatgtatcttacttatgtaagatataacaattttttctaattgcattagaggttggcacaaatgactttccataattgaaaacataaaatattttttccaagaaagatgtactcaatgatacaaaatccaagtataagartaacaggtagatttgctgctaagatgtaatctgtcaataatgggtctgaaaaattactgaaagtacattgcaaagacgagtacaaaatgcttgattaaaactcaaactctaggtaaactatatccaagaattackgagtctcacatttttaactgtccggatgttcactgaagtgcacatataaattttgatagtcatattctgtattttagtatttatgattattaatcccttcagtcagcctgcactctctaatccattagaattttcccaaaygtgggtttagccaatatgcagaactggttttctttaggttgagtccttttgtgtgatggtaggcacttaacacgccatggataattctgggttttgttatttttgaagcaaacttcttttgttatatacataatacatggatacacgttccttgtagaa

SEQ ID NO: 4544 - DNA, 600 bp, Bovine  MMBT20012
ctatgggctccaaagttcagttgagggccctcaggggttaggggtatctcctaactccatcctccttaatctcccctgaggcgtgccaacgttcttcccacttcactttggtgtcacagaacagaactcatttcttctgtgcagtagcccatatggtacacattggtggctcctacattcatctcttactcagtcttkcctttggctaaatgcagtatcggtttgtgttgcctattttacagaggtctcaaagggattaagttttattgtgctaccaagtagcacaggcaagatagagakccaagcttttactctttctaccacaaaaatgctaccaggcacaagatagacagcttccttgctgtgtttttggtaactttcaattcataattggatcaatctattrtgtttccccacattaattcccatgtttacaaaggaaatttacaaattagagaacattaaccttttaattatgaaattaaatacaaggaaattacagtttgaagattttaacagatactaaaatctggtttcatttaaaatacttcaagcatactttagaaaaatgtaaagatcaaagattttgtatatttactt

SEQ ID NO: 4545 - DNA, 598 bp, Bovine  MMBT07445
  misc_feature (1)..(4): n is any nucleotide
nnnnactgtgagaaaagaaatttctggtgtgttaagctgcctgatttgtgataatttgtgatgatagccccaggacactaatacacctactcaggagtgagaagggacatccccctgttgaaacagctgaggtgacatttgcagagacctctcatttcctattcgtttgatgaccagacgtgagaaactgtctctgcgtcttggcatgtgaaatgcaaatgaagcaaatcctaggtctgaggtcgcttctcagcacgtttggttctggctgggataaggttctcaggtgtctggcatgcrgtagactctacgtattcatatttgcgaatggatggattgacttatgagtgatggctgtgggaggtagaagagatcrttctacttctttgtggaagtcaggcttcttcatattttcctttgattcagtcatctgtaaaggatggtctggtttgctgaagtggtagagaatgggcttgaaatcaaacttggagtcactttctgtgtgactttgagccaataacttagcctcagtgagcctttctttccttatctgtgagtaaagatgacartgcttgcctcagagggttgctgagaggay

SEQ ID NO: 4546 - DNA, 600 bp, Bovine  MMBT13304
tattatcattcatgaaccrttggttgctgtaatctccaatctttattttgtgttagaaaacttacattgtattcgtttctataatgatgcaaaatccattgtcaatgaccatattttagtatcaccaagaatytcttttgagcgcccacaaataagtcaaayagaagatgctttgtggtttggaacatccatctccrttcactagtattttataactctcgggctcttttagttcagactggtgatacggtttactgasagcattacaaatcctgtattttaaaaacatcacccagcctytcattttcatcctcttcaagagagaatcaaattaagtgttaccatgaaggaaagaaaagagctaaggtcatagagtattaaattcaggctttagtgcagaggaaattctgaagccctaatcttgctgaaaatactctggcatcaagcaatcgtggtgactaatcccagtatccggagctgcctggcatggtaggaagatgttttagaaatgacagtctcagagaccagcaaagagcagctcttgtggtctctgagtttcactttcacttaagaaactcaattttcagttctacccactgc

SEQ ID NO: 4547 - DNA, 600 bp, Bovine  MMBT21629
catgtgggttccgggcccctcttgcttggcctgcagtggtaattgtttttttctccgcagagctttgtcattagcacgtttatgcattcttacctgcakctgtgctgcccactcacatctcatttagcatccagaatgagagagaagagagtttttctgccctagagaagtgattctttcctgccttctgcttctgagccctgcatataaccccgaggargggctcaggggtcgttataatggagctgaagggaacagtgctttctgagagtgaatcgagtggcagtgccttggtacccygtttacttgtaactctgagggcctcagagggcccagggaacccaatgaggaggaacggcgtgtcacagtggatgccctacctggggtcctcatctctcttggccctttcttttccaggtggtggaggagtcctctttcctgaccctggacatgctggagtcttgtttcccatacgtgctgcttcgaaatgcctatcgggaggtctcccgggccttccacctgaaccgagtgtcggccagtacccactgaaaggtctttggacctacctaaacccgtgctgcactggaagctgtggctatt

SEQ ID NO: 4548 - DNA, 600 bp, Bovine  MMBT00607
aactgctgatttcaagtctacaaaatcagaacaggttctaggggccycacacatgctataaccaattctccccgtcctcatcctttccctccatttttttctttctctctaccttgctagagagaaatacctacctattctcaactccttaagcccagccacaccaaagtggaacattagtcrttaacaagaaaaccttgtttctgttgatcatagagatttcatgataacagcacgttaggtgggacccgtgttagagtctgaggtccagaggatttaagggacttgcctggagtcacrcaggaccagtagacccagatcgtctaactccaggtacattgctgtttccattcccttaggcaatacctgacaaccaggccagctggatttttctgctggctacaatctaaatagctgactgggcctccagactcaccagagagtcattctggtcacctctgggagaggcttcacaatcctgagctatagaaaaaagcaaagacgaagatctagtggagtttgcctcttcggagcctttagctctctgttattgaacagcaatagaaatacccttattcattggtgaagggtgggcagggc

SEQ ID NO: 4549 - DNA, 600 bp, Bovine  MMBT00857
ttcttccaagaaacaagagtcccaggattttttctttctctcttagctacttctagatgtagccaaaaattgatgggcatgactctcctgaccttgtcatcatttgtaggactctctgaaacactgtacctttttgttcatgacatttcaggatggattgtttaatggatctgcaaaaagatacttccttccctctccggttgttacttagaggaatcttacgttgaagctatttgctggcctcaatttttaaagaaacagttaattcactggtattcagataggttataagtaaaaatktttaaatctggacaaccttccccctacctattgcctcatccatctttatacacccagagactgattttatcagtgtattgctcttgaggggaactcttgtgttaaaagccttctgtgacttcaagagagctttggacttcctcctcctactactggtaggcatcaggaaaagaggaatttttattttcctttttctttttaaactaagtaagctaactagaaaggcaaatgaccctcccttgcagattattagatggtatattctaataacaatcagaaaagtcttctgggtggttggag

SEQ ID NO: 4550 - DNA, 600 bp, Bovine  MMBT00611
tgtaaacccacatctcaagatgtaagctctgtgacagaggcgcggggatatttacggacttcccaccaccagcaaccgccatgaaagacagggtggctgtttgcaataaagggaaagaaaaggtgctctatttccgcacatctctatgcggggacaggcttatcagctgcagctgagactaggtctctcctcctcctgtatttgctctattattttcactacatcataaaatggaaaaggttacacgtttgttccttgggtgaggagaaaggacatgaagcctgagggatctggttctckttgtttctgattaagacagttctttttgtaagttttgacttgaaattaagtaaggataaacaaagcattttccaagtggacttatgaaatccagtactttctaaataaaccatatccaacagctatttaaaaagcaaaccagaatacccataggaaatatacaaatggggaaaagagggctatggtcaacaaaaatggttaaaaagctacttaacattgtttgaaaacgagcagcaacaacaaaatcccagcaacaggctgcagaggtgggaacccgggacaagttccagccacacaaga

SEQ ID NO: 4551 - DNA, 600 bp, Bovine  MMBT02444
tcatttttttctaagcatgcatgtgtgctaagtcgcttcagtcgtatccaactctttgcaaccctgtggaccatgctgtccatggaatttgcgaccaggctcctctgtccaggcaagaatactggactgggttgccatgccctcctccagggaatcttcccaacccagggatcgaacccacgttctcttacatctcctgcattggcaggcaggttgtttaccactagtgccacctgagaagcccttttctaagcattcttatcagtttttctgatgtctttgcccaacactatttcttayattaacatacttgtctttttcctggattcttacttattttgcaggagttatgtcctcaaggaattactccatatagctttagggctgataagttttcagagttcttacatattaaaaaaagtattttacccttacacttgaatgataagcaagaccagatttaaaatcatttcctrtaagatttttaacatatttctccacgatttactggtttccattgttggtggtaaggattttgatgtcattcttagtcttgattcttcttggaaaccctctggactttctttaaccttcaagctc

SEQ ID NO: 4552 - DNA, 600 bp, Bovine  MMBT00613
ggctggtgtgtaaattccctggtgggggccaagggggaggtcaggtgcgcccttgaatgcccagcttggggccgtcctggctcagacttaggagacagagttgggccaggcaggaaggggcagcggggggtttcctcagggtgggtcggcttggctcttgttgtgctggaagccagcctgaaaaggaatttcccagtcatgtcttaattccatcttccttgcagagtaagcacagcattgaaagatgggctggactcttcacttcctcagaaaacagttgttcaaggaggaagaggagaygtgaggtacctttcttttggggaggaaacaacactatctcataaggtttcagggtctgattcttctctcctaggaagagaacatacctcaacaactccagagctgattattgcccagggaggaaatcttggcttggctgggtgatcatcagctgtttatccagagttgtgtaatagaaacacaatatgagtcaatatgtgaaactgtaaatgttctagtagccacattttttttttaaagtaaagagaaacaagtgaaattaattttaataacaaattttatttaatccaacatatccaa

SEQ ID NO: 4553 - DNA, 600 bp, Bovine  MMBT03343
ttctcacttatgtgaaatcttaaaaaatccaactcatagaaaaagggatcacatctgtggttcatatgagaagcagggcatggaggtggtgcaactggatgaagatggtcagaaagtacaaagataagatttataagataggtaaatcctggggatgtgaagtgcaacatgataactggagttaacactactatatggattatttgaaagttgccaagagagtaaattctaaaaactctcatcacaagggaaaaatattttttgtatatctgtgagatgatgaatgataattaaagttaytgcagtaatcatttcacaataagtataagacaagccatcatgctgtacatcctaaacttatacagtgctatatgtcaactatattccagtaaaactgagaggaaataaaaggaattaggaggaaaatgttaacatttggacaactacttcctaaattcctttaggcattttgaacattgaaaactgttcagggtatatacaattcttgcatcagtaactaaccacaacacccagattatactttttattcaagtattcaagttggtcttaggacctctaaaattataaggtatcaaacca

SEQ ID NO: 4554 - DNA, 598 bp, Bovine  MMBT05864
  misc_feature (1)..(160): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagctgcttattgataggggaaatagggaatgtgacacgtggcagttagcagcctactactgattctattactgctatagtcagagaaaccagctgatgtgtcagacatgttaaaaagtgaaagtttgccacagtgtacrtttgctgtagctttctccccaagcttctataatgatgcttgttacacaataataaggacaaggcaggggcttaggaattcaattttctacagggtcctgtcaattcagccatacactgacctattctctaatggaaatagccggagaaatacaaatatcaagactctgagaacatcaaaaggccttgctggaaaagcccccacacagaaaaaaagtgtgggtgtgaatccttccactctggaagggtaaaagcctgagctgatgatgctggaagacacactcaaagtctttaaagaag

SEQ ID NO: 4555 - DNA, 598 bp, Bovine  MMBT12511
  misc_feature (1)..(159): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagggaaattgtattccagagaaaaggtataaaatcatgtaaaggtgattggttggtatagtctgagtatgtgaagtggggatgcagaaccagacaaataaacaggcagtcctgttttctgtgctcgtaaattaaacaygcagggtctacttcactgccctctgtaaatggtccagacggagcttccttttgaacaaaaaacaaccccaggacctcaggaatgatacaccagtagtgagcctgtcagtcttgtgggtagaatttcaccattgtgcttcctgtcagcacagggagggttggtcttctgtcccccagacattaattaaagatagccagagtcccggcagggcactcgaggtgaggctgggccacagcaagcccttccctctctgctccccattctcctgtgtctaaacatagccctgagatggtggtgc

SEQ ID NO: 4556 - DNA, 600 bp, Bovine  MMBT11500
aaattcttacacaaatacttagttgatgatatcatagtaaatattcagtaagtatttggatgagtaagtatttgctttcagttaacactgtttcctgggtagttcttttgcttaatgaggtctctaggcttctgcaaatatgctaaactatcttccrtcttactttactgtaaaatgattctgttcctcagaattggcatcttctttatctccagggcatttctcccccsacccccccaccccaggttctgtgtcatattaaaacaacaaataacatttggtctgtttcagcaggtggtrcattatggctgacatgcgaaatctggtagaaagattggagagagtggtgggccgcctggaggcagtctcccatgcctctgacacacactgtgggtatggagacagtgctgcaaaaggtaagcagtatacgtgccagtagagtgctttgagtgaaacttggtgtcctggcctgaaatttttctmtcttggtatgatctcttctttggagctaacttgctgaaacattaaatttagaaagttcatcgcctgtaagataagggaggaagtgacttctttgcagggaggcctgtggttaagtta

SEQ ID NO: 4557 - DNA, 600 bp, Bovine  MMBT11487
tatccagagccctgcacacagcccagtactctgggttgacatctgctgaatcattggaaactgacatcccaaaggagggaaggaagcggagggcacttccactttgtgttcattgtccaacagctgccaagccttgaaaccctctcaaaggtctgttttcagccacacacatctaggaagggcataaatttcttgacagcagaggggttatttaaagtctccattaaaacagctgggccttgttggaaacagagctgttgtcactgctggggcctgagaagggcagggatgcacaggcargattaattctagacctttcagagacgcctgctttatagctgtgtttagggcataaagwtgccaactggcctcagtggcatgaaaggacagcctggcgctcacagaagcaggagccttgctgaatgatacttctgtcttggggatatgggcagacctgtccactttttcttttaatctccctcttagaagtttgccaagagctgggttgtgaactgcagggagatgctgtttcagcaagagcaaaaatagacatcaccagcaatcacagattcatcagcgcagcctcatggacacccactg

SEQ ID NO: 4558 - DNA, 600 bp, Bovine  MMBT16091
ggtattttatagtatcagataaatctcccctctagggtgaagagcagcattttacagtggaaagggtgtaaacgttgaaatcctggttctggtacttataagctctgtgaccttggccagtcacttaaccgatacgtgtgattttcctaagtcctcatgtatcttgtactgtttctgtaaaggttaaaagaattaatatatagaaagcatgctgcttgatgcatagtgggtatgtaattgtagtttctttttattaataagagtcttgtaaaatgtgatttataatgtaaaatatgcatraaagttaccattttaaccattttatgcgtacagttcagtggtgttaagtacagtcacactgctgtgttaccattaccactgtccatctccagaacttctcaaacttatatttcatacccattaaacagtaattcacattctcccctccccagctcctggcagctaccattctgttttctgtctctgttaagtttgactgttctaggtacttcatgtaagtagactcctacaagatctatacttttgcgattggcttatttcacttagtataatgtctttaaagtttatccatattgtagt

SEQ ID NO: 4559 - DNA, 600 bp, Bovine  MMBT15397
gtaaatgatgttacaccgaatattatgaaataatttggagaaaaagctaaaatctaataacaatttttttttctcagaaacatgatagcaaaggagaaacaaaccttggtcggcgtttaaaaagtttgtagagtatatccacctgatgactgggaatttcagaaaattcctttttaaagctgcgatccagaacctaaagaaaaacatatcattcccaggattgcaactttgttcagaaggcttttatctgtgaaaatactctttaaaatattaattgtatcactttgatttttaaaaatycatgaatatttggtttataacatagacttgttaaagggtgaccactcactgtgcaaggatttcacaaagatttaccttaaagaagaagcacctcagtaaactaaaaatattatttcatataagaagtcttagaaaccacttagaactgaagtgaagtgaaagtgaagtgttagtcactcagtagtgtccaactctttgcagccctatagactgtagccttccaggctcctctgtccttgggattctccaggcaagaataccggtgtgggttgccattcccttctctaggaaatcttcttg

SEQ ID NO: 4560 - DNA, 600 bp, Bovine  MMBT17508
ttaagatggcaaagttgattgaaaaccacagaggtgagaaagctatgcaaccaggaaggcgacacggctggagctgcatgtcctctcaagcggctgccctctggctccctcctatctcggttcaccatgcggcaggtagtatgtgggtgcccggccccgggagcccctctccatggtctgtggctgtttactgtcagagactaatctgtctcaagtaagccttaggctcagatgagaagcagagcaaaatgccaacacttcctctgggactcagggtaccataatgtgggggatggggcrcagggacactgaagtgacaagagctggagccctggacacgtgtgctcccaggggaaatgtctccaaagccagccctgcctggcaaagccttagttctcccgggtccctggattcagctcccaaactggcacagatttccagcatttaccagacagacagcaccgtggcttcgggggtcaattttgagagcgtcaggttaacaaataacccctcaggaagcaatgtctagttctgatggagaccctggaggcaggaagtggacatttcagtccagggctgatgccatcatttgaagttgca

SEQ ID NO: 4561 - DNA, 600 bp, Bovine  MMBT23243
ctcagattccaggagattctggacatctagaggcaccaaggcagggtcagataaggccaaagttccctaaacatcatctgtggtcttctggtgggggttaagggaggggggaatcttttcaggggtctgtgtggtcaaaagtattttcataacaatgctaaaagtttttctgattgtgctgttatgtgaactgacagtgcaaaagcaatgttggataaaactgctggtgcttttgcaaaaaatcaggcctgtggcaccaaactgtacggacagtcactgtatttcaccaccatatacccrcaataaaaaaccaataaatttaaaagccagtttcatttaagaatgtccttaataaagcagtaaaataattttataaaatccttgagtaaatctttttaatagttacagaatgagacgtgcttaaagcacttacgctgcacactaagtatgatggttgtctcaagaaaaagcacttgtgcgacggtttaagttttaaactgaaccaatcacttttttcataggacaccatttttactattgcaaactatggtttttcagacttgggtatttagcatacattttcttgaaaatgagtgaacc

SEQ ID NO: 4562 - DNA, 600 bp, Bovine  MMBT02533
caaaaacttggacatctggtgaggaaatctaaagtacttgggaaggcgagaatcaagcagcttagacaatggggatcaccacagaggttccataaggagaggggcagggcatgttcaaatytgatggacctgcagccataatcagaggatgggatggagaggaagctggataaggacgtatcttaaaatataaggtggtccttctcaggctgagcrcagggactcctaactcaggtgtctaaaaaatgtatgaggagatgccaaagacagggcccattagaaaggattccccaggagggmgccragagttctcactcacttggaactttaggtgttcctagtggggcaaagcctttgactgagtggatcccaataaactatggaaaattctgaaagagatgggaataccacaccacctgacctgcctcttgagaaacctatatgtaggtcaggaagcaacaattagaactggacatggaacaacagactggttccaaataggaaaaggagtatgtcaaggctgtatattgtcactctgcttatttaacttctatgcagagtacagtatgagaaatgctgggctggaagragcacaagctg

SEQ ID NO: 4563 - DNA, 600 bp, Bovine  MMBT10596
ccccactagtttcctgtcttgaaccactggaggcaaagtttagccagctgggagctggatggttgaaccacagacaaaggcaacaacacttcatttttaaaatgagagaaaaaagagatagcacccctccccaaatatagagctatatatgtatattttatatatatagaattcattcgtgcacaattcattaaatgagcttttcaaaaattaaaaaaaaattataagatacatttctttaggcttttgcgtttttaaattaaaaccaacaagaagtctccatctctactccacccaatwgcaaggggaggccccagaacccttggttccttgtactgtggcctcttgcaaggggtccctcaattagaccaccagcccctctttgcctaactgaagctctgcatacaacaggcactcacccactgctggagtggggtgctgactccttcaaggcgggatggggtgaccccacaggcctgggagatgggtacctcggtctccacccagcctgtccccatcttggtgtcttggcaactatcagtaagacagggccaggatggggacaccctccctctctcctggagtggtagcccctaattc

SEQ ID NO: 4564 - DNA, 598 bp, Bovine  MMBT09664
  misc_feature (1)..(12): n is any nucleotide
nnnnnnnnnnnnatctctgcttaatgagccctagcaataaatttggcctgatcaattttatgttccttccattatcatctcacactcttattatccattcctacatggtccccagatttttatctgtatagattagggaatcttaaattatatattgttgtaaattatatgtgaatatgaatactagaaagagatttattataaggtgctggcccatgtgattatggaggctgagaagtcccataatctcccatctgtaagctggagaccaaagagagctgatggtgcatcaaaggccakagagctggagagctgatggcataggttctagtctgagtttgaaggcttagggactaggagtgcttgaggacaatttaaatagtcaggcaaagtgcarcctcttcacacctttttgttttagtcagccctcagtgggttggataaggctacccacattggggaaggccttctgctttactcagcccactcattcaaatgctagtctcttctggaaacatcttcacagaccacccagaaataaggttcaaccagctacctgggcatccagtgcctagtcaatttgatataaaacattaat

SEQ ID NO: 4565 - DNA, 600 bp, Bovine  MMBT09786
tgtagtactaagtccattatcaggaatattcaggaaacacattcttggggaattcaggatgtgtcaggggcctggatatcttgacatcacttcacaaagcaaccaccagagtcccaaaagcaggagagtccgtgcttaggggacaggtaactggaaagtagaaaaaaatttcccaccctgacccagctgggttggttttgaatagaagcagtttagaggataatacctcttactgctggattcagaaatactttggaaagacatcaatattaaacatatttagatttgctttattaatcrtgtataatttctactactaagatattttatagtgaaaagaatgttaaaatatttccttggctagcaaaagttacaggcaagattttagatgtgttttgttttgctttgttcagccttccccagagagaaagggtgttaaatatagactcatccacatgatccctctgaggcgtgtgggtctgctttctgtgtcagctgtggcacaaatgtgcatgatttacccatacaactattgaaccagcattggcctattaagacttcatgatctgttcatgagctgtcaacccaaattgagcttga

SEQ ID NO: 4566 - DNA, 600 bp, Bovine  MMBT09356
tattttaaatccactaaataataactagactatgaaagggtctacttaatttttgaaatacagttcttttaagaattgtaagatctgcagatacaaaaattctacgccatttctaaaacataatctatatcaccaaaaaaatggctgaagaatgtacatttcagattgtaaagatgactcaacttctgatttaaccataaatctaaatcaccatttaactgaaaattactgaatgtctcacagctgatataaatcacatgtatcaactgttttaacattaacacaaaactgctttgatayaaggaaatgcacttgacgggcttttcctcatcccttttttgagattaagtctacaatttatgtcacattgacaacctttactgatattttcctattcaaatgttggtagctattagacttcatatgttgggtaaaaacatttacttacttgctatacaaaatacagactatcacaaagatttatcctcaaggacaaaattccatggtctcagtcttcaaaatggcataccttttggggggggggggggggaagaaaacaatattctaaacaattcattgatggaaccaccaaaagccaag

SEQ ID NO: 4567 - DNA, 600 bp, Bovine  MMBT11246
aaaggtgttcagagtgggaactcatctccttaatgaagaaatggcaagtaccaagaagacacggagaattgaagtcaatagaggaggcctgggactgaggtctcggagagagagctggtagagtttagagtgctctagaggtcctgcatcttgaaggcagaaccaacaccatctgctcttgaacactggggccgtgatgaaagagctggctctgagagctttcctgatactactggcaccaaggaaaagcaaggcacgtgagctgaccagggaaacacacagacacagacatgctagttytgcaaccytgcagctgtcaagctccatctgccagcatgaggaaaaactaaaccaattcactcacacaaaactcatgtcctaaggagtttcagtaatgactttaaaagacttcctgccagcctataattctactstagtyccttctccatgcacaactccaacaaagatcttgaccaggaagaactcacttcatttaaaggggagttacagtaaamagataaaataaacaaacagcatsagatctatataaatatattacagaaaaactggaaatggaggcagggaacaagaaaaacaaaa

SEQ ID NO: 4568 - DNA, 600 bp, Bovine  MMBT08770
gacttaaggactaacactttcgctttcacagaggctcacagtgaagacaggataaaggaagtcaagtgattactattagtcagcaaacttttgaaaagtgtccatagcaacaaaaataggcataaacaacatcttgaaattttcttaaaagacaatagtcaggaaagaaatcaatagccaacaaagggtcactggagctaattagaagcaagggataaaatgatggacatatttcatcagaaatcttcaacctgaaataaatgggttgtgttttggatgattgcttctgagtcatttgcyttagagctgagaaatacatttttccatagaaataacatgctagtcgataactcagtttttgaatagccaamagagtgttggttcctgggaatgtggagtaataaagaatagtccatttcagttatcacatctacattttcctatagggtagtgcattctgtgttcataaatcaagcttccaggaatacatgagacactcatacagtagcagagtcactggttgaaacatatgggagaaggcagagaagtttagctgttgagcagacccagaaaatagaacttactggaatcaggtaataa

SEQ ID NO: 4569 - DNA, 600 bp, Bovine  MMBT10430
gttgggaggcagctccaggtcccacctgcagctcacatgccatccagaccccaaggggcacatgtgatcccttgacctaaagatgcagacttgggggcactgcaggaccaggctggggctagtcccagcttgtaatcatctctcctgattgaccacactagaggaggaaacaccccacccttctgtgcctagaccctcactttgacaacctggggcctgagtctcaccgtccttgagagccccccaagtgattcattaagattacggggcccagtctggccatgatgctaaagggtcacrgagcccccctcacttacctttggctgcctcgttacaccctgccggtcccagctctgtgggaagtcgggttacggcgggttgcaccgttgcccctgccccctcgaaatccaccccggaaactacggcctcggaggaacctccctgacactccgaaggtctccgtgttgagcttcctctcctcagcccacgtcgtccgcctggaactgaaccacaaacaaagaacgtgaaactgactgcagcaggcagctcctcacacagcctggggaggaagraggacagatggtgactcatcactggagc

SEQ ID NO: 4570 - DNA, 600 bp, Bovine  MMBT13472
aaaatgctcctgaccatatcctgaacacacgagagagagagagaaaaaaaaagctagctctcttaggaagcatgttcaattttttgtgggactggctggtggggaaaaatggtttttaagactaaaggttgggagaagaacacacagtatgtgggagggtgcattgcaaggagtgtatgaaattacagcacaaaggatcaaagagaaaaattgcctttagagtgacaggctctccttcaaggagaagaaaaaccaaataatttatgcctgyggaggtaccgtagggctcatatattagcyggcagaattcctcaggattgctataactgaggcttttgcagggaggacctattaatcctttgcatgctttgccattaatattgtttattgggccacaagaaggggacataaacctttaatgtcactttttcgcactaaggattttttccttaaaaattcaatgttgtctgccaatttgatacggcactttaaggtgattagagaagcagatggctgattcttaatgactattttttttttttttgcatcaaccattgattcgttatttaatgcacacggcacagaatagcaacattcctt

SEQ ID NO: 4571 - DNA, 600 bp, Bovine  MMBT15601
tgatttcttggctgtgagaaacatgtgggatcttaactccccagccagggggcaaaccctcaccctgtgcattggaaggcaaagccttaaccactggaccttcaaggaagtccctaggcacaccattgtcttaaaggactttccttggttacttctcyctgggtgatcataaacttatttcccagtaattcctgttcatttgctgaagactttagcatttgttctttttactctctatccctgctcttaacatcattcttgataataggaataaatatggtaaatccaccaaacaattamayctaacactttaataatgcttacaatatgatgggcacagttaagaagtctgttaataaagtcatttaatcattgcagtaatttatatagtagaaactatcattatctccattgataactccaatgataactatcattatctccayggatatggaaattgaaacacaagatgtcaagttactcacttggatcctttaataagaaggagagatagggtttgaatccataagttctgtcaccagagtctgtgaacttaacaatcaacatctaggtgaggatcacagcttttgcgatttaaaa

SEQ ID NO: 4572 - DNA, 435 bp, Bovine  MMBT07290
ggycccctgcactggagggcaaagtcccgaccactagaccaccagggatgtcccagggcaaggctgcgcgctccttgccctcccaccccatccctgcctctcctcgctccactgtcaagtccgatgaccactcagggtgtagagtattagcccagggtctctgagggggatgctcttagcgaccccacgcttgtttctgggcagggatcctgggccacccacaacttgactcccccgctcccaagcacaccccggacgctgcccgatgaagtgacacgagacgagacgagtggaggggcygtctgggtttaccctggtagaagacgtccacgcagggctggtcggcgctgatgaccttcaggatcttggggtacgagggggaggatcctggacgatgttcctgtgatactcgagcagcttccgcgccgtctcccc

SEQ ID NO: 4573 - DNA, 600 bp, Bovine  MMBT15023
aaagcagcccctctaacaggcacctttactaaaagggatgctgtgtgcctgcggtactagggtggacttctgggtcctctggggtgaggacagaagaaatgcaaatactcctccctgggggcctgagtttgctggtgacatgtagcagaatacacagcaaattctttacaggcagagcgcaagcctccctcccgaccctctccactcaagctgggacttctccttcctgtgctctgtggcaagcctgccctggtcacggcatctggcaacttgtccccgagtccctggctttctctgcaygttgccatggaaatgggttcctggctctccagaaagacatattccagtgacattcactggcacttccgagggccccaaaatgggcacacacacatgcacggtgacctggtgcagtggctctagctgcccggcgaccccaccaacatgagaaggagagagtcacatggcagggacttaagactcacgtgggcggctcgtgtggctcatgttcaaagaagaggggaaatcagctggcttcacaaatgcgataatctttgcgggaatctctcgctctctcccccttgcattcagtctagaggc

SEQ ID NO: 4574 - DNA, 600 bp, Bovine  MMBT18474
atcacatggacagaggagggtggagggctgcagtccatggggtggcagactggagaaaagccctcgcagtggcaaagacccaggacagccaataaataaataaatattttttaaaaagacagtaacacaaacatgactatggggtttgaaagaaagaggagcctgaaggtacctcaattatgtatcgcatcccatccacagtgtgctcagagccgctgatctccgaggatgctccgccccagtggaagtgcatctgcttggctaagtactgcgtgccgtcggaggttgtcatgcgcatgstggatggcaggctgatctgtactagaagagaagaygaggggcagggagtgtgcggacgggcggggacagggcaggcccgcaggtgaggcagcgaccctgctcacctgcccactcctggagcaagctggtgctatagacagacctggattgccatgggcagggtgaccgcagaggaggcactggcacacagggccagttggggaccaggccctgagctgggctggacaggcacttgtcccagggcacacaccttccyactcaggaccagcaggtcaggggcaggacaccaaagggcaggtc

SEQ ID NO: 4575 - DNA, 600 bp, Bovine  MMBT20436
attcaaaatcacggaaacaaaaacaaaaaacacacaaaatgactagttctctccttattttccttcgaagtgaccctttcaataatttcaacattcctgaatctagggacaagctccttttctgggtaaatgttaaaaatctatgtacagacattcacttaaatcttctgaaggataacagattgaactgttttctagggtttttgctatgtgtgacctctagattgagctttttgcatgataacagagaggtatatactaatcatacatgcttatacacacatacacataaaataaaastaaattctcaaaagtcatacctgtgggttttccagtattcgtttaacaccatcaacaaggtgagagagaaacttggccctctctgcattgttgaatagggatcttctaactgaggcaatctgtactaagcaggataacacctagagcagggcacaaccaaaacacaaatgagcagaaaagatggtatagctcttttcattactctttcccttgctataaatattcttctctgttttgtcaccctctgctatcattataatgatataaaaaaaaagatcaaggaaggtgtagttgaggata

SEQ ID NO: 4576 - DNA, 602 bp, Bovine  MMBT19039
  misc_feature (1)..(2): n is any nucleotide
nnactgaaattatttcatgctaatatgagtgaggagggttgtagagagatactattccttgaaatctaaagggacaagctaataaaacactttcatctacctttaattgagactgcttgtctgctgacaaaacctgttaaagtasagatttaatgaagatttagctcctaagtctgtctttcccccacacctaaacaatttctaagacatcaaaagtgtcctgtcatgtggcgtatgctcgggtaaattctttttattacattcaacagaaaaatagactattttaataaactccaggcaaytggaatcatacacctgccttgttgacttcttttctgttagaagaaattgccaagtttataaatgagagcctagcgtgcagcactctctgtaaacactatgtgcctctgrgattcaggtgagagctagttttggaaacagttccaattgcaacactcctttatacatataaactggatttgtctttgtacatctggaaaatacaggcaaataatctactttgtaggctcaagctgaataagcttgtttcctttaccctttcttcttggcacattgtttttgtttttggaaacttacaagta

SEQ ID NO: 4577 - DNA, 600 bp, Bovine  MMBT19450
ctttgaatcgagtgttcccttgctatctctaattttcttgaagagatctctagtcttttaattctattgttttcctctatttctttgcactgttcacttaagaaggctttattatctctccttgctattccctggaagtctgcattcagttgggtatatcattccctttctcctttgcctttcacttctcttcttttctcagctatttgtaagacctccttaggcaaccactttgccttcttgcattcctttttcttcaacagtgtagcacagcaaaacatggtgtgactacaatggaaytgagtataccagtggtctatattgcacatgctatttatttgtgttttcacttatttatttacttattcaggttctgaagggcttccctggtagttcagatggtaaagaatccacttgcaatgcaagagacctgaactcgatccctggcttgggaagatcccatggaggagggcatggcaacccactccagtattcttgcttggagaatccccatggaccagaggagcctggcgggctaaagtccatggagttgcaaagagttggacacgacagagtaactaagcacagcacacataggtt

SEQ ID NO: 4578 - DNA, 593 bp, Bovine  MMBT12359
gagtgaagttaaccaccaggaactcaaaaatatttattgaaagaattatgtgagataaattgttcattatcatacagttggcatgactgttaattaattacaattgaggctgatagagtaaatttattcccttgaagaaaacagataattgtcatttaaggtccccagagggttagacagcaacacagaaaggaagaaataataaagattattggacaaagattaaaggaaaaaactctcttcttgaaacaaacccacaagataatagcactttattggatgcttactattgttcatatrtttgggttgcacatttttgccaaacagtttacataaatcagctcattttctcttctaatccctacagtatatctctatgagaaagatactcctatggtctccattttctagataaggaaatcagggcttaagactgattaagaaaattacacaaaggcaggtcagagtccttaatccagattttactaatactgtaaaattccatactcctagccatgaagtgatatcaactccaacaagtcaaagaccaatctgatgtgtatttaaacataggaaatatgttagaatataat

SEQ ID NO: 4579 - DNA, 598 bp, Bovine  MMBT20733
  misc_feature (1)..(136): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatcatgtatacattaaaaattttagtacttaaatcctatctttggctacatcttcaaaatccttactttggctacattttcctttttaaataaataatgaattctacaccattttattcaaatttagattatattaagaaatttttaaactcctgctcccrgtatactcttgtcttattattcaatatataaaaatctatcactttcaacactgaaagtgttgagtttccaacactggaaactcagattccatatcagccctttagggctatcattaaaccagcaaaacactcattaatctctacctggattaagaccagcatctatagaattcttgataaaatgaccccctcttatcagttctctgatacaacttrataccatatagattgccccaaatgtctcagataaataaagaagacatagtatctttctacagaaattaacatccaattgcty

SEQ ID NO: 4580 - DNA, 600 bp, Bovine  MMBT20125
aactttatccaagtagtggtattgtggaggaagtctcctggggacagagaattggcaggaagtttccagagaccaggttaaggaggaactgccgtttggaggtcaggagaaagtcgttcccttctctcctgcacggcatcttccccgcacgcccctccccggcactgcactgcggtccctaccacacgtcatcagagctctctgctcagctcctgctctctgttctgtctgtttgtgcttcacaaaggaaggatcgggcctctgaagtccgggcaggacttgtccactcaggtttagctygtccgcacctagcacgtgagcaatgctcagttcagtcggatttgtatctttcagttctttgctctttttttccccccaatcctcaagtatttagttttaaacttcatttatgttggaargaattctccaaacaacagaaactgcacattagtttctgtgcgtgctgagagcaggaacacagtggctgcgttctccttgtgagtttctgcagctacaatagaggagcaacatacaccaggctaaggagatgacagagccatggaaaagtgttacagagagttcttaaaaggagcttggagt

SEQ ID NO: 4581 - DNA, 600 bp, Bovine  MMBT02110; identical to SEQ ID NO: 4502

SEQ ID NO: 4582 - DNA, 600 bp, Bovine  MMBT01614
agtggggctaagaagtgtgtgcaaaattcagtagctccagagacagtaggtcataccatagagtgtctcccatagcatcttcagagacatgatagtatctttcctgttgagacagtgctatcacagggaggaatccaccaagcaaacttgatgaaaggagtggaaaattgacaggaatttctttataaagagtacatgctattctttgacatggaaggcgacaatagtgagaaagcatgtaagtctcattagactccgtgcccaacagggtaattaatcccgctactgccccactcaacktcctgtgttcctggccctttgcatatatcctgggttgctgaatcagctctccactttccagattccagaggagtggtacctaaatgtaaacacaacatatcaaagacaattatccatcctttgttttaggaataggcattaaattttagagttgtctcattttaaaaggatgaataaagatggataaaaaataatatcaaactcaagaaaatctgctgttatgtcagaaacaagacataacaataaaaggcagaaaggcatttttttcccaacagattcactgtagggaaaaggaataaa

SEQ ID NO: 4583 - DNA, 589 bp, Bovine  MMBT01175
ttctggagctcagacgggactgtgtctctgcccccatggctttgcccacttcctgcggcttcctggcccatttcagccttcaggtagatgagatgctcttgaatgtgcgggcagatctgccttcgaatgtactggaatgctgcctactccctgctgctttccatgtgccctgctccatgatttggccacagagttctgagcaaaccccattcccctctggcaccctcactggtcacggggggcaggtggagggctgtcgtgtggagcaatcaacaagagggactccttcaccctcatctktaagccccttctggactccaaaggaaggtagaatggctcctcaagcctgccccgggggtatggaaaaccctacctgtggatggactgaatcaagaatctcaatttctacagcttctgtgccaaaccatcgggcgtcctttggttcccttgtttctacaacatgttccttcaattttgtagaacataattcattatatatccattaggtatacagatcctcatttatacatatggcgaacatatgcatgtatgtgtgtatatatatatagcatgcacacatacatatata

SEQ ID NO: 4584 - DNA, 600 bp, Bovine  MMBT00897
tatgaactatgtgtgcgtgtgtgctcagtcttgtccaactctttgccaccccatgactgtagcccgccaggctcctctgtccatggaattctccaggcaagaatactggagtaggttgtcattctcttccccaggggatcttcccaacccagacattgaacccaggtctacattgcatgcagattctttaccatctgaaccaccagggaagccccatataaaaacttaagcacagttatttggtaggtgaaatgcatacggccccatcaatctcatcatatcaacgaattaaccaaaatytttatcaattttcagtaaaatatataaaattagttgtgacctcatgtattccactgacgaccacatgacagatgccctttgtcttccatttgctgtgatttctgttagcccagcatatgcaggtcatattttgacattgtcccactcctccaccaagtcctaccacagcttcactcccttcttacccagcactccatgctgcagatgccatgaggttctctcaagagttcagtgtcacacgccatggtcccagcttcatccttccactccttacccatcccatttccaagatccagtaag

SEQ ID NO: 4585 - DNA, 600 bp, Bovine  MMBT07383
aaggggccactgcttaccaaatccagaaacaagcccaagaatatgttaattaactgcattgtgtcccagaaagaaagaggttgacaaattcatttttttattccttcaatcaagaaaatgtttgcctagtacatcttagatttttttaatctataatgtgtatatttaccacttgaaattgtacagtaacagtgccaaagaccaccatggccccatagggtgaatcttatgaagcttaacattcctggcgaattaaacacaagcctccgatcactttttgtcagtctttactgtgacacktaagagccaaactgtaggtaatttttatatggtggcaatttatcctaattaaaaaagcaatgatcttggatgcaagcacaagtgaaaaatataatgacagaaaactaaagaaaggtattacaaagactaatctggaaagctacttgtccctctccatccccacccccattcatgcccctttttccacccatttgttgtttttctcacaagtatatcatgacttgtaacatttttttaatttaaataacccccccaaatgcctgaaacactaaaagatgtaaaaagattcaccatctacaa

SEQ ID NO: 4586 - DNA, 590 bp, Bovine  MMBT05769
catgttccctgtctcactgtatctgtggataagcttttaacttttaagagaaatgtctggtgagtgaacgtctgtggagtgcccactgtgagcagagcttctggctaccatcaaatgttgttttcacaatttattttaggtcagcccagatttgtcagggcttgagagcaatctgaagagcaaggctgaccttagcaagaactcactaaaacactggtgattgctttctaaaaggaagggcatctggaggaggcctgagcctggcacttgaaagaatgaaacgcacgtccactgctgagytgatttaaattgggtgggatgagagcaatcaggaacacagggggaaaagctgcataggcggatgggggtggaaaagattatctaayaggtgttcctggctttgagtattcaggcacttcgggcacgttgtccttaggcttctgtagtttatgcatcagtgctgtttctcagaataaatacattagtaatttcacttatgaagctcattctctgcctaaagacccacaacagtactacatcctgtgaggactattttatttccctctttgtcagaattttttttcttatca

SEQ ID NO: 4587 - DNA, 602 bp, Bovine  MMBT06310
  misc_feature (1)..(2): n is any nucleotide
nncagtgtccttaaccccaagttcaatgtctgagtatttccaatatttattttgagcacataataaagcagaggcaactacttttcctgaacattttatttccattcagagcttagcaattactttagcttcacattattctgtcataaatgataaccaaatggcctaaggggctaaaatcataaaattattataagccaagtcaatgtcatatatatatatatataaagttaatataaaatgacaactatactggtacatatttgttttggatcctactagaaatatgccaaaataacacrttttagtaaagactgaggtccttgggtagaggagggggaagaagagtcatatcatcaaaaattattaggaaaactgtaggtaaaaaaaaaaccaaaacagcctacaatttaaacaaaataaaggagggaagaagagtacaacactggggtgatgacagttcaggaacacactccccatccatcacagactcgctctccacctcaggagcacagcaccaggctctctaggcactactgctctctcacgaagttctttatgtggaacagaaacctacatttatggtcacaacagaattttat

SEQ ID NO: 4588 - DNA, 600 bp, Bovine  MMBT02381
aaatatctctctgtgtatatatggctgagggttaacatatagggcttttatatcattttgcaacttttttttttttttccatgcaatgacatgtcttgaaaatcttccagatagtatttctcatggtggatattccatagctgttttagcaattcttctattgtttcttttttaaattttttaccattataaacagtgctgcagtgaacattcatgaacaagcatgcacataggcaattatttctctagggtagatacaaaggattggaattgctaagctgagtaataggtacatttttwaattttaaaatgtagatttcatgcataaagcttgcccttgttaattttggcctagtgttcaaatctactgagataaatttatttattgattttggtcatctcttacagtattaacctcactataccagttttgtgtcatctgtccataccatcaggcatatctttcatcttgtcatcttagaaactattttctttttaagtcaaaatgcagcagtcaagggaagagctttgtggctaccaccagagacctgtatcctacccaaagctcactgtattgtcctaataaacactcttagggtt

SEQ ID NO: 4589 - DNA, 600 bp, Bovine  MMBT14010
agggcggtgggcctttggaggcgcgggatgagcgtgctgccgggcggccctgggcgcatgcggggggctcaggacgcagcctcgtcttcttggacaccgggcagctctgggcttttgcctccttcgccaaacccgtctttcctgttcaggggacaccaggggcagagggacctcagaggtcagaacatgcatgcaggaggacacgctcatayacactcataggcatttttatccacatctctcaaatcccccaagctcagctcagtctcgccaccctgcactgtggtcccttgctggttmcccacccatagtctcagcccacmaccctccatggctccctattgcttggaaaggaagtctagacttcccaccctgacttctggagccttgccagatctgaccagacatggcctggctcaggccccatggtccagggtaggagggctttggttttgctttttctttgttcacaggacagattctacccatcagtcttgggattctgtcccatattcagtagattcccattatcatcctgatatcacccccccccccacaaccccgtgccagggcctttaaaaaaaaagattaataaatggg

SEQ ID NO: 4590 - DNA, 600 bp, Bovine  MMBT12112
tcattcacctcataacaactgactcaaatatgtttctttttatggctgagtaatacttcatttcatatatgtatcacagcttctttattcattcatctgttgatggacatctaggctgcttccatgtcctagctattgtaaaaagtgctgcaatgaacattggggtacatgggtcttttatagttatggttttctcaagatttcttatatgtcaagtagtgggacattgggtcatatagtagttttatttctatttttttaaggaatctccatactgtcctccgtagtggctgtatcaayttgcattccaccaacggtataagaggattcccttggaaagcagctatgctcaccaccataccatcaacatgttaactgacctttgtagatgaatttggaatggtcctaggatgagtgtcaaagcaaactytaaattaacctgaayattttattttacaggtataaagaaaatagaagacagcacatataaattttaaataataagtataaatcataaatmatgaataaacatcattttggttattatctttttatttttctgtattttaaaagtttatctttgtaagaaaaaaacattca

SEQ ID NO: 4591 - DNA, 600 bp, Bovine  MMBT13806
aagggaagagaactttgggttcatttttgcatacctctcacctcctaatgtagctttcatattgttggcctgaaaaacaacagaaaaagccctggttgctaaacctgggaatgaggcgagggtcaggagcatcagcgagaattccatccagtctgagcgtgtttccctttcatagcaagattgcaattcctgtctgtcagagaaggggcagaggtaaccgtgcagatctgcacagagggagaattcttcccagggagcagctgcagccgcctggttccacaaagcacacgctgaagagargcaaccttccaaggaaatagagttgaagtcaatccagacttaatggcgggggaacattgagtcagttcagacagactgaggagttatagcagtcagctaaaacatctggtctgagtaagcagatgtggtagcagtagaacccagaagggaaactcaaaccraaaaggatgagaarccaaagtcctgagatcacccaagtgaggtatgagatgagaggagaaatcacaaggacattttcctaagtcctgccraggttgtgtagttgcagggagacccctagtcttaaccactcagaagtgt

SEQ ID NO: 4592 - DNA, 600 bp, Bovine  MMBT16294
tttttttttttgtcttaagctacattattaaccaaaacactcctcttcctraaagagcaaaaaatatgcctttgcacctttcactaatgagccccgctgtttgatacggagttgatgatayacctcaaacratggtggccgaagcttctgtagtttctggcaagaggctcactttaaaacaagcgatataagacttaagatttgcctgtattccaacatacagtcattggacttttggggggcaggagarcaaactcgaaaacggatgaattgagatcaagacatwtcaaactttctttrggagtyttcattatgattatttattaaaaacccgaggagctcatgaagtatagatgttgctggtagcttgcgcgttctgtcttactggaacgatgtttctggaaagaggggttgctctctttggctcctggttaaatagcctgttttgggggttgtggggtgcacacacagaggtgcctgcagagcatttggcgggggaagaagcaaggggaccagtcttctgtactgggaagcagagcagtgcagccgtgggttgaagtattttgtgtttgttcttttactgtcattgtattaatacga

SEQ ID NO: 4593 - DNA, 600 bp, Bovine  MMBT18935
tttttgtcttaagctacattattaaccaaaacactcctcttcctraaagagcaaaaaatatgcctttgcacctttcactaatgagccccgctgtttgatacggagttgatgatayacctcaaacratggtggccgaagcttctgtagtttctggcaagaggctcactttaaaacaagcgatataagacttaagatttgcctgtattccaacatacagtcattggacttttggggggcaggagarcaaactcgaaaacggatgaattgagatcaagacatwtcaaactttctttrggagtyttcattatgattatttattaaaaacccgaggagctcatgaagtatagatgttgctggtagcttgcgcgttctgtcttactggaacgatgtttctggaaagaggggttgctctctttggctcctggttaaatagcctgttttgggggttgtggggtgcacacacagaggtgcctgcagagcatttggcgggggaagaagcaaggggaccagtcttctgtactgggaagcagagcagtgcagccgtgggttgaagtattttgtgtttgttcttttactgtcattgtattaatacgactgaaa

SEQ ID NO: 4594 - DNA, 600 bp, Bovine  MMBT23029
tcctgtgtggcagctgctgtgtatggaatgttgagtctctttgtgacagttgcatggggtttytgtgttcagtgttaaggaacaatgcgtactggttgcttgagtttggtagtatcacggtcaggacagagtgaggtgtcacagaggtgcctgagggagattggacgcagcaagggcttcacaggatggaaaccctcaaggggtctctstgtttcgaaagtcatttctaaactttgattatatttttttctacgtcagagatgataatctccaaagaactgattcaaggtaacccacttkgtgggaggctgaagcttaaatcagaaaacccsttctttaatacagagtgagaagtggaatctctgcttagtgtgacatgaaaaatccagtctctgtgagtttgctattagagtaagagggattcgttaggtgagactaatgggtagttgctccatggcatacgggatcttcctggaccaggaattgaacccrtgtcycctgcatttcaggcagattctttaccactgagccaccgaggaagccctgtgcttgctcttytgtttgtttttcttggtgctgagagtcacagggatagatctg

SEQ ID NO: 4595 - DNA, 600 bp, Bovine  MMBT20482
  misc_feature (1)..(12): n is any nucleotide
nnnnnnnnnnnncgattgctttttgttcaaggttagtcttctgtttcctctgggtgctgtttgttccaatgcaaaagtggagggcagaaaataaccaagtctgtttttatctgtaagtgtattattccctggaaatataattattttgttcatttaaaattgcttttgatcaaacaggttggtataaaccagatttttttggttgcctgcagatggcagtgattattaacttgtcattctaaataaaaggtgttggttttacttagcagttctaaagtgctatattaatggcagtttattgkgttctaataaaaattagtaagatttacatgctgcctttgaagaagagagttgatttatatatttaacgtgatgtcatttaaaatattaggtgactagacaygaaacacaaagacattaaattaacatacttcactggattatgcaaaacattgaacagtgacaaaagcgtttcagagcaggatttgattattgtggccaaatccagtaatgtatcctggaaaatttgattccaaagatatgcaaaacatgataaactttgcactctgttttatctccagaacaagatatagcagtaay

SEQ ID NO: 4596 - DNA, 598 bp, Bovine  MMBT07445; identical to SEQ ID NO: 4545
  misc_feature (1)..(4): n is any nucleotide

SEQ ID NO: 4597 - DNA, 600 bp, Bovine  MMBT13304; identical to SEQ ID NO: 4546

SEQ ID NO: 4598 - DNA, 600 bp, Bovine  MMBT21629; identical to SEQ ID NO: 4547

SEQ ID NO: 4599 - DNA, 600 bp, Bovine  MMBT06445
tcccaggattctgattcatgcaacaataagcatttattttcatgttcatagggcagcagcacagatgccaaacaatgatggatctcagctggactttacctggtggccccgcttcaagctgtgggtccatctgtgctccgtttctgtgaactgggctcgggtttattccctgtctgttcattccagagtcccagttggaggaatagcagctagcaggggaagctttctcttggaaatggcaaaaatgcaaaaagtcaagtctgacgacgcaagcagatcacaagcctctgtttgtatcamatatgctaacatcccatcagtcaaaacaagtcacaggaccaagccctaaagcaagtgcagggaaacatacctccttctaatgggaggatctgaaaagctttgtggcaaagggcacaagacagaaaaagtgaacaaggcgggggaaaagtttaatctaccatgatctgccctctcggtcataattacttacagctctaccacatgcaaaatatactcagctttatcccaagtcctcaaagtctcattcaatcagacaaagttcaggatctackttaggtccgggtgaggcacctggaaacc

SEQ ID NO: 4600 - DNA, 600 bp, Bovine  MMBT04222
gcatcctctgtgcttggtattttccatgagaagcaaacccagcattgaagcatcattcttccagattgggatcatttcctgaaagctttcagtacaatgacagtgattagctgccagactaattgctccaccaccaaccttgttgcataagcaaatggtgcccaagggtaaaataacaagcacactgaggcaaactttccagcgtgtgcccctaaaccttccccctcaayggagaaagtgaccttttggtgaacaaatgttctttcaccttcactgtttagaagttgttaacattgggcyagctatgtgattgatgcatgagtttgcctcttttctgtggagtaggttctcctctttccacctcagagctgtgagctttttatattgttttcgtttgataaggtggctggactacccataaatttgaatgtatttttttaatgacctggtggtgctgaaagagtgttattctgcttttgtaggctgctggcttttcttttgtcactcacactgctagttaaaccttttgtgamtgtgctcttctattagtaatctgtttgaaattaaaaaaaaaataatgaaaaaaaatgagtttcttgc

SEQ ID NO: 4601 - DNA, 598 bp, Bovine  MMBT06488
  misc_feature (1)..(59): n is any nucleotide
nnnnnnnnnnnnnnnnnnnnnnnnnnnnnnnnnnnnnnnnnnnnnnnnnnnnnnnnnnncttagagtcatataaatggtttataataaaaaaaatactgtattgtatcttaattttcatttaatccttaacactttatgagtaagtcctttattcctatagagatacagcaattttccaagttttgacctctagaggtagagaagagctgggattaggtgtggtccctctaaagagaattggccaactttttatgtcaaaggccagatagtagatatttgtggctttgcagtttgatctrtgcccaactattcagttcttctgatacratgtgagggtgattgtcacctgacacrgcttgataacattaataaataaaactttattaacaaagataggcggycactgtgtaggaccctgaccctacagtcagagttctttcctctccttgggaagtcagcctttcttttcctgtgtcagttttgcttcttaaataactgattttctcaatgcccagtcaaaaatgtaagtggactctgcagaaggctgacaatcgatggatggaaccgatgagacaacttgattagttacctgagtcc

SEQ ID NO: 4602 - DNA, 600 bp, Bovine  MMBT06574
aggcagccacagggtccagatcccaagagcaaggtcctaggccagtgaacccctcccgccaagaccaatcaaggccagggctaattaaacataacccttcagggatcgtcttctcttctggcttttcagatctctccccgtctctcctcagcaccaactcagctcgcgcttccaaacaggcatgcgaaatgtgctcagacatcctagttcactcaggacgccactcgggtcgaaggcacccaggcgtgtaacaccctgtgtcagattaagtctgcagtgctggctggtcatccatatttrattgtcagtctgttaatttttaactatgtttgctatcaagggccattagaggtctccaggagccggagtcggtggagcgagaagcgctcggtggcaaagcggatgaaacttggaagtcggggcgtcccactttcccctcctgtcaccgagttctggccttccccactggcagcgccggccttgaataaaacatgatcccatttggagctcgttttccttttcgcccctgtcaccacgggttttcttcacggagttcacttggtttttatggcgcctgcgtcttttaattccaaagtttct

SEQ ID NO: 4603 - DNA, 598 bp, Bovine  MMBT08752
  misc_feature (1)..(24): n is any nucleotide
nnnnnnnnnnnnnnnnnnnnnnnnaagatcagtatattaaaactatgaccactggggactttatagaaagtctctcacatttccctgggaattctcatggaggatctggctgtagaaaaatgactgcatacagaactcagaatttcttgtaaatagatttcaaatgcttccaattgcaactgttcacttcaagccagaagtaacatgtggctatatttttcattgcagaattatataataattttggaatatcaattctcttttgtacaattacttgtaaatttactcaaggatatccaytgaacagattatctgtggatttcaatttcctgtgactggatgttacccatgatctttttatcagttttttccccctatgttgcaatgttaattaaaaaagaattattatttgagatgcagtatagctattttctatttctaagggacagaaaatatcattgccaattgcttcaaaaaagattaaaatgtgtgggatgataaggaatcttcccagcttgctattatwtttaaaagctgcatttaaacattatgttaatggaatgtaactataatcaattaaaatgttattttcaaagca

SEQ ID NO: 4604 - DNA, 598 bp, Bovine  MMBT14032
  misc_feature (1)..(123): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgtcatctcgagggctctgaggttagcttgcttaggagcccgactcccataggtgtgtggatggtgggggtgggggaaatgggaggagccacagggcagacgtggagggagggtcagagcagaggtgtgtgaaccaccagagactgggcgcttctgagatactttcctggaagstgctggtggggagtgcagtagaccggtgtggagagggactgctctccgtctgcacttactggccgactgaccctggaaagtaatttcacctgtaaaatgtgggcaataataatacctctgacctagagtcattgtgagagtgtatggagaaactcttagcacggggtcttggcactgaaaattttcttatcaactgagagctgcaatcattatcatcatggcctgttctctaaggcaggctttttcaaactgtaggaggtaacctgtaagtggatcatgaagtaaattgaatagcttg

SEQ ID NO: 4605 - DNA, 600 bp, Bovine  MMBT20331
gctgagacctggaccccagctctgcaagatttggtggagatgcaatccctctcaggcaaagagccaaccagcctgactcattatctgtttggtggttggcttctggcctgtattatcaccactctcttgtctttattctctctgcagttcccagaggttgaagatgctgtctttcaggtcacttcactagaaaactttgggcttcccaggaagtactagtggtgaagaacccacctgccaatgtaaaagacttgagagatatgggtttgattcctgggttgggaagatcccctggaggarggcatagcaactcactccagtattcaaattaaaacattcatagtcatgtaggtggttatgcttcatgaattccacgaagcaaagttggttagctaggatgtgggacagtgagaagtgtcaggcaccttgtctacttagacagtcataggagcggagcttgctctgagccaggcctttgtctactaaggtcaggtctgctgcgaaggatgaatgagggaggagagaaaggattactctcactcctctcctccaaaagaaatgtcttgaaaaatgcactttttaagttataagcaccacttg

SEQ ID NO: 4606 - DNA, 598 bp, Bovine  MMBT02076; identical to SEQ ID NO: 4512
  misc_feature (1)..(104): n is any nucleotide

SEQ ID NO: 4607 - DNA, 600 bp, Bovine  MMBT06654
tgacattgaacacgtgggtagtcactgtttcaaccaactggggattgactaagaagcagatgtgttttgagttgagctgaaaaatagactgcaattgagattgctcatttttattttattttgtctgctgtgttgtgttcagttctcaaaggcatattttatgaaggttataggcaaacaaagatgtgcccaaaggcagatggaagaagcctgaatcatgtcacaaagaacatgagatctccctgggtttgtctagcctaaggatgagaaaagcagagaaaacacatcatccatgtccawatatttgaagaatgtttcattcagtttcgagtaactctaagaaacaaatcaaggtatagggaatgtgagaagtgttaacaaatgttgccagcaattgagccatccaaggaaaatggtagtgagtttcctgtcattgaaaatgatgaaatctttgtcctattgacaactttcaacaaattacttattaatacctaatctgtaaagtgaggatcatggcatttatccctgctccagtggatcttcctgatccaggaatcaaaccaaggtctcctgcattgcaggcagattctttaccagctg

SEQ ID NO: 4608 - DNA, 598 bp, Bovine  MMBT04346
  misc_feature (1)..(24): n is any nucleotide
nnnnnnnnnnnnnnnnnnnnnnnnaatatggagcttttgacacaactagtaaatccatttatgcctgagatacagccaacaaactgcaatatatagaagttgttcattctagcataagcctgggattactttgtgattttttttttaaattacagaaatcataattactaaatttgcatcttggttactctcaatctgtccatggtataaattaaatttgccctttgacttgtgtctaaatgaaagagcaaattttagtgaggagcagctctgtattcagaggtaaacacattcatcttygcattagttctgatgaaatctatccacaggcaggttatatgccaggacactgatatatgccacgaggatgcactgctatgaactctatctcagcaaagtcctccagatggaaaataaattggaaagcttcctccagagaaaatgagctaacaggaaagatttgagtctctgagtttaggagctttgcctagagttagttcctcttggggaaattcagtgaatgtgttcctagcaattctaggaagtcttgagatcttttaagacaaacattatggtcttatgtaaattcaagtaaact

SEQ ID NO: 4609 - DNA, 600 bp, Bovine  MMBT04211
tccagtagtatgtaaacacagtcaaagaatataaacacgacaaaaagaggcatttccccaacccaactccaacctcaattggtaccaataataaaaataattgctttgagaacgagaatactttttttagtagttttccggcagaggctcttaagtacacatgacctccaattatacatcctacacatcgtagagctccctatgtataaccattcagaccttttcccattatttcctggaattttaaggattcgtttgaaaataagcgcctgcactacttttagtcaagtccaaaagtayaataaacattyctgcccaagacctttttcctccctaaaacaagtgaaacacgagccctccttaaaggcttgaggtattcctaatgtatgtataaaagtccatggacaggccactcatctggaggaaaatgatttaaaatttgccaaagttgccaaatcacatttggagacaaaaaacggaccaattttacttcataagacaaatcattttcaataaacgaacgtgacaccaggaaagtaagtttaatgatccgggcaattattgctggaaagaactttagggacaaagagaatcactcat

SEQ ID NO: 4610 - DNA, 598 bp, Bovine  MMBT07889
  misc_feature (1)..(50): n is any nucleotide
nnnnnnnnnnnnnnnnnnnnnnnnnnnnnnnnnnnnnnnnnnnnnnnnnncatggaactgggttcatgggcccaagaaagaaggagcatgattgaaaatgatggtgagagagtatcatcatcttccttagcgtaactatagctggagaacctttgagtcattgctgccaccttcacttaaaacaaggaaacaaaactactattctcccatgaacagacactgcaggagccaacatatctgtggaggaaccagctggacttgatcctgtcctgccacgcatcaaaaaccttgtgaggcccrttacactgcacaatctcctaagcattgatcctcacagaggcagggagagttcagctgggtatttttttttttttttttaatcccacaaggagtcagaggcattggcacttagcaaatcctcttttaatttgctcactgagaaaattcaatcaagacatcattaaaagaaaagagaccagcatggcaccatttgtcaagtctatctttgagctatcactgcttttcaaggggtggtgagtgatgggcagaattatattttctggcttctgaataagcttctgtagaagagctcacaatt

SEQ ID NO: 4611 - DNA, 569 bp, Bovine  MMBT12658
tcggcagtttatagatctttatcttaagaaatgctaataaaatatggctgacagtgaaatcagttcctcgagaaagagactcctgtytgcccaaactaatcattaattacttaacacactggttagaaatgtccatagatcagagttagggggtctcatctgagctacaagtgatgcttaaaatttaaaatgctttaaatgaagaaggtgccagcagtcccccctggacagtcccactggttgtctagaataacgtgagtcctaaactcgggccgtactccgtgttcacacgagttactmactcttcctttaggtctgtgtgtttaccgagcaggttcacagtttgtaacccagtgtgctttcttggtatttgcagaatgtgtttccaccatcctcccaaaatgtgaagattttgtttgtactttaagtgagaaataaagaaatgagctaccccatatatcctatttgtggtataaggaacaagaacaagtttaaaaaaatgttcttggaaaacatgtttagagaacctgtaataaagatctggagaatggagctgccaagtcaatgtg

SEQ ID NO: 4612 - DNA, 600 bp, Bovine  MMBT13103
ttgggaaagcagatggctcgagctagcactggggccactggaactcagacagctttagtgggaagtgaggaaataagcccgtgataggtgcttctgaggcatcttctgaggatccactgggttaggtttccctcaggagcattgtctgcggtcagcccttgacgtcatgcgacttgtcagggtgtgctgaggaaaggtagggacaaaaatcggcttaaaggaacaggaaagagggataggtagtcactgaggtataagcctgaataaactcatttcctcatttctcaccatcctcgcctstctytgctytctcagcgggcagagctgacatctgataaagacatgtaccttgacaacagctccattgaagaagcttcaggagtgtatcctattgacgatgacgactacgcgtctgcatcaggctcgggtaaggctagctgcatccacactcatctctgttctctgtgtttgtgtatgcacgtgccacacacaccctgtcttacacacgcatacactcacactctattggaatgtgcttcagggaagcaagcaggaggcataactgttaagggcacgctctgtggagtcacagtgcctggg

SEQ ID NO: 4613 - DNA, 600 bp, Bovine  MMBT12991
gattgactgatattacagcccagatcatagtctaagcttcttatttaataagccttcaaatgaaagtactcaatgttaaatctgttttcattctgtctttggtgttgtccctcccacgggattttcatcactayttaccttgagtgttgacagtttctgcactaarcttgctgcctaagtccttcacttctaactgttaccccactgactataaacctgcactaggttaagcttcctaaaactctgctttatgggcattgcattcttgatccaaaagtcttcagtggttcctcaacacayagaaaataagatttaaaccaactggcaatcaaggtctatcatagtctaagtcctacatttacccttgtttattactgtactcctatatgacattcctataagacaaattgtcttattggttgctctacattcagcttaatgcatgttcttttaggtacgctttttccccaaatggaatatttttaatgatttttaccctatctattaagtcattatctgttctacatgagcaatttcaaatgttacacaaatctttttcaaattttactaacaacttcttttttaattgcctaatcactc

SEQ ID NO: 4614 - DNA, 598 bp, Bovine  MMBT14263
  misc_feature (1)..(89): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttgataccatgttataaaactccaaatcttgctgttgccattattattttattattaaaatattttagcaaagtacattccaagtcaggtacttcgtataactattgatttataaagtcatgaaataaaaagaaattcctttgcagtatctgtgaaaccaatatgccttcattggtaggccaatagcaagccctaaataattttatgygtctttatagaaaygtattcttttttttttttttagttttttttttaattggaggataattactttaccatattatgatggtttttgccctacatcaacatgaatcagccatagatatacatgtgtccccgctgattctgaaccccccttcccacttccctcgctaccctatccctctaggttgtcccagagcaccagctttgggtgccctgcttcatgcatggaactcacactgtcatctagtttacatatagtgatgtatatgtttcaattctattctttcaaatcattccaccct

SEQ ID NO: 4615 - DNA, 600 bp, Bovine  MMBT13519
tgtttttgctttggctccatctcttcattctttctggagttatttcaagagactgacccagacttgcccatgagtgtccaggagtctccggcggaggcgtgggtcggcggtggcctgctgcagggtctggggcactgactgcagcagtgcctgcatgggaccttttgaaggaggaggtcattatcttcattacctctaccatagtttggcctcaggtccaacaaaagggagggaacacggcccagtcccctgagtaatatagcagcaacgtttaatccagaaaattggattaaagrtatrctgagcatggtctggagcatcaaaacaagacccagttccccctcagtcagtctctcccatcaggaagcttccataagcctcttatctttatccttcagagggcagacagaatgaaagccacagtcacagaaaactaaccaatctgatcacatggaccacagccttgtctaactcaatgaaactatgatccatgccatgtagggccacctaagacagatgggtcatggtggagagtccaccctctgtctgactcgtcccataaacaggaggtggaaataacaggaggtcaggcaattcctt

SEQ ID NO: 4616 - DNA, 598 bp, Bovine  MMBT16148
  misc_feature (1)..(25): n is any nucleotide
nnnnnnnnnnnnnnnnnnnnnnnnncatatgtataaaatttaatagctcagcttttagtgtgccttattttcaacaacactctactcaggaacatttgctaaatttctcatttaaataaggtgataaagcatccttaagccctgcagggccaaatgtgttgacttccaaagattgttccaacatttgtaaaaacgtcttatcactttcactatgaactcttcccaataagcagataaataataattcagcaagtaatctagacccattatctcttctcccttctgtttaatccaacctgytttgcttcttgggtacttaatcagaagcttgtaagatatctattacagattatgacrctataaatcatgtccttaaagtgcgaaacrtccttgtcagaacattcaaagtagcttttgagggcaagcagagtctatcwctttagaagtattgattgcragaaacagagagcaatacaagctaacctaaaaagaggacttattggaaagattttgkatctcacaagggccagatcttgtcatagcagaacaaggtgtgttccagaggatcacagagcaggaagaaacagagcatttccct

SEQ ID NO: 4617 - DNA, 598 bp, Bovine  MMBT17178
  misc_feature (1)..(156): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttattattagcagcctgagttttttggggagtagacaggatatgaaaagatctgcaaaaccagaagtgatatatttttggtttttgtttagcacggagaattggaaatggaatatatttattgcttaagtgatgccatgcytttcaaagaaagaataagtttatttcctccaagtcacagtggaggagcattatgtaatattggctcagtgggtaaaaaatccaactgcaatacaggagagagaggagatgcgagttcgatccttggtttgggaagatccctyagagaaggaaatggcaacccactccagtattcttgcctggagaatcccatgggcagaggagcctggcgggctacagtccatggggtcacaaagagycggacatgactgagcgactaaacacacacacacacacacacacacacagatacagaatca

SEQ ID NO: 4618 - DNA, 600 bp, Bovine  MMBT14616
ctttcctcagactgacaaaacgagtatatttgccaattattttaagaaaggctggtacaactgcttacaaaggaagaaaacaaggctcatgaaagttaggtagcttgtcaaggtgttggaagggtcaaatacaatagtaagtgcaatggaagcttcatgaaccataaaacatgatgaaaataccaggttttaataattactaataaaatattaaattattgttgaaacaacacatttggtaaatgtcaaaggagaagtactgtatgctcattcagtcatatctggttctttgcaaccccrtggactgtagtctatgaggctcctctgttatgggatttcccaggcaaaaatactgttgagaattactcggtgcataaaatatggaggggagagaaagatttcagtttgatgaccttctaaatgaccagaggcaaagtctagcagttgccaacctggctgggcctggatgatgcattcggagactttatcttcacctccccatattccgggtgccacacagtcactgaggatatcccagcattatttgactaagtgcctgagacacaggcctctagaatgtaccagaggaagccaccaaaa

SEQ ID NO: 4619 - DNA, 600 bp, Bovine  MMBT21689
acacggcccgacagaagtgcagtgtggagctgctcttgcctcctgatggggcgtagtctctgggtgttgtcactcagtcctgtctgactctgtgatcctatggactgcagcccgccaggctcctctgtccatgggattctctaggcaagaataaggcaggatgaaagtggtgagtgggggcagctggcgagagtatctgtcgatccactgctccagctccaggatgagccccgcctcgaacatggcgtgttttaaatgagcctctctggctgaggagcgcggagtcgccagggcagagcygaagtcctacagggagcactggattctctgaagctcttccacaaacgggtggtccttttctgcaattaattccatagcaaacccaatggctgaacttaattcatctgtagttcccacagcttcaaacacctggtcgtctttgggtggtctttctccagtgaaggtgctagaaaaccctttgtctcctgttttggtgtagatcttggggacctagggagtcttcgaggaaggctgaggcctgtccccatcttccacaccctgggggctgcgactctggaaatggggacacaatagctcgcg

SEQ ID NO: 4620 - DNA, 600 bp, Bovine  MMBT20253
acctctggagcttggaaaaaagtacagtgtgatggcagaggaagatttgagaatcatctgaaatgtaggtataactaaaatggaagagagcaatagtaagagtaaggatactggacattcaaatacttaagacaaatgatgtagtcagattcactgaagtgaaaacattccaaaagtttagtgataaatattagcagaatcctacgtttagtgattgagaacactggcttctcattgtggtggcttctcttgttgaggtctatggtgcgtggacttccatagttgaggcacacgggctcygtagttacagctcctgggctctagagtgcaggcttagtagttggggtgcaggggcttagttgcttcgcagcgtgtgggatcttcctgggccagggattatcaaaccagtgtctcctgcattggcctccagactctgaaccactggaccacyagcgaatttcttccttaattattaatgaggttaaatatttgtgttttttgagtagctgtgttcctctttaatcaaatgctaatatcctttgcccttgtgatacctattggagttgctttcttttttatatcaagttataggatctcttt

SEQ ID NO: 4621 - DNA, 598 bp, Bovine  MMBT01915
  misc_feature (1)..(57): n is any nucleotide
nnnnnnnnnnnnnnnnnnnnnnnnnnnnnnnnnnnnnnnnnnnnnnnnnnnnnnnnncacactaagaggtagagagtttatcacctgtctattcctgagattctaacaagaagcttttcagaagatcaaaatggaaggaacacaggattgtgatggcagggcaatgctcaggtatgcatccacagagagtactttctgggtttgtttaaagaaaatgaaactgtgtgcttccagtgctcctgagactgtggtggggattgtggcttcaaagaacagtgatcacagctccatggttaccaygatgcaggaaccagtgarcctgagaagaaagcaactacctttgtgtgaagaaaaacaaacaatcctggcaacaaatattgttaaccttgggattggattttttaattatatggtataatctgttccagtggaaccctttataaatagaacagcatttaatatgttaatttatattttaaattaaatttttataaatatgtatgtaaatctattataaattactttatatttttaaattaaaatatattaacatgctaatacactctataggagagtagaggtatgactccgcatgagg

SEQ ID NO: 4622 - DNA, 600 bp, Bovine  MMBT17798
aaagcagtttgtttttggacaaaatggtgaaaaatggaaaaccacatcaatcagtctgttctctttgacccagttcctacctacttttcctaaggtctgttcctaaggctgtaaggtctatttctttgctaaaaacatttaaagatgcctatggtatgggggtggggagtgtggggaaggatgcaagccatgatattgtctttcccygggttttcatggagtttcagatgcactggggaacctggaactataacttaggggtaggaatattttgaaacctggggaccatggatatttttrtgcttttttgtgttatgattggacaatagcagcagagtgagtttagccatgacaagccacatcagctcagctgtagtaacctttgtatagtagtatcagtttytgatgtttaaatgatgaaggatagaagtgtgtggaaggtaaaactctaacctgctcttgacttcaggggcagatgacagtggcatgaatttttactacttggaatttggcattggggtttgtttatagctaatgcagctttcctgttattaagacacacctttagattgctgttccaagagttctccaaaggctgtt

SEQ ID NO: 4623 - DNA, 600 bp, Bovine  MMBT22653
cctgcactggcaggcagattctttaccactgagcccacctgggaagttcttattttacaaatgcacaaatgctgtcaaacaactaacatttcccccccscttaaaaatgctaaagctttctcttctagctgggaacaatgaaaaaatttggacctaccctatttagaaataacccagaatgtgattcttacccatggaggaatcttgcagtagtgacatgccttcatgtctagaggagccacgagtttaggataaaggtgtcwcatgtactcagacgggactttwgtgtacttacttcakttcgtttacttgtctcagaatctcatgctgagtgttcacaacagyatccagttcttgttgaaaggtctggaggaaaaacaaaagatgaccagccagcccgagagtccccactccacagagcacaccgcctaacacccagacatggctcctgcttccttccctgccgcaggcacatccacggacctcgcaagctcacctgcccctgctgccctggggctccagctcctctcttagagatctcctctgtcagggaagagacgtatcttctctgttcatcgagaatcatatctaactgtcggt

SEQ ID NO: 4624 - DNA, 600 bp, Bovine  MMBT00607; identical to SEQ ID NO: 4548

SEQ ID NO: 4625 - DNA, 600 bp, Bovine  MMBT00857; identical to SEQ ID NO: 4549

SEQ ID NO: 4626 - DNA, 600 bp, Bovine  MMBT00611; identical to SEQ ID NO: 4550

SEQ ID NO: 4627 - DNA, 600 bp, Bovine  MMBT02444; identical to SEQ ID NO: 4551

SEQ ID NO: 4628 - DNA, 600 bp, Bovine  MMBT00613; identical to SEQ ID NO: 4552

SEQ ID NO: 4629 - DNA, 600 bp, Bovine  MMBT03343; identical to SEQ ID NO: 4553

SEQ ID NO: 4630 - DNA, 598 bp, Bovine  MMBT05864; identical to SEQ ID NO: 4554
  misc_feature (1)..(160): n is any nucleotide

SEQ ID NO: 4631 - DNA, 598 bp, Bovine  MMBT12511; identical to SEQ ID NO: 4555
  misc_feature (1)..(159): n is any nucleotide

SEQ ID NO: 4632 - DNA, 600 bp, Bovine  MMBT11500; identical to SEQ ID NO: 4556

SEQ ID NO: 4633 - DNA, 600 bp, Bovine  MMBT11487; identical to SEQ ID NO: 4557

SEQ ID NO: 4634 - DNA, 600 bp, Bovine  MMBT16091; identical to SEQ ID NO: 4558

SEQ ID NO: 4635 - DNA, 600 bp, Bovine  MMBT15397; identical to SEQ ID NO: 4559

SEQ ID NO: 4636 - DNA, 600 bp, Bovine  MMBT17508; identical to SEQ ID NO: 4560

SEQ ID NO: 4637 - DNA, 600 bp, Bovine  MMBT23243; identical to SEQ ID NO: 4561

SEQ ID NO: 4638 - DNA, 600 bp, Bovine  MMBT05614
gtgtgaatgtatatcttgtgttcacatttggtgtttatgtatttgtttattacatagctgctccattttcagagggctttctaatcgtgggttcacgttggatcagtaagtgacttcattttaagtgaggagtgaagtacaagaaaggcagaggagggtggtgactgatgtctgaacagtttcattgttaggctgtcccttgaatagtgtcatctctgtgtgtattccatgaaaacaaatgttcattattggctcttaaatagtgctattcttctatgtagaaaaagttaatattgatayaagggcaaaaggaatgtatttttggtagttttgtgcttttttccttctatttatttgtaatagctttatcttgtatttttattttattttatttttaaactttacaaatgtattagttttgccaaatatcaaaatgaatccgccacaggtatacatgtgttccccatcctgaaccctcctccctcctccctccccataccatccctctgggtcgtcccagtgcactagccccaagcatccagtatcatgcattgaacctggactgggaactcatttcatacatgatattgtacatgtttc

SEQ ID NO: 4639 - DNA, 600 bp, Bovine  MMBT09165
aggtggctcgcgtagcagagaacttcagaaagtggggagtccgacataatgtgatgtgtgatttattggagttggtggagacacacactgtaattgtatgcttggtctaatgtctgattgttgtgtctttcaaaccctctggaggccagccccccatgtaagtgataacccactggcgcttttgttgggagtgcaattgaaatatacgaaatgaatagcaactgattaattgaagccggctacatttttggaaaacaaatcaaagtgatttgcatgaatcacaatttgttatataatacrtttggagggcacaaattacctttttaagcctaagacacatatatacacagtggaacaaacgaaactacaataaactgggctataactacataattcatattgaatactggatrccaaaactgatatgaaacaaatgattttccaataaactactcaggcagagccatatctgttctaaactttcaatagaatattatttataataccaataattcttcccaattgttagccatggaatgaaggaacaatctattttacatattagtttgcgggggggcgtgtatttacaagttggaaact

SEQ ID NO: 4640 - DNA, 585 bp, Bovine  MMBT10701
gttagtaatatgaatgagttaaagaaaaagtgcacgctagattctagaaaaagtacaaggataactgtctcttgccttcctcttatgtttcccgcagtgctgctgctgctgctaagtcacttcagtcgtgtccaactctatggctagacaaataactggtcctcaacaaatactgctttatccattttatattcattcctttcttgatgatacaacacagatgtttaaattcagggcagtgtaaatggcaaagatgaaaattagcagacccatgcatcaccgtcctatttatgcttgggragacctctcatttattcagcaaagtcttgatgacttcacaatagacataatctctaaggaactattggttgagcctgagtctctgctctaaatgcagaatgcaaaaattcaaatgtactataatttatatgcatgctgatgtagaaagctgattgtatcagtcaaaatatcttcatttgttgacaacaaaagggttgatcttaattccttaagtgtatgctctgaggcacagttttaggtagcaaacaaatcaaatacaacaagaagagtaaagtaaaagagaaa

SEQ ID NO: 4641 - DNA, 600 bp, Bovine  MMBT07354
ggaaaaaagcaagaggttgagttgtggcagttctttatctttattttctgggatttggggctgcagtttactagtcaaccattgccaaagtctggttggttattttcatgataatcagattatttctttcagcatgttgaggaaacattccttgtttgagtttattttaacttcctattatttgcacacaacaaagtaaatttttccattttaaatggtatgtcaaaatatattgccgaggaaaaactagaactccctactgtaaagcacagctgtcttaccagtaggtatagaggcacrtgagtctgatggctgagtccttggcttgattcattcgttcactttgctccacattgtttccaggacatcattggggaccccaaggtccccaaggcagaagtggaacaagaagtggaacagctgaagacccaggtggcacgcctccaagctgaaaaggcagatctgctgggcatcgtgtctgaattgcaactcaagctgaactcaagcggctcctccgaagactcctttgttgaaatcaggatggctgtaagtgtattggttttggttttgtcttaagcaagttacaaaacctcacctgga

SEQ ID NO: 4642 - DNA, 598 bp, Bovine  MMBT05723
  misc_feature (1)..(120): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggggcgcagtaacaggctttactactgagggaagcttcaggttcaccgcaaaatcgaatggaaattacagaatttccataccatataccccctccccccatgcagaccgcctccccccgccccgcatcaacaccctgcatctgtgtgaggcatttgttaaaaccagtaaagcaacacraaacatcaccgttgaccacagtcagccagagcgaggttcatggtgaggtacaggatcagggttctgaccaagcgtccatcattacagcccccrcaaggtcactgccctgaacttcctctgtgtgtgcctcgtaggccctccttcctttcctgagcccccaacaaccactgatctcttaactgtctcaatggtattgccttttccagagagtcagagctggaatcatatgtgtgtgttacagtcactcagtcctgtccaactctgcgayrccatggactgtagcccaacaggctcctcc

SEQ ID NO: 4643 - DNA, 433 bp, Bovine  MMBT08014
  misc_feature (1)..(2): n is any nucleotide
nnaattatttaaggttgcttcctaattaggcctaataacatcaataattaacaattccccaaactcacagcamaagtgctttattcttttcaaagggttttttttttttttttccttattagatactcacatcarttctctgaggtaactgagaaaatgttaccctcatttattgggtgagaaaactgaatattggagatgtctgcagatagtttatcatatgagtacagtcatcacagrttacaatggaattggtgttgtattgtaggctcagtgcctatttcatagtctgtgaaacatcrtaacattttattatagtcaccctgcttctttctgagtccatacagcctataataacttgtgaaatcaagcttacaaatgtaccatgattaaatttaaacaacaacaaaaaaagaaataagaaaacagcaaa

SEQ ID NO: 4644 - DNA, 600 bp, Bovine  MMBT00976
tgcttatagcataagatggcagcttgtgataggtgacctccaaaatgaccctcagtgatcacatcttcaccttgacactcttgtgtaatctattatacctgagtgtggattggaccctgtaactcttttccaatatagaatacaacctaaacaatagcatgtcacttccaagattaggttaaagagatctaacctgcaaactttcactctttgtgagtggcaccagctgctattttatgatttgattcacgaagggtcccacagagaaaggaattgagggaggcctccaaataacaaccmctaagaacatgagaacttctgtccaacagctcatgaggaagagaagcctgtcaaggacaatgcaagtgacagtgattggaaatggatttgacctcaggcaagctttcagatgagattgcagccacagccaaaactccaatggaaaccttgtgagggatcataaggcagagacatctaaataactcggagattcctgacccacaaaaatggaaataataaatgctgattgttaaaagccattaaattgcaggggtggtggggtatgtttgcatacaggtaagtaatatagattttggtacc

SEQ ID NO: 4645 - DNA, 600 bp, Bovine  MMBT12907
cagtcattattattaagcaacatttttgtttctttaaagaaattgaaaactgaagaaatgaatcttagttgtctaataatattctaggacaatagtgatttttgtctctaaataattgaagttatgctactggaaagaatgatccaatatgaagagcaatttgaaattacctctcagaaaacagtacaacatacaatcacaatattgtttatgtgactctccacctgtgtactttaaaggataggcattcattaaatggtaacagttagaagctacatgtataaccttaatttcttacaytttaataggtataatgtaagaaaaagcacccccatacatcaataagaaggaaattctgcaacattatcggtctagcaatctctctcccatgtgatcatttatgtgtgttatgagaggatggttctcaacctttagtttgcaaaagaattcaccaacaggttatttaaaaggtggattctccttctcctatcccagatttctgctaaaattatattggtatagttactaaaatttatatgagtaaggactacttcaggagatttggctcaggtggcccatggattccacttaggaacagaa

SEQ ID NO: 4646 - DNA, 600 bp, Bovine  MMBT12780
taaattggatgtagattatatctaaattcccttctagttcaaaagccctctgatctctgatgcaacaccagcccagggagtaataacttcactttctttctatgatcatcctcataagaggaacaatcctgcctggttctattcatttcatgattgctacttgtatcattttcaaaggtgacacgtttgcttactttcactttaaaaaaaagacgaagaaaatataccatgggaaaaaatctgcaccctttattctataaagacacgttgagtgttctatgtgaacttctttcgtgttgkatccgaacttttgaattgtttgaaggtgacgttatacttacccgagcatcacacagcacatgcccagaaccacgtagtacacagtgtagaaaaggatggcacatatgagaaggttctgccaaacaacctgcagagaacacaggggtgagctccaagagcctgggcttttcacattgttgttgktaaggagtctgacaagcaaaagacaatgaatgactgctagatcacattggctagccttgtttcgcctggagacctatggggtggaaggacttcaaactacacaatagaagtgttgcc

SEQ ID NO: 4647 - DNA, 600 bp, Bovine  MMBT17944
tcttagctgtattctctctcccatttttcctcctgttacatacttctcaggttagaagcctagattaaatacttaaccacgctatttacccccaatctcctatttgaccttcatttccactggtccagctgcaaaaccaaaaaaagtcacaatgaacccaaagtcactatctctaagcagacttgtaaaggccctgaggatgacatacctcaggaaatagaaatatgttatccctcaattttcaggtatttttttcctaaaatgttctcatactatttgtttctgaaaaccaggaattcsaaattagtaatgacaggaaagatattctagccaagggaataaatagatatcctttacagtttatgtgccctatttttagtgttatttacttaactctgacgaccaaggactaaagcataacaggaatataaacgtctcacaagtatcagtgtttattaacacatgtaatcagcccatctattctgatttaaatgtgttatttcaaagcaatttacatacacaaaaaatggagaaaataagtttgtagtgaaaaaaatctaattttcataagttgtttggattgtctacaatgtatttgaa

SEQ ID NO: 4648 - DNA, 600 bp, Bovine  MMBT15679
atacattaaaactgtgctacgtacatatacctatcctccttcaaatcatttcatactctgtcctgcaacacgtgatatgattctaactggaataaggtggtgtttttctttctatgcaaacatatagaaattatacatccaaatgagtagggctgtactctttaataaggtaatcacctctagaagtcatatatgccttccaacaaggctgctatcacacatactttttctggaatttctaggttctccacatttcatgtgcataaggatcacactgggaacatgttaataatgctaatycttagagatgtgtatttaactggtcttttgatgggagtccgggaacctgtattcttaagaagcactccagctaagttttacacaggtgatctgtgagaaaaagcactttagaatagtgatgtaagggtatcaaagtaaggactactgagttaacctctgtttacatatacacataacacactggaagtttaattttttttttcaaatcttcatttctcctaatagaatatatcggtacagatatacataagagcatctatttgcaattaacatacctccatgaaagagattcctaagctc

SEQ ID NO: 4649 - DNA, 600 bp, Bovine  MMBT12571
aggaatattattatcccaatattacaggagaggatactagggtccaatcttaattgttcaagttacatagcttgaaagaggcaaaatctgaattacaagaaaacagtgcctttacacatagtactaaaaatgtttattgactagtgtactatgggatgatggtgaaagaactcaatttagaattagaacaccttaatttagtcttaatacatatgcaacacctaccaattaatgaggaaaaagatgactactccaacagaaaagtgaagcaaaaaaacagaaaatttacataaaattttracaagtgactgaaaaaaacacatataaaatctcactagtattcagatatttgaaaattataccaacatgatatgttagcttttgcctatcaaattgaaaaattgtaatatccagagtaggtaagagtatactatcagccactaggggaaaaaatgttgatttatataacatttctgaggggcagcctaataatatatgtcaaaatcttgcaagtggtttatatcttctctggtagttttaaaacaccgatataaattctttgaccctcccttcattgagaggtagcgaatctacattctc

SEQ ID NO: 4650 - DNA, 598 bp, Bovine  MMBT16411
  misc_feature (1)..(27): n is any nucleotide
nnnnnnnnnnnnnnnnnnnnnnnnnnncgggggcgcagtaacaggctttactactgagggaagcttcaggttcaccgcaaaatcgaatggaaattacagaatttccataccatataccccctccccccatgcagaccgcctccccccgccccgcatcaacaccctgcatctgtgtgaggcatttgttaaaaccagtaaagcaacacraaacatcaccgttgaccacagtcagccagagcgaggttcatggtgaggtacaggatcagggttctgaccaagcgtccatcattacagcccccrcaaggtcactgccctgaacttcctctgtgtgtgcctcgtaggccctccttcctttcctgagcccccaacaaccactgatctcttaactgtctcaatggtattgccttttccagagagtcagagctggaatcatatgtgtgtgttacagtcactcagtcctgtccaactctgcgayrccatggactgtagcccaacaggctcctccgtccttggggattctccaggcaagaatactggagtgggttgccatgcccttctccaggggatcttcccgacccaggcatcgaacccggggctc

SEQ ID NO: 4651 - DNA, 600 bp, Bovine  MMBT21186
tcccatcactacactgtcttaccctactttctttttcttcagagcgctggcatatattcatatatttcttttgtgtgtgtgtctcctcactatgacattckgttccctccaaacgttccaatatctagaataaagcctagtacagagtagccactcaataaaaacctactggatggatgaaagcctgattccaggggtagaagtataacacaatcgagttgcacatttaaactgaaaacatgatgtaaacgtcacaaatgaaagtacgtaaagtactcgtgtccagggaacaagagtagyagtagagcatagtctcaatgaatagagtcttaactactcagcatacctttggcttccttcattgtctgagagacaattcttcggagggtctgatcagcttgatgaagaatgttagttgaaccgataagtctgtctgtttcctagataataagacattgttattgggacagttacctagttgtacaaaagaaatgagcaaagtgtaggtgatacataggtgaagacactgaaagaaaagtaaaagtggcttttctcttccaggtatccttctctactgaaagtgttattygctcagtygtg

SEQ ID NO: 4652 - DNA, 600 bp, Bovine  MMBT21289
tattggaatgacctgacaaagtgaatattatttcttgtgactataatttattctatttgaccagaggtcaaattgcttcatctcctccacctgaaattgccatataggcctgtttagtgttgtttaactatcaggttttaccccatggtgacttttgtcatgagtgtgtacgccactattgttaacattttgaagtaatatatggtattactgttaaggtcattctagtttttgtgagggaaactgaccagcagcatcttcttatttagactttctgaatttaatttgtaccctcttatragtagtaggttactttayatccttacatttagttaagttcctgagatatagactcatttaatatcagtaagccttttagcttctgtactgaaataaaaaattcaagcagtaatttaaatttgaacaaactaaatctaaaatattttccattattttagtttaggagaaatctccataagaaataataacttctttctgaaccagaggctaataaartattttaactttctgctgccctggaccttattgaatgtcccacacagtcccacttccatcattatgggtattttaaatgaaaaa

SEQ ID NO: 4653 - DNA, 598 bp, Bovine  MMBT21194
  misc_feature (1)..(19): n is any nucleotide
nnnnnnnnnnnnnnnnnnnttaaattgtgacatcatcatccttttaacaaaaatggcatatttacattccctattcatctggaaattcattgcacacctggaaaatagggagacaaccagaaacatttaggactctttagctttggttgcagattcatggcttcattcatcaaatgcccttgcttaggggttgggggtcccaggcctgccctcagrgagttcacagtttaggggggatatagaagtatttagggcagccctggaactaggactgtattgattggttgactgattagttcrttcaatgaatatttattgaggatctattatgtgcatgaaattgatacttaaattattcatattttgcactcacgtattggttttaaaattggaaagtgccttgagatgtattctataaaaacccaacagatgtgatttgtacatttctaggacaaagatcatctacaaaccgaaaattagattacgattttgagcatgccccatgatgtcctgttttgagtgagagctagacctgtgcacactgtatctctatcctggctacacsatcatctgggggaggtgtcaagaaggatctatg

SEQ ID NO: 4654 - DNA, 600 bp, Bovine  MMBT19818
atttactgtgtaaaggttatttattggacatccttgcttcttccatagaatttagtatgataaagttaatttagtaagtactcatatttgcttcatattttttactgttcttagtgagaacttttatataatttctcactttacatactcatatatctcaatattaaataagagaatcaaactaaattaagtgatatttaaccaactagatattttctaatttatcatttatatcattacttatattgtttaataattcaaatctgtctagctgtctctagttaacctatatatgaaacrggtctatagtaaattattccttttgtkagactacctaatacaaattaagcttgttttatattaaatatgtattacacataaattgatataactgcttttacaaatctttaatttagatttttctgtagggaaagcgtgccytcctcacatactgactatttaaaatgaatgaaagcatcccttggaagtctcackaagcaccgaaaactaattagcacatctagcggttaagcttttgtttattcctttattctcagaactgactgcttgagtaataaggtcttcacttggatctagcat

SEQ ID NO: 4655 - DNA, 510 bp, Bovine  MMBT20339
tcgtttaatcctgtaatgaccctgtatcacggacggcattgtctccattttgcaggtacagaggctgagacgtagagaaatacaaacttgtgcaaagtcacagagcttgaaggtggtgtgtggattggtacccagggattctgacactggtcrgcattagggaagggcaggaggtggtcctaggaggactcccctctctccctcagtgtccttagtccattcctgacgtcccgctgtgccccttcgcccggggttcgctccaccacccaggtgagctccgccccttcagactctaaggtytgccacctgaggcacccaccgcccttggtcccagcttgtcctccggcaaccccctcccccgcccctgagaggccgggcccccgaggctgtgctctcacctgaggactgcggccgagacgagccactttgcactccaggtggctgttcaccagcacgctgtgggcagagagtgcgcggtgcacgaagccgaagctggataggtactgcata

SEQ ID NO: 4656 - DNA, 600 bp, Bovine  MMBT01190
ctactgatggcccctcgtgtcaacaacctccagttaaggcatatctgacaagttccttgttttctcctgtaacgatttcccacttctgcaggcttttgtcgttcagttgctcagttgtgtccaactcttagagtctctgcagaaatgtgtcgtggtggctgactctctttctataacaagctctgaataaatagctttgcttgatctcttttggttggtcttcatttactccacactgcaaaattaaatgaaagagttaggacagatgattctgaattctagaaactggatgtgctaaakctatctcagaagatccgatctagctgctgctgccttcatgactggaaggggtttgtatggttcctgtgtcaccagctttggattcagaatttgaggtgagcatatcaattggaaatacccaggtgatgtcagtgaaactggacaaggcttccctctgatggaggggtgggctcagaaggcagaggatctcctaaagctacgaatgagatccagctgcagggtggctcaaagaataaaaaagtctgctgaacctttcatttctaccatgccctaggattgccccaacttcttattttcaag

SEQ ID NO: 4657 - DNA, 600 bp, Bovine  MMBT22119
gacctttcatgtgagtaaatacattctggagtctattattagagtaggtttttttgacttttttctttaatgcttcctctcaccaaccaccacccccccatcacaactgtaatgtatacttattgtagagaattcagaacatacagggaaggaaggatgaaaattgcccattgctctgctcatttgaccaccccccacccatagacttgtgtccttctctgtcttttacccacccctacaagggtagaaaattggaagtcgctgggtcccccaagtagggccagcaccatggactcaggrtttcctagtgagtaatggtccatcctccacttacaatagggtctgtgtcccaaggtgagagaagcagtcacctgccctaggtcaggtcagtgacctgattgggaagggaaagctatctcctggtggctgaagatgtgtttctatcatacctctctttatgctgaagtctgatccttcatggatcctggccctgatccaggcatgatgacaaagcatccagcaaaggggagaggcccctctttctcttcagggaaacggggaggtagccacagacaatggctggacctttgaccacctttc

SEQ ID NO: 4658 - DNA, 600 bp, Bovine  MMBT06978; identical to SEQ ID NO: 4506

SEQ ID NO: 4659 - DNA, 600 bp, Bovine  MMBT01037
ctttccaaaaaccattcatgtgtactctgtgcaatgatctagtggcacagagtgctgttaatatttctgccagcaagggcagtggagccactagtaaaggagacttgaaagttattgtactatgtccagtgaacaaaaattttccttctactagcctaaatgttgacagagtgaagggtcagtatgtaccagaagggaacatgatgagattttgaaaacattataagttccagtcctgtatataactccttctgtcttatggattaagcatactgagaattattttttacacctattcaytagatttttgcctacataaattacaaactttgaacattctttatgttgaccttccctttatagtttgacttttgatgacatggctttccttctcttttgcctccatgagttaacccatctattaaaaggcttttaactaagaaatgagagttaaaggaaatgagaacaatttcccctccttttcagaaaattaccacggaaaattaccacaacttattctaccccatcagaaagaggaggagggaatgcaaattggaaggaaaatttaggagaagctatctatgagtactcacattactt

SEQ ID NO: 4660 - DNA, 600 bp, Bovine  MMBT04404
gtctgtcttaggaggaaacagatggcatgttctaactaggatgatttgaggaggttttagtagagagaccctatgtaaagtcatgtcaagggaaggcccaaagcatcacacagtaccccagggaaagctttctcacctttaggcccaaggaaccgaacctgggagaagagagccaagcaacttgaaaggggccgggagctttggttgtggtcagtttttggagacactgtaggtagaaactgggagaataaatactctggtctccttctcctccattcctttgatcttgtattggtgctyagcactggctggaaggcaaggtcacccgctggtgcctcccagggcatggggtaggctggagcgtggtggagagtggatctgcaggggcacgtggaagatatccagtgtaggtctaaccatatgttttccagtgtgtttgtgtatgtatatttatgaatccagtgggttttcattgttgtctttttttttttaatatccttgggatcatatcacatgcctcattcagcaacttgtggttttcactcatcagtgtgctggtgttctttccatggcagtacttcaagatctacctcattctgc

SEQ ID NO: 4661 - DNA, 598 bp, Bovine  MMBT05780
  misc_feature (1)..(91): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcaccgactcgatggacaagagtttgggtgaactctgggagttggtgatggacagggaggcctagtgtgctgcaattcatggggtcacaaagagttggacacaactgagcaactgaactgaactgactgaatgataaccctaactacaatattacaaattattatttctcactttaaaaggtgcccaaagggtgaatgttccctgcyttaggtagagtctaggtcagctaatgaggagatcatgatgggcagaacagagaggccacaggaaattgcactcctggctcttgagtcagctcatgtttaccttccagacttcgcctttctcaggtaggcaaaggatataaaggacwcttgttgctaacatcagggaagaaattgcactctcctatatatactactcatataggagagagatatcaacaacctcagatatgcagatgataccactttaatggcagaaagtgaagaggaactaaagagccttttgaagatgaaagaggag

SEQ ID NO: 4662 - DNA, 600 bp, Bovine  MMBT09020
aatactttaaaaagttacaaatatttaaaagttaaataaaatatatttttcctgtaaccttgataaatacacctccataacaacttataaggtcaggatcaaattttatatcttggaactccttggagttctgtactggaacatggcatggggggagcaccagcccctgccccagtctctggtttttagccaactctccttctcttcccatccctggctccacattgtaccttaagagcccccttacacatggacaccccagcctatatgtgtaaggcctaggtatattcccatgaatgracccagagaagcagaatagggcctggaagcaagatcagagctggttggcagataattctggggttccaggtctaaagggcatggtgggaggggcacatggtttccaggtagacatattcccttggtccctcaaactccacaccctgtgggcaggaatgcagccaaaggaaggccagagagtggtcatctaaaacaaaaggctcccagcctgataatatatattagtctcttcttgttcctggggccttataacccataagtaaatcatcagttcaagatcatctaggtttagcagctttg

SEQ ID NO: 4663 - DNA, 600 bp, Bovine  MMBT10400
ctaagaacaatttgtttttcatttcccatgaactgtttgatgctatcctttaattcattttttwattttattttattttttagctgcaccatgtagcttatgggatcttagttcccccatcagggattgaacccaggccctctgcagtgaacctcagagttttaaccactgactgccagggaattctcctatccattcttrttttgggttagtaatcattttgttattcacagaaactcttctttccccagttttattcagatgtagctgacctacagcgctgtgtgagtttagggtatrcaacataatgatgtgcctcacatacatgtcatgcactgatgaccacaagagatgaatgagcatccgtcatttcatattgatacatttaagaaataggaaaaaattttttttcatgtgataagaatccttaggatgtagtcttttaacaacttttatttgtaacaggcaacagtgttgatcatctttatcatgttgtatattacatctctagtacttattttggagaaggcaatggcaccccactccagtactcttgcctggaaaatcccatggacagaggagcctggtaggctgcagtcc

SEQ ID NO: 4664 - DNA, 600 bp, Bovine  MMBT00719
taaactactttattctggggaataggtatttgatgattaagttagatatggactggatatttattgagataatctggtgtgtttgattagatctaaatcttcatgtatgtataactcagtataaccttaaaggcaacttttcagccaatgcctgatttctattttttgattccatttgctgaaatctaaattagaattctttccatttaaatgcagattcagactttccacctgaggggcaaaagaagccatttcttttgactgaaaacatatataggagatatatatatatatagtttmattcacatgaatgaagtttcatttacatgaatattccttcccaacacaggaaggtattttttcttctgatttctagaatgcttattgcaataattttataacctccttatatttgcttcattgttttgtgctaaaagttcatgtgctaaataaataagctaaataaaaattaaaatttcagtggacattggaaaggtgtgtggaatttttaaatggaagtggtgaattaaatggcactgagtaaccaaaccaaaattgaaatagaggatgctgaaaagctaggcacattcatatgctgac

SEQ ID NO: 4665 - DNA, 600 bp, Bovine  MMBT20352
ctgaacaaaacctgcccgtgacccagcagtcctcgcgggggcagcagtgtggcccacaggccgggcttccgcctctgggggcaggtctgctgggagaggggcaggtcctgttctgctccagggcgctgcctctgctccatgaggacccacccacaacctcggcgccaggaccacctcggcgcgcacccaccgcagccaccgagaagggagcggcaggacagcttttggcacctctccttccccgacggctgggcttcagaaggaaacatggactcacwggggccaccaaggacgagaccrtgcaaatcacctgctcggatcccacactcaccaatcagctttctgatcggtggtctgctgtcctgggcacttggtactggcagctgctgctaggtcacttcagtcgtgtccgactctgtgtgaccccacagagaggagtctgtacatacacactgccttttaaactcatgaactggcattctgaggtagatacatatataaggtcctttttctcatcaagttctttattcttcctagaaatttttaacagctttatagggatgtaacttgcatatcttaaagtttcctgtttaaagtata

SEQ ID NO: 4666 - DNA, 600 bp, Bovine  MMBT20774
tgagaggtgcagacaccagggcgtgcaaactgtggcctgtcataaagcccctttgaatgggaacatggaggagctagagcacctccacctgaggctctcaccccacatttacagatgcttccaggagacttcttccccgaggccctcttcctctctggggagttaccgakccccacccttcaggaaggtgaccaagatgaacaattcccagaaatcaggacagagtgcagggcagccctccctgtgacctaggccttagctgacsttctggagtaacagggyccagagggccaggrtgarttcacagctaagcccaggtgccagagaagtgaatctaagcccaggcctcattctgcttctgtagcttctgtctgtgtttatttgaagttctgcttttggtggtgatggtagtagttttgcatctgcaaatgtaccaaaaacaatgtctttaaacactagaattatactcagtacaatagaaacaccatgaggtgcatcagggaacggagatcaaccaagggagggaggggatccatattacccatttcacacattctccaggacatgtcctttctaagtggagtggcaggtgaaatcacc

SEQ ID NO: 4667 - DNA, 600 bp, Bovine  MMBT09861
ccatggattttcagttcttctggttaagcttgaatttaagtctgaactatatgtcgactggatgactgaatagatgctgggaagagtctgaggagagacggactgggcatctttgtcccctttaaaaaggcagccctgggattttcctgatggtccagtggctaagactccacgccgggtactgcaggggacgtgggttcaatccctggtctgggaactaagatcccgaaagcctcacagcctggccaataaataaataaataaaaataaaccaataaaatagaaaggcagcctcgggayttgcctggtggtccagtggttaggactttgcatttccactacaggagtcatgagtttgatccctggtcagggaactaagtggagaagcaaatggcaacccactccagtgttcttgcctggagactcccagggacggtggagcctggtgggctgccatctatggggtcgcacagagttggacacgacaagcgacttagcagcagcagcagggaactaagatcctacatgtcactcggcgtggccaataaataaataaaaattaaaaaaaataatgcaatgaaatataaaggcagcccatgg

SEQ ID NO: 4668 - DNA, 598 bp, Bovine  MMBT08916
  misc_feature (1)..(186): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcttttagaaactaaaatagtataatcgctttctacccctgggtgtttgcataagataaatgaacacatatgtccacacaaggtctcacacttgaatgcttacagcaaattygggcattacataacacaaacataacacaaaactggaagcgaatagattaacaatgcggtaccgcctagccttaaagaaacaagcaaatgtgacatgaaacgaatcttaagccagtaacatcagatgaatgatgcctctccaagaagcctctaaaatactaaatgttgttttatttcatttttgtaaaattctataaattataaactaacccactgtgacagagagcctagtagccacttgggatggagaagtgtatgtttcccacaatggaaatagcacagggaaatcaccttgagca

SEQ ID NO: 4669 - DNA, 600 bp, Bovine  MMBT05489
cagcctccgtgctctgggagcaaagagggaggatttgctggaaaccttgaaagtggtgtaggagagcaggggaagggcaccctgctgaaggaacagttcgagcaaagacacgaggtatgaagtgcagggctcattctctgaagggcaaacagcgcagtgaggttaactccaagcaagtcccaagggagacagagagcgatgagggtggaaaaagaaggttaagggttgggccagaccatgagggccttgaatgccagaatgaggagtgagatggcctggggaaggaaggaaggatgtgarctctggggacttctacctggggccaattgagggggtgtcctgacccacaccaagagaggacgtgccctgagttcacccttcaaacaagcagtgtcttaccctcaaagctttcccggcttgacgcttccagctctgccatccttccctcccccagccagtcctataagtgagtccagatggtcattcctattttaggtcggggtgtgtgttggggggaggggtaacctatgagctctatcaatcctctcctgagctgtctgttagaggagcttcttccaggacactgctgtgatcctctga

SEQ ID NO: 4670 - DNA, 600 bp, Bovine  MMBT13698
ccatgggattctccaggcaagtcctggagtgggttgccatgaacagcacagagctacagagaagtgtacagcagactggatacagtcaccgcaggaaggcaagcaatctgtcatcagtgaaaagcctaatgacatcccattttagaaaacatttgcccagctggccacttcggagatccagaggtcactcctgccctcagtgtttccagtgtctggctgggcatgagacactagtcattactttccaggaaaccccacgtacagcgtgatgcccagaggccaggaccacagaactggcascatcaccgcagcgcaggttgcaggtggctgcctgamacctctgtactacccgaaatcctaacctacctgaatccaaaatgcagaagcccatctcaaatctaattcctggctaaaaaaactgtggagccagaaaaagaaaattgagcaattagacttcagtagggaatctggacttagtgatagatcatttcattcatcatcctgggcaagtaaactgctttccgaagctaccaacgggctttcggccaaacccccacttattgcagtctccgcaagaggcagaccggggcatgatgtcag

SEQ ID NO: 4671 - DNA, 600 bp, Bovine  MMBT11974; identical to SEQ ID NO: 4507

SEQ ID NO: 4672 - DNA, 600 bp, Bovine  MMBT21760
tgccaaggaaagaagatgcactgagtttttaaaatgagatgcaggacacatctgtcaaacccacagtccccaaaatgatgactttctcgctgaaatagcaaatcaacatttaaagaacctttcctagttcctagtccctttcataggacaagatgatttcttttctccacggatacaaacagattttaaaatcggcttgttcaataaaatcacccagatgcactcctgagtgtatgtaggcccaggccctgcaaaccctggagaggaatgacagataatgtactaataatgtgatgtatygggcgggggggcgattcataaaatatttatcctaaagcagaaaatgtgtctgtctgccttgttcatttatcaaataatagtttaggggaattaggtaccagctgaatcccttagtcagtgtggttggtctcacccagagtccattagaccaggttatgtatctgctgaggacgaggcatcctgtcagcagtggtgcataatggatcatgaaagataaatgggattaggcaattgaataattagaggagcgcccaccagcacggttctaagtaaagggccgcagggatttccattagaaac

SEQ ID NO: 4673 - DNA, 598 bp, Bovine  MMBT23513
  misc_feature (1)..(179): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtcaatcaaagtccacatgtgaatgtcgatggcagagatgcttaggtgctagtgccagagtgaaaacagaaggttaatcaggtaaaagggtgactctccaggggtagaagaagcatgayttttcccactcataatcccattaggaaaacctgcctgtcgtccttgactagagctcgatgatgatttaaaactaagactttagaataaattcatcaggagggaaattggatttagtttgatacacacatttgttgttacagtttaattagaaaataatgtactccacatgaggatgaaagaccataattcgaaagatgagctactaggaattctgaatataatcttttctcaaggtttttccctaactgctctatttatgagtccaaagcactcaagaacctgagaaattagtaaaaa

SEQ ID NO: 4674 - DNA, 600 bp, Bovine  MMBT07528
aagactcgactcagccaaaaataaatattttaaaatatcccaggatttaaagaattatttaaaagaaaaaaaaaaaaagaactaccttggctctttaatgtatcctgctgtctactctctaaacctttatacttattgctttttctgcctggaacattcctgaggcctgcttacctccctgccctgcttttgattggctgggtcgtgctcccaagtcaggtctcagcttggccatcacttcctctgggattcatgtgtgctccagctacccagagccccctatacatatgtcaggtggcygactgtatattatattgttagcttgttaactgtttgcttattagttatactggaggctctgtgaagctggtcttgcttatctcattcaaaatggtatgccttgcacccaaaatagtatgaacagcacctgccatggaggacagctactttgtgcacaaactttcttgaatgagtggaagaatgaattcatgaacatttctgtaggagacatatattagttacccttctagaattaatattaagataggtatcctagcataaaactgtaaaaatttgataaacacttaaaaaaatcaccac

SEQ ID NO: 4675 - DNA, 600 bp, Bovine  MMBT03387
cagtattcttacagaggacagaggagcctagagggctagagtccatgaggttgcaaaagagtcgaacatgacttagcaactaaacaacaacaaaatctcttcagaggagcaaacttgtagatacctaccactgtttctttgggacatctggagaagaaatctctaggacaagaagggatggaaagcttgatttaaattttaagagagtaggactcagctgggtcctgtgaggggagaaaacaaagtttgtaaaacagaatttcttggaaaaggtaaagattgtgttttttaaaaactatrgttgatttacaatattaattttaagagtgcagaaaagtgattgattcagttatacgtacatattcttttccagattcttctctgtataggtcattataaggaattgaatatagttccttgtgctatacagtaagttcttgttgtttatccattttgtatagagtagtgtgtatttgttaatcctacattcctaatttactcctccccccttcccctttggaagttacaaatttgttttctttgtccataggtctgttttataaataacttcgcttgtattattttttagattccatatgt

SEQ ID NO: 4676 - DNA, 600 bp, Bovine  MMBT04845
tgaaaaccatccattacagaaagtggtctgatgtcttcatgagggacttgaaaatacatgaagggactcttgcccagtgaaccacagtgctgaggtgcaaaaagtcagaaacacagacggcttagtcaggcttccttagtctaaaaaaaaaaaaaaaatttttcctggaaaaaaaaccagtgcaacatgttgtgcctggaggagagaacaaaagttgttatttttccttaatgacagcactggattctgaaattgagcacagcaggtaggaagagcatgtgtaaatttcaaaagatatcyaaatgttacacaggcacctcccatacggatgagcaacacaaaacgtattagcaattttctttatttttcccaaaacaaaacgttctgagaaaaagaaccccctctttttgcctctctctgccttgatttactgtcagaaaggagagatttggctctgatgaagttaggggctgggaaaggccaacctgcctgtctggtaacttctcaccttcaattaattcccagcctccggggatgcatctcctgatcctctctttgtttctataattgtcacttttgtttgttaaacatatccctgtg

SEQ ID NO: 4677 - DNA, 600 bp, Bovine  MMBT23006
accccatgaatcgcagcacrccaggcctccctgtccatcaccaactcccggagttcactcaaactcatgtccatcgagttggttatgccatccagccatctcatcctctgtcgtccccttctcctcctgyccccaatccctccacttacctggcagattggagcattctgtgtcttggtgtaatgaagcatcatgttggcatagcaaaaaggaaaccgccctcctgacaggaattcggtctcagcggaagcccatggtccggtgcggggcgtcgcctgggagtggacgtgtgtgtctgtrtgggtgtgcagccttgtttctgatgggaagtcaagaccaaactgcccattwyatcgcttaattccacctgatggtttcctgaaacgactgttggagagcaaatccttccctgtttgcaggatcttttattttttaacttgtggtttttctccccccaacttttgctttggaaacatggaaatgatttgtgcagaattattttgatgaagagtaaagaactgaaagggtggagtaaatcagtcaccagatcattactgcagccaaaacccactggagccaaaagctgctggctcatccgga

SEQ ID NO: 4678 - DNA, 548 bp, Bovine  MMBT01611; identical to SEQ ID NO: 4501

SEQ ID NO: 4679 - DNA, 600 bp, Bovine  MMBT13670
gccgtgctgctggctctggccagggcactctggacctctttggagagcctctatgggtgggagtggggacaaagtggaggagacctcaaaacagacaggcacaccctctgcccgagccccaggtctctctggggttttctgtctttagttggtgtcagatctatgcagggagttccagggacaaggggatgagacctagctccccttcctcccccatctccttctagcatgatttgctgagctcagacaacagactccagctgggatttggggggtgagctcctgagcctctatctcctsagggatgggccactgatcgtgaagttatctctagtattcagaggaagttatgcatgaccatacataatcttctcaaaaaacgagtctcgatacctgatcctgagctggcataagagcagggatgctctggatgggttgttcaggttgtatactgcacaagaaacactacctattaaggagtcaccatttacatccagcaacatacattatgtgagagactgaaaactagcacagagattccagaactcttagctgagttctagatggtggtgggaagtcacaggctatgaaatctgccca

SEQ ID NO: 4680 - DNA, 598 bp, Bovine  MMBT08185
  misc_feature (1)..(20): n is any nucleotide
nnnnnnnnnnnnnnnnnnnncttagaattcgtcttcgcttcctcttctggattctcagttgggatgaagtcagaggatggagactgaccacgcccttcctccttgacccctgtaaaatttcttggaggctccccagaggcagccagttcctgctggtggaggagcatctgactagaggccctgggaagcccccaggcctgttcaggatgcgccttttcttcactctccaagacttttgccgttatcccctggcttgagtgacaccaggcgctggttcctgcctttcacaccccagcaagyggctatttcccagaggtcttagaagtgattccatcctctttgtggctgtttcgtatttcagttatcttcaggaaggagcatatgtctgggatctttgcctggctgtgaaatttcatttccatttctttacacctgcagttgcagcgtgagtggaagacagagccctgctgatgtcccagacccaggttatcaagatgctttagctgttgtttcccagaaggggctgggkccctagagcagatttcatcagctagggctttgtgggggccatctttttttttttttytctctctctctc

SEQ ID NO: 4681 - DNA, 600 bp, Bovine  MMBT17611; identical to SEQ ID NO: 4503

SEQ ID NO: 4682 - DNA, 598 bp, Bovine  MMBT00898
  misc_feature (1)..(90): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgttacaacataaaataagacggaggctcaaaaccagagtgggcgttaatcagggggtgagagggaaaccgaacacacgcataggcacagagatgtgaaagggcttaatcttttccgggagcagagtggccacactgttctataagagccggaagtaggacaccagctggatgaaaaggaaaggagggcccagagcatctggagagytacatactgggttgtgtactttagcctatagagtaatggtttccaaaactatatccctcaaaaccctattgcctgggatgttcaaatatcayctccttggagagccacgcctgcagacagtatgagttgctctgccttgggtcacttccagtcctttcgccctgccgccaccgttgctattgtgttaaattcctgtctctgcaggcacaaaagctggaagaagatggttctcagagtcagggcactarcctttgaatcatgagtatgctatttagtgtttttgagcctcatctctttt

SEQ ID NO: 4683 - DNA, 600 bp, Bovine  MMBT08830
cggcccccaccccctgcgcccccctccacaaagcagaagggggtctggagtttgcaacttgtcacacggagaagagaaacctttgcgaggaggctgctaatgaattcggattgtatagttttcaaaatctgatgttttgcgatgatgacattagtgtggcaacggagggtctggggcgacaagtctgtgcagctgctcccgctttgagacgctccagacaaaggggccagtgttcccggagctgcggctccgcgccgcatttgcatagtctgttctgcctgattgaccagcggggctgcmgcggggaccagctttgttccccgatcactgggagatgcccggatgacaaggctcaggtgagaggctaagtgggccgggccgcccgccgcacaaagagcagcctgggaaacccggcggggccgccgccgaccccagagtggatttacttgtttgcttttaaagacctcatcaagtcgctggaggggaaagggaaggcttaaggatttcaacaggaatttacaatgccttatttggggggcaatttgggatccttctttatccaacaatccaatgattttatggcacttggtttccctgtat

SEQ ID NO: 4684 - DNA, 506 bp, Bovine  MMBT07100
tatttttgtcttgaaaacagcttcttaatttaataaatctgttatcctaaaaaaaaaaaaagaatttgaaagggaaactaattgctcgctatctctttggggaatctcatgacagtgcaatttgagcacagataaatgctaacagggtacactgtaccactatataggcacatttaacagtaatctacactaatgctaagctttctacgcaaaaacctttccttgaatttttaaccccaaagatccatgctttaggtaaataattctacagattacctgctacaaaaatgtagggaaaamtattttaatggattgttttcatgacgaactggcatttatatctatataggaaaagcttcactaacttagatcttacttattcagaatttgtagttgtttagacattgtccaggctttctgcttttgcaatatctattaaaatagggaacaagttataaaaattaacagtgtaagcaacttttgcaatggagaagcttgatgcagca

SEQ ID NO: 4685 - DNA, 600 bp, Bovine  MMBT03939
aattgattcttaaaactgttttttcattctgaagtccagcatttccctagcaggaagtaataggacatcattttcaaacatgtgacttcctttattacacacttgagatttcagactttaaatggaattatatgcttgcttctggtgaatcatgttcctgcatttaacgggctgctagcatttgaaatcagaaaggaattttcccttagaacactttcaaaaagacatggatagtttcccgccccctgctcttgggaacagggagtggagattaacattagtgaggaatagaataaaatyaatgtgaaaggatggacgttttgatttgtcctttcatctccagctttgtatttcaccctaagacttggcatatggaatatcatttcatcttgaagctcctcagtggttgaatgacttttgactgagttataccctcctcagtacaggaaaattgattgygtcctgggctcatagaaactggtagttatgccaggagacttgtaatgcttgctgggctgtgtaaaaactgtgaaatgtggcaacaggaaagacagtaaaaggaactggacatttctttatggcttgcaacttctatcctag

SEQ ID NO: 4686 - DNA, 598 bp, Bovine  MMBT11002
  misc_feature (1)..(210): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtctcccgtgttagcaggcagattctttacccctgagccaccaggaagcccagatcatcatcattatcgggcagtagtagtggcaayttccgccctccccccagcgtttgggtgcaggtcacaggaagtgctcagtaggtgtttgttgattgactgaaggatgttagtaactgcctccttctgtctcccctaagccatgcatgggacattygtgattctgctgccgctcagcctgatccttatggttttcgggggcatgacgggctttctgagcttcctcctgcgagcctcctgcctccttctgctcacggggaccctcttcctctttggaggtaggtgcccgcctggcatggagccccaggtrccgagagggtctgtgcayggt

SEQ ID NO: 4687 - DNA, 600 bp, Bovine  MMBT11126
ctctgcttgaaggtaacatttggaaccaaagttaccatatataatctattagtggcccatctaagattttactgcagagacataagcacagggaaatcctgatgagtatatgccaggtacgcttatgtaagggtgcttccagtgtatggtactaactacaaaattatgctcttctactctatctcagaggctccaaagattcgcatcccaaggcacctgaagcaaacctatatccgcagagttggagaagccatcaatctggttattcctttccaggtaataattcagggttgttcactktctctttacaatgctggggtgtttaagaagtaaaaggagatacttcagcatttacgttattcatgattcaagattttctcagagaaaaagtaggaaatgatggaccagatttggagaatgactaaacaatttcctgctttagaagtactgaaatctataaaactgtcatagattttccaaatgagacctcaacttgtctgaagctcaatgactgtagtgggccagagagcaaataccaaggacacaccaaaacaagaaatgcttgtttaagatcttaaagatctttttgggtctattcat

SEQ ID NO: 4688 - DNA, 600 bp, Bovine  MMBT14312
gacgcaaaggcagggagttacaggcctgtgcaggcacacagggcaggcccccaccagctcccttggccctgctggccccaccctgcccaggaccgcaccgcagggtcttggccgccatagactggacgatggcgttgctctccatgagcaggtccagggccttggaggcacagccgacagcagcagggggcaggctgttggagaagaggtagggccgggcacgctgccgtagcagggataccagggccccaggcccagtcgtgtagccccctgagaacaagggtgagaacaaggagccasagcttaccccatggtcctcctgagaggaccgtccatgctgtcttcttccctgcagccccaggcctccccttcctacctcccccaagtcccctccagggccgtgcatgcagataaagggagcccaggggcccaagcctgcaggcacctgatgctccrcccagggccttccccagtgtggagttgatgatggtgacttggtccatcacgcccagcagctcatctgtgcccctgcaagggaagctgccactaccaccacggccacctgagcacctaggctcatgggttgggcgtaggggctgg

SEQ ID NO: 4689 - DNA, 452 bp, Bovine  MMBT22366
aaccttagtcttgactgccccctcactcccttctctcaggcctggacagccgtcctgcttctgaactaggtgtgatgataagatgacgagccccatcacagccscctgcctggttgggggcactgagggctgactggccaccttctgcagggatgggccacgcccagggcaccgctgccccgtagaactctgcacccgcagaacagttctgtgtctgtgccatccagcagtagccaccggccacatgtggcagttgagggcttgaagtgtggcccatgggaccgaagaactgagttttcrgttttatttcattgtcacgtgtttaaacgtgagtgtgaatggccgtgcgaggctagtggctaccatmcctgatggcactggtctggagacttgacccatacttctgacagcctccccacgtactgggagtctccgccaagctcctctttggg

SEQ ID NO: 4690 - DNA, 600 bp, Bovine  MMBT05718
caggccgtgtgggttcgatccttggttggggaactaagattctgcatgccatacatcagggtcaaaaaacaaagcattaagaaagaaaggttcagcttgagtaagaggaaaaacaatggcaccacagagacagaaatctccaggtgatgtttccacttctctcctctgagcatgtctaggcctcctctcctaggctcctcctctgatactgaggtttctctgaccttcaggatgcccccacaaggccggggaagagttcatgatccaaacccctcaccctgccctggaaggtcccacacyaccactggactgctctctgcccacttcacggctactgaacagctgagaaycggccagagggaaacctacccrggaggaaagcaccttcacaattcatccagagaatcccaggaatccaggcagggcttttaggagctcgtcaattctctttttctagctggtagctaaagggtgtagacagagaagctaagggcatgcctttccatttcaaatcatttctttttaaaattatttatttatttttggctgtgctggggcttcattgcgtcacccgcgctttctctagctgaggccagcgga

SEQ ID NO: 4691 - DNA, 600 bp, Bovine  MMBT13552
tacaacaaatgaaagccactaaaagtagacacacagagagctgatcatataaaccaggaatccatcagagaatgcaggaaagcacagctgggacaggagggaccagcccagctcctcactctccaaggtgcaaggcatcctctcccgttgcccagccctgtttctgtgcccagcagcaaccaacggctgccccactgggcccctctcctccacaacgcccaacaccagcccacccaactccaagtccaagggccccagccaggggaggtggccaactcagtttaggtcatctgcacaccyttgaatcgatcagctgtggctggcgggctaggagaggcagggcattgatgtgtcagtacattaaagaaagggacttacctacaaatgttatttactgtttcttcaaaggatatgtcaggaaaacagcctgcactagtcagggcagactaaccgctatttacaaaaaccctggaggcttatttcttgctcacatcccagttgacagtgggccagcacggatggtgggggtggggtcaggaggggcactgctgctttgagtcctccccggccttctgggcccacccagtggcaggacgaggg

SEQ ID NO: 4692 - DNA, 600 bp, Bovine  MMBT14869
ttgctcattcttccctctacctgctcaaataaacctttgaatccttctggtaaatttttttcatttcagttattcattcagtacatttcagctccagaatttgtctggtttctttccaggttttctatttttttatttatacttctgttttgttcacatgtcattttcttgacgctctccacatctttagtttttcaagcatctttaagaagggtgttttaaagtctttgtcaagtagatatgctatcaggtctctttgggggacattttctgttgattttttttctttgagtcgacaayactttcctatttcttacatgccttgtaattttttacattgaaaactagacatttgtgtctaataatgtagtaatctagaaatcagattctgtctcttccccagggtgtggtaggtttcgtttttgattgttgtaggctatctctgtgccaaagatcaacctgaggtgtaaacttaaggttttctcaggttttttctgagcctgtgcctttccctgggcatgcacggtcacttttaattttccccatacatgcagttgcttttgaatttcctagcctttaatgtctggctctcaaaagagg

SEQ ID NO: 4693 - DNA, 600 bp, Bovine  MMBT22805
gggttaattaactgttcaactttccatttagtgttctcttcatgtttaaattacattcaataatttttaaaaatgttttaaactttttttttttttcaaatttaaacggagccaaatgaagacgtaagaatctgccttacactgtgttcaagaggccagcagatggcgccccgcaagcccaataggcagaatgagagccttccccgcattgcctgcatccgggttattgtaggcctaatggatagggttttaactgtgtgcatacaagagtaatctgatagccagggccaggttgtttasaattaagtgctctttttgcccttcacgttactgatcagttctatgcagtcaaaaagattatgatattttagtggggcagagatgtaaccagtttttctccattctgctcattaatttctcactatttattcagcactaagaactgagctaaaaaaaaaaaaaaaaaaaatagcggctaaaattagctccactcatccattactagatcatgggtgtgtgtttagaggatatgggcttgtttgccctctcattttggaccaagtggcacaagacctgttaacctctaatgtatcccgctgt

SEQ ID NO: 4694 - DNA, 600 bp, Bovine  MMBT00994
atgcaggttgagaagctgaggcactgggagtttaaatgatttgcccagtgtcacagaactaagaagaggtgaggctagggtcttcccattacactatagcatctcacagggctaacctgtccagtgagagatgcccaattctggctggaataggtacacagcccttgagtaacttatggaccaccagttctcccctctccatttttgtggacagatttgtgcctttyrttgtctgtaaaggagcatggtctttgaagtcaggcagaggtgagttcaaaacccagtgctttatgacctgcrtgttcctcaatttctctgggctcggtgttctcatccataaaaatggatgttgtagtgatgccttagttgggtcgttatgaggattagaaggagttggatgggagatatctcggcatatttctccctactctccctcctgaaaagggttcaggggctgcacaggggttttcagagggcagataccttgaacaatagtggtggtctattgattcagcattttctcacctgcttttttctctcacgcagagacaaagtgaggctaagtcttccatgcaatttgctcagaattctaacactagc

SEQ ID NO: 4695 - DNA, 600 bp, Bovine  MMBT00814
gcatttaataaagattagctctgtttttcttctagtgtcacgtataaacctcatattttgcttgatatttgcagccttccctagcratccagaaattgaaatgagtggyccattagtgagtggaaacccagtcactgtaagctgcagggttcctaatgtgtatccttctgaccrgctggagattgaattgtttaaaggggagagtattatgatgaataaaaccttctcgaaagatktaagtaagaaagccctagagaccaagagtttggagaagaccttcatccccaccactgaagataytggaaatgttcttgtttgtctggctcggttaccaattgatgaaatggaatttgaactcaaacaaaggcagagtacacaaacactttatgttaatggtaagtacatgtgtgatgtattcacaatagattatgatttttttttatcatgtttgccaggtaatagtcaamatgaggttcatagttgaaaccaytgtgaaaaaataattgaaaaraaactacaaaatattgattgtttttttaaaaaaaagcacctccaagcttaaagcaactgtttatttgcttatgattctaagcygacact

SEQ ID NO: 4696 - DNA, 600 bp, Bovine  MMBT05174
cggctgacaaagaggctaaggcatcatccaagccgcctgatggcttccctttgcgaatccagctgacaaccagctcaagcagcatcaaggaaatgaaaaatggagttgcctggaaaggaaatcacagaagagagatgctatttgtgcttggtatgaaattcttccaagtttcctgattagtcattcccgatgtgggaggcccagagtgacagttcatagcagaaaaggtacgaacctatcctcgggggttacttcctcccaacaggcaaagaaatctgtttatttcagacacacactaayaaggtactccaattctatcatctgatttggatacaaaatataaccatagaggcttccctggcagctcagtggtggagaatccgtctgccaatgcgggagacatgggttcgatccctggtccaggaagtgttcacatgctgcaaggcaactaggcctatgtgccacaactattgagcctgtgttcaagagcctaggagccgcaactactgagcccagttgccacaactactgaagcccatgcgccctgtaaccccccagcaaaagaagtcactgcaatgagaagccttcacaccacagcta

SEQ ID NO: 4697 - DNA, 600 bp, Bovine  MMBT07059
ggtaggttctaggagtcctagagcactgaccgagacacaaaaatgggatggggggttttggaggggaaaaatgagtggcttgacaaaaaataggaaccagttatatacagtaacatctgtctgttattttgtcctcatcagagtggagatgagagaggggaaaattaatacaggagctaagaaggcattatgtcatagtaggaaggacatctgactgggagtcaggaggcctagatttgagtcattaaaaaaaacttccagtctctaaagtggtgcaataattcttgccctgtctatctytcggtctgcttgtaacgctcaaattaggtaagaaacttaaaaatatcttagagactctaataaggtaaagtattttcgctagctagattttgagtccttttagggctaagatcatgtctcaatcatatctatatccatggagtctaatacatagcaatagctgctcagtaaacatttaataaacaaatagacttggttcacactcccacccccagccccagccccagccccttgccacactgggcagaatattacctaggaactggaagatgtcggggaacaataagcataagccatcac

SEQ ID NO: 4698 - DNA, 600 bp, Bovine  MMBT08438; identical to SEQ ID NO: 4509

SEQ ID NO: 4699 - DNA, 600 bp, Bovine  MMBT09649
ttttctgcaaagtcagattcctcattgatcctaaactaaggtggccagaaagcctgtgcttcagttttcttctcctccagaaatgcctactcccacgttgtctccttgacacatttggacccttgtttaatcsttcttcattccctgtctgcctttcattgtgttaccatgtttccttgcacagtcagtcacttggaagcatcctccacctcctcagggcarttctaaaccacatcatgaggtctccctggttttctcctcttggcccgtattcctcttctttctggtcacattgactgytccttgcaggagccacttaggcacgtatggagcacttgttctgatggtgacaggacttscctgacactgcagagtgacaggggcagggcttcagagccatttgtgcctctgcacacagtggcacttagtaggctggcattggcacgtgggcacgttgacctcccattcgtgtctgttaggagttgtaatggaatggctttgtatccgagatttgggtatggaggtttgtatcagggtgtggaaagttgccttgagccactgtaaaaggcagtgtagagtgctttggtctgtttagaacag

SEQ ID NO: 4700 - DNA, 600 bp, Bovine  MMBT08542
gatccataatccatccrgggagcagccttctwccatggggaggtacatacccggcatcatgattattaacaacctggtaaacacgatgcrctgtgggtagaatttatcagagcatctcaaagcatgagcaaagccgaggctcctgttctgcaagagtgtgatccctygggaactctgggggctgctaaggaaggtccatcgccccaggcagtgggtggactggggggtcccccagatgagggtgggaagggcaggattcactgctcattcatcagccccaatccagaacatgctcaggaraggactcaggcctgccrttccctcatgacagagccctgggaagctcattatctcgtttttccagactccttgctctcagccagagctaygcctcaccacagagtacatgtggagactttcyttccattgtctctgtcaacctcaaagtaaggtgttttgaacctcattgggaagcagtcctgtgcccactccccccaaaccaagagcaaagtgacagccctgtattcgtgctcaacagagtgtatcactcaggctagaacagggtctgctgtgtaacaaacatcccccctcccaccacac

SEQ ID NO: 4701 - DNA, 600 bp, Bovine  MMBT06711
attgtctgggtttgaatcccaacaccactatttggtgaggcttccctagtggctcagacgataaagagtctgcctgcaatgctgggtcaggaagatcccctggtaaagggaatggctacctactccagtgtttttccctggagaattccatagacagaggagcctggtgggctatagtcagtccatggggtcgaaaagagttggacatgactggtgactttacattttcacatagctatttggtagctttgtgacattgagcaagtgcctgatattttctcatcttttaaatgggagtgrtgatgatgataattatacatttatcttacaggaattttttgtagatttcatgaataaaatatgcagagtgcttaaaataaagcctggaatataataagcactatattggtgttttggttttgttgttttggtaatgatatggtaggaagaaagaagaattaatkggatggtattaatcctctcctattttctttctttaggtgtgaagtgtttttcttactctacaagtctgatcagccttgcgtttctaccatacatttttgcacaaaataatgttatatttggaagtctccctttgca

SEQ ID NO: 4702 - DNA, 600 bp, Bovine  MMBT09384
gtggtccagttactaagaatccgcctgccaatgcagggaacatggattcaatccctrggcccaggaagatttcacctgctgcgggccagctgcaccctwgtgccacaactattaaacaccacagcaagagaagccacctcaacgagaagcctgcacacyacagctcgagtagctcctgctggccacaactcgagaaagcgtgggtgcatcaacaaagacccggctcagccaaaagtaataataataaaatatctgaaagcttcaagaatgctgtggttaacaccattttagagctcatgraattaagayccttggaatggctrtggaggaagatcctaaattgcaaagatttgttgttgccagctttcaacttaagtcaattagttattaatrtcaacctgtcataaaaatgccagcatgttgcatctggctaaatgaggggagaaaagattttatttgccttgtttacccaccctgccctgtaatgcctataatcatgaagatggaataaattgtaacatttagtttctatcattaaaaaaaaaaaaagactagttttgtctttcaggagcttagagtctagtagaggaataggatgtg

SEQ ID NO: 4703 - DNA, 600 bp, Bovine  MMBT06911
ctgcccactgctataaagggaaagcccacccttgacattatcctgcagagattggacccttcactgatctgtcctgctatttcctggatgcctacgctttgttgagaagcttctaaggccccctgagagccagaaattctgtaaaatttgatctgtccatgtagattgctgcccaaagagggttaagagatgaactgtggagaaagttaatttaatctggtgcggagccaggaagtaaatcaggcctgttgccagaagacctactgcagttagaagacaagaccctctcattcaaaatcrcccgtggcaattcgatccttattaaagcgggatgtaaaatcgtaatgtggacattgttgcgattcataaaggattttataaaaaatgtctgctgggtgagttcgctgtccctcttaaatacaggagccattaaactgcctcagtaactctgggaatattaaggaggacttactggggacaataggctacatgggaatccctcatggattttcttctttctcattacttaacccctgccatttaaccccaaagcccagagctccagaaaacgggaaaaagcctacagtgacaaaaaagaaa

SEQ ID NO: 4704 - DNA, 600 bp, Bovine  MMBT10287
ggtgtgcagaatggggagtctggcctctgtttttggaacaaaagctagggttcacagtgtttaggtgggagaggacacccagaaccaaactttgtagtgggtagactggtttctatttcacaagaaggggaattgtacaagtttttattagttggtaacttttgaatatgatttagtataccattactaagagctagccctgggacaataggagctcagcgcagtggaggtggaagaagactttgggcctccttgtgagtggtgggcaggtcttaggattgtctgggaagaggatctgtrtaggtttcagagtattaaggcttctggagaaascaaccagttaagagatacacccaagagtgggcagattttgccaggggtcctagagggtgggggagagcctgaaatgcagccagaggtcagggttccctagccaaggggtctgacaatgaaaatggcccagtgggactacccatggtggcctggcgtatgtgggttacactgaccctccatgggattttgtgtccattgttacttgggctgcaaggccacgcagattctgtgtatttacttttgatgaatggggcaattggttcagaa

SEQ ID NO: 4705 - DNA, 504 bp, Bovine  MMBT09190
ggtcattttacattccgctgtgaactaggaaaagtcctcttagatycttccagggaaagggaaacacagctctgcttccaggaaggtctctagttgggtccctgccattggaaagggaattaaacgttcaatactgggaaagactaatcattacatctgcgtaattatattgatgtgaatctcagagccaagttcctttcagggagctgatgttgggaaacactgccctactcctaggatcatggggaataggatttaggatgtttttaatttctagaaattatcagacatcttcctacrggcaaatttcatgtctctacgtgtttcttctttctctctcagtttttctgatgttcttcctgtctttctataaaacacttcctgacagctggccaagatgcccaggatctttgggctttagatcaacaggagataaataacacaggattgaatacctgccttatcacttgtcacagcttacacaggaagtgggctctggaatgg

SEQ ID NO: 4706 - DNA, 600 bp, Bovine  MMBT09829
caagttgcaccaatagcatgattctggtatttgctttaaagagagagaggaacagtccatgagtcagtaaggaaactgctgtaaaggaattttatttagacatttatttagaattttatttagtgggaaaaccagactagtccgactacattcgtgtaaaataaaggtcttatgtatttagaaaatgctaacaaatgcacaagttgccaagtactggaaatgctaaaagctcagaaaattgatatgaarttcacatgttctactgtcagaaatgtatttgttttcttataggtataaagragagaaattatttatataccagcttgcatattttcttgactcaatataacaycaacaaatcaaatatatgtacataatttttctcatttaaaggacaaacttatgaatccacrtattcataaaatttatcctttaaagcctgagaagagagttatagtcctcactgtctcagctaggatttttttttttttttttttgcctttgattactcaataagaattacacatagaaacagaaaatcaatatgtctacttctgcttattttcaaaattgaacattgctctgtattaatttcagaga

SEQ ID NO: 4707 - DNA, 600 bp, Bovine  MMBT11481
cytggctgcacatttctgcacgaggaagcagcatggaaaggttctgcggagggaaaggttcagaggtgattgattgattggggactgggaccgtggaacaccgcaggcaggagaggccttgtggggtgggtgaaagcaagtcaaagcagaaatccctgggcagtaacccaggtgccctcagattccagggataaagggctgtgtcagacctgggtctgagrggagtgggggacaggcggctctggggagagggcaaactacctacagctcaggctggttccagtcccaagagagctcccrtctctgggagccagtcaagaactaggataataataactactccatcttcactgtccacgttcaccttcacatgaggaacaagatttgagttttattaaaatatgtgacataaatcacacttattatacgcaggcataattctaaagatgtcccaaacattaattcttttaatccttacagccacccattttttttgaaatttgtttatttttaattgaaggataattgctttaccatattgtgttggtttctgccatacatcaacatgaatcagctataggtatcattatgtgcccgccc

SEQ ID NO: 4708 - DNA, 600 bp, Bovine  MMBT21801
cctctgagagcgtgtccagcactcaccaccacccagggggccccacgctgcagctaaagcaggagaggaaacttgagtctgaagagggacaagggacctggtgggccggccgcactctgccttatttccccatctttcctgactctgcccttccggtgattttcacattttctcctcccttttacgttcagaaaacctctggggaaggcagcttttattctgtggcttcatgtaaytcccagggctgggaatgaaagtgatttcctttcacaacccctggctgagtgcctttcacatccyggctgtgttgtggggtgatttatcaatggcaggggccggggctccttccccatcctccctgctcccgccatcacttagaacacgaccatgcccacgaccggctccaaggccagggcgtcctctcaagttggctctgaggccaggactcggtcgaatcaccgtgatgagagccattcgttctcctcccaaagaacaaacacggcctgaagtctccaagtgtcggggctggctttgaaccgagactgtgaaagcacatttttccaaacttgtcgggatcatgtttcctttctagacctttat

SEQ ID NO: 4709 - DNA, 600 bp, Bovine  MMBT01609
acggttagttttcagttccaaggtcactttgttcccgtttccttgaggccagttctcaggattgtgtgagacggaacagtttatatcatggctacagttttatcattatgtagtttacttcttccacctgctgggggtttcagtatctgtaagacagccacaggagatggctcagggctattgtctatatagcccttgagaaggaaccaaagggcctcgattttgcttgataactaaactgtcattatttcgtcctgtttgactcttttcttttgcttctacattttctcacttctcagrttaaacttattctttgactgaagtttttttacagacaaaaggcaggtggaggacatggggggaagggccatagagtcctgctccatttcacaggctataaaaatgttaaccagtaggggtcccctcaaatcacacccaaggaaatcactgcaagatagatctacactaaaggccttgcacaagggggraaaaaaaaatgtttttccatatcttagaatgaggtcccaataacatccctgacttccaccttgagtcataatgcatcatttggtagaatagaaaggcagatcccagaagtgg

SEQ ID NO: 4710 - DNA, 600 bp, Bovine  MMBT01532
gtcacaacagaaaggatcataaacaccacagttaaattttagcctcatattgtatgtttttaaaaagaggctgtttcttcactattgtcaatgaaacgtatataactgaaatgtaacttaatattactctctttaaatcaaatttagcaattaatgaaattgctttataattaacaacaacagaaagagttttacgtggtgatttttctctctgtagaggttaacaaatgctggctggtaagcaaccgtcgacagctttcaaagagagtagttcacgcgactctctgaaaatataatctktccataaaacaaaaaacagtgcctgtacctgaaaatttattcactggatccttactcctgtttgtttctgcttctacacgcttgaattgctgtacaatggcactgagctcagaagagcgctgagagattcgatgttcagctattcggagacgttctttcagagcaagaaattctcgttgataagcaatcactttttctaaaaacaaaactagacgttattagtgcatttcttaaaaaaacacataaaaacaccattataatcaaatctgaactggaacagcagaaattttaaagctgcac

SEQ ID NO: 4711 - DNA, 600 bp, Bovine  MMBT02966
ttattacagtattaattgaccctgaatttttttagcatcaggttgcacatgcctatcataatgtgtctcttagaaatctttatttaatattcaaatatattccttattagaagaataattattctacctcaaaaaaaaaagtaccttagggaagttgaagagaattgcttaaattgatcttaatttgtaaagtaaaatattcagtgggcccattactgttaacccaaatcatgttgagatttaggtagctaggaaataagaatccatagggtaaaagttgaattagtactgaaaaaaatkgcttgcagtgtagccagtatatttctgtgtagmcagaaataattttacattcaaaaaagcatgaattattttagagtaaaagtcataaaagattaaagcaagattcacacatgattagagcaacttcacctatattatttgcaaaattatagatctgttttgtagcagaggaaataataaagatttatcttggccttaggatctttattgtaaaatatttttactttacctttaggtgaggttcttttatctttattatttaattactagattgtatgaaaagaatgtaactcttacttt

SEQ ID NO: 4712 - DNA, 600 bp, Bovine  MMBT02691
gctatcaattaatattttatcctcctgaattttactaccaaaaatcagttctactacttcaaagattggcaagttaaaaaacgttgtaacttctttttaatagtgatatatatatatacttacatatgtatatattatttttcattgaaataatatgctttgaatgatttaaaacctaattattgatgtcagttctacatccaagccattctttattctcaagtgaaaaaatggtgttcctgagacatttgctaataccttccggataaggataagatcttttactgccgagttatttaygcatattcacttctcatattgtgtgtaatgtgggaagatgatgaaaatatttaagcctgcctgtgtttctaatcttcctgacggagttcaggagcttagctaagatgacagcatcccaaactacatccggtatacaggttgttgctgttaatatgttaataatggtcagtgtatcttatctttagaaagtctttccttctacaagtgggtccattagattctactgtttagaccagtgtaagaacatcagaagttctcatgcaattttcatatcttttttttttttttaagtcttctcaa

SEQ ID NO: 4713 - DNA, 600 bp, Bovine  MMBT04380
gcctagttcttaagtttgagggctgatgatgacagagaaatcatttcaaaacttaccgaagcacctccgtccattatcagacaatacaaacccagggggacagatgcactggaagcccccaggagtattggtgcaggaaccaaaaagacagatgttgggatcttcatcacactcatttatatctgcagatcagcaagataatwtaytgatttaatcaattcaatacactgcttaatatctgaaaataatttgtccacattgtacagttcactagccattggatattcaatgtgaaacaawatattacattgtctatataattaaatatgtttaaaataaactgytactgcttcaaaagtcaaaggttatatccagtttcaatgatccatatgacccagacttttaagtcggtctccagttctctggacttgactcctaggaggtgtctgcatgtctgcctgcaggcctgagaggaccacttccatgyctcaggggcatcgcatcctcagcaytggtcctcttctctgatgcccctcgccctcagcaatccacactggggagctggggtcacattctttcctctccttaattgttcaactt

SEQ ID NO: 4714 - DNA, 600 bp, Bovine  MMBT06322
ccctgggtgcaaacctatctcatagttttgggttgttaattattgcatagggtgatctaagaaactagatttaattagctagttaaatgttccactaatattcatggcttgtactaggaacggttccgagttctcaattcagtattttcaccctgggaaaatggggtctttgctctgagcacatttcagaagtgatggaaatgctagtaaaagccatctctactttccaagagatgcagtcttgcctcatctctccaaccccagtgcccttggctttctagaagcattaacacgactgtwgttcctctaaaggaataagcctgctcttctggaaagcgagcatttatctcatcatggctgttgtgctgttgcacaacaaagcagctaatcagatttatgaaggccagcccacccagagcagtggctgygtttttatcacatcagagacaagttagcactaggtttcactctaggattaggtgctgtctcacaaattgggcttttcgccagacaaagaagttgcagcatgcatttgcccttttcaagatcgctaataaaatgctgctattaacctctaggactgcatggatttctcagtga

SEQ ID NO: 4715 - DNA, 600 bp, Bovine  MMBT06377
aacttctgtgtgggaagtggctatactgatcctgagaccttcatgcaggtgatctctgatgtctgctgtgtctttgacataggagctaaggttggtttcaacatgtatcttcttgatattggtggtggctttcctggatctgaggatgtaaagcttaaatctggagatcaccagtgtaatcaagccatcattggacaagtattttccatcagactctggagtgagaatcatacctgagccgggcagatactatgttgcatcagctttcacactcgcagttaatatcattgccaaaaaaamccctcatattaaaggaacagacagactctgatgatgaagaggaatcaagtgaacagttatgtatgacatgaatgatggagtatatgggtcatttaactgcattctttaggatcacacacaygaagcctcttctgcagaagagacccaaaccagatgagaagtattattcatccagcatctggggacccatctgtgatggcctggaccacattgttgagcgctgtaacctgcatgtgggcaattggatgctctttgagaacatgggtgcttacactgccactactgcttctaccttcaatg

SEQ ID NO: 4716 - DNA, 526 bp, Bovine  MMBT04858
atattcttgtcagttgttcaaagtggttgaatttgactctaaatagtttcactgtcttaatacattattctgtgtggcaaaaataaaactggactagaattatctaggccaaatgatacagtggatttctaggaagcctaaggcagattggctattttgcattgagaagaagccattggagagtgatagtttaagaaaaattttgttgtgaaatatttgattggggaaacatttttgaaatgttcagtttaacacattaaggtactattatgcgccctccaaatagatttcctggagatygtctgccaccttcaacacatttactgaatttcaacttgaaagtttattgttgtcaggggatagatgtaacctgaattaaaggtgtaatgttagtaaataattttctaacaacttacaaaaattagaactgaaattttaagctttgttactattggaggtagtattaaagtaaaagtgaaagtctctcagtcgtgtccaattcttttgaccccaggactatagagtc

SEQ ID NO: 4717 - DNA, 600 bp, Bovine  MMBT04975
tgtggggaaaggggaagaatggaaagaggcaaggagataacttaactgaagtaaagaatagaaacaaagtctgttttataagaatgaaatcttttgagatagscacccaggaagagagctggtctgagaacaggttgaggatggagactcagaaagtaytgagttgcccagagagacatttcactctacatcaagagataaatgggtgcattctractaaattcttcacacagtttctcctagagtagaatgtgtagttagatatattttcttcacgtgataacttatttgctttaaagratgatgtgtgagagaagaaaggaaatattatcaaaacacacaaactttatgaagyggtttatagcatttggcaaaggagtgacagtgaagagaggtcacctaaatgtgtcatttcaactcaggagcactcttgtgtgcctggtcatctcctgctatcaaccaggatcacacttaaatattcctgcgagatattgataaattcattgataaattcacagttcttagcaacataccactgtttaagatcatgtaaattaaaaaattcaaggacactagtggtaaagaacccgtctgccaatg

SEQ ID NO: 4718 - DNA, 600 bp, Bovine  MMBT04073
aatttaaatggactgagttgggagatcatgatctaaattcagtcaacaagctggtaggagtccagtgactgctgtgacacatgacatttagagcccagagaaaatacagggattcctggtctggtttctgttattccctaggcctgtaaacactgggaaaagacagcataagagacttgaagcaaaacaggtcaagtaaattttatacagctattacattggaaagtgactccgtgggtgacctgtctaaacatgctgaaggaagtaaatcacattcatggaccatcctgacctcgcctytgatttttggtggtgcattccttaagtctgaaaccaagtttaattgatgactgcattgtttagtagaatataagcattttgtcaaagctagagagttatttccaaagtaaagatcaaattttcaagccgagtgagtttgtttctctttttctatctggattttagtatgtttaggcagcggcactttgggatgacaaaaaaaggaagaaatccatgtcaggcttaagaggtgtatcatcatgcgtcaacacaaattgcttttggaagctgtaagtctttgggggaaattatcctaaatga

SEQ ID NO: 4719 - DNA, 600 bp, Bovine  MMBT04170
agtcctgagacttggaacaggttctttgaaaaagagccttttmttccagtaaaattgttccacatattattattttaatttaattagattttaaaaaggttaaccatgacattttaatagcttaagctcacattaatattctgagaacacagtttagcccaaccaaatgtgattcaaaaaggatgtttttccagaaaaggaattggcttttaggacaattactgaaaaatagctttcatttgattcagacaggtatcttactattaaaagatagttattgaaataaaatacgtataagayattgaaaaatgttaaagccttagcatgacactgtttatctagtagaaagggagtctgggcagtgtgtttatggagattatcccaaaggtggctgatgtccttcggcaatgagcgaattagtgaactgtgcttgtgatgtgctgagtgttgtcaacctaatgttttatttatttggctgagagctgctatcttcattagggagtttagagagcaaagatgatatttattagcctggcaaactaataaactctgctcatgtttcttcttttgctgtcatagctaattctggtggtggttgtt

SEQ ID NO: 4720 - DNA, 600 bp, Bovine  MMBT05810
aggcctcaagggaggcagaaacaatccagtgcttcccatagtctgggtcgctgattcaatctgggtctgcaccaagggctcagcagcatcacgtcaacagaaaacgagagttgacatggagtgacgggtcaattgcaaataccaggctcactccacaggcttccccattgtgcctgagagagaatccaaaccacaccaaggctctctgtagtggatggtgtgatgcaccacccagattgtcctgtgaggctgaaggagcccccctcccccaggtattgggcaggatacttgtagacaacygtcagacctcttyatctgagygaatgaacttgtgagagaagaaatgaatgamgaaagcgcatccttccaatacagcacccattaatatggcactctcaattatggagaargaaatggcaccccactccagtattcttgcctggagaatcccayggatgraggagcctggtaggctgcagtccatggggtcgctaagagtcagacacgactgagtgacttcactttcactttctcaagaatacaactgccgtcacgaatacatgaaaaatgttttttagcatcagttttgggggaaaaaaa

SEQ ID NO: 4721 - DNA, 600 bp, Bovine  MMBT08660
tgttaaacacttaatcttcttgcatagtggttctgtgcttttaagaggattatattattaattgtttaattattcattatgcwgcattttgccattcagtaccaaagctttttttaaattaatttaatgttttatccttcttagccgtcattctttgtactgggctttctgttctttcatgataggatgtcacagcaaagaatcaagaggatggcttgttgaaaactaagcctgtagctctacaaatagatcttttgccagagcaatgactcaacacaccacccggcaagtgagtytcayggagctccagagacagcagttagaaatgtatcaccagcgagagcatcattaatcataattgtgggagtsacagtcagtttcttgacctcactgagacaggcagggaggtcagtgcctcaagcagttcatccttcaggcaaggaaaacttttgggatgatttccctttttgttatcgctggcatttttatttaatccagtcattttccccacagtctgggcagaagtacaacagcttctagcaggcacaatctggcccattttctttttctctctgccaaaagtaaccttggcaattgatg

SEQ ID NO: 4722 - DNA, 600 bp, Bovine  MMBT09406
tccccaatccttgtgggaatacaacactctcatgtttctcgtgttctctgtctagcctgctctaagtcacctgaattaaatgctgaaaatggaacccaccactctcctcaccaaaggtatctgttattcacagctatctgggtgggtggcaaccagttttctctaggattgtaaatcatgacagactaattctctttcctttgttcagtgttccaggacacccggaagacctggggatatgcatttgtacactgacagttgctcgcggtgtccttgaggcaaggaaaatgtggaccaggygcactgggtgcaacgcagctaatctgctcagcagctggctttacactygtaataaaaaaggatttgagtgatggcagaaaacactggactctgtcctcagcctggagttggattttttaaaaaaataagccaacacattcctcgttgatttaatgggcaacacccattcctcctttaattagcacatgcctccagctccttcacaccacaatggaagttcaccaaatatatctggttgaacaagwgacttcaacagcacaaaaaaagtgttttagtctgagaaagaaccgcacagaagac

SEQ ID NO: 4723 - DNA, 598 bp, Bovine  MMBT10463
  misc_feature (1)..(50): n is any nucleotide
nnnnnnnnnnnnnnnnnnnnnnnnnnnnnnnnnnnnnnnnnnnnnnnnnnttgttctagatatatttatttttatgacttttaatttaattttatatgattttcatttaactacagatatatgcctttattatgtttttattataaattccatctaaaatttattttacaggataacagattgattatccaaatactatttattaaatgttttaaatatcatcaccaattttaataccttccttttaaaaataggaaaatactgccagtatgttattaaaaaatttcttctacataatcytctttgaactatatataaataatgcatttccattcaatttggggagaagtacaggatttgtattggtgggatttcatgaataatagatatcctaagtataacataatgaattagaaatgaatatctattctagattttttgtttgtattttcatttttctctcatggcactagtacatgtattttaaaattattttagtgttataaagattttcagtgtctgggaatgtaaaactctaccctctccctgtccccctaaaaaaaaaccaacctggccaatttcttattactgtgtgcca

SEQ ID NO: 4724 - DNA, 600 bp, Bovine  MMBT10470
ggggactttcctggtggtccagtggttaagactcactctcagggcagggagatgggttagatccctggtcagggaattaagatcccmtgtgccttgccatgcagtgtggcttaaaaatgaattggaatacagaaaatataggacatgattaatatacagagagaktttggaggttgaccagcattgttacaaatcttggttttgcttgatttaaaaaaatagttttttatcttttgaggtaaatacaatttatagaggtctgtaatttgttttgaaatcatctagggtggagtgggaaayaggtgtaggaaatgtatttagactccatttttttctaaaaataatctaagatgattctctgccagtaaatggttgtacaatgtttcagtaagttacattagctttatgagtctcattttcctcacctcttggataggaatagtaatacttctctcacagataaggtactggagaaatctaaaatagggacaaaattaatattattaataatgtggtatctgsaaatgtsttgtatcttagtgtctgatatgcctggctatgaactaagatgaacataaatagtctgtttcaacaagtatc

SEQ ID NO: 4725 - DNA, 598 bp, Bovine  MMBT10366
  misc_feature (1)..(171): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatactgtagggattaagaccgaaaccaaacagacctgggtctgaatctgactctgacatttattacatgaggggcagtatggtcattcatctgttttagatgcctgaaatctgcattgacttatattygagtaatttcctaccatatgagacaaggtgagaaaatacctctctctctctgcagctgggaagatcacagttttgtttcgtagtcccgctagggtaagggcatgtgatctctagcgccagtgttctctttgcttaagatcctagttccactcagaagatcaattcaccagttattgggttatggttttgtggttagcgagtccaagggaggcagttcgtcagagggacatgctgtacagacaaaaacagtttacttctacaacattctctttgaagcgaaacyaatagaagaatcagg

SEQ ID NO: 4726 - DNA, 600 bp, Bovine  MMBT10281
aaaatcrccccttcaacaaacccaaacaattcattgtcagatttaggggaaagcagcctggcagtagagccctgggatgaaagccaggagattgggcttggtatctctgggccaaactggctgtgtggcccacaasaagtcacttaccatctctgagactctgtgtcctcatctatgaaataagggtgtgagctggatcttatcggttctaacattctctgattctaaatgatcagactagagatggcagayaggagccaaagactgggaaaactcaggatactccagtgtccagcatayagtgggtgtttcacaagttaaaatctgtgctatgaaataaaaatgctttaaaataatttaattatttttcttgctgtaaagaaaactatacttgtagaaaatccaagcaacacagaggaagaagaaagcatacatgcatattgcctcaaacatatgtaaaataaatttccataaatcccattgtccagagaagctcgtttgttgyctgcgctttatgcttaacygtataaatgctcattcgatgctttcttttccaatcacggactgcacacgcattgtcgtcagcagtggggtctcttg

SEQ ID NO: 4727 - DNA, 600 bp, Bovine  MMBT05476
aagacttgtcccagccctgcagcggccaatgaagaattatcaatgccttattttctaggcatagattagagaatgtaaaccagacaatttgtttactgttataagaaaactaccagtttgcttacagaagattatttttgtgaacaataggtttgagttcaaaaccatttgaagaatttcagactcacactcagaaaagggaaaaggaagaagtctgcttaaaatgagtatgtaaaatttgcttatcgtacatcacatttagacacttggctgtgacctgttaccagtatcgcagagaarcccaaagcactgtttaggtacaaacattcttcatataggtaactgtaagaagctagagcctacaacttgctcctccatgccttgctgggagcctctgaaagcactggcaattttaagagtctttctcagggtaacaatgttttcttaataaaaatgttttcagctacaaattcctcccaaataaattgtcttccctttcaaaatgtaattttatgaaagaaatgtagccatttgtcattgatttaggctattttcagtattgagaaatgattttgatctctgtagagttaatgctctgtc

SEQ ID NO: 4728 - DNA, 600 bp, Bovine  MMBT11055
aaaaataaaccttkgaacttggattaytcttctccaattgcctccttagttgccagttattgactttctcttctttctacctcaagtcagaacccctcatttctttctccaccctccccttcctccatgccccaaatttcctctatattacagtgattctccacatgtgatccatagaccaatggcattaactggggcacagggtataagagcaaaacattaagccaagccctgcatcagacctagtgcatcagaatctctgggacaagagtccaacaatcagtgttttgggctgtgatratgctgctattgtgtgagagttactattttatatattgtagtaaccatgcccatgaaagtcttatgctacaggctgaggctcattttgctcaagataaatagtgtatatggcattctatctgttgcggtgctcaatgtagctattttccttatttctgaggactactctaaggatgtaacattaaattaaggctgacaaagacaaaagaaatgagatatgcccagaacaacagataggctttttgaggatggacaaactgcaaaaagtccgtgacattaaaagtatgttgtatgtaagta

SEQ ID NO: 4729 - DNA, 598 bp, Bovine  MMBT06402
  misc_feature (1)..(108): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggctccagaggagaacctggggacttaatctggaaaagtatgggtttttgttttcctttttgatctcaaacaaagcaggtccagcctgtttcatttatacctacttgaaaatttaaatttcatttcaattaaacatttcaatggtaaaaataaataaataataaaactatacgttctagtgacaatgggraaaaaatgagaaagataaaaccattgattctaaagcttagaatggagccagctcaggccactgtcaaaggcctggtcactgagtgagagagggcagagaggaagctgttacagtttgggggctgtgtgcagattctcatgcattagggctgaggtccagcaggaaacctgaaattgggttcagatttggacctttctttgtggagatggcataacttaacagcaactcggttttagggaatgactgaagagaggattgagaaaggagyagagaggaatcttgtrtgcctttccttaga

SEQ ID NO: 4730 - DNA, 600 bp, Bovine  MMBT13913
atacaatagaaaagcataaaaagttttcaaattatttccagacacaaggatttggaacaccccttgctgaaacaatagcaagaagaagaaaaaaaaattataaaaaagaaaaagaaaaaaacagccaaaggtgcagtgtggggcagtaagagatctaaggtttgtgcaaatgtcaggctggggacacagcctcccacacaacagtcttctgggatctgctagtcttcagtccaattgacagggccctggccgtccaggagttcatgggctagatgtgaagacaagatttgagtgcaggamataatctgatggccattcctgagggtccctttggaaatcagcatggctcctggcccttgacagttggggaggtgttcctaaatgcaagcctcagtgactctytagtgaaggggaagtggcctattcccacatatctagccgtctggcagacttagaaacaactcccaaaggtggagccaggaagaagcagatcctttgaggtatagaagctcaaactggcaatccaggaggcagaggtactcagggacttgggtgctgggaccttcagcaaaccacctgacctcttcgtgcttcagcttc

SEQ ID NO: 4731 - DNA, 600 bp, Bovine  MMBT12960
agtgtaagatggagcaaatgacctcatttctttgaaggtcaagttataaattattcttgtgatgaagtaggatgcatatggtccttaagcgaaatctcaactgaaggcttcttgatgaaggcacacagatgctcttggttgcatcttaaaacagattttttggtgttcactggaactacagcaactacaccaggactgatttaagaattatcaattttctagagccaaagtttgcagtgaaggctttttagtggtttccaaaactcaccacagaatggtcatgcttgtcatggcgttgtstcattactaattggaggagcccaggaaggataagtgtggaggtcaaacataggtacaatccaggtaaacatgccaagcatcaccacagcaacacccacaatattaacgccaagtccagctttaaccttgaatatgaaagagcttgaatgttagtctcaaaaaaactaaaacaaaacaaaacaaattgggagaattggaatactgttgcagaaggcatatgcagatttacatgcatcttaagtgactggtatcaattatttgtttcataagacaagtccttccatttatgccaaaaaagaa

SEQ ID NO: 4732 - DNA, 600 bp, Bovine  MMBT14227
caaaatgatgacattttaagtagtaaaaccttaattagacagcagtgaggacttgtagcgtgaagaagggactgtcacggtgtcttcctgtggttaaggaaagggcttcccagctgccacagggaaggaagggggcttcagccttgactctcagagaggctggctggtgggaccctcatccttaccacgagatccttcggatccttagacagtgcaggtcacatgttcctgaccttccttgggagtgaccacccacactttatctactgtcatatctgcagrtgggaggggtgcttttaygatgactgtgacrtcttagatgtaactgtgtaacccttatagcgactgaaggggaatgtccacacccagtggaaaattccacaggaaacaaccatgtcttcattgcactcagtacctatgtatgacatacacgttaagtgaatgttttcttgggttttccaggtctacaatatttagtccatgtaaatgatagaatttgataaatatggtaaattaagttataaggtgtcatttgatttctcttttgctgtctcacgttatttaatgttcctgatgctccatacctggtttgtgcctacg

SEQ ID NO: 4733 - DNA, 600 bp, Bovine  MMBT14232
cttgggaaaactgacaaaaaaagaggtgtagattgcatttcggctgagagtggctgggcaatcagagctcggcmcctttgtgccgctgcatcggaagccactgcgccgggctcgcgcagacgacatttgaaggctcataaatgtaatgaagtccctttgacacctgctcctctcttcactttaaatgtgagccattggtccatggggaacctccgctttaaaaatagaaattatagtaattgtcttccgtgctgtcgggaggctgtaaatgcatggctctcagctctactgcctgcaatygacggctgcaagaattaccccaagttgagattttttgtccttaacaaatcacatgtatgctcgtgctgcgtgggggcaggggggctcactttgcaagttccaacttatgaactgggggtccatgggaaaggtccctctcttccttcctgggtgggaccttagatgctggacctgtgctggtttctggggacaaagcccctctctgctgctcctttctgggcatctggctttgctctgatggccatgcagtggcaggagggtggggggtggcttcctccccttcctggccacagggcacac

SEQ ID NO: 4734 - DNA, 600 bp, Bovine  MMBT14231
cctggactggacagggctcctcgtgcaggcagctgggggccttgtccctgcagagctgactttggctacagacacctcattcaggtttgagccacagggctgggagtgaggttagaggctcaccctgggttctcctggccaccccagctccacggctggagggaaaccccagaagcctgtccagcccggccagctctcccaggctgtgtgccctgggtcatcgacttccatacaccctgccctggcctgagggcctgaactaggtctctaccccatgatgggagctaaacgcctgctaaytctgatggcccttggctgacatggggccttamttacagggtagaagggctgggggctgccaasagggtcagggtccctaggggatggttgcacgtgtggccctgaaggggaagcttttctccatgggcctggtggggatagaggaagtacagctttaccaggagggctatcaaccgcctcttctgaccccactttcaggattccatgtgggaacaaggcctgtggcaaaggccgtttcagaggagggaggcccatagtacaggcacccctactagaggcctgggggctgcagggctgcgg

SEQ ID NO: 4735 - DNA, 598 bp, Bovine  MMBT14428
  misc_feature (1)..(137): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgcaggaggtgacggcacttgctttttggtctgaaacttcagagtcatttctgtacatcttagaaacattaagacaattgtcagtccttttgagaagatgtgagggctccaggaagagcagccttgctgaaaagaattgaggtgcaatagggagagaggyggtggctyttgcagaactttgtgctgtgactcatgtacaaccttttgcaaaattgaatgtggcaaaagtactgcattattatgatgtaccatgtggtaccctgatttgtcatcttcacttgacatatcttgtatggaggggtacaaraagaaaccccacactggctgaggaaaattttcctacttacatcccacacggagatttaaaaatatattcctagaatttggcatttacaggaatatgtttcactttaatagttctggaagaggagagcttttttaccccttgagtgtaagac

SEQ ID NO: 4736 - DNA, 600 bp, Bovine  MMBT17237
gtttactgagtgatattggtctggtagtagttgaagggaagtctcgagtgaatggactccttcgtcactgtaatctcaatttcatctacaggtcagagatggagtgcaaagtatcgctacgataaggattggttgaataatgggagaatgtgtgggttatcatttttaaaagaaaattactctcacctcaatgccaaaaagatagtttccacacaccacctgcttgctgacgtctgtggtgttacagaagtcctgcacgggttacagctgaagatcggaatactcaagtaagtgaagggyggccaagggaggggttcagttaggtgtaagttttaattcaagctaagtcagttgttttttgtttctaactaatttttactggagtgtagttgctttactggccaactggaactgatcatgtccttggtagactccatgcatcctggtatcaggcactttggtgtaccttgtttatgtctgtcttcccttactaagccttgagttcctrgaaggttgggattgtgtcttactcatcattttattcctagagcttagtggagggatgagttctcagtaacaaatgaaattcgcttctgttgg

SEQ ID NO: 4737 - DNA, 600 bp, Bovine  MMBT15367
agcagatagcatgagcttcatgtttgcatctgtttctcttgtcccctaagcccacacgggcaatgtgatgacagacctagatggatgcaagatacacagtggatttgtgtcagttgtaagcttaggaacccccaatcttttgaaagaaaacaaaccaaattttgccccagaaagacattttatttactatactggtcagcacacatatctgttttctacttcagaagagtgcagtatctttatatatattccacaaactctataaaaggttaactcagaagccaatgcctccacttycaragtgtacagaaatgcaagaaactcatgaaaaactgtctcccagcacyccacagcacttagtagtctagatacactgtaggaattcaataaatgttgaatgaatctgaccagagaatcatgaagtcattgctaaaattgacatgaccacttatttatgtgtcctctgtgctgatttccctgtcacttgcgtttctgaggaagacactaagaactcaaatatttgtataaaaatgatgtttyccaatactaagggcccacgtcaatcaaagatagcgatgaatgggaacaaaggaattagtt

SEQ ID NO: 4738 - DNA, 600 bp, Bovine  MMBT18231
ggagctccccttcaaggcttcaaggggagggggtggtgcagagccccccagcagtcctcaccacagacccacttctccttgcatgcttcaccccttctcccctctccagggtgccatggccaaggctgcctcatccttctgagcagcccctccggagggtctggggtcctcagggtctttgtcacttggagccttcgggacctcagtggaagctcagaaagctctgttttcttatcctgttacattgactcataagaaagtgtcattctcaaggagaacagttttgtggttgccaaagcrgaggagggtgtggaagagatggagtgggaatttgggattagcagatgcaaacgattgtatatagaatggataaacaaggcccgactatatagcacagagaaccatagttaatatcctgtgataaatcataatagaaacgaatctgagaaagaatgtatatgaatatataactgaatcactttgttatacagcaaaaattaacacaacatggtaaatcaactatactgcaataaaatgaatcaaaaaataaaaagaaagtgtcattcggggtcctgaagtcaccggccactgttggtgact

SEQ ID NO: 4739 - DNA, 598 bp, Bovine  MMBT16575
  misc_feature (1)..(78): n is any nucleotide
nnnnnnnnnnnnnnnnnnnnnnnnnnnnnnnnnnnnnnnnnnnnnnnnnnnnnnnnnnnnnnnnnnnnnnnnnnnnnnacatgactgagtgaatgaactgaactgaactgaatgcagttgtcctagaaaaatgaggaatgaagtagataaagcatgcagagctttgaattcctgtggagaaaggcaataagttattctgtgcgtatttgaaaatttctcacattgggaatatcatactccgaagacttccgtaggaagattaatttgacaatagaatgcaatgtagatgagaattgggaratgccagaggcaaagttaccaaacagacattcttacaaggacaccagtttgaactatgtacaataatatgaaaagccctatgggaaagagaaagtaattagaattgaaagcctactatggaccagcactctactgggtatcccagatgattaaatacattatatcatttacatgtcattatccctctattatggtgggatttcctggtgctcagacagtaaagaatctgcctgcaatacgggagacctggttcgatccctgggtcgggaagatgccctggagaaggaaatggcaacct

SEQ ID NO: 4740 - DNA, 458 bp, Bovine  MMBT16184
aaacagttatgtgcagctattggtctgacatttattatttcagcaatacctctgtgtagaagactatataaaagatacattatttacttttattcattaagatcttcatttttttttttatttttcttggttaattataagccctgtttttgaaggcttataattaaccaccccaccccaccactctccgccaaatgtgggatgtgggatcttagttcccagaccagggactgaacccatgtctctgcattaaggctgtggagtttttaccacaggaccatcagggaagtcccagccttrtcctttaaatccatatgttttcatagtttgttagcaagaagacaatattwtgggtaatgtctgtggtgcacttatcatatgccaggcactatttgaaggactttacatgaactagcttatttaatctgcaaaacaaatcttgaaaggagatttgttat

SEQ ID NO: 4741 - DNA, 600 bp, Bovine  MMBT18395
tcgttcaccatctcccaagaggttgagcaaactcatgtccatcgagttggtgatgccatccaaccatctcgtcctctgtcatccccttctcctcctgccttcaatctttaccagcatcagggtggcagattatattttccaaagatggccacaacaacatagccccttatcccattatgctcttcccacaatgtggtcctgatgctgctccgttgagaggtgggagtctacgtgtcctccccaacctgcatgggcctctatagtggaagtgatgccgcayggattccaaggccaagtyaraaaagaccacattgcttctaccagtgctctagtggcacacaagyctttggagcccaagctgccatgtgaggagcctagctaccctgacgtgacaggctaaagagataacacacagatagagaaaaatgctgggcagtcccagctgttcccacaccaggtatgaaactcttccccacccagcaccacagagctgagtaaaagccttcagaagagtccagcctcccggctaatgtcaaatgaaacagaaataagccaccctaactgaaccctgtccagactgcagattcatgagaaaaatta

SEQ ID NO: 4742 - DNA, 600 bp, Bovine  MMBT16230
gggggggtggatgctctctgcacccttgcgattgctctgcatatgcacagctcttctgagcaaaaagcttatattcacagtaaataaagatgcagagatgcctggcaatcctaacagaagctgggcttcgctcaccacccattcgatggatttggggatttggctggaccactccagctcaagtaaaccagggtctccgagcctggggcctgaaacttggacgtccacaaggtcccgatgagtgtcccrtgcsgtttgggggtaaaaccactcwccagggtgagacaggaatcaagtcckaagggctgccgtggaggcacatggaattctaaacaartactggcatcctcgacgaacgagaaaggaccgcactgaatgcgtttcctccccggcccgccagacctctaaaggtctcattgttgcatctcctccggcagctacacccccagcccagggagtgctgtacggctgtggaaatcaggtggtgggaggggttcaaatttctgctcagtgtgaaaatgcaaagtgacctgggctagcgaggaaaagagcaggtgtcctctttcgtccagctgggggtcactgtcccctaaggggccc

SEQ ID NO: 4743 - DNA, 600 bp, Bovine  MMBT18376
catacatgaggagagaattaatgacatggaaaatagaaattaataaactccccaaaatgtactcaggaaaacaaaagggaaacatggaagaggagagataagacttgaaacacagctgagagagtctcacaaggtatcttctgyragtggagtcttggggaggaggcattattcaaagagatttggcaaagggctttctagaactgacaaaagacagttctgcttcaagatgcccagttaatcctaaactggatggattaaacatttttcttttaagtgggtgggggagatttcttacakaaaatttcagagcacccaaaaaaagtcttcaaagatgactggaaaaatacacagatcactttgtcatgccatgaccaatccaaaacagctttttaaccccrgcaatggaaaacagttgaaaaatctgcaaagttcagaggggaggaggaaaaaaagtaaactgtaaattgaatacataattgaaaatgggatgagagaaaagtattctgataaataaaaaccaagaattggctgccagtgaaatctcactataggaaagtcgaaagattttggttcaagaaaaagaacattgatcttaga

SEQ ID NO: 4744 - DNA, 601 bp, Bovine  MMBT21229
  misc_feature (1)..(1): n is any nucleotide
nttctttcccccattccacgtgtaggcacagaggcctttaagcagcaccacttgtacctgagaagccccaagaagctgagctggcaggagagctccaccatctggtgctaaaaaaagtcctgaggttcataaccaccatccggttcttggcctttacatagccacctctcgctgaggtcagggaccactgagcagcggctgctaccagaaaaccacagccatttctccccatggggtcattcacttgactcatgtgctaatcatctgctctgcattcaggcctgtgaccacaggctcttkmtaaggttgcccaggtgtcctagtcctgacttcacctctgatttggtgtgtgcccttccctagctgttgcctccatatgtccstgtggatgaagcgggggtgcagcgggggaggggggctgtatgatttgcgagggctstgccattctgcttctccctgtggaggtggtctgtacctaaaggatgacctccagaaaaagccctgacacaacatgtatttcccttcccttctgaaattgctgacttaagactcttcctctttggcaaaggtgccaggtagcaggctcagaggcacagattcc

SEQ ID NO: 4745 - DNA, 600 bp, Bovine  MMBT20629
actcgaatgagcaacttcactttcacttttcactttcatgcattggaaaaggaaatggcaacccactccagtgttcttgcctggagaatcccagggacgggggagcctggtaggctgctgtctatggggtcgcacagagttggacacaactgaagtgacttagcagcagcagcagctcaatcaattaatctatctacctatctacagtccatggaatcacaagagtcagacgtgacttagagactaaaccaccaccaaccrtctatctatccagctttgatatacttgttgctgaagaaytcagcaaacacaatgcaaaggattcctgaagccagccactgtgtaaggcatggagacctttctgtctctagaagtattcattctccctaggtccactgcaggctgtttttaaattaaggtggatcatacacatacaagacctacctcaaagttcattattggattaccgcccttrgcatcaagggaggaaccacactggttaaaatgatctggtttgctccacctaagaatctccggggttttatagttgacctccaggtactatctgacttatctttagaactctagtgcttccttcyc

SEQ ID NO: 4746 - DNA, 600 bp, Bovine  MMBT18759
gctgttagttatactatctatgggtcattgcaagattctccctgagtctggagcgtgtttgctggagggaacgtgccctttgaaggagagactttccagggaaacgagattcgaggtgacaacatcaataaacttctatagcttcctatctgaccatccatcactaacactttttcccacataacatcagataactcaaagtgattttccatatgagctttgtatatatttatccttgacatttccttaagttcttttaccggaatatcacagctcaatggcagcacattttatctatgyattaaaggttagttaaaagaaatgaatttgagttcaatcaccttggatgctttgcttgaccatctccagtgttctggaggcaagcaattctatcatccacacttgatacataaaaacaatgagagggacatatggggtcgaaaatgtgtaaagtgaacagtttgcgataaaatggccaatatcttcatatgtatattattttacaagtattcaaagactaaaagagtccttgtgtgtatgtagacacgtgtgtctgtgcacgtgctcagctgagtctgaccccatgtactacagcccacc

SEQ ID NO: 4747 - DNA, 598 bp, Bovine  MMBT22156
  misc_feature (1)..(47): n is any nucleotide
nnnnnnnnnnnnnnnnnnnnnnnnnnnnnnnnnnnnnnnnnnnnnnncaatatctgaatctataacccaggagtaatatctacatcgcagaggttaataatggtcacaaaaatagcatttgcaaagagccttccagagagccttgcctaacacacaaagctgagagttattagcttcttttaaaattttatgtacccagatcccctgacagtcactctttagcatacatgctttctacacccttttctggggacaacaaaacacagcccttaggaagagtaatatgagagcgtctacycracttcaagagcaggttctataaattcttcagtgacaaagctggcctgggctattcagtgttcagagcaaagtcatttttattgtaatgaaattttaaaaggcagttccattagttacacatatacacaactgacttaataactgttagtcatagagaacattcaagaaatacaaatgatttatccacagcacggttcacattcataagaagaaaggttaaaagagaaacgattaagtgctgaaactgtcctctgaagctcatctgggaattatcttgtttttggaggaaaatgagatt

SEQ ID NO: 4748 - DNA, 600 bp, Bovine  MMBT13396
aaagaaagtcatacctatttagacttcactgatttagaatttgtgcagttcagattagttacttgatctacctttggcaagtcagcaaatctttttaaagcctcatttttttaaaacccatgaaagaggtgaaaagtcatgtaaagtttgcctgagaatgtgctgctgaactgttacgtattggacaaatgtgagaaaagaatgtaggaaattaaatttcagaaacaataatttagacaagtatgaaaggggaaatttgccttactctttaataaaaggctgttttcagccagtctgggrccattgtttacaacctaataataaatatgctaatatagaattttcataatgaattcactaaataaggtgctctctgtggagtattttcctttaacatttagttaatcagatttcagttattgtgcctttcaaatatgcctcgtaatttttacttttcacaaagtttaaatgatggcatttagttatataaattcgtgagcctagcttatattactttcttcaccttggtcaacaagtatcagattttcgaataggaagaattataaacttccattgcyttatagacagaatgttcctctc

SEQ ID NO: 4749 - DNA, 600 bp, Bovine  MMBT19100
cacgtggccaaagtatttctaggtaggaagagatgcaaagattgagatcatgagacctgttccaccagactgcctggagcacagagtgcctcccctccaccctgaactccctcagggggtgttgaaggtcaacagccacagcagcacatggttcagtctctgcaaaggcagatggcaaatgcccttggcaaacacagatttgtagttgacacaaatttatgagcagatagttagaaatttggcttctcgagcttgtgtcctcgggctcaacgtggtagtgggtaatggtggagaaaatakgtggaaaatcaagacctattttcagatttcttttcctaagatcttttaaacagttgtaacaaacttatcaacatatcaccccttttaaaatgtaccacttttcaagattgctcaagaggacaagtcactgcttcttcctatgttttgtttagaatggaagggcccagagttttaaatatcacctcatgttctccttatgatcaccaagaaaatgtctttcatctctgtacaggtgatatcagggagctttgagcaaaacaatcagaataaaataatgcaccaaaggtctagttgccttgt

SEQ ID NO: 4750 - DNA, 600 bp, Bovine  MMBT00929
tccatcattcttgactccaacttgagaaagtgtcatcctagaatacttccagaaatggtagcaacaaagaatttctaatatcctcaaacacaaaaataatcctactctgaaacatagctgaagtcacttcttttcaaccctcaagtttatattctgaattcataaccatcaacaatgactcctttaaaggtgaccagatgaaatttatcccctgggaaatttaggggcttacagaagtttaagctgtacatggtcacgttcctaccttttcccaagttcagctcctcctgggctttcgayagtttgctagaatgatttcaggaaatctgactataattgttcagattccataataattgttcataattccaaaacaattccatagttgttcaaagactaatggtattagtttttctttaccctggatttacctagtctttgcctgaaaatgctgcccacatatgtgagaggtttttttcatcagatcataaaaagagttacatttcattgatcttcaacagcccctaacagatcattaaatggatatgacaaaattactcattttgcttcaaactggatttctagactaccaaactgata

SEQ ID NO: 4751 - DNA, 600 bp, Bovine  MMBT05031
ataaacaaggccaccctacaagcctctgtctgatttgcatagcagtgagagctgatgcaaattctcacatttggggctatttcagtttctggagatgggaagggttcctttccttaaataatcttgagcatggtatcctttctaaagcatgattactgtaaagtgaaagcatttgaggaaataaagtgttcatggtaaaagaaaaactttagatggtgtcaggtttgatttttgcagtaagaacacaccacgtcaccgagtggggagttagaatttgtagactgcaggttagctgtgtcygcatcttcactctcacctgctccttgccacacagggctccaccagtcccgttctccacatacacacgtcacttcctccctcccataaaaaactgaaggaagcccctttacagcctcttctaagtcttctttaaagcatacaaatgctatttgctatgtttccctttttcctaaagtaaattcaagagttttgtatttttagcttaatgtttgtaaagaatctagcaggttgtatgctaataaacaggtaaacagcaaaccctgatttatccccgctggtgataagactgtgaagtgagct

SEQ ID NO: 4752 - DNA, 602 bp, Bovine  MMBT04041
  misc_feature (1)..(2): n is any nucleotide
nngtatcatctgcatatctgaggtgcttttgcaatatctaaggaccaaacacaagtgartgctttattggatccttctactgctyggtgggtaaataaacaagtttgcatgagacaaggtctttcaaggaaatgtctatatgatacacacagagattttaatcatgtmctttcagtgagttgtgagactaccgtaatccctgcctggtaccagggaggtgtgatttaataagtgctgattttcactttgtaaatagagtcagcttctcctctactggggattctaaggtaatgtagaccccrggctgatctgcatattttaaaattatcaaacacatttcaagtagagcaatagtcaggtgtgtcccaaggaagatgctttagcctgagaaaggagggaatgaattttaaaatgtctctttccccccttttttaatgtagaaaaaatggatattcttataatcaaaagcactgttctactatttatataggttagataatggctctgatatttactgtgatcasaaaaatatccacatatatttgtaggatttccctatgctcctagtacctataatttggaagaattacaaagaagtcatg

SEQ ID NO: 4753 - DNA, 600 bp, Bovine  MMBT11263
cgcccccgcaacaacaacaaaatttcattcgtgcacacacacacgcacacacrtytgtctgttcaagaacttgtgcagtcagcagtkttctggcccctgagtggtagtgagtgccccattgtgggaggtattcaagcagggaatctgtcaaacataagaccaggctgagatcttctgtgcctggcattctgaaggttctggttttcctctcctgggaggaccagtgtgccctcactcagctctgggaggcaatgatgattcccttcctcctcttctttttcctgttcttcctgcctacarggtggaccttcagactctgtttctgttcatgctcgtggctggggtgtggagcccggacctcaccagagaggcctggcctgaagggcctgagggtccctcagctggattatgcgctggtcactctggggacccacagggtgactgggatctgggctcagctctgagaagaatcaagatttgtccgctttctcagatgtactttgtcctcatagcatttcctccaatttaacaattacagccaattgtattgtttgcctcttcactagcaagtaagccccaaggacagacgtcttgtatttc

SEQ ID NO: 4754 - DNA, 600 bp, Bovine  MMBT13505
aggtgacaagcctgcaagccttacagtcaggcctgtgaatatgcggctgttgacatatttagagcaaccctccccggcggtggtggtggtgcagagtgtcagggaggcttcttcagcgatgtcactctggactgactggcaactggccaggcaaaagcaagagaagggaaaaggtgttcccatagaggcagagaagtagaatgccatctggcaagttcaagaaccacaagctgttcaggctagagcaggagccttgggaggtggggttgagggatgacagtggagggccaggcctgggcygaggagaacaggagtccttgagagtctaaggtggtgaggggtgtggagagcatctcagggagcctgcagtggccttcattatctctctgctgactctccggtttggggaaaggcaccaagccactcaagccaaagcccaggaagaacctttctcatttctcactccataagcacatcaggtcctactgacttcaccccagttcaggtcctyctgattttcttcagcattaacaaaagggctagtaacgagactccgtaatcatctgcccggctctctggtcctcttttcatcccactcac

SEQ ID NO: 4755 - DNA, 600 bp, Bovine  MMBT13932
ctttcctctccttccacaaacccagctattatttagtctctagcaaagctgcacaaaccaactgttcctcctcagattattcctttcaaggctcaagtgatatgcctccttgggttacaccttccaggttttgtggtcagatggggctgtcagtctccagtattccaccttgcaagaaaatatttatatatgagtctcaccaggtcccatttcctctgggaatggtcctgcatgccgtgccttcatgctagtggtgacagttggatcgctggttttcatgggaccactggacagctggcrggaaaaccaggaaactgccttcccctctgtgacttcactcagcctgaaaactacaaggtgtgtgactgtgagctggaaagtttctgagmggttatatgcaacactttgagaaaacacttggaaggaaactcactgatgctgaagcaatggaaayttgtaccattcacagaatatttattttcctagatctggaaacaccagagcttgcttgtacagagtcttttcattattattttgttactggtaaatagtaattcccgttattcaccaaagggtcgtgaaactgacacttctatatgg

SEQ ID NO: 4756 - DNA, 600 bp, Bovine  MMBT12904
atcttaaaagccacgtaataaaatggaggtttccttttttattatatgtacacgttgcatgtttattgtggtcttggggataactgagggcaactccatttaccagatggcactccataccaggaattacatttcaaactagagagaaaaagtcttcacccagctgagtactgcttttgcgtgaatgtgtatgtgggcaggtgggtgggggtgctttttgcttatactatactgtacrtagctcatctggtctattgactctacttatgaattacttaaagagacatctaactaatgctrtagtagcatagtcccatataacatactaayggtaattttttttaaatgactgaatttctatctaatttagttgtaaggcaatacagtttcggttgttaaataagcttacccttaaattcctaatctatgagcctgggrcttmtttctctatatggtagggtccttggctgacttgcctctctcaagtttggcrgtattgggacccctacagactttatagagccaagggacaaccaaayccatcagaaatatcatttttcactggccacgcaatgttgaatgaatatgtggaggcaattc

SEQ ID NO: 4757 - DNA, 598 bp, Bovine  MMBT20429
  misc_feature (1)..(21): n is any nucleotide
nnnnnnnnnnnnnnnnnnnnnattgaatggctggcagcagatgctgccgtaaaagctcaataattaggaacccaatatggagtgatttgattgaagaaaatttcataaagtaaagacatcttaggattttcttacagttttatgtcattttactttcttcatgattatcactgtttcattattcccaaatgacttttagaaatatttttgcagyctattgatatagaattatttattaacaaatgaaatgcttgtgttagattttctttatttcacaaagagcagaagtaattatgattmaaatgtagtccaggtgccttcatctgtttttyraatttcttccttttatttttatttcattgaaaatrtattcattaccacattggagaactgatattcatatttagttttattaaacccattttgtatgtatattcttgaaatatttcaaagccattgaagatattgactgatgaaataccatgctggtgacatggcagataatgatttgtttttcaagaaacactttgggcatagtagatgatatatttattgatttatcagtatatgtggagaaagagcacagtaatataaagta

SEQ ID NO: 4758 - DNA, 600 bp, Bovine  MMBT19305
catgatgattcaatgcaagctgatcaatcgtaacaaatgtatcacgctggaaagggataccaggggtggctgtgtgtatccaggaacagctatgcaagtgtaggggcagaggggacaygggagttctgtatgatgtctcacttagtttttctgggaacctaaaactactctaagaaacaaagtctattaaaaaagtgaaaacctcaatggttaccatcacaatttcctaattaccaaactttaaaatattagtgtttacatcttatattcaaaagttatattaaaaagtagaggcattaygttaatgtgttatggtttatgaaaatcagcataacaggctatcagactatgcaaacttggcctctatctgctaagaatgtacactatgtagaagttaaggcttgaaggcctgactagagaaattctaacagaccttgtaaacttggtcgccaagtatggagaaaccccatccacctaagcacatttctaactggaaagtacaactgaactaagcttcaggcaaaggtccgtatgatgaagagcctgaattatctgcaaattccgagaatgaacaaaaccaaatcttatatacctagattc

SEQ ID NO: 4759 - DNA, 600 bp, Bovine  MMBT23333
cctttgtttcacagccatttgctatgatttggggctgatttttggcattttgtgattcaagattttcttccagaagtcayatactacgtaagccgcttgttytgttcagagtcaggaaaatataacttttttgcaaaaggagattgtgcctgatgtagaggaattgacttgggatcaagacaagcatgagtgattgaaagaaagaagtcatcactcaggattctgcaggaagctgccgtctgtaccctgtgaatgctgcagggtgtcagatgctgttcttccatgagatgcagtctctcyaagcactgcctctacratgtttcctctctttctgtattagtcataccagtggatctcaaacgaggctgggaatttattttttgaaatgataaatttctagtattcatcatagggctatacaatcagaattctaagcgctgctgtgtgagtgattctgaaacagtcagctggctgatggtttaaagctgggccttgaggactgctacattcctctcatggatcagagggtgattatgaagatcttcaaactggaattctttatatattagccctgggatgctggaaatacaccagaattcc

SEQ ID NO: 4760 - DNA, 600 bp, Bovine  MMBT23336
agcagggactgttataaaagctttagatttcaggctcacagtcgtctgagtaagaagagaaggcgtcaatggatctggctgtggtcctcgtgctctgtctctcctgtctgcttctcctctcactctggaaacagagctctgggaaagggaagctcccgccaggccccactcctctcccaattcttggaaatatctttcagttagatgttaagaatatcagcaaatctttaaccagtgtaagtagattttatgtttctccagggtcttgcaaatggtaagtaagttaagcctaattwtgaygctaatacataagtttctatgggcacactgtcaaaatatgtaaatgtgaagcaaattacttcctgtaaattttgacacttttcttgcctaaatagaggaaaaaggaatgtgtttttcgagtagagaaacacttagctctttgtatggtaaaatgaaaatatataaagtattaaaagctgggagtgttgcctccctcctttgtttcacagccatttgctatgatttggggctgatttttggcattttgtgattcaagattttcttccagaagtcayatactacgtaagccgcttgttytgt

SEQ ID NO: 4761 - DNA, 600 bp, Bovine  MMBT23334
gaygctaatacataagtttctatgggcacactgtcaaaatatgtaaatgtgaagcaaattacttcctgtaaattttgacacttttcttgcctaaatagaggaaaaaggaatgtgtttttcgagtagagaaacacttagctctttgtatggtaaaatgaaaatatataaagtattaaaagctgggagtgttgcctccctcctttgtttcacagccatttgctatgatttggggctgatttttggcattttgtgattcaagattttcttccagaagtcayatactacgtaagccgcttgttytgttcagagtcaggaaaatataacttttttgcaaaaggagattgtgcctgatgtagaggaattgacttgggatcaagacaagcatgagtgattgaaagaaagaagtcatcactcaggattctgcaggaagctgccgtctgtaccctgtgaatgctgcagggtgtcagatgctgttcttccatgagatgcagtctctcyaagcactgcctctacratgtttcctctctttctgtattagtcataccagtggatctcaaacgaggctgggaatttattttttgaaatgataaatttctagta

SEQ ID NO: 4762 - DNA, 600 bp, Bovine  MMBT22694
tctgtgtgatatatactttcttgacaatcagagtgcagccaaggtcagccttttatgaaggcagaatatggtttgaactaggaggcactgaggggtcctctcctgcctttccaataatatcaattttctcctggctgatgatggcaatgctaacagtctaacgttttaactttattttaaagctctgattcatgatcaaatgcaaataccgctgggwgaggtaaatgaaatggtaactttatcaacyactttcattttaaatgactgggtgtgagatcttccctgatctgatttcacgargatggagaaagatggtgcgtgtggaggcaggaggcaggcttctggtgcctcrttctcccgaccttcccgtcacagagatgtgactgcaagtgtttttaaaaatatgaaagaaaaagtatttcagtataattcatatgatgttaaagtgataacagttcaaagaataactacaggatgagaaatttctgggaatcaaggggcagggtatggagtgggggggacgggggaatgtcgtggaataaagacaggtaggtgaagacaggaaggtcattaaaatttaggattctgaggttcacactc

SEQ ID NO: 4763 - DNA, 600 bp, Bovine  MMBT21734
ataagataaaggaaaattctaaactcagtttcccctcccccgctttatgctcctgtgtactgtttaacttatttttattatggacattatcgtgttttttattgcatataaacattgatttgtttcactgttcccagcttcaataataacaatagcagcatttatgttacaaaacattttttcttatgtgtcaggcattatacttgtaaagacttcatgttgtttcatgacattgccacagaaaaggtaaacgttagttccattttacagattgggaagtggaagctgagggagattaakaagtatcgaaacacacgctactactcactcaagtctcaaacccaatgcctgcttaaccactgtgctytcaacactttccattccaagcagattgcaggctgaaatctcacacacacatttttataactcattaactcaaatctctagtgttttccaggttgtaytaaggaaaattgggctatcagtttaggataatttctaggaagaaagtttttattggcgcttaagtgccttagacttatttcctattttaacaccttccatctcaataatcaaaaaatggaatttgtattcatttct

SEQ ID NO: 4764 - DNA, 600 bp, Bovine  MMBT01262
ctcccagccaggaacagcatccttattctgctgtttaagaactctcttccggactgtctgggctctttggactggagtgactgctccaatttctccccatagatgtggcttgctgtyatgagctggttattcagcccttggaatactgaacaaatgttttccatcagttattgcagtgaaatcctggccattgggaaggtaataaaatctctgacccaaggaaagaatgtttcacacatacctagcaaccagagagaactcataaaaagttcattacaaagcagccctgtccattcttgygcatctccccatgaccattgctacaaaacttckctctagagcacatgtccctacagcttcatagggacaaaagttcccaaactgtgtgattaaaatacatttgggttaaagattctctcctcttttaaactatcatttgtccttccattttcctacctctcacttaaccctctattgaactttcttcctccccttttatttcctcttcattctaatcaagttgcaaagaagaaaagttaaaaagaaaccagttaggtcaagcagagcccaaagcagaaggagctgaactagccagtggac

SEQ ID NO: 4765 - DNA, 600 bp, Bovine  MMBT10615
tatatatatatttttgckcttacttttttatttaattttttctctcgggatcataaagtgaaagtatttaaattcatatttcaggagataaaagaagcctaacatctttcatccacttttatgcattcttactaattttttttttttttaaacattttgtactggcatcctgaagggtgcaatttcatgagtcaggagaataaataacagataaaaataaatgtcgttctcagcaaaggtgtgagctttccttaggggtgaaaaaaataatgaatgcatggaagaggcaacagagcctcsggacagaacctagcagcaagtggggtgaggggtgtggacagtgcgtggagtcagcacccccagggagagcctgccyagggaaccgtcccccctccccctaggacacacttccttccggaggaggcgggtggtgttgggaacaccctcacatttcacagccgagtcttgcttggcaggttcattggacaccgggagaggcagggctgcaggggatggagacgatcaagaggctgattttgctaacggagacttttcagagcttgcgatgtgcaggcagcattgcattgcaggaatgcgcca

SEQ ID NO: 4766 - DNA, 600 bp, Bovine  MMBT10159
ggctttgtcagccagggtctctgtacagagtctgccctggccgctgggaagcccagggacacggcgtggacaaaggggcgggagcgtgcgtggtcacatcatttacaagaggccccggacctagaacagccttcaagactgcaaaccaagactggagcacccacacagcaaacagactacgtctgcacagaaccctcatgggagggacgcacagccctcgcacatgctgtgacatggtcagatggggagcctcccaatcatagagaatgaggcgttggcgaccctctcagggccatgagstctttgttctttgtgttttttttagagtcaattccagtttcatttttctttcttaaattaatttttactagagtcaaaggctgtgatttctaagaacacatccacatttcacaataaggttcctgcccaccctagagatcaaagctggctgggaattctgcttttcaaatgaacagagccgctagacatcagactgcacccaaatgaagataaaaggtgtcctggacagagaccacctgaccgtgctgcccgctgagaccactaccactgccactcatgcctcagtaagaacacagctga

SEQ ID NO: 4767 - DNA, 505 bp, Bovine  MMBT11347
ggctttgtcagccagggtctctgtacagagtctgccctggccgctgggaagcccagggacacggcgtggacaaaggggcgggagcgtgcgtggtcacatcatttacaagaggccccggacctagaacagccttcaagactgcaaaccaagactggagcacccacacagcaaacagactacgtctgcacagaaccctcatgggagggacgcacagccctcgcacatgctgtgacatggtcagatggggagcctcccaatcatagagaatgaggcgttggcgaccctctcagggccatgagygtggatgattagtagttgaaacgtaacagataatctgaaaatagtagcatcytttataaaagaaggaaaaggaagaatattggaaaatgcgatttggacttctatatgtgggttaaaagtctaaatattatttatggacagctagatgcacaaggatctagtccatttctatgtactcaaaaatgcttattaatcctatcattga

SEQ ID NO: 4768 - DNA, 600 bp, Bovine  MMBT08178
gagcttgaagccaaagacacaggcttctcaggctcccgctcagcttcatggtcatggatgaactccagccagccttggagtaaacagagctggggctgcagcctggattctccggccaacaattgagcgctgcagtgagttaccagaactgctgtctcctgggtggacccttcctctgtgaaatgccatgatgatcacacctctgtcccagactgttgtgagctgacccaggaacacatcccgcatggtgagatggtagcccccttttytcagaaatgagggatccggacaagagcgtgyaggagcccctgggagggagaagcccctccaagctgarcctctgtgcacagtgggtcagagtgctgcttccaggggccaagtggccaaggcccccatcctctgtttcttggaagtgactctgacagctggcctggggatgcacagattagagacagggtaggaggtcagagcagggccagggcttggaggaccccaggctgttcaataggactcaggactgggaccacctgcaaacctggagcccgtggtggcggggaggctcccccgggttcatcacagaggacccaaggtcccctaaga

SEQ ID NO: 4769 - DNA, 600 bp, Bovine  MMBT04493
gacccaactcttaaactgtgaatagtaatttgcacttttcccaggaagaaagatgcttttttaaacttgcttctgactctcattgactgtgctagctcatgactgctagccttagcaatggatgctaaattatatagcgataaggaggaagaagagatcagaggtattttgctaaaaatgtctcattttatagaagaatctgatagaatggaaaaaaagaaggaaaaatatttgcttaatattatttcttcatatagaaagaacaatatcttcctacagaaaagctaccttgggagtcarttgaaaataaacaataatcttggggcatgaattagaagacatattcctactctagatctgctagcaatcttgaaagaatgtgataactgccttattattaaacaatgtcattccagggtgaaattactgcaataaaaaataagtttgattttagagaaacttattttattatggaataacacaaaatatgtagcacaaacttcacagatatatttatgaacctattaaaatgaaacactcatttttgccctaattatttcccatgaattctatagtcatttaggtgagtaaacacagtta

SEQ ID NO: 4770 - DNA, 600 bp, Bovine  MMBT01651; identical to SEQ ID NO: 4508

SEQ ID NO: 4771 - DNA, 600 bp, Bovine  MMBT13919
atgatttcagtgagcccagactcttgcatcttcccatgcacagaaaatcaccaaactcyttaacctgggttatctggttttctttcattaacaactgttttttgatgttagaccacctgccctttgttgcacaacttctatataacctgacttctccccttgcctccttggagcagttctgtcagttacttagatgctgcctcctaggcttgaagtcctaaaaacacccacctaatgaaacctaactctcaactttgaggttgtgaataagtccacacctccaataragccccatcaagrcccagaccccagggaggcaaatggagacctctgaccttcaggccacgctggaaggtggagatagacagcagggctaggtcttgctgctcctcagcgtagcgcaccaggtacacgtagacgagcttcttcacctggggaagagggggtttctcagcagggactggtgcccctkccctgagagatgtcctcaccccgggtggctgtgctccacagagaaagcatccagggtaccctggccccatcatgctgatccacatctggttcagggacatctgggaggtgtcttttcctggaccaggg

SEQ ID NO: 4772 - DNA, 600 bp, Bovine  MMBT19275
ttccgtgttctgagggatgtctccatttctcagattcgcattagtcctaaatgagtgggacgtgctgtctggccagtgcctctgttctttcccttttccttgttggtatccccatagctccgccctctttactcttctctcttcacttattgcattgtcttcgggcaacttttgctactcttgtgccctcaggtaccacctctcgacagcttatttccgaagctatccctataagtactcttgtgtattgaacttggatcctgtatcctttttcccactggcagaagccccatgasaacstcaaattcagcttatccaaaccataatttgtytccttctcaaaacctaattattggtgtgtataccctgtttttgtgacaggcattatcatctacctagctgcccatgctggagccctcggggttattaaggtctgtcgggttctccaggagacaggctctgagatgsagatttgcgtaaaagtggaggtttgcatacaaagtgtgttcaggacctgtytcttgccctccacccaactcgctaaaaaagtaaaagtgaaaaccgttttgttgttcactcatgttgttgtggttgtttagt

SEQ ID NO: 4773 - DNA, 598 bp, Bovine  MMBT15295
  misc_feature (1)..(120): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagttctttagacataatttctttaaaaataaagtgcatataattttccacattcaagacttctctatttgtggaagattctgaaaatagaagcatctgccataatatcaggggctttggagctgaagcgtctgtccaaactcacagacrggtatttcaaaatattgaggtagtctccrgcatagccgtgatgaattttgtcaggagaagggggccattttcagtcttggacccccacctggttttgcctcactgttgactcacatacctgcctacagcaatacacactrgttttggcctgtgctaggccacgcaccatcaatggagtccattgttttccagcaaggcacctgcacaacaggctcaaacaatgaggccatacctcaagcccctcctttctcctcagggcacccaaggtgaaagaaaacttgttgaggcccggaagcccacttgcatcataattagactgcctggcca

SEQ ID NO: 4774 - DNA, 600 bp, Bovine  MMBT00155
aagcatgattttaacaaaagactggaaagaatatcaatgcctaccaataggagtttgggattggttattcaataatcccattagattggaagccttactagtggtacatgcaaattgtcttccatctgcccctccaagttcattcttcccacttctctagcctcctctgggccccagaagctggcctttggcttctgttgagtgcagccaatggggagcctagtaataggccccgagagagggaaagtagaatacaggcagtgtatttacttctctttccctccacctgtgtgtatgacyctctttgtcccaggtcagggaacccctccctcccctatccgctttcttcaggtttagggatgacagatatacaccggctgggcccaagaccttgaactactcctcctctgctccctttaccatccaatcccttggtaaacactcctggtattaaaccacttcaaattatcctaaattgattagggcatctttcctgcaggggacctcactgatacagtatgattaaagatgtgggggaatgcaaaggagagataatggtaagacacaaaaatcaggctaccaaactgtatacagacaagm

SEQ ID NO: 4775 - DNA, 598 bp, Bovine  MMBT02976
  misc_feature (1)..(100): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgaacgtttataaaattctatatgctttaccaagaactttgaagtcagggccaatgttttattctatttatttattaagtatctccaagcctagggatagtcaacaatgtatgttaaatacacaagttaatgaatgaatgatttttggtttgttgtatataaattgacatgtgttcttccaaaatgaacatattcrtgttgttttagactattatttttattgacagctatcataattatttaaaatacaataccatcaatcatcacaatattcacatcacatcataataagtattattaatctcattttacaaataagaaaattgaggcacagagattttgcataaatcatgctaattcacacagatagttatgggtaaacctgagcatccattccacattttgactccagagtgcatgttctatcttccctgtcacaaatggtgatagatttgtttgggttataaaaactcagagtaatgagtatatttatt

SEQ ID NO: 4776 - DNA, 600 bp, Bovine  MMBT02468
tccaatactttggccacctcatgcgaagagttgactcattggaaaagaccctgatgctgagagggattgggggcaggagaaggggacgacagaggatgagatggctggatggcatcaccgactcaaagcacatgagtttgggtaaactccgggagttggtgatggacagggagcctggcatgctgcgattcatggggtcgcaaagagttggacacgactgagtgactgaactgaactgaagtactttcatgtggaaatcaaaaataacagaacaagagcagactagggagaggacatttytcccagtaaaattttccaaatcaacactttcatccagtttctgacatcagttctttgagtgggcatcatctacctaatgcaaaacatggagaatgtggctttgctttgttgagttgcaaagggaaagarcttttgttcagagctgtagacaagtcagttcagtccacataatctattttctcctttaattctgaaatgcagcccatgctcatttggtagtgaggtgttgtacaagaaatgtttttcttctccttctttaaggtgacttcacatcaggtttcaagtgtgttacttcaacct

SEQ ID NO: 4777 - DNA, 600 bp, Bovine  MMBT10654
aaattactgtaagtcataattagtttgagggaaaacacagattcaaaccagtagtttttcagatagaaaccataaaagttataagcatattcaccagttcattcagtccttttgttcatcttttgaaaccatcagatttcccattagaattctttaattttttacccagctcagcattatagtttaaaaatcagaaacttgtatttatccaaaagtcctttctataaatcttaaagaggaagcatgtttacaaaagcatcataatgaaaccataactgtctataatgacaaaagatttawggcatgcttaaaatctgaaacttgggtactactgtgacaacatttgaagatagtaactagaattatgactgatagtattttaccaggacataycagaattttaggcactccatgtaatttctaggatrtctatattagtaacattyaccatactatctaggtcttcccagcggcactagtggtatagaacctgcctttcaatgcaggagacataagagatgcaggttcgatccctgtgtcagaaagatcccctggagaaggaaatggcaactcactccagtattcttgcctggagaatcc

SEQ ID NO: 4778 - DNA, 600 bp, Bovine  MMBT11336
taatcctcatatccagttacataatgttccatctcattaatggaggcatacctgtactgtgccattaagtctaaaatctaatagtcacaatacattcattttcacctttcaccatctaaatggccactgctaaatcctttcagtttcaccttctaagttgttttttttttttttttaatctattcaatcccatccatcttcagggtcttagtttagactctagttgccaccactggctcacattattgcaaaatattccaaacaagtttccctgtccttcaacccatcttctattctggmcacaatgaccttataaatactcaaacatgattgtataatttccctaacagaaaaatcttaatggctgctcattccattaggacaaaatctaaacaaggagaaacaaacaacaaagaaaaaaacatgcatcactgccagcgtctgcttacttttctaacctcatctctcaacatccctaccctccctccattcacagtaaccctaggctytagtcgtatgcaacaatgtattccaacctgcccctgttcttgaatgaccttctgcagcacaatgtagtgattaagagtttgggtttaggaa

SEQ ID NO: 4779 - DNA, 600 bp, Bovine  MMBT03020
tgcaaagacccttttgacatataaaacaacatattcgcrggttctgagtattgggatgtggacaagccaccattccgtcatttcttgaacacttgcttgctttctggtataagaagatgtcctgggttcaggcttccaggattccctgagaatyggggtagaatgctctacccyrattcctatagagaagcttctgctccctaaattctgaagccccatgccctccagccagcccctctggagtcctccaacctgaaagatacacttccccatctgcttcctgccctaccctggctcctsstttacacctcagctccttcatttgtaatatgggactgataatatctcactgggcagttgtgaaaataaaatagatgacctaggaaaaaggcctgacccagtgccaggcagaaggtaaataccagcaaagacgtcttatcagtcctctcctaactgtgccccatcccttcttcttaggtcctcagatgcatgttctctgtgttatttyaatattttattccttgcctcctcttccccatttctgtttctcttgtcatccactccccatagtcacacctgctgatatacgtaatatctgac

SEQ ID NO: 4780 - DNA, 582 bp, Bovine  MMBT09934
gatctttagttgcggcatgtaggaacttagctccccaaccagggatggaacctgggccccctgctttgggagctcagagtcttagccactggaccaccagggaagtccccacagccttggtttttaacgtttaactctggctaaggcttcttctgtaaacgtagcatctctgaaactgacctcatcatcttagcttctccgctgtgctcagtccccctgttctgaagtcaccagggttcctcatttacccatttctttccagaatgattgctaccaacctgtttgactttttagattttstgaacctcttcaataacctgctgtgcttttgtctaaatctctttcacatcaatctcactacaackgaaagaaaaactttctgaaacattattaaagtccaaatagttttgagaattgagcttgtaccccactcttcctcttggggacamgtttaaacacaatttttctgaacttcttagcccttgtgcgttatttgatgacacttattcgttccgtgtctttttaattttttcaatttttattttctttatctgcaatattgtgtttcaggtgtacagcaga

SEQ ID NO: 4781 - DNA, 600 bp, Bovine  MMBT05367
caacttagcacacacgtatgcacgtggaatactcatatatattaaaaaacaaaaaacttggtggcatttcgaagcatggactaaaaggataaatggctacaattactcaagcaagtagattttatctgtaaattaagggtgaagttcaggagggagcagttctagcagctctagaacatttgaggggaggcggaagtggggggcaccaaatgaagtgctcaaattagagatagtttagaagttaacatcgtctggcatgttgaaaaagataattagggaacagtgatatgaagcagttaygagtctgaaagaaaatttgtttatttctatcttttggttttcatgtagatatgactattaggaaaataggggagaaaagaagagttattgrtgcattctctctacaattcactgtctccaacatctttttattacattttatactttctattctcasatgactatctttccagattggcagtatcaattttcttttggaggcttttgtggggtaaagtagaatattggttccagggaaagaatatagtattttcagaacttaactaatacactttatacatgaatcataatgttatttct

SEQ ID NO: 4782 - DNA, 600 bp, Bovine  MMBT07656
gcattactaggggcagcaaccttgtgctgagtcctccataacccagcccctgggcatcgagttggtgctctcaggccactatcatgaaaagcacgcaccagcagggggcttggagccagatgatgggaggcctggcagcctcgggaaaagacaatggagctcatgaagaggatgaacagaaaccaggactttcattccagctctgccacctgctcatatgtgagcccatgtcttctgatctgtgaaatgggtatcataataccacgtggcaaagttgtgaggatgcagcaaatgacttgyttttggtaaagcataatgtgctgggcaagtctaagcaacacttgtcatcaggggaaatactactgatgctcttaacctgccaggtgagttcctgatagggtcatatcccaggcttcccttgctttcaaagctgcttgcctcactggactgctctgagtctcatagacctccacttgtctcttacattctgaacattctgctcttgacttcccagtctaacagtcatttctgcaagagaaaaaattgttttttgctggtttatttttacgtggaacattgatgacaatgttgaacttgact

SEQ ID NO: 4783 - DNA, 600 bp, Bovine  MMBT09851
tctgtgattggtgtttgaggaccctgtatgagattggttagataataaaagtgatactagtttgtgataatcgttgttgtttcactcttgcattcaggacttaaaaattagtctgggagggccttttctgaactgtggagatatagcgtttaacagttctggctgtagaaggttcccctcctaccgcgtcccgcttttggatcactgtgtatttgacacctgggtgtttagggactacttgcattcctaaattaaatatatcctttgtttctccctcctcttaatgtcttttcatttctyttggttacctgcarcttcttctcatggttaatactaaaaataaagaggaggtgaaatgagagagtttacttgattgtcagtggcttggacaaaaaacctcttccaagaaataggtcatttaaaagtattggattggcatttcacttgagttatttgtggttaacatgttattagccttttcttatttgggttgtttaaggagacattaaaagatcaggtcatttaggagttaaaggacacaaacatgtagagcgtgcagatccccagcatgtattgatgctgaacaaactccttagtcat

SEQ ID NO: 4784 - DNA, 584 bp, Bovine  MMBT09319
gctctagagctgcaactgttgagcccacgtgccacaactactgaagcctgcactcctagagccctcgctccacaacaagagaaaccgccacaataagaagcctgagcgccccaacgaacagtagcccccaattactgtaactagaggaaaaagcttgcagagcaacgaagacccagcataggcaaagataattaaataaataaaatcattaaaaaaaaaaccaaaactgtccttcaaaagacaggcccagatggacaagagctgcaggagttctgcctgcaggaaatgccccagctagtygcgcaggcgagaggaaaggaccccagagagtaacctcaggctctggaaaggaagacacacagtgctggtatcaaagtcatgatggtttgtaacagcaattttagtttcctacatgatttaagatgctaacatagtcttttaaaaagcattttttagcctaaaagctggtgttattgtaactttggtttataactccacattttgttttctatagaactaagaaactgatgtatctaccaatttctgtttatgttacggatgcgcaagtaatacaagaattttgt

SEQ ID NO: 4785 - DNA, 600 bp, Bovine  MMBT09405
agcccaggtcttgagcctgtcacaccgaggcaggggctcccgcactctggcctctagctacctcgccagctgccctcctcaaagtcagacctgaccacccgactcccacagctgctgaagacctggtaatgacctcacgttggcgttcgctccactgtccaaaaggaacttgaccatctgctggtgcccagcactggtgcagtggaagagggcagtccagccctgaatgtctttcatttccagctcagcaccttgctttaagagaacagagaatgcctgttaaggccacgtctcctccgyacagggcgggcaccctctaggccatcacactgaaagaatcgaagtgattacccaggcgcgctgcagtggttccctctctgccgagcggcctgaggccctcgcagctcacctggagaagaaaataggcgatgctctcgttgccacagctggaagccagcatcagtggagtctgcccttccggggtcggcacattcacactgacccccgcctcgagcaggaggtgcacgatggtatcgtgtccaatgtaggaggcatacatcagcggggtccagccaccaccgttcttcttattcaaatcta

SEQ ID NO: 4786 - DNA, 600 bp, Bovine  MMBT07220
tcaagtacatccatagcagtattatccagacagattttaagaagaaaagtgggcaaaggcatatcatgcaagcagagcacaaagaagtcaagaaaatcagggcaaaaaaaktattaaataggctaaagtgagccacttgttaatagtgcaagttagaatctacaattaggacatcaatcatgaacataaatatcataacatcaaaatgtgtgagacaaactatcagaatgtacaagacaaactgagaagaatggcaatctaaataagcaaaaaataataacaacaacaaaaacagaagtyctgaaaagccttaccactaaagttgattgaagactaagtcttacctcatttaaaagcaaacactacacccagtattgcaaaactttgccaaatagtaaaccccaagaaaatgtcagcaaatcccccccaaagaatactaaaattgaaaaaaacaacctaraaatcaacagcaaagtgtaaatgttgagaatattttaaacctaccacttgatacatacataattaatctttcaatcaatggggaaaccaaaataccaagtatataatgctttgaaagtaaaaataaagggaacatatatt

SEQ ID NO: 4787 - DNA, 600 bp, Bovine  MMBT08733
attgggggcaggaggagaaggggacgacagaggatgagatggctggatggcatcactgactcgatggatttgggtctcagtgaactccaggagtcggtgatggacatggaggcctggcgtgctgcgattcatggggtcgcaaagagtcggacacgactgagcgactgatctgatctgatctgatctgattgctatatatgatagtgagacagagtgtggatcttgataattctataatggatagaagcaaaagaatttctcatgctcaaattttgttgcccaagggtgttttatatcttygcccaaatataaattctcatcatgtttgtatgtagaaaaagtactctaagttttctttccaaatatccttcactcaaaatagtgacaaatatcaaatatagtagggggataagtgatatactacaattgatttttaaagttatcatgtatttgggactttcatggttcctgaaatataattctcataaaacatttaatcctcaatgcacctggagttattgttatattttgaacatttaagttgaaaaatatgggatagaaatctcagtttttacaattagggaaaatgcccgtatacaa

SEQ ID NO: 4788 - DNA, 600 bp, Bovine  MMBT09783
cagtcaacaaccaacataatcagaggtgcgacatcagccctctgagggccaagttgagtatgctctgaacagctccgttcccataaaccacagacgtctgatgagtgacctcactccagtaacttctcgggtgttatataattaggtgtttgcatatctgagtattgatgggtctaaagagatgtcacacctactttccacactgtctcccaccttcttctctaaacatacacactatgctcaccacacatgacccaaaaacaaccaccaccacaacccaagctagctatttcctatccyaccaaattacaacctgtctataattaaaggaatgtctggaaagaggctatgagatcccaatgtctgagttcccagggatgaagggtcccagttcttctgggaaaagcagttatgaattctctggaagactgaggtagggctgaccctcaaacctcaaagtggaatcgcttcaactttacatgtcagtatggtcaggacaggtagaaagccagatcttcaggggaaaaattaaacctgttaactatctgtcctaaaaggggtggacggcaggtttcctggaaatagatacaagaccaggtg

SEQ ID NO: 4789 - DNA, 600 bp, Bovine  MMBT03729
gccatttgactctggttatggtcatgtgctgattaagctgcccctcaagaatatgaaattgaaacgcaaatgacacatcagtatctcaagcaccaccacaacctatgacagtttagaaacttcagattaaccattcggcaatggaaaatgagactaggaagccttcacttctaaagctttaaaaaaaaacatttctgagaaagcgtcttgcctaggttagttttcaatcacttcaaatcgtctggtaagctactcccaaacctttgcatttacagcacaaccctttcatgagcaaagcarttcaaaaggtggggcctacaatttagtgctaaggtcaacaaagctatgcttttgaatggtatgtattatccccagatctgtaccctccatgtcaggcagcaagtctaaaaagaccaaaagtagaaatatatgccagcaaataaaataattattatcaccaagaatgaacaattctacagtaaatttattaaacttcagtgcttttctttccccctaaaaatatatggcatgtaatgaagtgctcttgtttggtaagcagccgtcttggagagcactctcatttgctagagttgtatgaaa

SEQ ID NO: 4790 - DNA, 535 bp, Bovine  MMBT08505
tggtaagtctgaggccacccagcttatgaatctaaggtgttcatccccagatttgtccctgcgcctgaggaactctctcagacgtggcggagggcagggggaggggcggccgggtgccgtatttatgcgtttcctggctggtggggttaagaagttaacaggaaaggaagaagtaagtacacgactgactgcctgggccgcccaggtctctcgattcccaggtttgcagtccgcttcctcccaatttgatgcaggttggcttgaaagatcaagggtgctcattgaggctgtcaggatgcraagtcaggagcggtccgggtctgtctcaggttacttaaataattaatgctaaatgatgattagcaagaaatgctttgatctcccaccttgcctcctggagaacaaagtccctttctggaactgattaggtgccatgaggtcatttctgatgtggcgtctttcaaatcagagatgctactgaatcacccttggtcaccgtccccccacccccactccactccatggctgttttcac

SEQ ID NO: 4791 - DNA, 600 bp, Bovine  MMBT08844
agccacaggaaagctatgcaaagtaaacatgtttattattaacaagagtagacatgcatcatctcccctgattgcaaaccttaacttagataccactgcatacagactcgtagtaactgattaatcacagaacagatgggagacaccctaccttgcgatttaactatccatctggtctttcctgaccatctattcataggaacagctctgctctgtatttctgagaaccagtttaccattcaaacataattattggtcttaagtactttgaaaaatatttcatctgtggacaaaactctrtaacaggaaaagaacagactaagagcagacacctaccatgcttaaagactccaatgagcagggacttatcagcctcactgtcccaccatgttgttggaacctccagctgatccactactgggaaccatatgtcaatctcactgaaggtataagaggcaaagtcagcacagcgatgaaggaaataaaagcaaacaatctttggaaagattattacaggtatcttcttttctctattaatttacatagtcctacatctgcctatttccttccaatggtatcaagaacagctgtcccctggta

SEQ ID NO: 4792 - DNA, 600 bp, Bovine  MMBT06874
aaatgggaagggagaaaaaaatgctttagcccctcctccataggccaacaacaaacattcagaataactttgagaccccctccagaccttccaaacaacagagagaggagagatttttttaattcatcccactctgcaattttgagcaattcacaacaygtctctgagcctyagttttttcatctctatagacccatcatatatgcatgtgtaagaattaaattgaagacattctctggcagtttcatggttaggactcygaaatttcactgccaagggtccaggttcaatccctggtcrgggaactaagaccccacaagccatgttgcatggtcaaaaaaaatgaaattgagatgagtggtgaaaagggcttcatacgatgtttgccacctgggagaagaccagtaagtgaaccaataatatgacagtttccttctgctcttttggggttaaaagaatgtggttaggttcctaactaatatccattcttcttctttaccaacagagtcctgatttcactcagggcttcaaaacacccagatttaaaaaaycaccttcccagattcctttgcaggtttaggtggccatacttcagttcta

SEQ ID NO: 4793 - DNA, 598 bp, Bovine  MMBT09062
  misc_feature (1)..(58): n is any nucleotide
nnnnnnnnnnnnnnnnnnnnnnnnnnnnnnnnnnnnnnnnnnnnnnnnnnnnnnnnnncctgacctttctttctctctatcatctctgttttcatgtctctctctcactctcctcttattctttcctgttcatagttcctttagctaaacaagggaagcccaacaattctaaagtgggtagtctatcccttctccagcagatctccccaacacaagtattgaaccaaccaatcctgcactgcaggcaatttctttaccaactgagctatgagggcagccccttttgctaaaaaaaagagrcaaatttcagaaagcaagaatacaatttttctctgagatgccattgtgtgcttttggaaaagctttcttctctgctattcatggagtggtttactgccctatatgccattctctgcaatttggcaaagttctccattaagagtttctaccccactactgtgaactcttaatattttgtctgaaarttctcctgacttttgttcttcttgtgtgtagcagagaaatttytcttaattaaagattctcaagtcaaggatggtagtaacatccttttctgtagcagagacaatactacgtg

SEQ ID NO: 4794 - DNA, 598 bp, Bovine  MMBT09448
  misc_feature (1)..(203): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgtgccttatgtacaatgaatactccctcccccacaggaaggcatccgggtttgtagactggctgtgttaactaatgactgcagaaagctactrtcttatgctcaggatcatacccaaaatatctgaccacctgtaggtcaggagcgctgaatgcatgctgggcagattctggagccccccttgctgtggcaggtggtractttttagttcttggattatagygggtggaggcctgggagattccgagggtgattgttgactactgtggraagatttctttatgttaataatcagtatgatcatactgctgctctgagttaaatatcggcyttgccattgtagtcatatttaaaaaattctgataagaatgaagtgagcttcctatacgctg

SEQ ID NO: 4795 - DNA, 600 bp, Bovine  MMBT09459
cccctaaaattaaaaaaaaaaaaaaaaatagaatgggcatagtcacagctgccttctagcattgagaagtggattgtataagacactgcacagagcgctgtcacataatacatattccataaaaggtgaattttattattgttgttgttatgtttttttgtggtgtgtgcttcatcagaggagcacacagaataagctccctcagcaaagagggaccaaagtaaagttttccttcccagtccctttaaattgcatgatgacttaccatggttcagaactaggctgagagtccaccaccartgcacgaaggatctgggcaagctagatcccacgaggcatatgagagtgataccttctggctcagggtcagctacacctacccggatgcattgatgacatcgtcactcctcccaaggaaccagaagtagccctcttcgtcaatagttgctctgtccccagtgttataaaagtccccacattccacttcagctgttttctctgggttattctgcaaagagaacagcactcctttgttgaaagcaatgagtttagagatgatgagcctcaacacagggttcagatactggcttcaaatcctgc

SEQ ID NO: 4796 - DNA, 598 bp, Bovine  MMBT09436
  misc_feature (1)..(1): n is any nucleotide
naagtcttaatgtctgttatttactgtaagaagacatgaactccttatcctaatctgaaatatgtataatccattttaaactttgtaccacattactattttattagtctcttctgttcctggcttgttttaaatataaaaattattggaagaaattgtttctctttaaaggatttgaagcttaactgtctaaaggcttaaatataatttcttcattgttcctttgcaatttctataaaaatacaaaattattttcatacaggaagctgaaaaagcgggctgttgtaaaggaagctgctrtgcagttccttcctttctaaacttcaagctgaatgcgtttcctcactccaagttcaagggcttagtttacgtgcctgaagataaactgaacagcacctgcctcttagtcacaaagggaatgtcttgaagctgygaagcaatcatgtgtactcagtttcagcttttgagattctcaaagcatgtggaaaaaaaataaattcagtaacgaatagtataggacattccagggtttcggcagctcaccttgggcttccctggtagctcagtaggtaaggaatcagcctgcaatgcaggagac

SEQ ID NO: 4797 - DNA, 600 bp, Bovine  MMBT09143
taagcacacccacaaaccttttccaagaacagttgtatttgtccccaggctggcaagaatgctttgctaatgatatcaaagccttttgatttatctacaagcaatctgacttgaacactgaggaaaaaatactcattctgttccacttcaaattaaaacaagctattttttgaatactgggctgtctttatttttctttgaacacaggggaatatgctgctctgagaccttgtactatttactctctggctgtggaacagcagcaaaacacactattaatctctgcactggaattttagraaagacaaagtataatttcatttccaaaaatgatcatccatttctacttcttaccaagcggaataaaggtataggatttactctcctgtttgaaacaaagaagaagctgggacaaaatacaatttwaaaaactggtttccaggcactggacagaaagaagctgtgagaggggaacagtcaaggtgagccccatgcctgcccactttattgtctgaagggtggggcygcagacaggatggggaaccaggcagagacttcagtctccccagggcagtgggggacagaactgagggtcctggg

SEQ ID NO: 4798 - DNA, 600 bp, Bovine  MMBT09113
tttttaattaaaaaattctaatgtaaacaaaatgagaaataaagtggtatgttgacccttttaaggtataaaaataaacacttacattttattttatgactttaattttcacagccaggtggtataaatacctttaatttatagcactttctagctattgcatttaaaactttcattttccatgtcatttttaaactgaatttttmcaataaaaaaaaattagaccctgaggaaaaaaaaaaacactgtttgaggattattagttcataacttggtagtaggaaagggtgatagaacaaragtctaaactaatgaattgggattgtgtaatatttaaatagccatttgcattaaaaaaaataggttgcccaagtgctaaatatgatacagacattaaagtaattagaaaacaggaggtggccaggggggtataaggtaccagtgaatttggggtaccagataaatgtgaaatttaaagttcacgtagacacatatgcatacttttttttttttttctttttggtagctctctccgaatcatttgtttatagtctggctggacttgcggccgcagtcctgccccttgagagatgggatctt

SEQ ID NO: 4799 - DNA, 600 bp, Bovine  MMBT01270
catcttctatatttttgtaaacaatcatagccacattcttcccaagacaatccataccacagtggaaaagctttgattatctgttaagttcatccttccctaggtgaaactggcctctgatcaaaatttcatttccaatttcaaagtgttgagttttatttagatttataaacacagggaaaaataaacagcgttttcttttttgttttcctttgagatgacatgaagcccaaaagccagttgtagaataagaggtgttaataggatttggaggagagacacagtttgatattcagagamaaagatgggcttgctgggctgtttcctctatcaaatcttcattaccctccacactgtgtcattactcacaagctttagtaccaacatgctgctctgacatccctccctggcccctctttctctccagaaataaatgctattgatcagcagtggtcatattgaaagctggcaggaatgcgtgagcttattaagtttctttattaaagttgaacataatctggaaagaagagttgattccccctggatttatggtcatttatattttttcccttgtaatcctccatttgtaacatttcatta

SEQ ID NO: 4800 - DNA, 600 bp, Bovine  MMBT14513
caaagagactacagaatgggcctggaaaattaacaaggcctggtgctctctgcctaaatcattgttacacactaattagtgctgtgctctgatttgaggctttaaatttgttcctttgaagattttcttaaaattgtattcaaaggaaaggctcctctttaataaaactgtataattcttcattcacttgggaaacatagcttcctagcataatgctgcttgaaaacctggagctgacttctaatagaggtgctaattattaacattccagtatcagccaaaggctgcattctctaagamtgaaataaaataatagtgcacaaatatttcaactccattcccaataagtacttgaaaaattcaataatgttcattaaatgcataaatgtgaatattaaaaataaagatatttcccctgtgatttatgatgtactatctgaaaagcaaagctgaagaaaggcatcattatatggcataaaaaggaattctttggctgttaattataatgtaaatttatcattacaccaggaaaaaagaacagcttgatatttaaaaaccatcaggcatggttggtcattcaaaatatagacgcattaatct

SEQ ID NO: 4801 - DNA, 600 bp, Bovine  MMBT13288
aaaaagattctaagtatatgaattatgatgaaggtattcactgtacaaatgagtcatcagtgtgaagaccaatcattaatatttcatgctccctaatattgaggaaggtgtaagttgtatgctggccttcacacaccaccttattttcattttatttatactgcatttatactgcctgattaaattattttgttatctctctaaacatggcaactttatgcaatttaattttgactaccacatccacaatgtatttccttgatgatgtggtctaagaatctgaatatattcatcgaatcytaaaatgttgaacatttamgttctccttggtatcagtagctcccaatgcaagtatctttaatttgctaaatgctttgcttgtgtttcctaacagtcccaaaccacagaaccagagcattcacccaactgtaattacaattcacaaatcatcttttgtagaacctgatcaagagacattgcaaaataattttcagaaatgcaatttttatcaccttctttactatctatcaatataattcataactgtcattttaaagctttaatttcctggtggatattgcattattgcacacccaggat

SEQ ID NO: 4802 - DNA, 598 bp, Bovine  MMBT14068
  misc_feature (1)..(152): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagagacgttcttttcgccgttctcttttccttcccttttatcccagattactgaatgtcatcccctccgctacatagcaggaccttcttgttgtcctctgcaacggtctctcacacctcacgcaccacccaaaccagccctaaacrgaacccaacatcagaggcccaccagcctctcacagcctacttcacacactcacatagtaggtattcgggaaacttcaccgaatttcactaaacctgctgcaaataaaacaaagccacgtctgccctaagmcgaaaggcctgggccctcaggatgcatgttaactctttcatgctctccagaccccacacgtgtcactcgagattaatgagcaccgtgtccccaacgtccccagggtcagcctactggaatggaaacaggaatgagcaaggaacagcctcagaaggtcagaaatcccca

SEQ ID NO: 4803 - DNA, 598 bp, Bovine  MMBT17912
  misc_feature (1)..(11): n is any nucleotide
nnnnnnnnnnnaagatttaatgaaggaggtccttccaaaaaactcccccccattaataaagaaatatttagacttccctaatggtccattggttaagattctgagctcccactgcagggggtgtgggttcaacccctggtcaggggactaagatcccaaatgctatacagcacaacccaaaaaagaaagaaatattgactgttaccatctcacctggggaagcttgtgctgttgccatcaagtgtgcttcacctttgaggaactggccagggctcctctttattataaggtttggaaagscttggaaggataggtaggtcctgagcaggtgaggagcagagtgttcatgacctcagctttctttgcaggaaggatgttttttggaggggggggcagggttggccagaaatggttacttacagtagcctccatggccattgggatcagattccctgagagccttattagagacaagcagaaaataattgtcccacctgtttcctggtccctatgagcccaacaatgaaaacaaagtatrtgatctaacttcaggatcagaacttggagataaagcagtctgrgtggagaggagtyccag

SEQ ID NO: 4804 - DNA, 598 bp, Bovine  MMBT15906
  misc_feature (1)..(84): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnggatgaaccttataaagtcctctggaccttcatttctttatttgtaagttggagagaaactagacagacattgagaattttgctttgggcatttgatgagctaataaatagagaaatgtgttataaactgtaaaatgagatgatatgtgaggggttgtaattcacctggccacggatgacagaaggattgatccttgtgtccccagcacccagcasaggcccagggagctggggtcactagactttgctaaatgatgactcactttggctctttttgtcccagggacctggcccagctggacgcagcctcggtctcatccatccaggtggtaggcgtggtcgaggctctgatacagaacactgacaccctctttcctggaggtaaaactcctgtctttatgaacgatccacccaacttggtgccctccagactcagtttcagtccctggtagccccgcaaactcaccaggaggcctggaggaaatggcttctccccgctagcctcagtttctca

SEQ ID NO: 4805 - DNA, 600 bp, Bovine  MMBT16373
tggaaaagagcctggaattgaaaatgagaagacattgatttaaatcctgactgtgaaatattaaatgcaattacttaaccactttagatttcagtttcctctttagtaaaacagataatracartagtgtcatatttattaagatgattaaattaggtaacatggtaaaaatgctaatgggattaacaagagaatagaaaatattaataaatagagtatgttattgataatgattttcttctatttttgagcawtagggtaaagataaaacagtattgtttccattaatttcaacttggytattctcaataccatttattatttgctatttaattaggaaaacactttatatttttaaaatattgtacttaatattggccagaaaggtacacagtatctctctgtttatccactaatgtattctcttggtgaaaattcatcatctaaaaaatcctcagataaatattccagttatcaattgtaaaacaaactaccccaaaaactcagtgagtgttttaaaacaattattcgtatttatcacagttctatatgttgactatctcaactagaaggttcccactttgaatctctcatcatgtt

SEQ ID NO: 4806 - DNA, 600 bp, Bovine  MMBT17009
tcttgtgtaaccttagtctcactgcctctattctctgatcagctgatctgaccaaccacacaatgaaactaaaggtcatccaccctgaggacactcctctcactcctgttattaatgctgttttaaaagaggcagtttctgagtatttcaagacttaacagtagatctgtgaccttgaaatttagttttggacttatctaggatgatctttattaagtcttttcggctataaattactatgccattctggggacgggggctgcagtggggcaggcaggtgggaaaatcttttcctccccrgcagggacaagtccatgtagtaatcatggtggttcttcattgtgtgctccttgaacctctgcctaaaatgtgaggcagacattttagttgccagcttctctgtccgacttgcatttatacccaatcagtgcacagaagagagtgtgtgtgtgtgtggcctgcagcataaagaggcagatggttctgaaggctggtacagagtgggagcttcctgctgaacagatctgtctctgggggtaatgccggctgcccaataaacttatgttttctggcacctatacccattgccaagggtcttcc

SEQ ID NO: 4807 - DNA, 600 bp, Bovine  MMBT16751
atatgacatccttctaaacactgttgacccatttttcagccattgactccctcaccccattccatgccacccctccccgtaaagtagcagtacatagaccacagttctgagctgactcactggattgacccatgatctccacttccacagggccacactgaataatgaccataagctgttgaatgcttagagctcgtgggccaccctcttagaatgccttcacattttgaccctcaaactgggtgatatgcttacaaattgtcaactgtgttaattcccccaggaacttatattgtgacraygatgatgatgaattttgctcatttcactgttaaattgtaaccctacttttaatacattatttctattcctctgactaaccgtccgattagcttaaatatatgaatcttgtaacttctggggaagccagatgtgacctgcggcagtagtgagctgttttagaaaacttagagaactaaggtaattaagttagacgatacatctattttttttgagattccgttaggaaaaaaactggcagaaatatgaaaaactcaacttgtcatacacaagaaaaatatagtttattgacttgtgctg

SEQ ID NO: 4808 - DNA, 600 bp, Bovine  MMBT14355
actcatttctaaactacattaagaaactgagaacaaaagagatttttttttcactaatttcaaaagttaatgaaataagtttcaagcatgattatttctatcttctgaggaaatgtttcctgtaactgcctatgcagtgacacatgataattatttgaaaaccataataatgcggtttcattattctaacyatcttctttcttaaagggccagcactggcttgacagaagtgctcctaaagcctgtggtgccctcttctgacccttcactcaatagggtgagtcaaagcttttgtttctrtaaaaaatatgtaaaaattcgtatctgacacaggttctatgaaagaaatctgactacagctccatggtgtatacttaacaaattcttccaggtttcagttttgaaatttgagaattgttccagagaaaaaataatactgaaatttgaaatgtgatagcaatttcactcaagcaacatgcctgtgtaagaaaatcttaggaaaagaagtgaaaatattatgctaaaatatctaaatgaattacaaaagataactactgaattaaaattcaaacttcatgccataactgtgcgccttaggca

SEQ ID NO: 4809 - DNA, 600 bp, Bovine  MMBT11606
agggtctgtttctggggaacccgactcaccatactactcaacttgtttcacccaggattttgttcatgccttcattcgacagtcttttactgagtttttattatgtgccaacatatcctgaaggtgagtggctaatgattggctagtttgtttcaccaagtgtaaataggcgaggcttctctcygatgcagaatctatcagatttctgggaaatgagaatgcctttagaaaactttagaaaacaatgacacacagaattagatttggcacacaggaatctccttctcaaactacatcatrtattcctcaaggcagaactatagggtgtatttctttgtaaccacattattgttcagactgcattatgccctgaagttactctggacaaagaagtagaagcactgagttctcgtttatctttgtgaagtgaggagaaataggaagagacagcctggtgattaaaatgtgatgtgggtaaacacgggagggggaggttaatgtcaactttgtagaatgaataaaattttggccaactggcaatcctggataagattttcaaaagagggctgaataataatttctcccaagaagttccaactt

SEQ ID NO: 4810 - DNA, 600 bp, Bovine  MMBT22220
tgtgcaggactgattactgaattccagaaacttaaggggtgaaggactatgatcatgagacagaggagatgctttacagatggacagtctttcctgggctcttaaacttgcttaaggaatcgcagagcattccataaccactgaccacactagcatatccaaatgctggtagcaaacctgatggctgggactttggtgaagaaatgatttatttttatttctttatttttggccacagaggatgcaggatcttagttctctgaccagggattgaacccctgttccctacagtrgaagcayatagtcttaaccactggacacagggaaggcccagtgagaaaatgatttaaatgaaactatttaattgaaagaaaaatagtcttgggaattccctggtggtccagtggttaggactccatgcttccactcccagagggcatgggttccatccctggtaggggaattaagtttctacaagtctcagggcctagccaaaaaaagaaaaatggtcttccttcaggattggatgaggcaaaagggaaagtgggatgtagacataaaggagagggtaaacaatgacagaggcatgtgggtagggag

SEQ ID NO: 4811 - DNA, 600 bp, Bovine  MMBT22175
aatagccaggacatggaagcaagctagatgtccattcacagaggaatggataaagaagattggtacatatatacagtggaatattacttagtcataaaaaggaacaaaattgggtcatttatccacagagatgtggatggatctagcctgtatamagagtaatgtcagaaaaacaaatatgtatggatggawtgtatattaacacatgtatgtggaatctagaaraatggtacagatgagcctatttgcagggcaggaatagagatgcaaacagagaatggatatgcggggaggtgggaygaactgagagagtaggattgacatatatgcactacatgtgtaaacagatagctagtgggaagctgctgtatagcacggggagctcakytcagtgctctgtgattacctagaggggtgggatggggatgggttgggaagggaggtccaagaaggaggggcatatgtatacatatggctgattcaggtggttgtacagcagaaactaacacaacattgtaaagcagctatataccccaccgacacactcacataaggcactgagtgagccatcaccagttcgtcttttggtgacttggtgtt

SEQ ID NO: 4812 - DNA, 601 bp, Bovine  MMBT21402
  misc_feature (1)..(1): n is any nucleotide
naatcatctgactgggaatacagtaactcgaagcttaaaggtgatgagctgagtaacttttctcttttgcatcagtcggctcatgggcacgtgcacagaggccayggttaaataaatgcgtatttgcactctctgcatatgagcgaatctctgtgtccacagtttctggtgacatacggygttggtgtgtctcatccactcagaygtatttttcagttgtttcactcatgttcagtccacttctttataggagtcartgtttccacaagtttgtggttaaaacaaacaaacaaaaattcckattcattctcaagcttcctgagtaaactgtacactcatacacttcacagatttttcagcttttctcctcttcctatctcttagtcagacctactcatggaaacattatctgcactgtggtcttgaaataaatgaatttcactaaggctgcttgggagaatgaaatctttggtatgttccttatgtaagaaacccatttgcaagaatcacagagaaaatgacagactaatggtctagaatagaatcgctgctacactttctatgatgcagtggcataaaaaacaatcaaagkaaaaccaac

SEQ ID NO: 4813 - DNA, 600 bp, Bovine  MMBT20892
gaattatgatgaaggtattcactgtacaaatgagtcatcagtgtgaagaccaatcattaatatttcatgctccctaatattgaggaaggtgtaagttgtatgctggccttcacacaccaccttattttcattttatttatactgcatttatactgcctgattaaattattttgttatctctctaaacatggcaactttatgcaatttaattttgactaccacatccacaatgtatttccttgatgatgtggtctaagaatctgaatatattcatcgaatcytaaaatgttgaacatttamgttctccttggtatcagtagctcccaatgcaagtatctttaatttgctaaatgctttgcttgtgtttcctaacagtcccaaaccacagaaccagagcattcacccaactgtaattacaattcacaaatcatcttttgtagaacctgatcaagagacattgcaaaataattttcagaaatgcaatttttatcaccttctttactatctatcaatataattcataactgtcattttaaagctttaatttcctggtggatattgcattattgcacacccaggataaaggattaggaaaagcca

SEQ ID NO: 4814 - DNA, 600 bp, Bovine  MMBT11145
caaaataaaaagaactgaagtaactgaaagaagaattaataaaactccagtcaacttaattgcttgttattcttttaaacttatttgggagaagaaaatgagtggttagactcagttttgcaaakaggtctcagttacacatatgattctttactcaatttttataagcggtcaagtttaastcatttwaaaaaaatggttggtaaggggccaaattgcaatttttattggttatatataaggaaggaaatttcaggaaaacctcctcaaaggttttagttaggactctaagctattttstaccaaagctgaacattgtgggcttaattgattttccccttcccttcttgaggaagtgatgatgtgatgtaataaaaaagaaaacaaatatttgtagtgcaaattattgataactaactccaggtatttctatggttattttgtatgttttaacagaatctaacaaattatatctagctcataaatttctaagtgagrtgagtgaaattatgactcggattgtccataattgattgtatagttcatatgaaaataagatagcrttctctagatctgataatgttagagggtatcacagac

SEQ ID NO: 4815 - DNA, 600 bp, Bovine  MMBT08626
ttgggtcttttctaaaggaaatgtctgtttctaaatggaccaggctcatgtgctatgaaaaaagggctgtgaagataggtaacaaaacctggataactaggagaattatgaatgaagtctcttctccttagtgtgagagataacagaatcctatccaactgaccactcagtcaaatcacaacatcacccagttttttgctgatgtgcacagcagggtggtctgagacgtccagcttctgtattttactgaagatctgagatctgattggctgaatgactggctgtaaagcagtgggtcayacgggcagaattyctgaagtatggttataattcagttgcaaaagcattacgcacattgccaccatttggcagagatgaatcagatgcccgctgtgtaccaggcacctgctaggatctgcaaattaaaagttaagtaaaataaaattgtgacygtcaagcaatgcaatgtttatcgaagatgaaakgcttgagtcaagtcattgttggaagggcttgagatggattttgaaaagagtayaaacaaatgaatagattggccaatcatccttacaactttactccaaactgaacaatttttat

SEQ ID NO: 4816 - DNA, 600 bp, Bovine  MMBT08429
actgcaaattcttggtcattgatttcattgctgtagtgtaaatttccttctcctctgtccttaatataaataggaaaaataaccatacttctacagttgaaatagagtacttgacataatacatgacacataggtaactgctcaaaaatatcatggttgttattatgattattactattattaaatactcaacttgacacatattaatgtagagtctgttatatacaagatactactaggtttaggacgcaaagatgaataagaaagtgttctgtgttaaggaacacagagactagtgtrgaggataaaatatgcacaaagctctaccaggcaggatgttacaagttttccataataggaatcagtgctatgcatatattatatgtttatgtttttatatattaagtccctacttaatctcttcttcaggcaatacaaaaacagaaaataaaggaatgcattttcaaacagctttttcttaaaagattagtcattctacacacttaacctttcagatataaattggatgtcacattaaccagcaactgaatagagtgaagaacaattgactttattgttactaatatattagatagaaag

SEQ ID NO: 4817 - DNA, 600 bp, Bovine  MMBT16435
accctagagtcccagagcactgcatccatggtaaccgaggaagcctccagagttgtcaagtgtctcctggtagcaaaatcactctcaggccagaatgtctgatttcaggtctgaatttgaattacagactgtcccaacttaatgatggttccacttaacgatttttgactttactatggtgcaggacagggaagcctggcaygctgcagtcaatggggtcacaaaaagtaggacacaaatgagcgactgaactgaactaatggtgcaaaagtggtattcgattcagtagaaacagaattmtgaatgttgacctttttkggggctagcaataatcttttgtgatactgggcacaggcagggggcacagctcctggtgagccacgtgatcatgagggtaagcaatcgataccattcatctgtacctatacgaccattctgtttttcatttctgatactgtatccaataaattatgtgakattcaacacaagtataaaataggctctgtgttagacggttttgcccaacagtagactaacttaagtgttctgtgcacttttatggtagactaaggagatccaaccagtccattctaaaggaga

SEQ ID NO: 4818 - DNA, 600 bp, Bovine  MMBT18194
cagagacataggggtgcacgtcagtgcccggtcacctggagaggagacagaagccgaggacggtggtgkgggatcccagcttttagcaaggctctcctccaagctgagcctcttcctccgcctgcttcctactgcccttccccctccactggccgcctcggatgatcgcaccgagcagttcaggggctgcagaccctaaactggttctatagagaagagggatctgcccgactagttcttagctgatggtagggtctccagggacggagaccccagcaggacaaagggagagaaaacaasagtgagcggcaggaagacagagcagagaggcagcagggacccggggagacagacattcattcattcgctggttcattcactgtacaagtgtgctgagcacgtccgtgttccaggcgcggaggtggtgccgggtaggggagacacacacctgcctccaaggagacaggaaatgcaaagcaggggggatgtttaacgatcaaagcaggttgttttcaagttgtgtgatgctgggtcagccaactgctctgagcctcattttccccttctataaaatgggaataataataagaacaaccctaa

SEQ ID NO: 4819 - DNA, 600 bp, Bovine  MMBT16338
tgcgtgattgctgtgtcttttttattcagtggatcccttcagtacagtattttgtgcagtcactccgcatgttccagtaattcaccaagctggcaatttgttggtgtgattagggcagtacagcaaatctcagatgcatttaataggcaatctcatgctttttatgttcacagaaaaggtggtgctcaaacctaatgatgtttcagtatttacaacgctcaccattaatggacgtctgtttgcttgcccgcgagagcaattcgattcactggtaggtgtggatggccgccttggagcagygtgtgcaatcagaaaaacttgtctggagcttaattttgcagtcacattgaactcagttgctaaaaaaattcttgaatgctacttgtctttttcttttctccggtctattaggtaagcctcaggtgttcatttgagacgctctgagctttagatttacctttgtggaaattcaccaagttgcactatgattggggcataattcagctttcagaactctttgtagtaattcacctccttgaaatgtccctgatttaaatactgatattaaaaaacatgaacacttagagaccaggatagaaa

SEQ ID NO: 4820 - DNA, 600 bp, Bovine  MMBT14675
ttattgctacataaattatctccaaacatagcatcataaaccaatcatttattttgctcatgattttgtaggttaggaattcagatagagctcagttaagagattctggcttagggtctcttttgcaattgcattcagacagtggttaaagctggaagagcagaggactagagaagtgatggatagccagatagctctccttatttatgtagcctcagaacctctgcatataggaattttacatgggcctgacaactcctgggcagttgaactccttgcatggcagctcaggacttgagyacaagtgatccagtcaacaaaacaaaaactgtctcacatttctgacatagcctcaagaagtcacacagcactacttataccagattctattaattacaaatgaatcacaaccatattgctcaaggaaagaggcacagaccccacctctcaatggaaggagtataaaagacatgttgtaagagaatagcacatgggatggaaaatattgttgataccaactataagcaatgaatttgaaagatacaatctactgtactgcatgattttttttcaaatcccttctttttaaaacatgatatc

SEQ ID NO: 4821 - DNA, 600 bp, Bovine  MMBT20156
taaaactgtgctgctcaagggcaattcagtgactgatgaggtttctgtctggcagccctatcaacttgaacaatggaagtttcttgtgtcctttattcctgggaaatagagaaattctactgactaataaaaatttttcattaaaaggtagaaagaaaattttaacagatggctaatgttttattttgtacattcaataatagaaggtctgtcagctgcaggttgaagttttataatgaacatgatttaatggaaaatcgtttcttcagaatttcaggtagaaattcacaatggaaattmctagtttgactcatagggtgagcgtgggtccatttgacatatttcagaagcttcctagcactcttgaacttaataacctttgaaaataaaatattgaaattgtttaatttcacagattcttcagcactcttgaacttaataacctttgaaaataaaatattgaaattgtttaatttyacagattcttcagtttaaaatggaaacaatggtgttgtcacaaaatgttttggtgaaatttattaataaacttaaagcctcaaattcagatactggattttattatttagttactgcacatac

SEQ ID NO: 4822 - DNA, 600 bp, Bovine  MMBT20672
ctagaaaacctgaggcaaacaattacgccatcagagagccctttaatgaattaaacactgacaagatgatctgtcctgagttttcaaaattaagcatgaatacataagtggctatcgattttttttaaagtactgcctagtacagtatttctttcacatgtcattttatactactccatcaaaacccatgggttagctattattattattctcattgtcactattactcaagcctagtctttaaaatagtaaaagctcacttgcaagacgttctcctcagcaccattaaagagaaatatsaccgcatgatgtaaggcttctgaagatgtcgacaagacacgaaggacttccagcatcactgaacagctaactgcgtcatcgctggcacctttaaatcagaaaaacagatttgcttctcagattttaaaacctttatagcacaaaccatcatggcaagaaaaggagttttcctaccaaggcagcatcagaacatctgcagtagcaccgctctggcatcatcaggtaataactgcacccgccagcagtgacctccaggaggacagggatctttggtttgctcgctgacttactctcagtaac

SEQ ID NO: 4823 - DNA, 600 bp, Bovine  MMBT01422
tagaagctgaagcataatttataatgaactgatagcaaagtttatctactatgactaataatcataaagtagtaacggtaatgtcagtcataataagaaggaactaattagagtggaaaacaatatctctccttaaggaacctcacctagctgagaaaataagacatggagctggctcatcatgtgctaattcatttagcacagggaacccaaataatagcacttgcgtggaatgattgatggacccaggaaataattcacgtggaaactaattgattgaggagaactctcataccaccyttacctgtgacatgagatactttgcagtggcactgggatgctgctgtatgaagcagcccaaagcaattatttcctaggaaatgactccttacatattcttagatgtaagtgtcagctggactgagtgtcgagtaaagaggggaggctggctacagtggtgactgcaaaaggcatgtttttgatagagaaccctgtcactggattgagactatattcctgctgattggcaacgggttgagaaatattttgaagggacttattacagtgtgctaygaggattgaaaaaatcttgcaacagtt

SEQ ID NO: 4824 - DNA, 600 bp, Bovine  MMBT08437
gtaggagcgtcaccctgagttattaagttaatggcttgggtggcacgttatgatttatcagtgaaattactcctctgagggcagagcctataaaaggatggtcagcttataagtcatgctgttgcagagcagcaataattatgggtaagaaggaccctttagaaagcaagcttgttagtaaaataacaatgctctttcctctgtacatgtcatgatgcagtctcatggacagtgccacatcaactatttaaatgcaatgtagtctttgtaaacagcaaatgtgttagtggagatcctgasagattatctgggatgttggattttgctttatggcctctyacggtccttatgctctgcctgaattattaggttggggttttagtttggggcttaaaaagatcaggtcttttctctttgcagtgacatttgattacaggctgacctctgaatgtgcctgaataaaagcaactccaaatttgggaggatgattggattatgataaagctttcaggataactccaagcacctctacagcagccaaaggattttcagagccacagggacacacagtaactggctctgattcttttctctctggct

SEQ ID NO: 4825 - DNA, 598 bp, Bovine  MMBT07159
  misc_feature (1)..(206): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcccaccactcctcatcccaaccctctaaaactggagattttgaatacagaactgcactctgggaattacactgtctccatcccccaagsactgcattgtttgttgagtggtgccatcatccatctgtctagtgacttttccaaactatttttgcaagtactatattcctagcttgtgctgtcactgaaatctctgttaccttatctctgtttagttgtgctgcgaaggctgctcaatctctgtaaccacttgagaatatttttcacgtggaaaagagcatgacacaggaacttaagaaagaccccctacctggaaaaagcctcagtggagaggctaaatttcttcctagatgtgaccaaagggagccacaataagagatagtaaaaa

SEQ ID NO: 4826 - DNA, 600 bp, Bovine  MMBT10467
ttttttttttccagttttcaaatgtaagacctgttgcttctctgccttttggctaagatcaagtgtagtatccaaatgtaagccttttaaaactgaggcaatgaacattccagcattctgcttttaaacttgtggaaataaatgaagaccactcaaatgagaacaaaggctgtttattcagagattgctgtagcaagggagtcagccaccatgacttctgtttggcagagattcagtgcaggcaggggtgtgggaaagctttataatggaaagaagttttaggtgtgttctgattggggsttgttggcaaagtggagctggagacaggagctaaatagacataagacatccaagattgatttgaaagcatatctggcttcctcttcttggttctgagttggaagcagaggcaaaaaaaatatagggaagctggtagtcactaagtcctgactatttggggtgataactacagagtttgtagatcagagttgtgttgccacatgtgaggagaaggaaatggcaagccactccagtattcttgcctagagaataccatggacagaggagcctggtgggctgctgtccatagggtctcacaga

SEQ ID NO: 4827 - DNA, 600 bp, Bovine  MMBT04908
gcagaacaggcaaagaacaagcccaatgagtgctacagaccaatggtctgtgtgtgaagcagcctggggacacgccattctctggtcctgcaagctccatgttttgtgcaggcttgaccagggcctgtacttttctttaaagaaggaaaagtccccagattggacagcaggcaaatatattttcaagccaacagtawgtcagctagtactccatggtttgaagccctatgactgaacaaactcttgtactcttcaaagcactttcaataaaaagagaaaatcctgctgtcccttaccccyagcggcccttcatttcagtgctatagagtgggagtactttctacccagctgcagtaatagtcacaagatacactgagactccagctgcagtaatagtcacaagatacattcagacttcactgaagcagaagcctatttgtcacagtgaagaaaagtgtgctgtattgcttggtttataaacagcaagtacccaggaaatactctttgcaaaaagcactataattcaaaatcgccaataattttaatcacattcttctcttactaagtccatatgcccagcttcttttgaagtcagtggga

SEQ ID NO: 4828 - DNA, 600 bp, Bovine  MMBT04244
cctgcatcaattatttggttaagttatttcctaatatttcactctgtaggatgttttatataggacccccatttcatactctgttttaaagagaaaactattttttaacattaaaaaaaaactatttatagaatcatttaaaatatgatgaatggaaaaagagtactcattaaaaaagaggtggggggaattaccagagaactctcatttagaaatctcttcaactaaattatagttgatgtggtaaagaacaaatttaatatgttgcttacagaatataatttgaaacattctagtttyccttatctctgttctaggaaatacgcttcttccaagagttgatttcttgccgcaatttgcatcagagctttctccattgttgtatcttcctttcgtaagcctagattaacctattaatttcaaaagccgtawctttcacaatgtgctaggaaaccaagcctgagcaacyagagccttgcacaaacaattttatcaagtgtgttctgtttatttgccctacttgctccttataattaaattcttatacctctccccagagacaacctgtgtactttgagttgtgcatagggtaactcccat

SEQ ID NO: 4829 - DNA, 600 bp, Bovine  MMBT07012
gatgttactcattcttatatttcctcccctatgctcaagaagtagatgaacatgtgacaattcagttgaattagatgaataggggttgtcttaatgacttcagatgaatttttctctgtagagcaaccaaygggggttcaagaaattctgtaaaactctttgcttggatcgcttggtttggacctcttaaaacagataaatgattcaacttaattttgttctccttacacctccccccgaaccacccccacgccacagatggtgcttgatctctacagaaagatcaatagttcactccayagtggcccctcttagaactgtcttcattcttccttccttccttctgtctctttagcttttagagtataaattagctgagtcttttcagcccttgcaactgcttcgaagacaagcaacctgctgctgagtcctttacaagagcaggtaagttcaaagacagaaaaaccaataaaaagggaggcaaagtggtatccagagaaaagcgcttttgtcaggatgtagccaatcaggattccagtcatctgataagtctgtgtagacagggcaaagggagatgctaactggggagctgggagttgg

SEQ ID NO: 4830 - DNA, 600 bp, Bovine  MMBT03875
aggctcctccatccacaggattttccagggaagaatactggagcaggttgccatttccttctccaagtgaatggtatagatgcatataaaacctagccatgtgaagcatgaagctagaagctggaggaactgaaaaagtctgagtgttaaaaacgacaaagcagaaaataaatcattaactatgtggttaatcaacccactttccgtaagtcaccagctttctcaaaagattacactgctttgattggtttgataattaatgtttcttaaatcaacacagagccaggggttaagctaccrattctgtttgttttgtgcattaattctgcctgtgactggtggctcagtatattaataaatgcttgtccataactgaccctctgttttcttgcttgagaaaccaaagtggacagtggacacacttaaattggattgaacggtgaacttgagttctttctagggacacagtgaaacaagtctattcaactgaccacacactaaacaccatttgatctgccctgaagttaaacattatcatcaaaatgttttgcggagactatgtgagtataatggctatttccataaaacttcagtttttcg

SEQ ID NO: 4831 - DNA, 600 bp, Bovine  MMBT05409
gacgacttccagcgttgatatatgctgactccaagttgccactactcaaatctgccccaattattaacacttcagcagctaagaagaaaggccaagtttctcattgaccttctattcactaaaatgatatacctaatttgcaagaatatacgttttcctcattggaggcaataaaatcattcttgtttttgaatggggaaaagaagcaagcctgtaaagtctcgttgttcctgaattggccctcgagcaacagtgatcactcaccactttgctgggatttttgcttttgccttaatgccrtckttgcagtctatatgacgttagggatgaaaaagtgttctaatattgtcctgaccttttagccctgtggtgggtccagggaatgaggtgttaaagcaatctgcattattgtgctctctgtgccggaacttctctgaatcttgggctaaacagatcccacctcaatgtccataaacactgacattttctacactctcctgcttgtaagaattctgtctgtcagacttaaggttagcaacaaataattatgctgaagtttgggttaattaatgtatgagttgagtccatttgaaatttaaa

SEQ ID NO: 4832 - DNA, 600 bp, Bovine  MMBT07891
gagatcagaaaaaacaaatgaaatgtttccatgtatcagctcctgtcctcaagatcaacgctgtaggctgaaggattcaatgctggtggtcagcaaatggacatgggtgacacgagctatgtgtaaatgcttatgcaaaaattgtatgaagaactgtgagtgcagcaaactgtcccagactaaaggactcagcagttcctgggctaaagaaaacagtgtctatggaagatgctggtccagtacttccatatctaaccatgtttcaacagaagctgaacttcccaatttttatgtaatacrtttcacttttataaacactaatttttatgcacaactcttatattaatttcctcaccatattcactgcactattgttgaatcacacactgctatggatgtgctttttcgagagttcacagtctgacccattatgtaatattagttaccaatgccatttcatttccacccatttgaaaggcaactatggtataattatccatcaactagacttgtttccaggcttacgaattaagaggtagattgaatatctgaggatgaaatgcatgtaacgcataatattcggttgacgatattgaaggc

SEQ ID NO: 4833 - DNA, 600 bp, Bovine  MMBT10530; identical to SEQ ID NO: 4505

SEQ ID NO: 4834 - DNA, 600 bp, Bovine  MMBT12993
atctttccttttagtctcacacccatattctcaattccctctgtaagcagtggatgaattttcaggaaagaytgtagcagggagcctttacatggaccactgtccccctagtttattcaagatgtttatctttaaagacactgtccagtgatcctgttttagatcttagacccaaaggtattcttatatttcccctaatgtccagcattaayagataaattaaatactcctgttctgtgaattcaacagatcacccagggggcaayagaggagagtttatcaagtattttgttaagtatyaagctcyttttaagaatctagwcaagaaatcagaaaagaagttcatgctaacattttgtaatagactggaggaatrcaatgaagataaactcttggagaatataaggaccagacacatgggcaaaactgagaatagtgtggaactctgctgcttgatgcttaagaaaggcagtgctacttaggggataagattttagggtgctgaggtggaaaccttgttctgtttactcccagtattgtcttaggggaagtgattaattttctgagcctttaattgcctgtatctcctcaggtcactgt

SEQ ID NO: 4835 - DNA, 600 bp, Bovine  MMBT12042
taatattactcaattgtgttgagcttttactatatgccaaagcatttctacacgttttatctgcattcataaattaatttaatcatcaagacttgactaggggaggacccacttccaagcttggtcataggagaattgtcaggactcatgtctttactygctgttggccagagacagctcctcactaaatgggcctctccatagcaggctcacagcatggcacctcgatcttctgagagcaatgcctgagagagacagacacagagagagatggaagttaaagaagttaaagtctttgtracatagtctcaggggtgatttcctatcacatcattatcattttttaataaacatttgtttttaatttatctagctgcaccgggtctttgttgaggtatgtgagatctagttccctgaccagggattgcgcccaggccccctgcggtgggagcagagtcttaaccactggaccaccgggcaagtcccatcattttctattcattaataatgagccattaggtccaacccacactcaatgagagagtattacacaagggtgtgaataacaggaggcggggatgacaggtcatcctagaatct

SEQ ID NO: 4836 - DNA, 600 bp, Bovine  MMBT17532
ccgaccagggattgaactggcattccctgcgttggaaggcaacgtcttaatcactggaccacctcgctttggatgtcacatagtatcgcttctgctggactctattggttggggcagtcacaaaggtccacccagtttcaagggtagggaacataaacctcatcactctgtaggaagagtgtcagtaccacactgtaagaagaccatgtgtcatggaagatactgtgatagctatctgaaaaatgcaagctgccacactcccctggactgcttatgaggataaaatgagacagtgatgtraagtacttctcccatgcctggcacatggtgaatgctcagctatagctgtttttggtttttactgatgtggccccttcactttccacctctgccaagaaccacagggatcaccacccacagaggtgctgtgcagtcgcatggccacagaagaccactgacagggatgcacagacacgtgcatgagcctgcacagctgaaacacgtattgtctctcataatcccacctccaagtgcgcactgtctgacctgagtggggcagtgaccctgtggcaggaaggacctgaggctccttaggccctt

SEQ ID NO: 4837 - DNA, 600 bp, Bovine  MMBT14431
gggcctgagattctgaatctcaaacatgttcctgaatgatggagatgacattggtgccacactttgaggagaaaaggcctaaggcaccttccaaagagtcatttctcagctcttcctctatgttcacttctggaaacaacaatgataaccaccaccactttccacttatttcctgaatccaacatgcacattcttagctcaggatgatccccatttttagacaactgctggcttcttctccatttccaagttctccgttttccctctaaatgtcattcaaatctctgtccttcaccaggrcyctttcaccactcagggtctccataatcaatgtctccattgaggtcctatacctttcctgtggttctccttagccatattttttggcaagtatatatagttattgatcttttacatctgtttgtctccttactgaattgtaagcctcttgagcacagggtgtrtgttttgtcacccttttattccccagaccttaaatagagccccgcttattaagaaattgcacagtgtagcgctattaccccagggagacaggggttcaaaccccagctctaccattcaacagctgttggagcytgg

SEQ ID NO: 4838 - DNA, 600 bp, Bovine  MMBT13583
gtttatttttcacaagtatattaggcaacatgtaaaaaaaatcgatgtactctaagctttacttacacagcattcaactactgttgaaaaccaagctcttacaaactcagctctcacaatcactttttactaaatgaaaataatatctcagcattttttcttgactgttaactatgtaagttaacgggcaaagttagcaaccttgaaagtattgttagctttgattctaagcaggctagaaactcaattaagtcaaaatgattttggacaaagtaatctccaggcctgaaaaacaaatcrcatgagctacagttttctccaattccttcacagggtagataagatttttttgaagaaagtaggtgagaagcaggaaggctgctccatccaaactgactgcagcttcagaataagtcaattaaattcaaacctacctctttggggggtgggtagattagacctcaaagggaagagaatgaatggataattacaagcttcctaaattaactgttgaaggagggtgtataggggctatctgccagaaagaaggtaaatcctcctggcaggcattgagcactccttttatggggctggaatcat

SEQ ID NO: 4839 - DNA, 600 bp, Bovine  MMBT20283
ggcactgttacacatggagtttcttattttaatttttttgagccataactgagaacttggcacagaagaaactagagagagaggtctagttcctgtccttggggcttagccctcatcacactgtttactgtgctgaagtgtagtctgggcctcttgccaggaattgtcgcctgtgctgcctaataccaggccaggtatggtgtctttcagccccaagagcagatggagctctgtctatctcgtaacctcacggcaaataacactttcctctttcttcaacttttattttctcactaacasttcattatgggagggtccatatagttaaataggtaaaggtcaggagaaaaaaaaaaatcccactgaactagaagggattagagaggcagttctgaatgataacaggcctgagatgttttctggagtaagcacaggaaaggttatttggattttggtctaagaatggcagtctgcttactcagaatgatagcaaggcttaaggtaggaaaggaccccattacagtatacaattagcttgaaatttaatttttgtctttaaatgaagaaaccctaagatttggggcaggacttgcattcatt

SEQ ID NO: 4840 - DNA, 600 bp, Bovine  MMBT22496
atcttgaagtcttttcaaaaatctaacttggaagtacgacccacaaaaggaaaagaaaatgcagccaatccccttgtatcattcattgactgagagggaaatttccagcagaagttgcaataaaaggttttgagcaagtgtagtagatctgttctgctaacactgagactccctgcaaaagtatgtccttctttcaatcaacaagactagcacgcaggtgagaattaatgagaagatccccgccttcaaggaggccatgagcaaagaactacctcccatgttgactacttttacagaaayaccactgatttgtctctaactcatacctttcattttctccatttgcyaccgggacgttacagtctcactaaacagcagtgtgctctcccccatttcccagattcccttgcagttagattgtaaccacatgactagttctgaccaatgggacatgggaggaagaatgccatttccaaactcagtgatgtaagctcccagtgtggccctccagctttctcyttccaggctgcagtggtcatacaatggcatgatacatcccccagataggaacatctgggaccctgaatcaccacccagaag

SEQ ID NO: 4841 - DNA, 600 bp, Bovine  MMBT21371
aaaaaaagacccagaattgcttcatgttgtccacctcaacaggttgaatgaaactccttgacaatcacttgcgataacaaaatggccactgacctctcacctccaaaggatgcatccccaaccccccacccccaccccaccccaagcaaaacagacaacttgtgaaacagggtgcctgcaaaagtcccaagtttcactctggctggtcacctcgggtgacaagcctctcctgaaccaatcactgtggccaagagatggaatgtactgactggtctaccttaggtcttatttccacccctygagctgccttccctgggaccacagggttccctaaagggaagtgtgaactgcagaaaagaagaaagggaggatgaactgggggggggaattttgtgttggtgattctccccattcattcctctgagagcaaaacgcttctgccccaagaagagagtcgaagtagaactaaaatttcagctgtttcgtaattcccattataaaggccattggcattcttaaagacgatgtggcatggtgggttgcagcagcagggcagaattaaatatccctgcagtaagaaaaaggagggaaagggagaat

SEQ ID NO: 4842 - DNA, 600 bp, Bovine  MMBT19165
gctaacaagtggacagggaaaaaaacaagcaaactagaatttgcacaagaagcttctactgtagatgatcctaatttggaatcaagtaatagtgtgaaataaaacagatgaaggaacagtgcccaacataatagttttgtgtcacacaggaaagataacttggaaataaaaccagattcattgcatgaggttcaagtctaatgaggtgaagctttgagatgttatggaaacattcctcaggaagtattaacatcagaatattagagtgttgtgtttttttagtgctatcttaaagcagtygctctgaacatgaatcactttaaggactttgttccatataaacaattggtcctgctactttagttcacagtgaataatataaaatgttaataaaccttttaaaacttcagaactagcagtatattcaaataatacattttatagcttatggtatttaggaggctaaatcagacattattgtttgtatttaatgctaattgatctgctacaaatgcagaagtccaaactctatttatatggatgttcagttttatatttaaataacttttaatgtttgctagttggtttttttccctgtga

SEQ ID NO: 4843 - DNA, 600 bp, Bovine  MMBT21373
atggcaggaattagatcccatcgtggggccaaggctggacagggaagacaggtgggtttagggattggagctgtccgtttaggagggctgaaaatcagagagggagtacaggtcctggggaagcttctctccacacactgggccaactttggttgaaagcggtgctcagctcacccatgccacagtacgctggtgtgtggatggatgtgttgcagacaggcaaagggtgggtgcccagagagaaggcaggatgctcagggcctctgccagccctccaggacactcattttggcctacagrccccccagcagggagcaggcaagcatgttctgttttggcattaactaggcaagctgtgggaaagtaagcagcaggcttcctaagctgaatagggtctgctccctccacaggccagtgcactgtggttatagagcggtccctccccggcaacaattctctcccctgctccctgcctaaccccccaacycccagctcagcctggagggtcttctccgtggaagaggctcccagatgggtagcatcccatgccttccaggctgggaagccccagtgtcccagaagaggaaacgaaggctgagg

SEQ ID NO: 4844 - DNA, 600 bp, Bovine  MMBT21628
cccagcttacctctcctcgccatctggcgtctgtatggtggtctcagacagatctgccactatcgtagcggacttggcgcctccaacatacccctttccctcacctgtggatcagagcaggtgctcttaagtgtaggaaaagggcccctctcccccggttccccatctcctccccatcacaggcatcaatgcctctcaagtcttccgagcttctttacttccctttttccttcaaggcagcatattccagatggctctttcctccctctgactaccccagctattgtgcatccggaagtrttgcccctgactcaccacaacgttctgggaatgacaaggagtaaataagcggttcccccaacacggtgaacagcaggcggtttccactggggctccagcagccagtctggggtcagggagcaaagggcaggaaaagggtagtctatgagaattcaggaaggacgcacaggagcaagagaagtagaggaggtggggggcaagtacagccaacctcctcccccagctcctgcaccgcacactccctcctacctggcatcgccccgagagggtaggccaccgctcgcaagtccacatctgggc

SEQ ID NO: 4845 - DNA, 600 bp, Bovine  MMBT21370
gaaatgccataatacattcctgtggccctggagaccgaactggtacaggtctcagctgcrtctcaagaaggaggttttccaggcagagtggcccctggagggagtgagctcctccatccctgtgactgtgcaaccaggtgctggctcccttccatcgaggaggccacagatgggattcttaccctgggaaggaattaataatagccaccatttatttcrcctcttccatgtttcaagctctgaactaagcatattattttcattgcttctaaccctcaccacaaaccctagcagtacatrtgacccatttcacagatttcacaatctgaggcccagaagtaaaatgacctacccaaggtcacacagttaggacaggagagcgaagcctagcccctgactacctctggctctgaagctgtgctctcccttcagcatgcctgcagctatatagtctcctggaaggaatgtgattctaagtttaagtcagagccaggactgaacgttgacctggtacagatgtaagagtgggcattgaaagacaagctattctcatattccacaggactcccaggagaaacctcaggtaaagtatgcaccagc

SEQ ID NO: 4846 - DNA, 600 bp, Bovine  MMBT22831
aacaaattattttcccttcaggaaaaaagggtggcattcctaaagaggaaaaatgaaacaagttcagctaaagtttgcctagagggacagccattaaagagaaaatgttaccgttctctacatctamaatccaccaagagattctggaacacagtgaacaagacaactgctacatcagtgattaccccaagtggggaggttgatcagctgagttttaaaggattttacagagaaagtcctcatcttcaatgtttgtgagagacagggttttcattaagattgtttataaaccatgagaakactcatttatcttgtttgtctgtaggctccttgagtgggtctattattttgggggacaaagcatccgggcagtttaaagtcatctcctggggaaagtgactatattcaaagagaattcagtgctcctccccagctggagtagcgtcacagacagggggttgaggacagagtgataccactggaaggcccttgagccagggaggggagcttctggggggtgtttgggagaaggcttacaagcagaacaagactggggccacacttgctcgtccctttctgctcatacagctcagaagatga

SEQ ID NO: 4847 - DNA, 598 bp, Bovine  MMBT18672; identical to SEQ ID NO: 4515
  misc_feature (1)..(210): n is any nucleotide

SEQ ID NO: 4848 - DNA, 600 bp, Bovine  MMBT08326
ccatcgctccaagcctagaaagggcacgttcatgagtttcccagtcccccttcgggggaggcagtggtgttcagactcctgtcctccagatgcctatgagaggcacacgaaacacagtggactcttaagggcatggactctaccacccacaagtgtgtgatcttggcaagtgactctgctcctctggactgcagtttcactatatgtaaatttggaatgaaagctgtacccatctcatagggtgtatgcaccacgaggattaagggagtcaaatatgtcaagtgctggagagccgtcacrcaggagacactgtagaagcggtagctgttgttactgtcagcagagggaatgggagcttggtttgtcaataaacgagagactmacttcctgatgagctgttaaggagttgagggaggcatccttatctttgggttgacmctaactcagagagaaaggtagaaaggggctttggggtcttggctacactgggaggaagagtgggccatcgcaccccatggggggacaggcagatttattagaccaggtggccccattcgcttctgtctctctattcaaggatcaccgggcttttcttgagaa

SEQ ID NO: 4849 - DNA, 600 bp, Bovine  MMBT09982
cactgcaccagtttctgtggctcttagttacaaagattatttgtggcaagtgtatatgtaacaacacgatgcaggtgtactgtgattatttgctgttgtttcatttgtttgtgggacaaaatagatatgattaaactcatgcttcaaaccaacacacattgtatccacacaatgccaatttgggggagtcactcctaggttttggtataaataaataaaaatgtaatctattttcattctatttattactcactaataggatcacaagtggaataaaatgcctccgtgtttctcacactrggatttttttttaagtccccatctactcaagggtgagattgagactcgagtgggatcactctctgatattctcttctcagaagggttttgttttccttccctcatccacggtaataacctctgattctatttcataatgagattgaaaggaagcaactatataagctgagagtgaataattgtattattctttaaatgagcccattgaaatggcaaggaagggacattataaatcttttttactgggatatatattgagcttttaaaggcctaagtctgtgaaatgctccaccttattac

SEQ ID NO: 4850 - DNA, 598 bp, Bovine  MMBT16062
  misc_feature (1)..(11): n is any nucleotide
nnnnnnnnnnntgcggccgcttcgtacaagtgggctgcgtgcagcttcggcgctttgttatccatccctgctcggcgacagcgcagcctcccaggctggctgtctcaggctccttcccaccgccttatctctgtcttgcaggcaaagtatgaaaatgacaatttaagataacacataatggagctaatctttcttccaaagataagattttaaaacctggagtcactgcatatttgtgggctggtgaattaaatataaaaatagccaacacaatctcagaggcagaagaaggtttctagyaactcccmtctgttgtgggcgcttttgaataatgtctgctcctcacacgcggctcatttatttctctaggacctaattgagttttgctgtttccatattgtctgttttccaggctgccttggatccgacagctgtaaacaagcgagcagaagcctcagacccagcttaatgagctccgcgctggttcccgctgctcggctccggctctccgcacgcgtcagtgaggcccatggggctgcaggctctgaaatcaggctgggctgtaaggaatggaaaattccccaagaaagcgacagag

SEQ ID NO: 4851 - DNA, 600 bp, Bovine  MMBT16154
tataatagaattcatgcttaaataataaggtaacagctttggactgtgatgttttaaatgttttattgaaatgtagactgattaacaggcaagattcttcttctaattattttaattataggctcttaatgacaagaagctgtagaaataaaaacatgttaaaatttcatttttaatgaagtggcacctggaagtcccaacttctccaaagcaagtagggataatctattgttacatagaaacaaaccacatatacagagaggttaagatgttcgttgagggaacaggattatttatgcmccaatttctctgaatgtaagtagaacgaacaagacgtatagtgggataaaaagacactggactcagtcaagggctgatttttagccatggccctggtaaactgcttgtctgtgtgactatctcacctcttttggtcccagtttttcacaagtaaaatgcagaagttgaaattaatgagcttttcaatattcatagcagcactgtttacaataggacatggaagcaacctaaatgtccatcaacagaggcatggataaaagaggatgtggtacatatatacaatggaatattgctcagcca

SEQ ID NO: 4852 - DNA, 600 bp, Bovine  MMBT02774
aatgtgatcgttactataacccatacttctgtaacagttcagattgccactggcgtttgcgctctggaaaataatctggaatgtggatttttttaaaatcctgaatacactttttcatttcttcttccacacttagcttctcacagactttctttttggaaagattggtttcccgggacttgctgatgagcgtctgaaagagttcactgtttctacgtttgtctggtgggggcatccattgcacaggtgcttttttggaaggacgatccaaagttaaagtgttaggttggtgagctgtcrcctgctgggcactgggtgggttgtcctggggagtgctcgcctctgagtggctgtcgcaactggaagtggagagctcattacaggaagtcccactctcacttcctttatccgtgactttgtcatgtttcctatcttcgtgttcttgtttaggtgacactattttctgaggtggtcctaaaaaggagaaaagaagtagaaaaactgagtaagaagtgggaaggtcaaattaaataagctttatatatattttattttcaaccacaaacatttaagaaaaatgtggtctgctaccctaattta

SEQ ID NO: 4853 - DNA, 600 bp, Bovine  MMBT01044
atctgtatgttttgcttatttttgcagaggactctttgggatactattaataagaagaaagcatcagcctcttcaagacataacaagaaggcttcaaatattcaaaatgtgaataaaacatttaatgtttcccccaaagctgacagagttaggagcccactacaagcctgtgagaatctggctacaaatggaaactgttccccaccagaaagcaatcctttaatccttgaagaaaataaactccccatatcacctatcagccccgcttcccaagagtgccacagggggacctgcttgccrcttcctgttcgtcgatctacaacctacacatccctccctgcttctgaaaatgggggactggtgaaagcagacggtgccaacactgcagaagattttcattttaatgagaaaggcataactgaaacctcctttgactccatagacaacgttaatagtcaaattgaagagaatggtaaacttactcttaccccaaattattcttcaagtttgaacatcacacaaagccaaggacattttctaagtccggattcttttgtgaataatagccatgcatctaataatgaaccagaattcgtgaag

SEQ ID NO: 4854 - DNA, 600 bp, Bovine  MMBT01338
gctcacaagtacaactaccatagaacagatggcaaaacctttacacactagactttatatctgaaaaggagacactttattttaaaattgccacttgggagcataaagtgctctcatgagaaaaacacattttgcactttaaaggcagtccataaaataaaggcagatgtttaaatgacttcttaattaacacaaagaaaacatttacctacaccgtggggatgaagcactgcaactgatgaaccctttaaaatagcctgggacatgttatatgtaaagcaataccaaacattttatctyttaggatttttcgatattttgttaaaaaaaaaaaaaaaagagtgattattatttacccataattcattaatttgaaactcttgtaaaaataatagctgttattttctagtttgattaacatgctttttgaagtaaaatgtgcttgagtctaaaacatactatagtcacaaacaaatattatcttaaattaattatatggttatgttgcccctttagcactgaacacttctattacccaaggaaacattcattaagggattagagagatggaaatagttctcaaaatatcttcacataaaa

SEQ ID NO: 4855 - DNA, 598 bp, Bovine  MMBT06242; identical to SEQ ID NO: 4504
  misc_feature (1)..(35): n is any nucleotide

SEQ ID NO: 4856 - DNA, 600 bp, Bovine  MMBT04032
taacttacttctgtgcccttttacatcatgtgaatgaaaccaaaatcttagtttagatataatgcctagtaattttttacatttttttccaaaagcagagaaaatatgttggtttaaattgcaagtgtatttggtcctagatgggatggtggtttagtcactcagtcgtgtctgactcttaggaacccayggactgtagaccttcaggctcttctgtccatgggatttcccaggaaggaatactggagtaggtgtcatttccttctctagggaaacttcccgatgcagggagtgtaccckgctctactgtactgcaggaggattcacaaccgactgagccaccaaggaagccctagaaggaataacaatgtgattaaatagaaaagtggatataagcatgcattttcccttcaaaaatcagaatggaacacatcataataaatatgattctaggggaagttgggatcgcattactaaaaataaaaaaattccttacaatgactaaaagaagagaaagaatttgcagacttgctaggaagggggtgataattgcttcagtgartttrataatgtaaaacccttcaaaaatactagtggttt

SEQ ID NO: 4857 - DNA, 600 bp, Bovine  MMBT03185
cagcttttttgaagcttgttgtgaggaagacttttaccaattaagtgaaaaaaagatgagagattgacagattgaaggctgttattcgaattttaaatatagttttaattcattgtgggagtacaagtacgtctcattgaaaatttagaatatagataagcaaagataaaaaattttaaatcattgtttccttaaaaactgagattatactgtacatattgttttataacctgtttcttttctactcttgctctgaacattttcccataccttattcttaaaagcatttctaaaaattgmctagtattctatttttggaatattrtagagttactcctactagtttttacttgtcattgatcatttaggatgttttccactttttcagcttatataatagcaccaaatgaaaatttgtggtcataatcattttatgtccatctgaaatccaaacttcacctcggagcctccacatccttgagctttggtggcatgatcttgaccctccccagttactgtcctccccacaacacgcattcctcagttgctgccctgagctccaccacatctgcatcaagggtgtctggcagctcagcgttg

SEQ ID NO: 4858 - DNA, 600 bp, Bovine  MMBT06239
aaggttgataggattctcagagacaataaacacacgtttatttacaaactattgtaaatttacaaactgttatctttgctaaatcctgatggtttagggcagaaaataaggaatttacataaaactaactctcattcctggaacactgtccttgggtagttccagattttggaactgttacccttaatctaaatggcatgcaatatctaatagtcaataagcccctaatatttctaagtattccgatttattgccattggcttagaattttaaatcttaattatcttgactttccatttmttctttctcgtttcccttcccaccctgcttgatgtttccaagacccctagcatgcacatcgtgttctctacttgattcagttaaacatttcaattttagagttctttgcacagctgcttctgcagtttggataattagtgttccataaaatgaaaataaacagagaaagatacctccctccctctaatgttctttaaagaaattctacataaaaactgctgtgatatatatatatatatatatatatatacacacacatacatacgtgtatcagtgaccactatctactggtttccatgc

SEQ ID NO: 4859 - DNA, 600 bp, Bovine  MMBT09142; identical to SEQ ID NO: 4511

SEQ ID NO: 4860 - DNA, 600 bp, Bovine  MMBT04130; identical to SEQ ID NO: 4514

SEQ ID NO: 4861 - DNA, 575 bp, Bovine  MMBT05944
ctctaaggcagaagcatatttcataagattcatatgatttacaaacaagaattttaagttctaattagtactttcagggtgattcatgcaaaagaaagatttctgtttgcatgtcaatggaaacctgctgccttagaaacccttgctaaactatatgattaatctttgtacatgaggaaggatttattttttcttattcccagtcctcaggaacagattcaacaactttagtgtcttagacatttaaatatccatgagtcttgcactatgttttaggtttggtatgtggtatgaggagayaaaaactcctagtaagagttccttttctttaactataatatcccaactgtttctctccttgtgtgttcctttcctactttcctctctcttgtctttacctcctgtccctttctccttcctctgcctttccttctgcagtattatatttcttttagaaatatttatggccagtacttgttgtatggtaactttgattttgttagctcttaagctagggtgacttattttcacactgtgtaattattaattaaaaagatttattttaaagttcttta

SEQ ID NO: 4862 - DNA, 600 bp, Bovine  MMBT05260
gtaatctagaattaggaagaaagaacattcagacagacacgtcaacacagaagagaagcaaggaaacattcatgatgatgaagaagggaaattccaggatgacaaagggtccccagagttgaaaaaatcagtacaaatgagagccctttgactcaaaagacaggtatgtcaagggcatgttatcatcatgatacctgctctaacagtatgtttttaatctgacagaatgactaaaagaattgcgtcttcaaaacaaaggagcatgtcattacagagggagtcatgagacataggaagtarggaacccaaataaggagaaaagcaaagggaactctaaggatgaaggacaaagggaaatcccaggatgacagttattaaacagacctagagatgtatcaaaacaaaacagaaacaaggaattggaagacagctgatgtgatttatctagtgaaaaattagttctcacagaaaggtttttgttaattgttaaacaattaacaatacatacatacaaagaaaataaatgtttatattaatgaaaaacaaaagtaccaaaaaaatcatcatagtacatcatattttcaagggcataataatact

SEQ ID NO: 4863 - DNA, 600 bp, Bovine  MMBT05478
atatagtgtgacctggtcgctgcttgccatcagtcttacaccactgtctctcactcctgtgtcattgtcaccctggtcttctgagaatatagcaagctcttttgagcctctgagctttaatgcttctggcttcatctgctctgaagtacttgctcttccttgattccacccattgctgctgctttcattatttaggtcagagcttaaaggccttcccttcatggatgccttttcttcactctacttaaagtagatggcagaatttccttctccctattttcagagaaaaattgtgctgcraaattaaacagacaaagaagacttgttcaagactattgcaataaaggagagagattgaactccattgaaacaaaaagcagggaagtgtttaagttcggaggtgagctaatggatagcttttggaggaaatttggtgagaagggttgtcaggccagctgtgttcactgggtgaagttaggctcctaccctccaacagagcctggaagatagggtatctatttttcttgatcattgcagttcaaagggatacccccggtccttgatgaagacatccttgggttgtaaagctggtcagaggct

SEQ ID NO: 4864 - DNA, 601 bp, Bovine  MMBT07760
  misc_feature (1)..(1): n is any nucleotide
ntacctctgtgtccctgatgcctgccatacgccagggtctccgagatgtgctaagctgactgacccagctggggtcctgtctctcacagccagctgatactagccttgtggccctctgmcctctgctatgggctgtttcttctgcaagcgccgtccttgttcatccacgttttttttgtttttttttttttcctgattattggaaatttcctcatatttgaccactttgactcctgggcccatgaagaggctagcagcattggaacggggcctggggggccacaccagatcgaggccaccrtgtcttttcatgaagttgtgtttgtgcaaactaggtgggggctgtcagagctgagagttctctacagggccccttgccctctccctgcctccagtactcctgcaaccagcagggacccgtgggggtgagaggggagccaggctacgttgattatctttgacatcagttgttaatataattttgacattaagcctcccccttaccagctccggggtagctctgtgtccaggctctggcgtggggagctgtggggagcctctcagccctggatctggcctggctgggaggcggcctgggaag

SEQ ID NO: 4865 - DNA, 600 bp, Bovine  MMBT00824
accaatgacaatattttctgagcttctttgagaataattcactttttgttattaaattattttcctcaaaatccttctcaatttgcagtattaagacaaaagaaacttttgtttctttgaaaactttggacatacattaaattttaataaaacaacaagaatgtccagaactgattctaagttaaataatacaaaaaacagtatccaaaagagttttgaagaaataataaaagcagtgtctgaagaccatttctgaccttcactagccttgtgatagtaaacaaatcatttgaaattcawacattaaataaataaatggaaacagatttaatactttgattcattggcaaatgcaatttgaagagttttaaacttctgaaaaatacagtgatttaattctaatttatatttttaaggctctaactatattaaatgataaattcccaagagattttataaaaggacttttcctgagctttgctattcaaaaaatgactaattatcaaactacattatgttagtgacacaaatagaattttgtaatatgctatacatataaaatttaatacaaaaaatgcagatggcttacagttttattct

SEQ ID NO: 4866 - DNA, 600 bp, Bovine  MMBT18186
cagcctggtatcccgggagcaggctcttcactgggtggcagaggtaaagctgaccccttcgctccacctgggtctggagacacaagagtcgggggatggggtgctgccataaggcctgactaaatcacctccaagtttcctcacacaggaagatcctcgtgtgggtgctgggaggggcttggcagcctcttcacacacctgctctgtttacagaccctgaagattgcattagctctggccagcagactgggagatcccatctacgattctaccatcactgagagtatggatgacatgctyaggtgggcccccaggagcaggaccctgagtactacagaggtggcggcaggtgtggggaaaggatcaggtgaagcagctggtggagcagtaaggcctgcagtcccaagtaaatgtcagctcaaccccagctcacagtgtgacgcaagttgcctcactgtgtgcctcagtttccccatctgtacaacaaggtggcctacttcatacagctctcaaattttcttgatcccagtgagtgaaagttgctcagtcatgtctgactctttgcaaccccatggactgtagcctgccaggctcctctat

SEQ ID NO: 4867 - DNA, 600 bp, Bovine  MMBT16506
tagaggcactgatatactgatatgtacaattttttggtctcacacaaacataattatggactgtaaggggtatgctggctttctatggttttagtttaytatgtttttgagggtacatarggcataatagaaaaaaacaaacagaaaacaaaatatcaccttcccaacccaattagcaacatctcatactatgtaaaaattaaatcatctttaagcactttaaaaacaaaaacttccactgtccttggtctgtgggcagagcctccctggagaaaacaaccttatactaggtacaatgtractatctgtgttgcaaatttatgtaaaatacagatgcagcatacagagataccataggccaggaaacaaaaatggacatatgagggtccgttgtctgaaaggaagttaagagctagggtcaatattaactccaaagattaataaatcttgatagtctctatgcaactaaaaaggatagacttacattattatctttggtttgcacagggctttaagtatttagaaggtaggttgactctaggaagcagaatatccattttttcaagcgttgcctttctaaaatgtaatgagcggcagttt

SEQ ID NO: 4868 - DNA, 600 bp, Bovine  MMBT19278
tcaaatggagcactgagaaatgaatacagactccctgctggatccaacttgttaagagtgcagtgtgggtccctcagtccatacacactctacagcctaagatgctgttcatacagcctaaaattgagccagattatcagacaactgtcaaaatgcaactgtggagcaaagagacagacatatgtgaaaagtcatacaggctggcgaaaacccctccttaccctgttccatcaatgacccaaacrsactcacttgccagatttataactctcctgaaatacagatgaaaagtagaaggtyggagggctgtcactatgattacagccttttgccataacccataaccctcattttatttctttccagttttgtttttaaattgttttctttctctgattactaaagaaatgttcaatttagaaattttaccacattcccatccagaaatatttatcaactgataagaatctaaaaactagcatttttatgcattcaaccaaagaaaataaataattatccacatatctgtttgttgctatttggtcactaagttgtgtcggactctttgccaccccatggactatagcccgccaggctcct

SEQ ID NO: 4869 - DNA, 25 bp, Artificial sequence
  Extension Primer
atggtttcatgaatattgattagct

SEQ ID NO: 4870 - DNA, 25 bp, Artificial sequence
  Extension Primer
ttcctcatcagagctagagagcaga

SEQ ID NO: 4871 - DNA, 25 bp, Artificial sequence
  Extension Primer
ttaaatattcacagttcctaagtct

SEQ ID NO: 4872 - DNA, 25 bp, Artificial sequence
  Extension Primer
caaagttgtcttagtttctcttccc

SEQ ID NO: 4873 - DNA, 25 bp, Artificial sequence
  Extension Primer
gtaatctgatctcatggtcttcttg

SEQ ID NO: 4874 - DNA, 25 bp, Artificial sequence
  Extension Primer
ctgtgaggtggtttgattcacatca

SEQ ID NO: 4875 - DNA, 25 bp, Artificial sequence
  Extension Primer
actcaggagtgtacacagatcctat

SEQ ID NO: 4876 - DNA, 25 bp, Artificial sequence
  Extension Primer
gtccatggctcttttccacaaaaac

SEQ ID NO: 4877 - DNA, 25 bp, Artificial sequence
  Extension Primer
atcctccttgcatggctgcaggggt

SEQ ID NO: 4878 - DNA, 25 bp, Artificial sequence
  Extension Primer
attttgaatattatttagacttgcc

SEQ ID NO: 4879 - DNA, 25 bp, Artificial sequence
  Extension Primer
gaacaggcctgttaggatgaccagc

SEQ ID NO: 4880 - DNA, 25 bp, Artificial sequence
  Extension Primer
tcttcctggaccaggaattgaaccc

SEQ ID NO: 4881 - DNA, 25 bp, Artificial sequence
  Extension Primer
aagcggccttggtctgtaaatgcac

SEQ ID NO: 4882 - DNA, 25 bp, Artificial sequence
  Extension Primer
agggaaacttcttttcagtattggt

SEQ ID NO: 4883 - DNA, 25 bp, Artificial sequence
  Extension Primer
acttcacaatacatttttagaatgc

SEQ ID NO: 4884 - DNA, 25 bp, Artificial sequence
  Extension Primer
tgaccttggcaagtgattcaactac

SEQ ID NO: 4885 - DNA, 25 bp, Artificial sequence
  Extension Primer
gtagtggactgtgttcctaggcaag

SEQ ID NO: 4886 - DNA, 25 bp, Artificial sequence
  Extension Primer
tgtcattgtcgttaaagagactgtt

SEQ ID NO: 4887 - DNA, 25 bp, Artificial sequence
  Extension Primer
agggatcctcaggaagtcagctgtc

SEQ ID NO: 4888 - DNA, 25 bp, Artificial sequence
  Extension Primer
atgaagcagattttcaggaaggagg

SEQ ID NO: 4889 - DNA, 25 bp, Artificial sequence
  Extension Primer
ttcggcgctgtttgaaggttttctc

SEQ ID NO: 4890 - DNA, 25 bp, Artificial sequence
  Extension Primer
tggttctccccacttccgctggtgc

SEQ ID NO: 4891 - DNA, 25 bp, Artificial sequence
  Extension Primer
accagcgggagcagcacaagcagaa

SEQ ID NO: 4892 - DNA, 25 bp, Artificial sequence
  Extension Primer
ttgctgtggttctttaaaatatact

SEQ ID NO: 4893 - DNA, 25 bp, Artificial sequence
  Extension Primer
tgataaattaaagttgcatgctgat

SEQ ID NO: 4894 - DNA, 25 bp, Artificial sequence
  Extension Primer
tgccttttaacctcttctccaagtt

SEQ ID NO: 4895 - DNA, 25 bp, Artificial sequence
  Extension Primer
aatgtagtgtttactgggttaaaag

SEQ ID NO: 4896 - DNA, 25 bp, Artificial sequence
  Extension Primer
tgagccactccgaggcattctaata

SEQ ID NO: 4897 - DNA, 25 bp, Artificial sequence
  Extension Primer
caatttaatgaaatatgtcatatct

SEQ ID NO: 4898 - DNA, 25 bp, Artificial sequence
  Extension Primer
atctacaaattttgtgttaatctcc

SEQ ID NO: 4899 - DNA, 25 bp, Artificial sequence
  Extension Primer
gatctcccatgtttcccagtctcat

SEQ ID NO: 4900 - DNA, 25 bp, Artificial sequence
  Extension Primer
gacctgactgggctaaggatacact

SEQ ID NO: 4901 - DNA, 25 bp, Artificial sequence
  Extension Primer
gattatgtaagatactcatgactga

SEQ ID NO: 4902 - DNA, 25 bp, Artificial sequence
  Extension Primer
tctaaaactttactaaagtggaaaa

SEQ ID NO: 4903 - DNA, 25 bp, Artificial sequence
  Extension Primer
tgtaaggattaattgtgatggcaca

SEQ ID NO: 4904 - DNA, 25 bp, Artificial sequence
  Extension Primer
gccacagcgccctcaaaaagagcca

SEQ ID NO: 4905 - DNA, 25 bp, Artificial sequence
  Extension Primer
gacaacccatcttccatgatgcttc

SEQ ID NO: 4906 - DNA, 25 bp, Artificial sequence
  Extension Primer
caacctccagaacccacagtcagac

SEQ ID NO: 4907 - DNA, 25 bp, Artificial sequence
  Extension Primer
ataagatgctctgggagccctaagc

SEQ ID NO: 4908 - DNA, 25 bp, Artificial sequence
  Extension Primer
tctgcctgccctctctgtggcccct

SEQ ID NO: 4909 - DNA, 25 bp, Artificial sequence
  Extension Primer
gagtcacctgtctcttcctggacct

SEQ ID NO: 4910 - DNA, 25 bp, Artificial sequence
  Extension Primer
aaccgaaatactggctacaatgcat

SEQ ID NO: 4911 - DNA, 25 bp, Artificial sequence
  Extension Primer
tctttggtttccccatttgtcatca

SEQ ID NO: 4912 - DNA, 25 bp, Artificial sequence
  Extension Primer
ataaaatatgttgtgaatgccctaa

SEQ ID NO: 4913 - DNA, 25 bp, Artificial sequence
  Extension Primer
aggggttttgttgtagcaagagtca

SEQ ID NO: 4914 - DNA, 25 bp, Artificial sequence
  Extension Primer
acacataaaaacaaaattaccaaaa

SEQ ID NO: 4915 - DNA, 25 bp, Artificial sequence
  Extension Primer
aagttcatggagttttggcagttca

SEQ ID NO: 4916 - DNA, 25 bp, Artificial sequence
  Extension Primer
gaatcaagccctataaaacttactc

SEQ ID NO: 4917 - DNA, 25 bp, Artificial sequence
  Extension Primer
ttaaacagtggaaaccgttttatct

SEQ ID NO: 4918 - DNA, 25 bp, Artificial sequence
  Extension Primer
cctctcattatgaagattaccctcc

SEQ ID NO: 4919 - DNA, 25 bp, Artificial sequence
  Extension Primer
taaaaacaatcgacaccaagacata

SEQ ID NO: 4920 - DNA, 25 bp, Artificial sequence
  Extension Primer
tatcttagctcggaagtaagtattg

SEQ ID NO: 4921 - DNA, 25 bp, Artificial sequence
  Extension Primer
aaaagtgtactgttaatcattattc

SEQ ID NO: 4922 - DNA, 25 bp, Artificial sequence
  Extension Primer
acatgtttcgttatcacatttattc

SEQ ID NO: 4923 - DNA, 25 bp, Artificial sequence
  Extension Primer
tcttgtttaaagttaggcaccgcat

SEQ ID NO: 4924 - DNA, 25 bp, Artificial sequence
  Extension Primer
tgggaggatggttagatggctgcat

SEQ ID NO: 4925 - DNA, 25 bp, Artificial sequence
  Extension Primer
tcaagaccccagttgctccagctca

SEQ ID NO: 4926 - DNA, 25 bp, Artificial sequence
  Extension Primer
tattgtgtacagggctgccgtcaga

SEQ ID NO: 4927 - DNA, 25 bp, Artificial sequence
  Extension Primer
ggtccctattaaccatccaagtaat

SEQ ID NO: 4928 - DNA, 25 bp, Artificial sequence
  Extension Primer
gctggggaaacgtgtcagaaatatg

SEQ ID NO: 4929 - DNA, 25 bp, Artificial sequence
  Extension Primer
tggtacaggtaagataaaccatttt

SEQ ID NO: 4930 - DNA, 25 bp, Artificial sequence
  Extension Primer
aggaagccaggaaggtaaggcgaga

SEQ ID NO: 4931 - DNA, 25 bp, Artificial sequence
  Extension Primer
ggctccttcagccagaatagaaacc

SEQ ID NO: 4932 - DNA, 25 bp, Artificial sequence
  Extension Primer
gagggtctcaacaggctcagagggt

SEQ ID NO: 4933 - DNA, 25 bp, Artificial sequence
  Extension Primer
ggagagctggagtgaggccggcagg

SEQ ID NO: 4934 - DNA, 25 bp, Artificial sequence
  Extension Primer
ttaactgttccctggggcagtgttc

SEQ ID NO: 4935 - DNA, 25 bp, Artificial sequence
  Extension Primer
cataagttttgtttgagccccasaa

SEQ ID NO: 4936 - DNA, 25 bp, Artificial sequence
  Extension Primer
gtgatcaaagacattctcttttaat

SEQ ID NO: 4937 - DNA, 25 bp, Artificial sequence
  Extension Primer
atttgggtaagagaggtggcaaact

SEQ ID NO: 4938 - DNA, 25 bp, Artificial sequence
  Extension Primer
ggggaggctgacacagaactggtta

SEQ ID NO: 4939 - DNA, 25 bp, Artificial sequence
  Extension Primer
tctttccttccctcttccttctttc

SEQ ID NO: 4940 - DNA, 25 bp, Artificial sequence
  Extension Primer
acaccgagagctctttgactgaact

SEQ ID NO: 4941 - DNA, 25 bp, Artificial sequence
  Extension Primer
tcacacgagtctgatgaattatgat

SEQ ID NO: 4942 - DNA, 25 bp, Artificial sequence
  Extension Primer
tggaaatgttccccagctgactttg

SEQ ID NO: 4943 - DNA, 25 bp, Artificial sequence
  Extension Primer
aatcataaaagcaacactcaagaaa

SEQ ID NO: 4944 - DNA, 25 bp, Artificial sequence
  Extension Primer
tgtatgctccttgaatttttaacag

SEQ ID NO: 4945 - DNA, 25 bp, Artificial sequence
  Extension Primer
tccttctattagggctgccatatac

SEQ ID NO: 4946 - DNA, 25 bp, Artificial sequence
  Extension Primer
cagataacttccggagacaaggcta

SEQ ID NO: 4947 - DNA, 25 bp, Artificial sequence
  Extension Primer
ccagctgttcaaagtctattttgtt

SEQ ID NO: 4948 - DNA, 25 bp, Artificial sequence
  Extension Primer
aagcagcatgcaaatttaataggag

SEQ ID NO: 4949 - DNA, 25 bp, Artificial sequence
  Extension Primer
agttcacaacaaaactgagcagaag

SEQ ID NO: 4950 - DNA, 25 bp, Artificial sequence
  Extension Primer
gaaaggagggtttcttgtaaatggg

SEQ ID NO: 4951 - DNA, 25 bp, Artificial sequence
  Extension Primer
aatgtctaccgatgccgggtgtgga

SEQ ID NO: 4952 - DNA, 25 bp, Artificial sequence
  Extension Primer
tatctacaatcagtaaaatccctgg

SEQ ID NO: 4953 - DNA, 25 bp, Artificial sequence
  Extension Primer
tcctgttaagatttaaaagccagat

SEQ ID NO: 4954 - DNA, 25 bp, Artificial sequence
  Extension Primer
cccttagtgcctagtaaagtgtctc

SEQ ID NO: 4955 - DNA, 25 bp, Artificial sequence
  Extension Primer
caacagcaacgatgacaaaaactct

SEQ ID NO: 4956 - DNA, 25 bp, Artificial sequence
  Extension Primer
cagagagaaattctactggtaaacc

SEQ ID NO: 4957 - DNA, 25 bp, Artificial sequence
  Extension Primer
attattaaggaaatacagaatatca

SEQ ID NO: 4958 - DNA, 25 bp, Artificial sequence
  Extension Primer
gtgtccactccgggaaaaagggaat

SEQ ID NO: 4959 - DNA, 22 bp, Artificial sequence
  Extension Primer
tacaacctgtatcctatcaaac

SEQ ID NO: 4960 - DNA, 25 bp, Artificial sequence
  Extension Primer
aaggaagagctttggtaataccctc

SEQ ID NO: 4961 - DNA, 25 bp, Artificial sequence
  Extension Primer
aagaagaaataaaccttgcattcgg

SEQ ID NO: 4962 - DNA, 25 bp, Artificial sequence
  Extension Primer
gtggcagtcagaagtagtagggtca

SEQ ID NO: 4963 - DNA, 22 bp, Artificial sequence
  Extension Primer
cattcttcagagatgccaaacc

SEQ ID NO: 4964 - DNA, 25 bp, Artificial sequence
  Extension Primer
gtctcatccattttaaatgatgcct

SEQ ID NO: 4965 - DNA, 25 bp, Artificial sequence
  Extension Primer
atcttttaatgtaaaatactgggaa

SEQ ID NO: 4966 - DNA, 25 bp, Artificial sequence
  Extension Primer
ccctcagagtctgtgcctgtaattc

SEQ ID NO: 4967 - DNA, 25 bp, Artificial sequence
  Extension Primer
cggcaagtctccagctcactttctc

SEQ ID NO: 4968 - DNA, 25 bp, Artificial sequence
  Extension Primer
tgaggtggaggcgccagcaccgtaa

SEQ ID NO: 4969 - DNA, 25 bp, Artificial sequence
  Extension Primer
agcgggcactgtatttctgaacata

SEQ ID NO: 4970 - DNA, 25 bp, Artificial sequence
  Extension Primer
gggtaagaagtaggctacaccatga

SEQ ID NO: 4971 - DNA, 25 bp, Artificial sequence
  Extension Primer
gaggcggcctccaaggagtctgtac

SEQ ID NO: 4972 - DNA, 25 bp, Artificial sequence
  Extension Primer
gtgcagaaacagaagaactgggtga

SEQ ID NO: 4973 - DNA, 25 bp, Artificial sequence
  Extension Primer
tttatgattccatcttcctctactt

SEQ ID NO: 4974 - DNA, 25 bp, Artificial sequence
  Extension Primer
gtcagaatggattagggtcaagggt

SEQ ID NO: 4975 - DNA, 25 bp, Artificial sequence
  Extension Primer
ttgaagtacttctgcttcaggagga

SEQ ID NO: 4976 - DNA, 25 bp, Artificial sequence
  Extension Primer
aggcacgcaagagagctggggaagc

SEQ ID NO: 4977 - DNA, 25 bp, Artificial sequence
  Extension Primer
ccagcatgcacacagccaagcagag

SEQ ID NO: 4978 - DNA, 25 bp, Artificial sequence
  Extension Primer
tcaagttttggccttgaccttggac

SEQ ID NO: 4979 - DNA, 25 bp, Artificial sequence
  Extension Primer
tttgggtgccagtggctcttccggt

SEQ ID NO: 4980 - DNA, 25 bp, Artificial sequence
  Extension Primer
tcttcatatagtcagtgtgtcaagg

SEQ ID NO: 4981 - DNA, 25 bp, Artificial sequence
  Extension Primer
tcaaaatacttagctgcttttgtta

SEQ ID NO: 4982 - DNA, 25 bp, Artificial sequence
  Extension Primer
ttctccaaaaccgcaattctattca

SEQ ID NO: 4983 - DNA, 25 bp, Artificial sequence
  Extension Primer
tcggttttgcttgtttgttctaaaa

SEQ ID NO: 4984 - DNA, 25 bp, Artificial sequence
  Extension Primer
ttgaaccaatgcatagataataaga

SEQ ID NO: 4985 - DNA, 25 bp, Artificial sequence
  Extension Primer
aattacgacatcatactccaatgta

SEQ ID NO: 4986 - DNA, 25 bp, Artificial sequence
  Extension Primer
gaataatataccaggaagaataaga

SEQ ID NO: 4987 - DNA, 25 bp, Artificial sequence
  Extension Primer
aataatgataacaaaaacaaatata

SEQ ID NO: 4988 - DNA, 25 bp, Artificial sequence
  Extension Primer
tttaactagatttgccagttttcaa

SEQ ID NO: 4989 - DNA, 25 bp, Artificial sequence
  Extension Primer
agtagaggcagttttgagaggttca

SEQ ID NO: 4990 - DNA, 25 bp, Artificial sequence
  Extension Primer
gaaaaatcacctttacctcaccaca

SEQ ID NO: 4991 - DNA, 25 bp, Artificial sequence
  Extension Primer
ttactttagcacataatgaattgta

SEQ ID NO: 4992 - DNA, 25 bp, Artificial sequence
  Extension Primer
gattcaaacctaggttagtagcctc

SEQ ID NO: 4993 - DNA, 25 bp, Artificial sequence
  Extension Primer
grtgaacagatagttctaagtgttt

SEQ ID NO: 4994 - DNA, 25 bp, Artificial sequence
  Extension Primer
cgaagaaaatcagcctttcataaaa

SEQ ID NO: 4995 - DNA, 25 bp, Artificial sequence
  Extension Primer
aatagcctgtagtaagtttatggtg

SEQ ID NO: 4996 - DNA, 25 bp, Artificial sequence
  Extension Primer
ctgcagctggtggaaggaggtagtg

SEQ ID NO: 4997 - DNA, 25 bp, Artificial sequence
  Extension Primer
attgaaagagatactgataaacttc

SEQ ID NO: 4998 - DNA, 25 bp, Artificial sequence
  Extension Primer
ttgtcttctatgaacatttttttcc

SEQ ID NO: 4999 - DNA, 25 bp, Artificial sequence
  Extension Primer
ttacccactcttctgcttccaaact

SEQ ID NO: 5000 - DNA, 25 bp, Artificial sequence
  Extension Primer
agaattgttggattatatggtaatt

SEQ ID NO: 5001 - DNA, 25 bp, Artificial sequence
  Extension Primer
tcctcaggagagcccttgtgcagtg

SEQ ID NO: 5002 - DNA, 25 bp, Artificial sequence
  Extension Primer
cccagaggtaagtatggctgtcatc

SEQ ID NO: 5003 - DNA, 25 bp, Artificial sequence
  Extension Primer
taatttagctaatggtgaacaaaat

SEQ ID NO: 5004 - DNA, 25 bp, Artificial sequence
  Extension Primer
gtgtaagtatagttatttactcata

SEQ ID NO: 5005 - DNA, 25 bp, Artificial sequence
  Extension Primer
agtgactcttccctggcagcagtgc

SEQ ID NO: 5006 - DNA, 25 bp, Artificial sequence
  Extension Primer
ttgtcctctattctaaatctaccag

SEQ ID NO: 5007 - DNA, 25 bp, Artificial sequence
  Extension Primer
ctttggaaaactctgtctgtaatag

SEQ ID NO: 5008 - DNA, 25 bp, Artificial sequence
  Extension Primer
tcttatagagggctgcataaaattc

SEQ ID NO: 5009 - DNA, 25 bp, Artificial sequence
  Extension Primer
taccatgccagttgatacatcagtc

SEQ ID NO: 5010 - DNA, 25 bp, Artificial sequence
  Extension Primer
aatttcatttgtgtttacatttatc

SEQ ID NO: 5011 - DNA, 25 bp, Artificial sequence
  Extension Primer
tgaacaattcaataggaaagagagt

SEQ ID NO: 5012 - DNA, 25 bp, Artificial sequence
  Extension Primer
ttcagcccccagaaatcattcccac

SEQ ID NO: 5013 - DNA, 25 bp, Artificial sequence
  Extension Primer
gaatcgacagcttctgttaccaaat

SEQ ID NO: 5014 - DNA, 25 bp, Artificial sequence
  Extension Primer
aaaccaatagctcttaatggaggaa

SEQ ID NO: 5015 - DNA, 25 bp, Artificial sequence
  Extension Primer
cagggcctggcatacggttgggact

SEQ ID NO: 5016 - DNA, 25 bp, Artificial sequence
  Extension Primer
gattgagattttggaggcatgggtc

SEQ ID NO: 5017 - DNA, 25 bp, Artificial sequence
  Extension Primer
cccaggaatatggctagaaaaatca

SEQ ID NO: 5018 - DNA, 25 bp, Artificial sequence
  Extension Primer
gaattgggttatggtcacggaaaat

SEQ ID NO: 5019 - DNA, 25 bp, Artificial sequence
  Extension Primer
gcatctgggagaagagcattttagg

SEQ ID NO: 5020 - DNA, 25 bp, Artificial sequence
  Extension Primer
tgatcctgtgtggtttgtttgctct

SEQ ID NO: 5021 - DNA, 25 bp, Artificial sequence
  Extension Primer
cccaggtttacgtcacctttgccgt

SEQ ID NO: 5022 - DNA, 25 bp, Artificial sequence
  Extension Primer
gttatgtagaggggagaaagatacc

SEQ ID NO: 5023 - DNA, 22 bp, Artificial sequence
  Extension Primer
gattaacataatttctcttcca

SEQ ID NO: 5024 - DNA, 25 bp, Artificial sequence
  Extension Primer
atctcatctgtaaagctctgacatg

SEQ ID NO: 5025 - DNA, 25 bp, Artificial sequence
  Extension Primer
tgagaagacacctgagaatgaagac

SEQ ID NO: 5026 - DNA, 25 bp, Artificial sequence
  Extension Primer
cttaatgaacagcacataatgaaaa

SEQ ID NO: 5027 - DNA, 25 bp, Artificial sequence
  Extension Primer
acagatcgggaacattcactctgag

SEQ ID NO: 5028 - DNA, 25 bp, Artificial sequence
  Extension Primer
ccccagtccaaggaccctgcctgtc

SEQ ID NO: 5029 - DNA, 25 bp, Artificial sequence
  Extension Primer
kcgatgccgaccaggaccaggaagy

SEQ ID NO: 5030 - DNA, 25 bp, Artificial sequence
  Extension Primer
gcccatccattccccaacatcacac

SEQ ID NO: 5031 - DNA, 25 bp, Artificial sequence
  Extension Primer
aatcggtttcctgggctactctgtc

SEQ ID NO: 5032 - DNA, 25 bp, Artificial sequence
  Extension Primer
acttactctgatatcccaatattat

SEQ ID NO: 5033 - DNA, 25 bp, Artificial sequence
  Extension Primer
atattttcaggaagctaagattttt

SEQ ID NO: 5034 - DNA, 25 bp, Artificial sequence
  Extension Primer
atgggaaaataccacataaaaattg

SEQ ID NO: 5035 - DNA, 25 bp, Artificial sequence
  Extension Primer
gaacagttcttgggaatccaagatt

SEQ ID NO: 5036 - DNA, 25 bp, Artificial sequence
  Extension Primer
cttaacaacacaggatggtttcttt

SEQ ID NO: 5037 - DNA, 25 bp, Artificial sequence
  Extension Primer
tttccactgcacctgttattctttg

SEQ ID NO: 5038 - DNA, 25 bp, Artificial sequence
  Extension Primer
aaacatccacaagtgacttaagaaa

SEQ ID NO: 5039 - DNA, 25 bp, Artificial sequence
  Extension Primer
cttcaaataatatactaaacagaca

SEQ ID NO: 5040 - DNA, 25 bp, Artificial sequence
  Extension Primer
ctcctgcctttcaacaggggccaga

SEQ ID NO: 5041 - DNA, 25 bp, Artificial sequence
  Extension Primer
aaaccatgatgtctaagaatcagtc

SEQ ID NO: 5042 - DNA, 25 bp, Artificial sequence
  Extension Primer
ctgatctccagaactctatgagaat

SEQ ID NO: 5043 - DNA, 25 bp, Artificial sequence
  Extension Primer
tcactccaacggtgggtttagacac

SEQ ID NO: 5044 - DNA, 25 bp, Artificial sequence
  Extension Primer
tacatattcatacaattaaaatttt

SEQ ID NO: 5045 - DNA, 25 bp, Artificial sequence
  Extension Primer
caggcagcctgtccaggaacctaaa

SEQ ID NO: 5046 - DNA, 25 bp, Artificial sequence
  Extension Primer
cttcctttactgtgtccaggacaaa

SEQ ID NO: 5047 - DNA, 25 bp, Artificial sequence
  Extension Primer
tctgtgggtccaaagtctatgcttt

SEQ ID NO: 5048 - DNA, 25 bp, Artificial sequence
  Extension Primer
gttagcctggatgtgtgttcgctgg

SEQ ID NO: 5049 - DNA, 25 bp, Artificial sequence
  Extension Primer
ttcattcagctgcatttaagtgagc

SEQ ID NO: 5050 - DNA, 25 bp, Artificial sequence
  Extension Primer
tccaggcagagtcagcccctttccc

SEQ ID NO: 5051 - DNA, 25 bp, Artificial sequence
  Extension Primer
aagggcagggtcaagattctggcaa

SEQ ID NO: 5052 - DNA, 25 bp, Artificial sequence
  Extension Primer
agaagcaggcggaaccccacagcac

SEQ ID NO: 5053 - DNA, 25 bp, Artificial sequence
  Extension Primer
gggcatgactccagcccctcatgac

SEQ ID NO: 5054 - DNA, 25 bp, Artificial sequence
  Extension Primer
agatatagtcaggtaaagtaatttt

SEQ ID NO: 5055 - DNA, 25 bp, Artificial sequence
  Extension Primer
aagtctaccgtctaccaatgggatc

SEQ ID NO: 5056 - DNA, 25 bp, Artificial sequence
  Extension Primer
tactagacacagactatgacatatt

SEQ ID NO: 5057 - DNA, 25 bp, Artificial sequence
  Extension Primer
gcaactgcaaacaggctatttgaga

SEQ ID NO: 5058 - DNA, 25 bp, Artificial sequence
  Extension Primer
aaggctatgaagcaggaaccaagaa

SEQ ID NO: 5059 - DNA, 25 bp, Artificial sequence
  Extension Primer
agtcagagaaaccttaactatgaac

SEQ ID NO: 5060 - DNA, 25 bp, Artificial sequence
  Extension Primer
tataaaacatttaataatttatttt

SEQ ID NO: 5061 - DNA, 25 bp, Artificial sequence
  Extension Primer
ctataattctatcttcctattaaaa

SEQ ID NO: 5062 - DNA, 25 bp, Artificial sequence
  Extension Primer
ttagtttctaggtgatagagttttt

SEQ ID NO: 5063 - DNA, 25 bp, Artificial sequence
  Extension Primer
ttgcatgcttgcagacaaaggtaac

SEQ ID NO: 5064 - DNA, 25 bp, Artificial sequence
  Extension Primer
aattccaaaaacagacttttcagta

SEQ ID NO: 5065 - DNA, 25 bp, Artificial sequence
  Extension Primer
ctggatattgggaaacaaacagtga

SEQ ID NO: 5066 - DNA, 25 bp, Artificial sequence
  Extension Primer
aaaactctatgtgtagtagaaaaag

SEQ ID NO: 5067 - DNA, 25 bp, Artificial sequence
  Extension Primer
attggacctgagttgtaagatcagt

SEQ ID NO: 5068 - DNA, 25 bp, Artificial sequence
  Extension Primer
taaaagtgcagatttttctcttatt

SEQ ID NO: 5069 - DNA, 25 bp, Artificial sequence
  Extension Primer
aagttaatagcaaacattcatacag

SEQ ID NO: 5070 - DNA, 25 bp, Artificial sequence
  Extension Primer
aaggcttaggaataaatacattttt

SEQ ID NO: 5071 - DNA, 25 bp, Artificial sequence
  Extension Primer
aagacacacgtaaaatgctttattg

SEQ ID NO: 5072 - DNA, 25 bp, Artificial sequence
  Extension Primer
aataaggatgtgaaaaacgtgcagt

SEQ ID NO: 5073 - DNA, 25 bp, Artificial sequence
  Extension Primer
atttcatatatttagctaaatcatt

SEQ ID NO: 5074 - DNA, 25 bp, Artificial sequence
  Extension Primer
catcacctgacattggaaaccagaa

SEQ ID NO: 5075 - DNA, 25 bp, Artificial sequence
  Extension Primer
accagcgggaatgaggtttgtgtgc

SEQ ID NO: 5076 - DNA, 25 bp, Artificial sequence
  Extension Primer
caactccagttcgttcatactctat

SEQ ID NO: 5077 - DNA, 25 bp, Artificial sequence
  Extension Primer
caggggaccctgccctggaccacgt

SEQ ID NO: 5078 - DNA, 25 bp, Artificial sequence
  Extension Primer
ggaagccccctagagtttcagtgtg

SEQ ID NO: 5079 - DNA, 25 bp, Artificial sequence
  Extension Primer
tgttcccagtgggcttcttatcccc

SEQ ID NO: 5080 - DNA, 25 bp, Artificial sequence
  Extension Primer
aactagcttgttaggaaaaaggctt

SEQ ID NO: 5081 - DNA, 25 bp, Artificial sequence
  Extension Primer
tgctggttttgtctaactctgactt

SEQ ID NO: 5082 - DNA, 25 bp, Artificial sequence
  Extension Primer
tcaagtaccagggatggtcattaag

SEQ ID NO: 5083 - DNA, 25 bp, Artificial sequence
  Extension Primer
tctgatggaacatgtgatgttaaaa

SEQ ID NO: 5084 - DNA, 25 bp, Artificial sequence
  Extension Primer
atatgattgcaaaaatgctgattat

SEQ ID NO: 5085 - DNA, 25 bp, Artificial sequence
  Extension Primer
tgccagactgagccatcagggatga

SEQ ID NO: 5086 - DNA, 25 bp, Artificial sequence
  Extension Primer
actccttgcacttcatacaactcaa

SEQ ID NO: 5087 - DNA, 25 bp, Artificial sequence
  Extension Primer
aacattccacagctgacttggaaag

SEQ ID NO: 5088 - DNA, 25 bp, Artificial sequence
  Extension Primer
tctccaagcagttaaataatttact

SEQ ID NO: 5089 - DNA, 25 bp, Artificial sequence
  Extension Primer
tttgtaatgcatacatttttaaaga

SEQ ID NO: 5090 - DNA, 25 bp, Artificial sequence
  Extension Primer
ttcagaagcagcttgaataggctct

SEQ ID NO: 5091 - DNA, 25 bp, Artificial sequence
  Extension Primer
gtttatagtagtaatagcaagcatt

SEQ ID NO: 5092 - DNA, 25 bp, Artificial sequence
  Extension Primer
taggatattcatccaaaccaaatct

SEQ ID NO: 5093 - DNA, 25 bp, Artificial sequence
  Extension Primer
tatatacatacctggtgtgtgccta

SEQ ID NO: 5094 - DNA, 25 bp, Artificial sequence
  Extension Primer
aaacagatatattagtgaaatgtac

SEQ ID NO: 5095 - DNA, 25 bp, Artificial sequence
  Extension Primer
ggtatacacaggaaaaaaatacatt

SEQ ID NO: 5096 - DNA, 25 bp, Artificial sequence
  Extension Primer
catctgaaatacgtatacagagtta

SEQ ID NO: 5097 - DNA, 25 bp, Artificial sequence
  Extension Primer
ttggggctgcttgggcagcagtgac

SEQ ID NO: 5098 - DNA, 25 bp, Artificial sequence
  Extension Primer
atcttcatggacataaagtgctcac

SEQ ID NO: 5099 - DNA, 25 bp, Artificial sequence
  Extension Primer
ctaccccagatctacttactcaaaa

SEQ ID NO: 5100 - DNA, 25 bp, Artificial sequence
  Extension Primer
aggtgattttcctttgaagagtgag

SEQ ID NO: 5101 - DNA, 25 bp, Artificial sequence
  Extension Primer
ccttcttgggrctgtcctcgggctg

SEQ ID NO: 5102 - DNA, 25 bp, Artificial sequence
  Extension Primer
gtggcctctctgcccacggcaggac

SEQ ID NO: 5103 - DNA, 25 bp, Artificial sequence
  Extension Primer
ccagagagcaacccccagccccacg

SEQ ID NO: 5104 - DNA, 25 bp, Artificial sequence
  Extension Primer
ctaagtacagccgctggtgtccccc

SEQ ID NO: 5105 - DNA, 25 bp, Artificial sequence
  Extension Primer
tgtccaaaagatgcactttggcccc

SEQ ID NO: 5106 - DNA, 25 bp, Artificial sequence
  Extension Primer
tctcactaaccagccacccaaaccc

SEQ ID NO: 5107 - DNA, 25 bp, Artificial sequence
  Extension Primer
ttgtcagcaaactccagattggcag

SEQ ID NO: 5108 - DNA, 25 bp, Artificial sequence
  Extension Primer
agggtcaaaagcggctggtgctttc

SEQ ID NO: 5109 - DNA, 25 bp, Artificial sequence
  Extension Primer
aaattttgtaatccagtgggtgaca

SEQ ID NO: 5110 - DNA, 25 bp, Artificial sequence
  Extension Primer
ataagcaactcaggaggtacacaaa

SEQ ID NO: 5111 - DNA, 25 bp, Artificial sequence
  Extension Primer
ggagcaaattatgcaggtgtgagta

SEQ ID NO: 5112 - DNA, 25 bp, Artificial sequence
  Extension Primer
ggggagctacagaagaattgttaga

SEQ ID NO: 5113 - DNA, 25 bp, Artificial sequence
  Extension Primer
atgattctctctggaattctccaaa

SEQ ID NO: 5114 - DNA, 25 bp, Artificial sequence
  Extension Primer
cacatggaaataacttcttggcttt

SEQ ID NO: 5115 - DNA, 25 bp, Artificial sequence
  Extension Primer
gagattactaatattttccttaaaa

SEQ ID NO: 5116 - DNA, 25 bp, Artificial sequence
  Extension Primer
gcaaatcactgtactctggctttac

SEQ ID NO: 5117 - DNA, 25 bp, Artificial sequence
  Extension Primer
tgcttgtatgtccacaaaaggttac

SEQ ID NO: 5118 - DNA, 25 bp, Artificial sequence
  Extension Primer
atagattaaaatgcttacatgttag

SEQ ID NO: 5119 - DNA, 25 bp, Artificial sequence
  Extension Primer
ccccacaattgcatgtttaagagtc

SEQ ID NO: 5120 - DNA, 25 bp, Artificial sequence
  Extension Primer
ggacaacagcattggctcaacttta

SEQ ID NO: 5121 - DNA, 25 bp, Artificial sequence
  Extension Primer
tgactgaaggaacagaagctgtgac

SEQ ID NO: 5122 - DNA, 25 bp, Artificial sequence
  Extension Primer
ctgaggcagagttatttgtatgctt

SEQ ID NO: 5123 - DNA, 25 bp, Artificial sequence
  Extension Primer
gtacgaataatgctcaaaaaaaaaa

SEQ ID NO: 5124 - DNA, 25 bp, Artificial sequence
  Extension Primer
tctctgataacagctatgtttactc

SEQ ID NO: 5125 - DNA, 25 bp, Artificial sequence
  Extension Primer
ttattccgtttgctggaattaagta

SEQ ID NO: 5126 - DNA, 25 bp, Artificial sequence
  Extension Primer
gctcaactattaatttttactcctt

SEQ ID NO: 5127 - DNA, 25 bp, Artificial sequence
  Extension Primer
ttcaggcatatgacctcacgtaatt

SEQ ID NO: 5128 - DNA, 25 bp, Artificial sequence
  Extension Primer
tccagaggaagaatgacaagttata

SEQ ID NO: 5129 - DNA, 25 bp, Artificial sequence
  Extension Primer
tttttaaaataccagaaaactgtta

SEQ ID NO: 5130 - DNA, 25 bp, Artificial sequence
  Extension Primer
agcaaacgcggggatgtattcaata

SEQ ID NO: 5131 - DNA, 25 bp, Artificial sequence
  Extension Primer
actcttttgaaggaagccctcatta

SEQ ID NO: 5132 - DNA, 25 bp, Artificial sequence
  Extension Primer
ttatgcactttcttgaaaccctctg

SEQ ID NO: 5133 - DNA, 25 bp, Artificial sequence
  Extension Primer
ctatctattgcttgattacattttt

SEQ ID NO: 5134 - DNA, 25 bp, Artificial sequence
  Extension Primer
ggtggtaaaaggacacatatgaata

SEQ ID NO: 5135 - DNA, 25 bp, Artificial sequence
  Extension Primer
ttctgttctttcaccgaagggatac

SEQ ID NO: 5136 - DNA, 25 bp, Artificial sequence
  Extension Primer
aaaataatcccgtaatagaagagag

SEQ ID NO: 5137 - DNA, 25 bp, Artificial sequence
  Extension Primer
tgtggtagcatggtgatgggagacc

SEQ ID NO: 5138 - DNA, 25 bp, Artificial sequence
  Extension Primer
agttctaattcacacaaatgccatg

SEQ ID NO: 5139 - DNA, 25 bp, Artificial sequence
  Extension Primer
gatcagattgtaatggaaatccctg

SEQ ID NO: 5140 - DNA, 25 bp, Artificial sequence
  Extension Primer
gactagggcatactttcttgctctt

SEQ ID NO: 5141 - DNA, 25 bp, Artificial sequence
  Extension Primer
tacttctgacatttcatacagaatt

SEQ ID NO: 5142 - DNA, 25 bp, Artificial sequence
  Extension Primer
atggaagaatatggtttctacccag

SEQ ID NO: 5143 - DNA, 25 bp, Artificial sequence
  Extension Primer
gattcatgtgtaaagtatttcatgc

SEQ ID NO: 5144 - DNA, 25 bp, Artificial sequence
  Extension Primer
taccatcccaggaacaagactttgc

SEQ ID NO: 5145 - DNA, 25 bp, Artificial sequence
  Extension Primer
tcaacacatgctcctcttaaaaaat

SEQ ID NO: 5146 - DNA, 25 bp, Artificial sequence
  Extension Primer
atttctcaggctttgccttggtcac

SEQ ID NO: 5147 - DNA, 25 bp, Artificial sequence
  Extension Primer
aacaacagcagtgataacgattgag

SEQ ID NO: 5148 - DNA, 25 bp, Artificial sequence
  Extension Primer
tcatraacttgtaggaagaagactt

SEQ ID NO: 5149 - DNA, 25 bp, Artificial sequence
  Extension Primer
cctttcggaagagctggcctccaga

SEQ ID NO: 5150 - DNA, 25 bp, Artificial sequence
  Extension Primer
gcagatactgtgctttttaaaaact

SEQ ID NO: 5151 - DNA, 25 bp, Artificial sequence
  Extension Primer
aaagcttttaactatctcgctaaac

SEQ ID NO: 5152 - DNA, 25 bp, Artificial sequence
  Extension Primer
tcagtgaagcctgtaagccgttgtt

SEQ ID NO: 5153 - DNA, 25 bp, Artificial sequence
  Extension Primer
tagccccccaaaacttccaattcat

SEQ ID NO: 5154 - DNA, 25 bp, Artificial sequence
  Extension Primer
ggaaaatagattaaagcagttaaat

SEQ ID NO: 5155 - DNA, 25 bp, Artificial sequence
  Extension Primer
tgattctcccactgttggacacttg

SEQ ID NO: 5156 - DNA, 25 bp, Artificial sequence
  Extension Primer
acagtaacagaaatattaacacaca

SEQ ID NO: 5157 - DNA, 25 bp, Artificial sequence
  Extension Primer
gtgaggcatgggccggctgggaagg

SEQ ID NO: 5158 - DNA, 25 bp, Artificial sequence
  Extension Primer
ccctttcttccattgtttcctctct

SEQ ID NO: 5159 - DNA, 25 bp, Artificial sequence
  Extension Primer
tcttctagcccaagggatttcgttt

SEQ ID NO: 5160 - DNA, 25 bp, Artificial sequence
  Extension Primer
gctcactacacttccaaaggaaaag

SEQ ID NO: 5161 - DNA, 25 bp, Artificial sequence
  Extension Primer
ggacttttctgtactcagtatcttc

SEQ ID NO: 5162 - DNA, 25 bp, Artificial sequence
  Extension Primer
gatggcctgtgttggctcaggattc

SEQ ID NO: 5163 - DNA, 25 bp, Artificial sequence
  Extension Primer
cttcccctttygttaggccatcagc

SEQ ID NO: 5164 - DNA, 25 bp, Artificial sequence
  Extension Primer
cccaaaccacagtctgagtcagaaa

SEQ ID NO: 5165 - DNA, 25 bp, Artificial sequence
  Extension Primer
gaagaagtgtgtgtgtgtgttgggg

SEQ ID NO: 5166 - DNA, 25 bp, Artificial sequence
  Extension Primer
ctgtgtgttttcaatttgtgtggga

SEQ ID NO: 5167 - DNA, 25 bp, Artificial sequence
  Extension Primer
ccatgtgtcacaactactgagccag

SEQ ID NO: 5168 - DNA, 25 bp, Artificial sequence
  Extension Primer
cctgtgtttctggcatccttccccc

SEQ ID NO: 5169 - DNA, 25 bp, Artificial sequence
  Extension Primer
ttaggccagcggtctgaatgggaca

SEQ ID NO: 5170 - DNA, 25 bp, Artificial sequence
  Extension Primer
ttttggatttggaggggcacaggca

SEQ ID NO: 5171 - DNA, 25 bp, Artificial sequence
  Extension Primer
aatttgagggcagaatgctgagggc

SEQ ID NO: 5172 - DNA, 25 bp, Artificial sequence
  Extension Primer
cttatatcacagacatagaaacaaa

SEQ ID NO: 5173 - DNA, 25 bp, Artificial sequence
  Extension Primer
tacaatgtttgcttatctttattat

SEQ ID NO: 5174 - DNA, 25 bp, Artificial sequence
  Extension Primer
cagactgttgctgatgttgcagtta

SEQ ID NO: 5175 - DNA, 25 bp, Artificial sequence
  Extension Primer
accacccctgccaaactctagcaaa

SEQ ID NO: 5176 - DNA, 25 bp, Artificial sequence
  Extension Primer
caagtaaataactttctggcaagag

SEQ ID NO: 5177 - DNA, 25 bp, Artificial sequence
  Extension Primer
attcatcaaatatttagggaagtag

SEQ ID NO: 5178 - DNA, 25 bp, Artificial sequence
  Extension Primer
gcttattaagccagtgttcagtcta

SEQ ID NO: 5179 - DNA, 25 bp, Artificial sequence
  Extension Primer
aaactaatggaagtacaacctcatc

SEQ ID NO: 5180 - DNA, 25 bp, Artificial sequence
  Extension Primer
atttatagtctatataaatgcacag

SEQ ID NO: 5181 - DNA, 25 bp, Artificial sequence
  Extension Primer
tagttgacaacactgcattgtataa

SEQ ID NO: 5182 - DNA, 25 bp, Artificial sequence
  Extension Primer
catccagttgaatatgggttaaaga

SEQ ID NO: 5183 - DNA, 25 bp, Artificial sequence
  Extension Primer
attgatcttttggtattacctttca

SEQ ID NO: 5184 - DNA, 25 bp, Artificial sequence
  Extension Primer
tgtggccttatctccctcctgcctt

SEQ ID NO: 5185 - DNA, 25 bp, Artificial sequence
  Extension Primer
ttctgtctccatggacttgctgact

SEQ ID NO: 5186 - DNA, 25 bp, Artificial sequence
  Extension Primer
tgctcaatactattcttatctatta

SEQ ID NO: 5187 - DNA, 25 bp, Artificial sequence
  Extension Primer
tattgcatatagcctctttggaatt

SEQ ID NO: 5188 - DNA, 25 bp, Artificial sequence
  Extension Primer
acacaggcagcagagaagattgtag

SEQ ID NO: 5189 - DNA, 25 bp, Artificial sequence
  Extension Primer
cagttctagctctcctctcctaaac

SEQ ID NO: 5190 - DNA, 25 bp, Artificial sequence
  Extension Primer
agatgaactctaaaaatttgtttct

SEQ ID NO: 5191 - DNA, 25 bp, Artificial sequence
  Extension Primer
ggttgtttatcctttggcagtatat

SEQ ID NO: 5192 - DNA, 25 bp, Artificial sequence
  Extension Primer
gttcctgacttcagaaaaaaattct

SEQ ID NO: 5193 - DNA, 25 bp, Artificial sequence
  Extension Primer
attgtattggtgatggacaggggag

SEQ ID NO: 5194 - DNA, 25 bp, Artificial sequence
  Extension Primer
agggtttggagagagagattaaata

SEQ ID NO: 5195 - DNA, 25 bp, Artificial sequence
  Extension Primer
tttgtcctctaattacaatatgtct

SEQ ID NO: 5196 - DNA, 25 bp, Artificial sequence
  Extension Primer
gagtgctataaatgagggtacgaac

SEQ ID NO: 5197 - DNA, 25 bp, Artificial sequence
  Extension Primer
gattattttgaaaactgagcagtct

SEQ ID NO: 5198 - DNA, 25 bp, Artificial sequence
  Extension Primer
acaccaagtctggcatctggccctg

SEQ ID NO: 5199 - DNA, 25 bp, Artificial sequence
  Extension Primer
tatactgaacatagattttttcccc

SEQ ID NO: 5200 - DNA, 25 bp, Artificial sequence
  Extension Primer
cctggcagttcccttctcttgggct

SEQ ID NO: 5201 - DNA, 25 bp, Artificial sequence
  Extension Primer
cacatcgcctcttcctcccactgtc

SEQ ID NO: 5202 - DNA, 25 bp, Artificial sequence
  Extension Primer
tgctgccgccattagaggcttatct

SEQ ID NO: 5203 - DNA, 25 bp, Artificial sequence
  Extension Primer
atcctttcctgcacagcctttttcc

SEQ ID NO: 5204 - DNA, 25 bp, Artificial sequence
  Extension Primer
ggtgcccgtctgcccttaacttttt

SEQ ID NO: 5205 - DNA, 25 bp, Artificial sequence
  Extension Primer
gagtgtgcctgccttgttcaggtaa

SEQ ID NO: 5206 - DNA, 25 bp, Artificial sequence
  Extension Primer
tggcagcggacagggtggggctctc

SEQ ID NO: 5207 - DNA, 25 bp, Artificial sequence
  Extension Primer
tggaaccagtgctaagccagttcta

SEQ ID NO: 5208 - DNA, 25 bp, Artificial sequence
  Extension Primer
agcccattatctgactgcttccagt

SEQ ID NO: 5209 - DNA, 25 bp, Artificial sequence
  Extension Primer
agrtcacctacgtaccctcccagaa

SEQ ID NO: 5210 - DNA, 25 bp, Artificial sequence
  Extension Primer
agcagcatgcctccagtgtagggaa

SEQ ID NO: 5211 - DNA, 25 bp, Artificial sequence
  Extension Primer
gcctctcctgcaattccagcacctc

SEQ ID NO: 5212 - DNA, 25 bp, Artificial sequence
  Extension Primer
aacctagcctcatttcatggaggac

SEQ ID NO: 5213 - DNA, 25 bp, Artificial sequence
  Extension Primer
aaaggactgatgtcagtatcaggct

SEQ ID NO: 5214 - DNA, 25 bp, Artificial sequence
  Extension Primer
aacgatgtgggacaagcagaaaggc

SEQ ID NO: 5215 - DNA, 25 bp, Artificial sequence
  Extension Primer
cattaaaatcactttattttcaaaa

SEQ ID NO: 5216 - DNA, 25 bp, Artificial sequence
  Extension Primer
ggaacacaaacccacaacaaaacat

SEQ ID NO: 5217 - DNA, 25 bp, Artificial sequence
  Extension Primer
gattcctaatctagagtactgtttc

SEQ ID NO: 5218 - DNA, 25 bp, Artificial sequence
  Extension Primer
accactctggctgctgtgtgaagaa

SEQ ID NO: 5219 - DNA, 25 bp, Artificial sequence
  Extension Primer
tgtgtcacaaaataatacaaacttg

SEQ ID NO: 5220 - DNA, 25 bp, Artificial sequence
  Extension Primer
gcttctgggctccactctttcatct

SEQ ID NO: 5221 - DNA, 25 bp, Artificial sequence
  Extension Primer
tgtgatgctatatggagaactgttt

SEQ ID NO: 5222 - DNA, 25 bp, Artificial sequence
  Extension Primer
taaagtttggggacagacttggagg

SEQ ID NO: 5223 - DNA, 25 bp, Artificial sequence
  Extension Primer
gatttggacaggaaagcactcaaca

SEQ ID NO: 5224 - DNA, 25 bp, Artificial sequence
  Extension Primer
caggtcttggacttcttgattgtct

SEQ ID NO: 5225 - DNA, 25 bp, Artificial sequence
  Extension Primer
atatagtggagatctctgatgctta

SEQ ID NO: 5226 - DNA, 25 bp, Artificial sequence
  Extension Primer
aattctttgaatatcagttttttca

SEQ ID NO: 5227 - DNA, 25 bp, Artificial sequence
  Extension Primer
gtgtaacattgttcagatgttagta

SEQ ID NO: 5228 - DNA, 25 bp, Artificial sequence
  Extension Primer
tatacactgtgcacttagatccaaa

SEQ ID NO: 5229 - DNA, 25 bp, Artificial sequence
  Extension Primer
agttgcctctatctaccatatgata

SEQ ID NO: 5230 - DNA, 25 bp, Artificial sequence
  Extension Primer
tgcaagatttaaaaagttctggaga

SEQ ID NO: 5231 - DNA, 25 bp, Artificial sequence
  Extension Primer
ctctaaagtattgtattagttacca

SEQ ID NO: 5232 - DNA, 25 bp, Artificial sequence
  Extension Primer
attatattcagttgaggaattcaca

SEQ ID NO: 5233 - DNA, 25 bp, Artificial sequence
  Extension Primer
ctttggcttcactaaccttttacaa

SEQ ID NO: 5234 - DNA, 25 bp, Artificial sequence
  Extension Primer
caattttagtggcactattataact

SEQ ID NO: 5235 - DNA, 25 bp, Artificial sequence
  Extension Primer
atttatttctcctcagtgacacttc

SEQ ID NO: 5236 - DNA, 25 bp, Artificial sequence
  Extension Primer
taactaatcaagacaagcacagttt

SEQ ID NO: 5237 - DNA, 25 bp, Artificial sequence
  Extension Primer
agggagacaggtatcccctgctttt

SEQ ID NO: 5238 - DNA, 25 bp, Artificial sequence
  Extension Primer
ttctttccttttctgaagtcaacag

SEQ ID NO: 5239 - DNA, 25 bp, Artificial sequence
  Extension Primer
taaaataatcagggtctccaacaaa

SEQ ID NO: 5240 - DNA, 25 bp, Artificial sequence
  Extension Primer
ggtatgatttttccaatttagacat

SEQ ID NO: 5241 - DNA, 25 bp, Artificial sequence
  Extension Primer
cagcttaaagcagaacaggcacaca

SEQ ID NO: 5242 - DNA, 25 bp, Artificial sequence
  Extension Primer
accagtattgaagcaatctctctct

SEQ ID NO: 5243 - DNA, 25 bp, Artificial sequence
  Extension Primer
tacgttttattgattcataaatatg

SEQ ID NO: 5244 - DNA, 25 bp, Artificial sequence
  Extension Primer
tgggaaatgaaacggttacagagtc

SEQ ID NO: 5245 - DNA, 25 bp, Artificial sequence
  Extension Primer
aaacttttactgacctctccacagg

SEQ ID NO: 5246 - DNA, 25 bp, Artificial sequence
  Extension Primer
aataaaatgaaacagtgaaagaatg

SEQ ID NO: 5247 - DNA, 25 bp, Artificial sequence
  Extension Primer
tctagcctgtgggcctggataaaat

SEQ ID NO: 5248 - DNA, 25 bp, Artificial sequence
  Extension Primer
tatatccaaagtgctctaagacaga

SEQ ID NO: 5249 - DNA, 25 bp, Artificial sequence
  Extension Primer
acacattggtctttcattgcattga

SEQ ID NO: 5250 - DNA, 25 bp, Artificial sequence
  Extension Primer
ggaagaaactttgcctttacaggta

SEQ ID NO: 5251 - DNA, 25 bp, Artificial sequence
  Extension Primer
cctcatatgaaaattaaaatatcat

SEQ ID NO: 5252 - DNA, 25 bp, Artificial sequence
  Extension Primer
acgagtcccgaattgccataaccta

SEQ ID NO: 5253 - DNA, 25 bp, Artificial sequence
  Extension Primer
cattcagaatataccaaagtgccct

SEQ ID NO: 5254 - DNA, 25 bp, Artificial sequence
  Extension Primer
ttagatccccaagcattatggaagc

SEQ ID NO: 5255 - DNA, 25 bp, Artificial sequence
  Extension Primer
tcatcagctgggtttaagaatacct

SEQ ID NO: 5256 - DNA, 25 bp, Artificial sequence
  Extension Primer
actgttgctgtaatgcactggggaa

SEQ ID NO: 5257 - DNA, 25 bp, Artificial sequence
  Extension Primer
cagaccaatttccacatcacagcca

SEQ ID NO: 5258 - DNA, 25 bp, Artificial sequence
  Extension Primer
tgccgcgaactcaacctttatggaa

SEQ ID NO: 5259 - DNA, 25 bp, Artificial sequence
  Extension Primer
ttcaaattttaccaaaagcagaaaa

SEQ ID NO: 5260 - DNA, 25 bp, Artificial sequence
  Extension Primer
aaggcttgaaaatggcaaaaatcaa

SEQ ID NO: 5261 - DNA, 25 bp, Artificial sequence
  Extension Primer
cagggartggcagaaccccgaactc

SEQ ID NO: 5262 - DNA, 25 bp, Artificial sequence
  Extension Primer
aggctacaccttctgtctccatctc

SEQ ID NO: 5263 - DNA, 25 bp, Artificial sequence
  Extension Primer
ttccttgcctcaaccccttgtctct

SEQ ID NO: 5264 - DNA, 22 bp, Artificial sequence
  Extension Primer
gcttctgccagtgtgtctgcca

SEQ ID NO: 5265 - DNA, 25 bp, Artificial sequence
  Extension Primer
agtggctaagactctgtgtttccaa

SEQ ID NO: 5266 - DNA, 25 bp, Artificial sequence
  Extension Primer
ttttaaaagatttgtctctgcttca

SEQ ID NO: 5267 - DNA, 25 bp, Artificial sequence
  Extension Primer
tcagaagttaagggacttgccagag

SEQ ID NO: 5268 - DNA, 25 bp, Artificial sequence
  Extension Primer
ccagcctgcctgtggagtttgccat

SEQ ID NO: 5269 - DNA, 25 bp, Artificial sequence
  Extension Primer
aaattgaacaagctgtggctgtggg

SEQ ID NO: 5270 - DNA, 25 bp, Artificial sequence
  Extension Primer
agggtctgtatgcacaacaagggct

SEQ ID NO: 5271 - DNA, 25 bp, Artificial sequence
  Extension Primer
tttctcatgtatgtsgggtatttaa

SEQ ID NO: 5272 - DNA, 25 bp, Artificial sequence
  Extension Primer
ttagtttcttaaatgaatttgtatc

SEQ ID NO: 5273 - DNA, 25 bp, Artificial sequence
  Extension Primer
actcttgtcttgtttgttgttgatg

SEQ ID NO: 5274 - DNA, 25 bp, Artificial sequence
  Extension Primer
caaatgtttccgtttcacagtaagg

SEQ ID NO: 5275 - DNA, 25 bp, Artificial sequence
  Extension Primer
atcgataaaaaattggtatctgagg

SEQ ID NO: 5276 - DNA, 25 bp, Artificial sequence
  Extension Primer
gtaatcaaatttaatccagtttaag

SEQ ID NO: 5277 - DNA, 25 bp, Artificial sequence
  Extension Primer
cattttttttcaataaaagtggata

SEQ ID NO: 5278 - DNA, 25 bp, Artificial sequence
  Extension Primer
ctgttctagcaatcattgttcacat

SEQ ID NO: 5279 - DNA, 25 bp, Artificial sequence
  Extension Primer
aacactactatgctataggaagtta

SEQ ID NO: 5280 - DNA, 25 bp, Artificial sequence
  Extension Primer
aaaggtagcatattttcttttgaag

SEQ ID NO: 5281 - DNA, 25 bp, Artificial sequence
  Extension Primer
aaagttattattttatgcacatcta

SEQ ID NO: 5282 - DNA, 25 bp, Artificial sequence
  Extension Primer
ctgagttataacacagtaaattcca

SEQ ID NO: 5283 - DNA, 25 bp, Artificial sequence
  Extension Primer
tatcttcatggaagttaagtgatct

SEQ ID NO: 5284 - DNA, 25 bp, Artificial sequence
  Extension Primer
ctttactgttcttcctactccactc

SEQ ID NO: 5285 - DNA, 25 bp, Artificial sequence
  Extension Primer
gttctaagatgagaaaactcacagg

SEQ ID NO: 5286 - DNA, 25 bp, Artificial sequence
  Extension Primer
acaaataaacagggtaatgacagac

SEQ ID NO: 5287 - DNA, 25 bp, Artificial sequence
  Extension Primer
ctcattacctttgtaattaagctcc

SEQ ID NO: 5288 - DNA, 25 bp, Artificial sequence
  Extension Primer
catacaaaggcttcatgtttgccac

SEQ ID NO: 5289 - DNA, 25 bp, Artificial sequence
  Extension Primer
agctatggctcttgcctctctgctt

SEQ ID NO: 5290 - DNA, 22 bp, Artificial sequence
  Extension Primer
gcgtgtaacccaggccttccca

SEQ ID NO: 5291 - DNA, 25 bp, Artificial sequence
  Extension Primer
aggaaagggaaacacgattttggaa

SEQ ID NO: 5292 - DNA, 25 bp, Artificial sequence
  Extension Primer
tccattacccttacccttaggaaaa

SEQ ID NO: 5293 - DNA, 25 bp, Artificial sequence
  Extension Primer
cctggctgccattttcaacatatcg

SEQ ID NO: 5294 - DNA, 25 bp, Artificial sequence
  Extension Primer
caagattaacctactaagccaaaag

SEQ ID NO: 5295 - DNA, 25 bp, Artificial sequence
  Extension Primer
tgkttgayttayacagtgtttgaat

SEQ ID NO: 5296 - DNA, 22 bp, Artificial sequence
  Extension Primer
gttcacaagtttattctctaca

SEQ ID NO: 5297 - DNA, 25 bp, Artificial sequence
  Extension Primer
gggagataaagctgcaaagattgat

SEQ ID NO: 5298 - DNA, 25 bp, Artificial sequence
  Extension Primer
ctctctggattgataagttaaaata

SEQ ID NO: 5299 - DNA, 25 bp, Artificial sequence
  Extension Primer
gcttcttagcccgggacccagtgcc

SEQ ID NO: 5300 - DNA, 25 bp, Artificial sequence
  Extension Primer
gatgctccagaccatgctcagyata

SEQ ID NO: 5301 - DNA, 22 bp, Artificial sequence
  Extension Primer
ttgcaagcagtaaaccatacaa

SEQ ID NO: 5302 - DNA, 25 bp, Artificial sequence
  Extension Primer
rtcatgtttatctaaataccacctg

SEQ ID NO: 5303 - DNA, 25 bp, Artificial sequence
  Extension Primer
gcaggcgtccccaggctgagtctga

SEQ ID NO: 5304 - DNA, 25 bp, Artificial sequence
  Extension Primer
ctggcatttgagaccctctccaata

SEQ ID NO: 5305 - DNA, 25 bp, Artificial sequence
  Extension Primer
actttagccagtacagtattgttgt

SEQ ID NO: 5306 - DNA, 25 bp, Artificial sequence
  Extension Primer
gggactcgctcccctctcactcagg

SEQ ID NO: 5307 - DNA, 25 bp, Artificial sequence
  Extension Primer
tctatcccatgggtctgggatcagg

SEQ ID NO: 5308 - DNA, 25 bp, Artificial sequence
  Extension Primer
tcccagggaaagcagtcctggctcc

SEQ ID NO: 5309 - DNA, 25 bp, Artificial sequence
  Extension Primer
cggatgggcacagggactcggggac

SEQ ID NO: 5310 - DNA, 25 bp, Artificial sequence
  Extension Primer
aacggctctccctctctctgcaggc

SEQ ID NO: 5311 - DNA, 25 bp, Artificial sequence
  Extension Primer
gtcctcaatagttaattatctcatt

SEQ ID NO: 5312 - DNA, 25 bp, Artificial sequence
  Extension Primer
atagagggcctgtaagaaagactgt

SEQ ID NO: 5313 - DNA, 25 bp, Artificial sequence
  Extension Primer
atgtctcacgttttctttagaaaca

SEQ ID NO: 5314 - DNA, 25 bp, Artificial sequence
  Extension Primer
cctgttaaatctgaagtcattctct

SEQ ID NO: 5315 - DNA, 25 bp, Artificial sequence
  Extension Primer
taatatttatctaactcttggtttt

SEQ ID NO: 5316 - DNA, 25 bp, Artificial sequence
  Extension Primer
agtcttaaatctatgctgcaatgag

SEQ ID NO: 5317 - DNA, 25 bp, Artificial sequence
  Extension Primer
aacagagaatgcaaatggaaaaatg

SEQ ID NO: 5318 - DNA, 25 bp, Artificial sequence
  Extension Primer
aatgagaacaaacatcagagaaatg

SEQ ID NO: 5319 - DNA, 25 bp, Artificial sequence
  Extension Primer
agctgatgatgaagattctagaaaa

SEQ ID NO: 5320 - DNA, 25 bp, Artificial sequence
  Extension Primer
aagacttaaagtacaatgctgaagg

SEQ ID NO: 5321 - DNA, 25 bp, Artificial sequence
  Extension Primer
taccattcacaacctcttgccctca

SEQ ID NO: 5322 - DNA, 25 bp, Artificial sequence
  Extension Primer
gaaagcagctctatcacttacttgg

SEQ ID NO: 5323 - DNA, 25 bp, Artificial sequence
  Extension Primer
arcctaggacctaagtttgttgttc

SEQ ID NO: 5324 - DNA, 25 bp, Artificial sequence
  Extension Primer
tcaatactaaaatcttaccaaatta

SEQ ID NO: 5325 - DNA, 25 bp, Artificial sequence
  Extension Primer
agcttaaggcttgtctcagcattag

SEQ ID NO: 5326 - DNA, 25 bp, Artificial sequence
  Extension Primer
caaacctccagatgaccccctcatg

SEQ ID NO: 5327 - DNA, 25 bp, Artificial sequence
  Extension Primer
gtgtgtgtatgtgtgtgtgtgcttc

SEQ ID NO: 5328 - DNA, 25 bp, Artificial sequence
  Extension Primer
ctgaaatactcaaaactttgatttg

SEQ ID NO: 5329 - DNA, 25 bp, Artificial sequence
  Extension Primer
ttaaatatatgtacatattttgttc

SEQ ID NO: 5330 - DNA, 25 bp, Artificial sequence
  Extension Primer
ctgagagggatttggccagtagttt

SEQ ID NO: 5331 - DNA, 25 bp, Artificial sequence
  Extension Primer
gcctttgtctatgtgcagacaaaca

SEQ ID NO: 5332 - DNA, 25 bp, Artificial sequence
  Extension Primer
cctctgcctggaatgtcctttctcc

SEQ ID NO: 5333 - DNA, 25 bp, Artificial sequence
  Extension Primer
gaaaagcttataatgattgtgtgtg

SEQ ID NO: 5334 - DNA, 25 bp, Artificial sequence
  Extension Primer
ggatgtgaaagaacacaccctataa

SEQ ID NO: 5335 - DNA, 25 bp, Artificial sequence
  Extension Primer
tcatttttgcattgagtgtccgata

SEQ ID NO: 5336 - DNA, 25 bp, Artificial sequence
  Extension Primer
tttgtattggggtatagccgattaa

SEQ ID NO: 5337 - DNA, 25 bp, Artificial sequence
  Extension Primer
aaatgttttgttgttaaactaaaaa

SEQ ID NO: 5338 - DNA, 25 bp, Artificial sequence
  Extension Primer
caacagtttggaagcttggtcagag

SEQ ID NO: 5339 - DNA, 22 bp, Artificial sequence
  Extension Primer
ggcaaatctataatggtttctt

SEQ ID NO: 5340 - DNA, 25 bp, Artificial sequence
  Extension Primer
tttgctgtatcctaggtttaatttt

SEQ ID NO: 5341 - DNA, 25 bp, Artificial sequence
  Extension Primer
actatgcccaataattgatacaaga

SEQ ID NO: 5342 - DNA, 25 bp, Artificial sequence
  Extension Primer
agtatgaacaggattgcttttttct

SEQ ID NO: 5343 - DNA, 25 bp, Artificial sequence
  Extension Primer
cacttctgcatgtcytaaagctcac

SEQ ID NO: 5344 - DNA, 25 bp, Artificial sequence
  Extension Primer
atcagtactaccagccataagttat

SEQ ID NO: 5345 - DNA, 25 bp, Artificial sequence
  Extension Primer
aaacttaacattttgcaactccaaa

SEQ ID NO: 5346 - DNA, 25 bp, Artificial sequence
  Extension Primer
gttaatgtatctcaaatgccttaaa

SEQ ID NO: 5347 - DNA, 25 bp, Artificial sequence
  Extension Primer
aataatgcggtttcattattctaac

SEQ ID NO: 5348 - DNA, 25 bp, Artificial sequence
  Extension Primer
tgcatccctaccctagactacatct

SEQ ID NO: 5349 - DNA, 25 bp, Artificial sequence
  Extension Primer
ctcatacgagccttagacacatcat

SEQ ID NO: 5350 - DNA, 25 bp, Artificial sequence
  Extension Primer
gaaaaataacactttcaatatttgc

SEQ ID NO: 5351 - DNA, 25 bp, Artificial sequence
  Extension Primer
ggttctcttacacagtatgcaggta

SEQ ID NO: 5352 - DNA, 25 bp, Artificial sequence
  Extension Primer
gactagaattgacatatatacccta

SEQ ID NO: 5353 - DNA, 25 bp, Artificial sequence
  Extension Primer
tatctctcagacccaatattgctcc

SEQ ID NO: 5354 - DNA, 25 bp, Artificial sequence
  Extension Primer
tcctggttccctttcttctgcatct

SEQ ID NO: 5355 - DNA, 25 bp, Artificial sequence
  Extension Primer
tagatgaaactgttgctcagaggtg

SEQ ID NO: 5356 - DNA, 25 bp, Artificial sequence
  Extension Primer
ctacctccttattcttctcctttgc

SEQ ID NO: 5357 - DNA, 25 bp, Artificial sequence
  Extension Primer
tacatgtgtcccctgtgtgcccaga

SEQ ID NO: 5358 - DNA, 25 bp, Artificial sequence
  Extension Primer
aataactattatgtataatgactgg

SEQ ID NO: 5359 - DNA, 25 bp, Artificial sequence
  Extension Primer
tgcttcaagtcatttcttcttccca

SEQ ID NO: 5360 - DNA, 25 bp, Artificial sequence
  Extension Primer
aaatgaggtatgaaaaccattatca

SEQ ID NO: 5361 - DNA, 25 bp, Artificial sequence
  Extension Primer
aaaacggtcattattaacataccta

SEQ ID NO: 5362 - DNA, 25 bp, Artificial sequence
  Extension Primer
tatctcatagtatgtaaaaataata

SEQ ID NO: 5363 - DNA, 25 bp, Artificial sequence
  Extension Primer
tgatgcctttctggacttgcaggaa

SEQ ID NO: 5364 - DNA, 25 bp, Artificial sequence
  Extension Primer
tcttccttggtttagcgtgacctag

SEQ ID NO: 5365 - DNA, 25 bp, Artificial sequence
  Extension Primer
cataaatataagttccattctgata

SEQ ID NO: 5366 - DNA, 25 bp, Artificial sequence
  Extension Primer
gcttagtgaagaactcctataaggc

SEQ ID NO: 5367 - DNA, 25 bp, Artificial sequence
  Extension Primer
aatcaacttgtatttgaggaaggca

SEQ ID NO: 5368 - DNA, 25 bp, Artificial sequence
  Extension Primer
ctgtcagcactgcccacctccctcc

SEQ ID NO: 5369 - DNA, 25 bp, Artificial sequence
  Extension Primer
tggactcagcctatttcctcctgtt

SEQ ID NO: 5370 - DNA, 25 bp, Artificial sequence
  Extension Primer
gcatgagcacatgtacataatgaag

SEQ ID NO: 5371 - DNA, 25 bp, Artificial sequence
  Extension Primer
atgaacagctctgattctaattata

SEQ ID NO: 5372 - DNA, 25 bp, Artificial sequence
  Extension Primer
aagtcctgtgcttatccaaaaaaat

SEQ ID NO: 5373 - DNA, 25 bp, Artificial sequence
  Extension Primer
gaacctcaggtcacacagaagtttc

SEQ ID NO: 5374 - DNA, 25 bp, Artificial sequence
  Extension Primer
tcattgggctgtatttccacctcca

SEQ ID NO: 5375 - DNA, 25 bp, Artificial sequence
  Extension Primer
cccccattcccttgggggacttaca

SEQ ID NO: 5376 - DNA, 25 bp, Artificial sequence
  Extension Primer
agtggttaagatttcgagctcccaa

SEQ ID NO: 5377 - DNA, 25 bp, Artificial sequence
  Extension Primer
atgggccttagttgtttatagatgc

SEQ ID NO: 5378 - DNA, 25 bp, Artificial sequence
  Extension Primer
cgagggatccagaggaggcacagtc

SEQ ID NO: 5379 - DNA, 22 bp, Artificial sequence
  Extension Primer
ggattctttaccactgcgccac

SEQ ID NO: 5380 - DNA, 25 bp, Artificial sequence
  Extension Primer
aagagaaggacatttggcccttgaa

SEQ ID NO: 5381 - DNA, 25 bp, Artificial sequence
  Extension Primer
cacatgataccagaagmtttccccc

SEQ ID NO: 5382 - DNA, 25 bp, Artificial sequence
  Extension Primer
tgtgcctytgtccatcttttcaggg

SEQ ID NO: 5383 - DNA, 25 bp, Artificial sequence
  Extension Primer
ttattctgcatccaaggacacgaca

SEQ ID NO: 5384 - DNA, 25 bp, Artificial sequence
  Extension Primer
tgagtcagaaacctgaagtgggggc

SEQ ID NO: 5385 - DNA, 25 bp, Artificial sequence
  Extension Primer
cttagtcgtgttacactgagacggc

SEQ ID NO: 5386 - DNA, 25 bp, Artificial sequence
  Extension Primer
tgaaacacaggaagaaaattgtcta

SEQ ID NO: 5387 - DNA, 25 bp, Artificial sequence
  Extension Primer
aaggtttctttcatttttaaagagg

SEQ ID NO: 5388 - DNA, 25 bp, Artificial sequence
  Extension Primer
gatatctctagtctttcatccctga

SEQ ID NO: 5389 - DNA, 25 bp, Artificial sequence
  Extension Primer
ttataatttgtgcttatgaagattt

SEQ ID NO: 5390 - DNA, 25 bp, Artificial sequence
  Extension Primer
aaattacgtcctttttcagcattat

SEQ ID NO: 5391 - DNA, 25 bp, Artificial sequence
  Extension Primer
ttcatgggtgacttaaaggaatttc

SEQ ID NO: 5392 - DNA, 25 bp, Artificial sequence
  Extension Primer
tttaaacagcaaaagaaatgtactg

SEQ ID NO: 5393 - DNA, 25 bp, Artificial sequence
  Extension Primer
attagatataaaggtggaagaaaat

SEQ ID NO: 5394 - DNA, 25 bp, Artificial sequence
  Extension Primer
agaaaaatctggattgcggtccaag

SEQ ID NO: 5395 - DNA, 25 bp, Artificial sequence
  Extension Primer
gaatgggtatatcaggcctccaaaa

SEQ ID NO: 5396 - DNA, 25 bp, Artificial sequence
  Extension Primer
ctcagaggggtctgggaaagacttt

SEQ ID NO: 5397 - DNA, 25 bp, Artificial sequence
  Extension Primer
acagaatactgtaaatctcctatac

SEQ ID NO: 5398 - DNA, 22 bp, Artificial sequence
  Extension Primer
aaagatgtgtttttgaaataat

SEQ ID NO: 5399 - DNA, 25 bp, Artificial sequence
  Extension Primer
aagaacattcctgattttttatttc

SEQ ID NO: 5400 - DNA, 25 bp, Artificial sequence
  Extension Primer
catcccagtttcccccttgattatt

SEQ ID NO: 5401 - DNA, 25 bp, Artificial sequence
  Extension Primer
aggaaattggtctttcccttcatct

SEQ ID NO: 5402 - DNA, 25 bp, Artificial sequence
  Extension Primer
gaggctattaagtactcaaggaaga

SEQ ID NO: 5403 - DNA, 25 bp, Artificial sequence
  Extension Primer
aagagagtagatgtatgctatttaa

SEQ ID NO: 5404 - DNA, 25 bp, Artificial sequence
  Extension Primer
taaaaattatataaacctgtactaa

SEQ ID NO: 5405 - DNA, 25 bp, Artificial sequence
  Extension Primer
actccctcattatttccattctgta

SEQ ID NO: 5406 - DNA, 25 bp, Artificial sequence
  Extension Primer
gtcataatgccacaagataaggata

SEQ ID NO: 5407 - DNA, 25 bp, Artificial sequence
  Extension Primer
tgtagctaggttattactattatta

SEQ ID NO: 5408 - DNA, 25 bp, Artificial sequence
  Extension Primer
tggagatcctctttttcccctttca

SEQ ID NO: 5409 - DNA, 25 bp, Artificial sequence
  Extension Primer
aattgagactggtggtgacagtatc

SEQ ID NO: 5410 - DNA, 25 bp, Artificial sequence
  Extension Primer
ccactttcaagtctttgaaaactga

SEQ ID NO: 5411 - DNA, 25 bp, Artificial sequence
  Extension Primer
gattttgctacgtttgctttgcctg

SEQ ID NO: 5412 - DNA, 25 bp, Artificial sequence
  Extension Primer
catgaaaagtggtaactatgtgagg

SEQ ID NO: 5413 - DNA, 25 bp, Artificial sequence
  Extension Primer
aatgtccttcatgtaaattactcta

SEQ ID NO: 5414 - DNA, 25 bp, Artificial sequence
  Extension Primer
gtcatggccaaagatgaaaatgtca

SEQ ID NO: 5415 - DNA, 25 bp, Artificial sequence
  Extension Primer
gcacaggaaaaacaccactacattc

SEQ ID NO: 5416 - DNA, 25 bp, Artificial sequence
  Extension Primer
ctggtgaaccccaattggacacaga

SEQ ID NO: 5417 - DNA, 25 bp, Artificial sequence
  Extension Primer
cttttctgagtagattaaggcactc

SEQ ID NO: 5418 - DNA, 25 bp, Artificial sequence
  Extension Primer
agtgattgtttagaaatatctaagg

SEQ ID NO: 5419 - DNA, 25 bp, Artificial sequence
  Extension Primer
tattttcagtaatgatgttttctag

SEQ ID NO: 5420 - DNA, 25 bp, Artificial sequence
  Extension Primer
cagaattttccaggtatctaacagg

SEQ ID NO: 5421 - DNA, 25 bp, Artificial sequence
  Extension Primer
tgtgtttgcatcatctgttcctgga

SEQ ID NO: 5422 - DNA, 25 bp, Artificial sequence
  Extension Primer
ggctttcacatgcctctggcagcag

SEQ ID NO: 5423 - DNA, 25 bp, Artificial sequence
  Extension Primer
ctagactacatcccaaatattagga

SEQ ID NO: 5424 - DNA, 25 bp, Artificial sequence
  Extension Primer
tggaaggagcaggctagtataggca

SEQ ID NO: 5425 - DNA, 25 bp, Artificial sequence
  Extension Primer
ccaggctcctgcatgttacaggaac

SEQ ID NO: 5426 - DNA, 25 bp, Artificial sequence
  Extension Primer
atctgctaatccatgataaaagggc

SEQ ID NO: 5427 - DNA, 25 bp, Artificial sequence
  Extension Primer
cagctgttatttctctggtctaaca

SEQ ID NO: 5428 - DNA, 25 bp, Artificial sequence
  Extension Primer
gttatacatactttggtttctgcag

SEQ ID NO: 5429 - DNA, 25 bp, Artificial sequence
  Extension Primer
ggaccagggaacagctctccctgaa

SEQ ID NO: 5430 - DNA, 25 bp, Artificial sequence
  Extension Primer
tgccctaggggcgggttgtggacat

SEQ ID NO: 5431 - DNA, 25 bp, Artificial sequence
  Extension Primer
aaaggaggtataggaattgattgaa

SEQ ID NO: 5432 - DNA, 25 bp, Artificial sequence
  Extension Primer
ggcctggcgagtctctgctttgaat

SEQ ID NO: 5433 - DNA, 25 bp, Artificial sequence
  Extension Primer
taattgtgtgtgcctggtgcttctc

SEQ ID NO: 5434 - DNA, 25 bp, Artificial sequence
  Extension Primer
atgtcgagtttatgccgaggtaaag

SEQ ID NO: 5435 - DNA, 25 bp, Artificial sequence
  Extension Primer
aggagaaacagggtgtcctgggagg

SEQ ID NO: 5436 - DNA, 25 bp, Artificial sequence
  Extension Primer
gcttcttttctcaccactctcctta

SEQ ID NO: 5437 - DNA, 25 bp, Artificial sequence
  Extension Primer
tacgtggctgaatatgggagatgag

SEQ ID NO: 5438 - DNA, 25 bp, Artificial sequence
  Extension Primer
aatttgggcagggggtagccttggt

SEQ ID NO: 5439 - DNA, 25 bp, Artificial sequence
  Extension Primer
gaggcctctgggattttatttcatc

SEQ ID NO: 5440 - DNA, 25 bp, Artificial sequence
  Extension Primer
tgaccttgccccacgagtaataacc

SEQ ID NO: 5441 - DNA, 25 bp, Artificial sequence
  Extension Primer
gacagagacagaccacgtcacccaa

SEQ ID NO: 5442 - DNA, 25 bp, Artificial sequence
  Extension Primer
gacttaactgaggtcccacggctcc

SEQ ID NO: 5443 - DNA, 25 bp, Artificial sequence
  Extension Primer
aatgcagggagcaggggtttgatcc

SEQ ID NO: 5444 - DNA, 25 bp, Artificial sequence
  Extension Primer
aaccagcgcgtgcgagggtggtgga

SEQ ID NO: 5445 - DNA, 25 bp, Artificial sequence
  Extension Primer
aaatccagtcaagggcgaacaagga

SEQ ID NO: 5446 - DNA, 25 bp, Artificial sequence
  Extension Primer
acctaaccagcaccaccacrygcat

SEQ ID NO: 5447 - DNA, 25 bp, Artificial sequence
  Extension Primer
ggggtgaatccaccgcgtttctggg

SEQ ID NO: 5448 - DNA, 25 bp, Artificial sequence
  Extension Primer
gtgtgctccttgtcatttaggggct

SEQ ID NO: 5449 - DNA, 25 bp, Artificial sequence
  Extension Primer
accttgcaagcagcagtttgtgccc

SEQ ID NO: 5450 - DNA, 25 bp, Artificial sequence
  Extension Primer
ggggtgtaataaacactgaagacag

SEQ ID NO: 5451 - DNA, 25 bp, Artificial sequence
  Extension Primer
tctcttyaaagaaaatgtaygttta

SEQ ID NO: 5452 - DNA, 25 bp, Artificial sequence
  Extension Primer
tcatgaagtgttctatgtaataaga

SEQ ID NO: 5453 - DNA, 25 bp, Artificial sequence
  Extension Primer
ggcagaactgcagaaaaatcctata

SEQ ID NO: 5454 - DNA, 25 bp, Artificial sequence
  Extension Primer
aaatatttattktgcttttgaaatg

SEQ ID NO: 5455 - DNA, 25 bp, Artificial sequence
  Extension Primer
agatttccagctacaggaaagctag

SEQ ID NO: 5456 - DNA, 25 bp, Artificial sequence
  Extension Primer
tattaaggagcttaaaaaataaaca

SEQ ID NO: 5457 - DNA, 25 bp, Artificial sequence
  Extension Primer
ccttgcccacttctgttcttctctc

SEQ ID NO: 5458 - DNA, 25 bp, Artificial sequence
  Extension Primer
taaaaactgtcatgatagattagtg

SEQ ID NO: 5459 - DNA, 25 bp, Artificial sequence
  Extension Primer
gtaaatatataactaaaaggagaag

SEQ ID NO: 5460 - DNA, 25 bp, Artificial sequence
  Extension Primer
tctttagttttcttaacttctcaca

SEQ ID NO: 5461 - DNA, 25 bp, Artificial sequence
  Extension Primer
atgttttacatgattacattttagc

SEQ ID NO: 5462 - DNA, 25 bp, Artificial sequence
  Extension Primer
taaaagtgtgctctgagaacagtag

SEQ ID NO: 5463 - DNA, 25 bp, Artificial sequence
  Extension Primer
aaattttgatcatgtgcaaaagtaa

SEQ ID NO: 5464 - DNA, 25 bp, Artificial sequence
  Extension Primer
tggttggtacttggatgggagaaaa

SEQ ID NO: 5465 - DNA, 25 bp, Artificial sequence
  Extension Primer
atgtcatcccactttctcttatttc

SEQ ID NO: 5466 - DNA, 25 bp, Artificial sequence
  Extension Primer
gagtcacatgaattttttggtttcc

SEQ ID NO: 5467 - DNA, 25 bp, Artificial sequence
  Extension Primer
catgggggcacataacagtcgcttc

SEQ ID NO: 5468 - DNA, 25 bp, Artificial sequence
  Extension Primer
gctctttgttttcttttaaataatt

SEQ ID NO: 5469 - DNA, 25 bp, Artificial sequence
  Extension Primer
aaaggcccgctcaatgcattttctt

SEQ ID NO: 5470 - DNA, 25 bp, Artificial sequence
  Extension Primer
attcagtcattccaatctactacta

SEQ ID NO: 5471 - DNA, 25 bp, Artificial sequence
  Extension Primer
tctccagaacaagatatagcagtaa

SEQ ID NO: 5472 - DNA, 25 bp, Artificial sequence
  Extension Primer
ccaagcacatgtaatgtgtataaaa

SEQ ID NO: 5473 - DNA, 25 bp, Artificial sequence
  Extension Primer
acacttagtaatgctctggcacttg

SEQ ID NO: 5474 - DNA, 25 bp, Artificial sequence
  Extension Primer
aagagaatgcactggctgcccaaag

SEQ ID NO: 5475 - DNA, 25 bp, Artificial sequence
  Extension Primer
ctaatacctataagtctttctagta

SEQ ID NO: 5476 - DNA, 25 bp, Artificial sequence
  Extension Primer
ctaaaacgtggtggaattccctctc

SEQ ID NO: 5477 - DNA, 25 bp, Artificial sequence
  Extension Primer
atggttgactaagtaaatctacttt

SEQ ID NO: 5478 - DNA, 25 bp, Artificial sequence
  Extension Primer
cctaacttttctctcttctaacaaa

SEQ ID NO: 5479 - DNA, 25 bp, Artificial sequence
  Extension Primer
aaaggactttccttggttacttctc

SEQ ID NO: 5480 - DNA, 25 bp, Artificial sequence
  Extension Primer
tttattaagtgcttactatatattc

SEQ ID NO: 5481 - DNA, 22 bp, Artificial sequence
  Extension Primer
aggacactgtcaatgtattttt

SEQ ID NO: 5482 - DNA, 25 bp, Artificial sequence
  Extension Primer
acagatggaagcttcgttgcttaaa

SEQ ID NO: 5483 - DNA, 25 bp, Artificial sequence
  Extension Primer
ttatactctttaaatagcatgagat

SEQ ID NO: 5484 - DNA, 25 bp, Artificial sequence
  Extension Primer
tctagrtaagtctatgtagyaaaat

SEQ ID NO: 5485 - DNA, 25 bp, Artificial sequence
  Extension Primer
gttctgtgagtatatatccacagtt

SEQ ID NO: 5486 - DNA, 25 bp, Artificial sequence
  Extension Primer
tccacaacttaccagttgataaata

SEQ ID NO: 5487 - DNA, 25 bp, Artificial sequence
  Extension Primer
tttgattatcaggtactatcatgga

SEQ ID NO: 5488 - DNA, 25 bp, Artificial sequence
  Extension Primer
gtgttttattacagtaagttcccta

SEQ ID NO: 5489 - DNA, 25 bp, Artificial sequence
  Extension Primer
atgccacagcagctaaggcacatag

SEQ ID NO: 5490 - DNA, 25 bp, Artificial sequence
  Extension Primer
tggttacaggtagccgggagcagag

SEQ ID NO: 5491 - DNA, 25 bp, Artificial sequence
  Extension Primer
ctatttctttcgaaatcaagaggct

SEQ ID NO: 5492 - DNA, 25 bp, Artificial sequence
  Extension Primer
atgagccataccccacagtttggaa

SEQ ID NO: 5493 - DNA, 25 bp, Artificial sequence
  Extension Primer
aaaagctggtctggtgattgatcgg

SEQ ID NO: 5494 - DNA, 25 bp, Artificial sequence
  Extension Primer
cgtgcccaaactccccgtggcagac

SEQ ID NO: 5495 - DNA, 25 bp, Artificial sequence
  Extension Primer
caaattcctaaatagctcattactg

SEQ ID NO: 5496 - DNA, 25 bp, Artificial sequence
  Extension Primer
ataaaacctatgaagtctttctctc

SEQ ID NO: 5497 - DNA, 25 bp, Artificial sequence
  Extension Primer
ggctttctttggcattgtaatgaac

SEQ ID NO: 5498 - DNA, 25 bp, Artificial sequence
  Extension Primer
gcaaaactcctaattagggagatga

SEQ ID NO: 5499 - DNA, 25 bp, Artificial sequence
  Extension Primer
gcttatacaaatagagttacagatg

SEQ ID NO: 5500 - DNA, 25 bp, Artificial sequence
  Extension Primer
catggggtcgcaaacatgactgagc

SEQ ID NO: 5501 - DNA, 25 bp, Artificial sequence
  Extension Primer
gggccttttagcctaacgacatatg

SEQ ID NO: 5502 - DNA, 25 bp, Artificial sequence
  Extension Primer
ctccatccatgggccgatcgcaagt

SEQ ID NO: 5503 - DNA, 25 bp, Artificial sequence
  Extension Primer
gatggcaggaagagtgcccccacac

SEQ ID NO: 5504 - DNA, 25 bp, Artificial sequence
  Extension Primer
gcctctcagcatcttagaggtttca

SEQ ID NO: 5505 - DNA, 25 bp, Artificial sequence
  Extension Primer
gcctcgttagccggccgggagttgt

SEQ ID NO: 5506 - DNA, 25 bp, Artificial sequence
  Extension Primer
ccctcccacaacatctccagtgaat

SEQ ID NO: 5507 - DNA, 25 bp, Artificial sequence
  Extension Primer
ttttcttagaagggaggccctcatc

SEQ ID NO: 5508 - DNA, 25 bp, Artificial sequence
  Extension Primer
tcaaccacaccttccaagggctcac

SEQ ID NO: 5509 - DNA, 25 bp, Artificial sequence
  Extension Primer
gagcctggtactgtgacaagagtgg

SEQ ID NO: 5510 - DNA, 25 bp, Artificial sequence
  Extension Primer
gacttctggggagggagcgtgggaa

SEQ ID NO: 5511 - DNA, 25 bp, Artificial sequence
  Extension Primer
ggagagtaacccaggcagtgggaac

SEQ ID NO: 5512 - DNA, 25 bp, Artificial sequence
  Extension Primer
agaaaagatttcacatagaagtaga

SEQ ID NO: 5513 - DNA, 25 bp, Artificial sequence
  Extension Primer
ttaatagtttccagccataacctca

SEQ ID NO: 5514 - DNA, 25 bp, Artificial sequence
  Extension Primer
ggttttcattagttatctattttac

SEQ ID NO: 5515 - DNA, 25 bp, Artificial sequence
  Extension Primer
atcatgctagatgggcaaaattgtc

SEQ ID NO: 5516 - DNA, 25 bp, Artificial sequence
  Extension Primer
aacatttgctttatttcctcctcta

SEQ ID NO: 5517 - DNA, 25 bp, Artificial sequence
  Extension Primer
tcattgaaataacaaagggaactgt

SEQ ID NO: 5518 - DNA, 25 bp, Artificial sequence
  Extension Primer
aattttaaaactcccaacaaacaaa

SEQ ID NO: 5519 - DNA, 25 bp, Artificial sequence
  Extension Primer
tataaaaatgaaattttacaactca

SEQ ID NO: 5520 - DNA, 25 bp, Artificial sequence
  Extension Primer
ggagataagccacaaagtaggtgac

SEQ ID NO: 5521 - DNA, 25 bp, Artificial sequence
  Extension Primer
caagcatatttttgtcatcgcctcc

SEQ ID NO: 5522 - DNA, 25 bp, Artificial sequence
  Extension Primer
aatcacatagaaaagttacaactgc

SEQ ID NO: 5523 - DNA, 25 bp, Artificial sequence
  Extension Primer
agaacagtgtaaacaggtcacataa

SEQ ID NO: 5524 - DNA, 25 bp, Artificial sequence
  Extension Primer
atacatgattcaatttacagactga

SEQ ID NO: 5525 - DNA, 25 bp, Artificial sequence
  Extension Primer
gaggtgaccttagattataatgttc

SEQ ID NO: 5526 - DNA, 25 bp, Artificial sequence
  Extension Primer
gaaatacaagattaagttcctgtga

SEQ ID NO: 5527 - DNA, 25 bp, Artificial sequence
  Extension Primer
acttctgtgagccctttatttttca

SEQ ID NO: 5528 - DNA, 25 bp, Artificial sequence
  Extension Primer
tatagttacatatctcttgtaatag

SEQ ID NO: 5529 - DNA, 25 bp, Artificial sequence
  Extension Primer
atttgctagcattttgtgtttgtgc

SEQ ID NO: 5530 - DNA, 25 bp, Artificial sequence
  Extension Primer
atgaatgtgaactaagyagagaatg

SEQ ID NO: 5531 - DNA, 22 bp, Artificial sequence
  Extension Primer
aagaaatcactgaaagggaagc

SEQ ID NO: 5532 - DNA, 25 bp, Artificial sequence
  Extension Primer
tccagttttcctcatatataaaatc

SEQ ID NO: 5533 - DNA, 25 bp, Artificial sequence
  Extension Primer
aatatcagagcagacaatctaaagc

SEQ ID NO: 5534 - DNA, 25 bp, Artificial sequence
  Extension Primer
gaaaaaatgggctgctgctaatggg

SEQ ID NO: 5535 - DNA, 25 bp, Artificial sequence
  Extension Primer
tacatcatcttcaacaaatatgacc

SEQ ID NO: 5536 - DNA, 25 bp, Artificial sequence
  Extension Primer
agtagtgttgagattgagaaaaacc

SEQ ID NO: 5537 - DNA, 25 bp, Artificial sequence
  Extension Primer
tgtccccagaggctattactcaaaa

SEQ ID NO: 5538 - DNA, 25 bp, Artificial sequence
  Extension Primer
acaaaaggcatgagggctgtgtgat

SEQ ID NO: 5539 - DNA, 25 bp, Artificial sequence
  Extension Primer
actctaccccttcattttaaaatcc

SEQ ID NO: 5540 - DNA, 25 bp, Artificial sequence
  Extension Primer
atggatcattgtaaggattaagggc

SEQ ID NO: 5541 - DNA, 25 bp, Artificial sequence
  Extension Primer
taggcagtctttccaaacaatctgc

SEQ ID NO: 5542 - DNA, 25 bp, Artificial sequence
  Extension Primer
ccatatctcattgcagtggagagct

SEQ ID NO: 5543 - DNA, 25 bp, Artificial sequence
  Extension Primer
tggaaacactgttctcaggggtccc

SEQ ID NO: 5544 - DNA, 25 bp, Artificial sequence
  Extension Primer
acagccagggaaccttcccagccca

SEQ ID NO: 5545 - DNA, 25 bp, Artificial sequence
  Extension Primer
gttcctcccagccttaatttagacc

SEQ ID NO: 5546 - DNA, 25 bp, Artificial sequence
  Extension Primer
gtggggatattgttttctgagccgg

SEQ ID NO: 5547 - DNA, 25 bp, Artificial sequence
  Extension Primer
gctgggtcttgaagtatcagattcc

SEQ ID NO: 5548 - DNA, 25 bp, Artificial sequence
  Extension Primer
tgaggccagcagaagagcatctgac

SEQ ID NO: 5549 - DNA, 25 bp, Artificial sequence
  Extension Primer
ccctcagctgagagcagagacacac

SEQ ID NO: 5550 - DNA, 25 bp, Artificial sequence
  Extension Primer
gcggaatcagaaatgtgtggaagtc

SEQ ID NO: 5551 - DNA, 25 bp, Artificial sequence
  Extension Primer
gaggtgtcccttctttgcttcttca

SEQ ID NO: 5552 - DNA, 25 bp, Artificial sequence
  Extension Primer
tagcaagactcacagccttctccac

SEQ ID NO: 5553 - DNA, 25 bp, Artificial sequence
  Extension Primer
cctcctgtttattacttttcttctc

SEQ ID NO: 5554 - DNA, 25 bp, Artificial sequence
  Extension Primer
ctgcttccagttctagcatggagtc

SEQ ID NO: 5555 - DNA, 25 bp, Artificial sequence
  Extension Primer
ctctgggaggtagtggaggacagac

SEQ ID NO: 5556 - DNA, 25 bp, Artificial sequence
  Extension Primer
ttggctcacacaaccgggcaattcc

SEQ ID NO: 5557 - DNA, 25 bp, Artificial sequence
  Extension Primer
tggaggtgaactcagctaccggggt

SEQ ID NO: 5558 - DNA, 25 bp, Artificial sequence
  Extension Primer
gacaccgcagtcagagccctaggac

SEQ ID NO: 5559 - DNA, 25 bp, Artificial sequence
  Extension Primer
tgagagctccttgccaccttcaggg

SEQ ID NO: 5560 - DNA, 25 bp, Artificial sequence
  Extension Primer
gtttgtgaagaactgcacaagttcc

SEQ ID NO: 5561 - DNA, 25 bp, Artificial sequence
  Extension Primer
aatacttgaagcagtagtttaccaa

SEQ ID NO: 5562 - DNA, 25 bp, Artificial sequence
  Extension Primer
atttattgaaatgtcagatggattc

SEQ ID NO: 5563 - DNA, 25 bp, Artificial sequence
  Extension Primer
cataggttccaaagtagaccttagc

SEQ ID NO: 5564 - DNA, 25 bp, Artificial sequence
  Extension Primer
caaggtactttcttgacttcaattc

SEQ ID NO: 5565 - DNA, 25 bp, Artificial sequence
  Extension Primer
caaaagacataaacctacacattca

SEQ ID NO: 5566 - DNA, 25 bp, Artificial sequence
  Extension Primer
aataggatttgatgttagaggcttc

SEQ ID NO: 5567 - DNA, 25 bp, Artificial sequence
  Extension Primer
tcaacactagtaaaacagaacaaca

SEQ ID NO: 5568 - DNA, 25 bp, Artificial sequence
  Extension Primer
gttgctacatttaattcagaagttc

SEQ ID NO: 5569 - DNA, 25 bp, Artificial sequence
  Extension Primer
gcctactcagtgccgtttgttttct

SEQ ID NO: 5570 - DNA, 25 bp, Artificial sequence
  Extension Primer
gttagatacactatagaaatgatct

SEQ ID NO: 5571 - DNA, 25 bp, Artificial sequence
  Extension Primer
tgagataggattagctatgggacta

SEQ ID NO: 5572 - DNA, 25 bp, Artificial sequence
  Extension Primer
gttacttatgtcttagaggtaaata

SEQ ID NO: 5573 - DNA, 25 bp, Artificial sequence
  Extension Primer
gtgatgctcgttaaacatgattttc

SEQ ID NO: 5574 - DNA, 25 bp, Artificial sequence
  Extension Primer
atcctgtttcagggccaaccaatta

SEQ ID NO: 5575 - DNA, 25 bp, Artificial sequence
  Extension Primer
gataactctgataagatgtttgatc

SEQ ID NO: 5576 - DNA, 25 bp, Artificial sequence
  Extension Primer
agagaaagcttgattattctgaatg

SEQ ID NO: 5577 - DNA, 25 bp, Artificial sequence
  Extension Primer
gaagcagatgctgtcacgtggtcct

SEQ ID NO: 5578 - DNA, 25 bp, Artificial sequence
  Extension Primer
ttgtaagaatcagcaatgccctgac

SEQ ID NO: 5579 - DNA, 25 bp, Artificial sequence
  Extension Primer
ttgcacatcccaaccttgaagacat

SEQ ID NO: 5580 - DNA, 25 bp, Artificial sequence
  Extension Primer
gggatcttgtttcttaaactttatt

SEQ ID NO: 5581 - DNA, 25 bp, Artificial sequence
  Extension Primer
ataacaacagccactgtggttgtac

SEQ ID NO: 5582 - DNA, 25 bp, Artificial sequence
  Extension Primer
agttaattgactgcttggtagatga

SEQ ID NO: 5583 - DNA, 25 bp, Artificial sequence
  Extension Primer
gtattaagttccagatcctgttcta

SEQ ID NO: 5584 - DNA, 25 bp, Artificial sequence
  Extension Primer
cacctgccttctatctttcttctgg

SEQ ID NO: 5585 - DNA, 25 bp, Artificial sequence
  Extension Primer
cattttgaactttatccctttgaaa

SEQ ID NO: 5586 - DNA, 25 bp, Artificial sequence
  Extension Primer
ggagggaaagaaggagaaaatttgc

SEQ ID NO: 5587 - DNA, 25 bp, Artificial sequence
  Extension Primer
agaaatagtggaaaataatagaatg

SEQ ID NO: 5588 - DNA, 25 bp, Artificial sequence
  Extension Primer
cgttcatggttatataaagggctca

SEQ ID NO: 5589 - DNA, 25 bp, Artificial sequence
  Extension Primer
attcgttttcattcaccccattcta

SEQ ID NO: 5590 - DNA, 25 bp, Artificial sequence
  Extension Primer
agactgacaacaaaagaagcaggtg

SEQ ID NO: 5591 - DNA, 25 bp, Artificial sequence
  Extension Primer
ggacttccttygtggtccaatgggt

SEQ ID NO: 5592 - DNA, 25 bp, Artificial sequence
  Extension Primer
agaaaatactatttttcaatttgct

SEQ ID NO: 5593 - DNA, 25 bp, Artificial sequence
  Extension Primer
aatacacagaatatatgaacacagt

SEQ ID NO: 5594 - DNA, 25 bp, Artificial sequence
  Extension Primer
attcaagagacagaggcacagatgc

SEQ ID NO: 5595 - DNA, 25 bp, Artificial sequence
  Extension Primer
gacgtaagagcagaggttaccaagc

SEQ ID NO: 5596 - DNA, 25 bp, Artificial sequence
  Extension Primer
gctgttaaccaacttacatgccctc

SEQ ID NO: 5597 - DNA, 25 bp, Artificial sequence
  Extension Primer
ctgctgctctacctaacaaccccca

SEQ ID NO: 5598 - DNA, 25 bp, Artificial sequence
  Extension Primer
catatgcatacgtaaaatcaagagc

SEQ ID NO: 5599 - DNA, 25 bp, Artificial sequence
  Extension Primer
acggttgcagaattttaggtggacc

SEQ ID NO: 5600 - DNA, 25 bp, Artificial sequence
  Extension Primer
tttcgttacagtgttggaagaggct

SEQ ID NO: 5601 - DNA, 25 bp, Artificial sequence
  Extension Primer
aatcttgggagaaattcttctggct

SEQ ID NO: 5602 - DNA, 25 bp, Artificial sequence
  Extension Primer
cttgctttgattttctcaggggacc

SEQ ID NO: 5603 - DNA, 25 bp, Artificial sequence
  Extension Primer
gagacccggaccaccgtcatcaggc

SEQ ID NO: 5604 - DNA, 25 bp, Artificial sequence
  Extension Primer
aaatacattctatgccaggcttaag

SEQ ID NO: 5605 - DNA, 25 bp, Artificial sequence
  Extension Primer
taagattagcaatgttttggctaat

SEQ ID NO: 5606 - DNA, 25 bp, Artificial sequence
  Extension Primer
gcagaaggtgatactattgtcctta

SEQ ID NO: 5607 - DNA, 25 bp, Artificial sequence
  Extension Primer
cactcactaggactcagcctcatct

SEQ ID NO: 5608 - DNA, 25 bp, Artificial sequence
  Extension Primer
gacactagaacccttctgctttctc

SEQ ID NO: 5609 - DNA, 25 bp, Artificial sequence
  Extension Primer
gcccaggtgccttaccttacacaaa

SEQ ID NO: 5610 - DNA, 25 bp, Artificial sequence
  Extension Primer
gcagtgcatggacttctcattgggt

SEQ ID NO: 5611 - DNA, 25 bp, Artificial sequence
  Extension Primer
attctgtgatcagttctgctcccac

SEQ ID NO: 5612 - DNA, 25 bp, Artificial sequence
  Extension Primer
cttctcgtcagaaagggagggtctc

SEQ ID NO: 5613 - DNA, 25 bp, Artificial sequence
  Extension Primer
tggaaacttgccagcggtggggtgc

SEQ ID NO: 5614 - DNA, 25 bp, Artificial sequence
  Extension Primer
tctcctctgcaggttctccatcccc

SEQ ID NO: 5615 - DNA, 22 bp, Artificial sequence
  Extension Primer
gaatgatctacattcttaccca

SEQ ID NO: 5616 - DNA, 25 bp, Artificial sequence
  Extension Primer
caggccagccgcctgtctctgcctc

SEQ ID NO: 5617 - DNA, 25 bp, Artificial sequence
  Extension Primer
gggctgaggtgagagtgtggaggcc

SEQ ID NO: 5618 - DNA, 25 bp, Artificial sequence
  Extension Primer
cagagccttaactatgtgaccttac

SEQ ID NO: 5619 - DNA, 25 bp, Artificial sequence
  Extension Primer
ggattaagatttttttttttttatt

SEQ ID NO: 5620 - DNA, 25 bp, Artificial sequence
  Extension Primer
gaaaatggcaacagcaaggtttatc

SEQ ID NO: 5621 - DNA, 25 bp, Artificial sequence
  Extension Primer
gactgaagttcatgaaatgtggtta

SEQ ID NO: 5622 - DNA, 25 bp, Artificial sequence
  Extension Primer
ggatgccttgctggcttcaaaacag

SEQ ID NO: 5623 - DNA, 25 bp, Artificial sequence
  Extension Primer
ttaggctcatataaaaatgtagtaa

SEQ ID NO: 5624 - DNA, 25 bp, Artificial sequence
  Extension Primer
ttttagaattactacatgctagatg

SEQ ID NO: 5625 - DNA, 25 bp, Artificial sequence
  Extension Primer
taagcataattctctaaattcaaat

SEQ ID NO: 5626 - DNA, 25 bp, Artificial sequence
  Extension Primer
tggctttggggacaaatagtgattt

SEQ ID NO: 5627 - DNA, 25 bp, Artificial sequence
  Extension Primer
aaatagattagagaatggtgcaaaa

SEQ ID NO: 5628 - DNA, 25 bp, Artificial sequence
  Extension Primer
aaggaagcaaaataacttgcaacat

SEQ ID NO: 5629 - DNA, 25 bp, Artificial sequence
  Extension Primer
aaatcaaagtcccttctctccaaga

SEQ ID NO: 5630 - DNA, 25 bp, Artificial sequence
  Extension Primer
attggaatgatcttgcttgcaactc

SEQ ID NO: 5631 - DNA, 25 bp, Artificial sequence
  Extension Primer
caaattacaagacaaaagcatacac

SEQ ID NO: 5632 - DNA, 25 bp, Artificial sequence
  Extension Primer
attgatttgcagccagggagtacac

SEQ ID NO: 5633 - DNA, 25 bp, Artificial sequence
  Extension Primer
gacytcaatcaaaaatataatagag

SEQ ID NO: 5634 - DNA, 25 bp, Artificial sequence
  Extension Primer
ctactaagggtttttaaattctact

SEQ ID NO: 5635 - DNA, 25 bp, Artificial sequence
  Extension Primer
gatgccatccccagatttttttact

SEQ ID NO: 5636 - DNA, 25 bp, Artificial sequence
  Extension Primer
ttgatagatgatgagagatattcat

SEQ ID NO: 5637 - DNA, 25 bp, Artificial sequence
  Extension Primer
ataatttctccatcatctgtacaac

SEQ ID NO: 5638 - DNA, 25 bp, Artificial sequence
  Extension Primer
tctgtctactactcaaataactcca

SEQ ID NO: 5639 - DNA, 25 bp, Artificial sequence
  Extension Primer
gggaagagctcaaagaacatgtaag

SEQ ID NO: 5640 - DNA, 25 bp, Artificial sequence
  Extension Primer
gcaaaatgtgtaacttgcaaaatgt

SEQ ID NO: 5641 - DNA, 25 bp, Artificial sequence
  Extension Primer
gaagacaatgtgtactttacctgag

SEQ ID NO: 5642 - DNA, 25 bp, Artificial sequence
  Extension Primer
tcaaacttttctaaggccagagaac

SEQ ID NO: 5643 - DNA, 25 bp, Artificial sequence
  Extension Primer
gcccagagggaaagtgaatttctca

SEQ ID NO: 5644 - DNA, 25 bp, Artificial sequence
  Extension Primer
tattattttcaactacatacagaac

SEQ ID NO: 5645 - DNA, 25 bp, Artificial sequence
  Extension Primer
tcgaaaaagctaatgatgccaagga

SEQ ID NO: 5646 - DNA, 25 bp, Artificial sequence
  Extension Primer
ggaggcttaactgattctcattctt

SEQ ID NO: 5647 - DNA, 25 bp, Artificial sequence
  Extension Primer
ttatacagggtaaaagtggatgggg

SEQ ID NO: 5648 - DNA, 25 bp, Artificial sequence
  Extension Primer
gacaaagtatgaattttaaaaatct

SEQ ID NO: 5649 - DNA, 25 bp, Artificial sequence
  Extension Primer
attcatcatgttattctcgctaagc

SEQ ID NO: 5650 - DNA, 25 bp, Artificial sequence
  Extension Primer
tagacaaagtatttgctcatcctac

SEQ ID NO: 5651 - DNA, 25 bp, Artificial sequence
  Extension Primer
gatcactgaatcaaagtcagaatct

SEQ ID NO: 5652 - DNA, 25 bp, Artificial sequence
  Extension Primer
acctatatgccaatagtgtatacct

SEQ ID NO: 5653 - DNA, 25 bp, Artificial sequence
  Extension Primer
tcaagtcaagcagcattgaggacct

SEQ ID NO: 5654 - DNA, 25 bp, Artificial sequence
  Extension Primer
ctccgcatccctgagaaccaagcac

SEQ ID NO: 5655 - DNA, 25 bp, Artificial sequence
  Extension Primer
cacatgaaatcccacatccatcact

SEQ ID NO: 5656 - DNA, 25 bp, Artificial sequence
  Extension Primer
gattatttgggtcacatagcacgga

SEQ ID NO: 5657 - DNA, 25 bp, Artificial sequence
  Extension Primer
cagataattgaagctggctgttatc

SEQ ID NO: 5658 - DNA, 25 bp, Artificial sequence
  Extension Primer
aggcaatgtaggatttcattttgca

SEQ ID NO: 5659 - DNA, 25 bp, Artificial sequence
  Extension Primer
gtcttgaggaagaatcacttttctt

SEQ ID NO: 5660 - DNA, 25 bp, Artificial sequence
  Extension Primer
cagctccccaggaggtggggcrccc

SEQ ID NO: 5661 - DNA, 25 bp, Artificial sequence
  Extension Primer
caacacttcttgtcaaggggctact

SEQ ID NO: 5662 - DNA, 25 bp, Artificial sequence
  Extension Primer
gtggggcctgagactctgcgtttct

SEQ ID NO: 5663 - DNA, 25 bp, Artificial sequence
  Extension Primer
gcctccttcacgccagacttcctcc

SEQ ID NO: 5664 - DNA, 25 bp, Artificial sequence
  Extension Primer
catttgcccgaggccatgtgccttc

SEQ ID NO: 5665 - DNA, 25 bp, Artificial sequence
  Extension Primer
caaacaccgcagttttatttaacca

SEQ ID NO: 5666 - DNA, 25 bp, Artificial sequence
  Extension Primer
tggcagggaagacaggtcgggctct

SEQ ID NO: 5667 - DNA, 25 bp, Artificial sequence
  Extension Primer
catcattcctcataatgagagcccc

SEQ ID NO: 5668 - DNA, 25 bp, Artificial sequence
  Extension Primer
tgtaacttgagagttggacgagccg

SEQ ID NO: 5669 - DNA, 25 bp, Artificial sequence
  Extension Primer
gctgtgatcccttaagaattgcatc

SEQ ID NO: 5670 - DNA, 25 bp, Artificial sequence
  Extension Primer
caacatcaccgtatgtacttggcct

SEQ ID NO: 5671 - DNA, 25 bp, Artificial sequence
  Extension Primer
gctggcatgggtagatatgggggcc

SEQ ID NO: 5672 - DNA, 25 bp, Artificial sequence
  Extension Primer
aaaagaaggaccttttctgrctttc

SEQ ID NO: 5673 - DNA, 25 bp, Artificial sequence
  Extension Primer
ccagagagtctttattagaatttgt

SEQ ID NO: 5674 - DNA, 25 bp, Artificial sequence
  Extension Primer
cttaaaagtgacttttaaaagtgac

SEQ ID NO: 5675 - DNA, 25 bp, Artificial sequence
  Extension Primer
tcacctacttggtaagaagagcaac

SEQ ID NO: 5676 - DNA, 25 bp, Artificial sequence
  Extension Primer
tgggaaatctctggacatttaaagt

SEQ ID NO: 5677 - DNA, 25 bp, Artificial sequence
  Extension Primer
aactatgattattgagaacacataa

SEQ ID NO: 5678 - DNA, 25 bp, Artificial sequence
  Extension Primer
ctgcttccaactcgaagcgacartg

SEQ ID NO: 5679 - DNA, 25 bp, Artificial sequence
  Extension Primer
tagtccttaactgcaaagcactatc

SEQ ID NO: 5680 - DNA, 25 bp, Artificial sequence
  Extension Primer
agtagctctataggaaggccaataa

SEQ ID NO: 5681 - DNA, 25 bp, Artificial sequence
  Extension Primer
tgatttttccagctgatgacacaac

SEQ ID NO: 5682 - DNA, 25 bp, Artificial sequence
  Extension Primer
cytaagatatcttttagttcaacac

SEQ ID NO: 5683 - DNA, 25 bp, Artificial sequence
  Extension Primer
ccaaacactgatacatacttgagaa

SEQ ID NO: 5684 - DNA, 25 bp, Artificial sequence
  Extension Primer
agccccccagatacatagtctttaa

SEQ ID NO: 5685 - DNA, 25 bp, Artificial sequence
  Extension Primer
ttagtctaaaggagtgtgaaggctt

SEQ ID NO: 5686 - DNA, 25 bp, Artificial sequence
  Extension Primer
ttacacatctgtctcttgtgaactc

SEQ ID NO: 5687 - DNA, 25 bp, Artificial sequence
  Extension Primer
gtattgtgcaaagaaaacagttcaa

SEQ ID NO: 5688 - DNA, 25 bp, Artificial sequence
  Extension Primer
tgacctcatttatactgtgtgggtg

SEQ ID NO: 5689 - DNA, 25 bp, Artificial sequence
  Extension Primer
caaacacttgttgagtgacaaacac

SEQ ID NO: 5690 - DNA, 25 bp, Artificial sequence
  Extension Primer
ataagtaaataaacaaatggctaat

SEQ ID NO: 5691 - DNA, 25 bp, Artificial sequence
  Extension Primer
agaaagaaacaactacaggatcaaa

SEQ ID NO: 5692 - DNA, 22 bp, Artificial sequence
  Extension Primer
agtatgtgtgtttgatgtttcc

SEQ ID NO: 5693 - DNA, 25 bp, Artificial sequence
  Extension Primer
ggacgcacactctaaggcttttcat

SEQ ID NO: 5694 - DNA, 25 bp, Artificial sequence
  Extension Primer
atacattcaatatttcttacccttc

SEQ ID NO: 5695 - DNA, 25 bp, Artificial sequence
  Extension Primer
gaaaccaaggctccagaaaagaatg

SEQ ID NO: 5696 - DNA, 25 bp, Artificial sequence
  Extension Primer
aaaatgttaaataatcagagaccat

SEQ ID NO: 5697 - DNA, 25 bp, Artificial sequence
  Extension Primer
atggaatactaccctttgtccatcc

SEQ ID NO: 5698 - DNA, 25 bp, Artificial sequence
  Extension Primer
aggataagattaactgaggacagac

SEQ ID NO: 5699 - DNA, 25 bp, Artificial sequence
  Extension Primer
tctacaatatgttttattctggtgg

SEQ ID NO: 5700 - DNA, 25 bp, Artificial sequence
  Extension Primer
ctggctgattttatttacagctctc

SEQ ID NO: 5701 - DNA, 25 bp, Artificial sequence
  Extension Primer
tttagtgagcatctttacgatcatt

SEQ ID NO: 5702 - DNA, 25 bp, Artificial sequence
  Extension Primer
atagggaattaacatgtgtaataaa

SEQ ID NO: 5703 - DNA, 25 bp, Artificial sequence
  Extension Primer
aaatattgctctaagtaactgccat

SEQ ID NO: 5704 - DNA, 22 bp, Artificial sequence
  Extension Primer
agttcctacttccctgggctgt

SEQ ID NO: 5705 - DNA, 25 bp, Artificial sequence
  Extension Primer
accaagctgcgtgtgatatagcact

SEQ ID NO: 5706 - DNA, 25 bp, Artificial sequence
  Extension Primer
ctcattaaaatgaagaatattcccc

SEQ ID NO: 5707 - DNA, 25 bp, Artificial sequence
  Extension Primer
aagaaaatatcaatgtcctatggtc

SEQ ID NO: 5708 - DNA, 22 bp, Artificial sequence
  Extension Primer
tcatccagcctttagtcaacct

SEQ ID NO: 5709 - DNA, 25 bp, Artificial sequence
  Extension Primer
aatttatattgtttccgaaagccct

SEQ ID NO: 5710 - DNA, 25 bp, Artificial sequence
  Extension Primer
ctcttgtctggctttttaatacctc

SEQ ID NO: 5711 - DNA, 25 bp, Artificial sequence
  Extension Primer
ggtaatgaaatgaaaaatttcccca

SEQ ID NO: 5712 - DNA, 25 bp, Artificial sequence
  Extension Primer
tgccacccatgctgataaaatggaa

SEQ ID NO: 5713 - DNA, 25 bp, Artificial sequence
  Extension Primer
tgtccccactgctcaaggcaaacgc

SEQ ID NO: 5714 - DNA, 25 bp, Artificial sequence
  Extension Primer
ccgggagggctccccggaggcggtg

SEQ ID NO: 5715 - DNA, 25 bp, Artificial sequence
  Extension Primer
aagggctccgaatgtggggacacgc

SEQ ID NO: 5716 - DNA, 25 bp, Artificial sequence
  Extension Primer
agcagatgggtgcgttccagcattt

SEQ ID NO: 5717 - DNA, 25 bp, Artificial sequence
  Extension Primer
ttcttgccatttaaaggtacactga

SEQ ID NO: 5718 - DNA, 25 bp, Artificial sequence
  Extension Primer
ggtctgattcacttttttatttttc

SEQ ID NO: 5719 - DNA, 25 bp, Artificial sequence
  Extension Primer
aacacactgggacatgctcgcattc

SEQ ID NO: 5720 - DNA, 25 bp, Artificial sequence
  Extension Primer
gttttygttactagaggatctccag

SEQ ID NO: 5721 - DNA, 25 bp, Artificial sequence
  Extension Primer
actaatcctaaattttcattgaaac

SEQ ID NO: 5722 - DNA, 25 bp, Artificial sequence
  Extension Primer
cattccagtcttgttcaaaatcttc

SEQ ID NO: 5723 - DNA, 25 bp, Artificial sequence
  Extension Primer
tgcaaartccattttgccatttatg

SEQ ID NO: 5724 - DNA, 25 bp, Artificial sequence
  Extension Primer
cactctacatgttctaagcattctt

SEQ ID NO: 5725 - DNA, 25 bp, Artificial sequence
  Extension Primer
gtttgtcctgaagcctgccctgagc

SEQ ID NO: 5726 - DNA, 25 bp, Artificial sequence
  Extension Primer
aactagagaggagcccccgctctcc

SEQ ID NO: 5727 - DNA, 22 bp, Artificial sequence
  Extension Primer
tgtgatgtcacttatatgtagg

SEQ ID NO: 5728 - DNA, 25 bp, Artificial sequence
  Extension Primer
gagtttcagattttctttcttcttc

SEQ ID NO: 5729 - DNA, 25 bp, Artificial sequence
  Extension Primer
aataattcaattcagatttctttca

SEQ ID NO: 5730 - DNA, 25 bp, Artificial sequence
  Extension Primer
taaattcctggtaagaaagagaaaa

SEQ ID NO: 5731 - DNA, 25 bp, Artificial sequence
  Extension Primer
atatagattagaaaggcaaagtaag

SEQ ID NO: 5732 - DNA, 25 bp, Artificial sequence
  Extension Primer
gtgggcatcaggaacctgccctttt

SEQ ID NO: 5733 - DNA, 25 bp, Artificial sequence
  Extension Primer
agactctgagatttcacttcagggg

SEQ ID NO: 5734 - DNA, 25 bp, Artificial sequence
  Extension Primer
tttttttccttaggaatacatggat

SEQ ID NO: 5735 - DNA, 25 bp, Artificial sequence
  Extension Primer
tatacatttttgaatcagttcgtca

SEQ ID NO: 5736 - DNA, 25 bp, Artificial sequence
  Extension Primer
gggggctgccccaatggagggtggc

SEQ ID NO: 5737 - DNA, 25 bp, Artificial sequence
  Extension Primer
attatcattgcttcatatcatcaac

SEQ ID NO: 5738 - DNA, 25 bp, Artificial sequence
  Extension Primer
aaggagttgcctcaggagaatagac

SEQ ID NO: 5739 - DNA, 25 bp, Artificial sequence
  Extension Primer
agactcttttccaaaaaccttgatt

SEQ ID NO: 5740 - DNA, 25 bp, Artificial sequence
  Extension Primer
caattttccaaatgatgctccttta

SEQ ID NO: 5741 - DNA, 25 bp, Artificial sequence
  Extension Primer
gggctcctcaccatcacaataaaga

SEQ ID NO: 5742 - DNA, 25 bp, Artificial sequence
  Extension Primer
ccattcacaacttacaaccattcta

SEQ ID NO: 5743 - DNA, 25 bp, Artificial sequence
  Extension Primer
aattccccaacaaatccayggctgt

SEQ ID NO: 5744 - DNA, 22 bp, Artificial sequence
  Extension Primer
acgtttgggtgtttaaagttac

SEQ ID NO: 5745 - DNA, 25 bp, Artificial sequence
  Extension Primer
catttttatcaggaatcctaggtct

SEQ ID NO: 5746 - DNA, 25 bp, Artificial sequence
  Extension Primer
gatttgattgtagcctgagtatcat

SEQ ID NO: 5747 - DNA, 25 bp, Artificial sequence
  Extension Primer
gagacttttcataaaatcacatttt

SEQ ID NO: 5748 - DNA, 25 bp, Artificial sequence
  Extension Primer
ttgactttttcttactgtttcatct

SEQ ID NO: 5749 - DNA, 25 bp, Artificial sequence
  Extension Primer
ctgcctagaatatccttccacctcc

SEQ ID NO: 5750 - DNA, 25 bp, Artificial sequence
  Extension Primer
tcgcctggggacgcattttgtgtct

SEQ ID NO: 5751 - DNA, 25 bp, Artificial sequence
  Extension Primer
gaagggagaggatgtgatcctcaga

SEQ ID NO: 5752 - DNA, 25 bp, Artificial sequence
  Extension Primer
acaattcaaagctgacaaccttggg

SEQ ID NO: 5753 - DNA, 25 bp, Artificial sequence
  Extension Primer
agccaaaccagttcggaagggacca

SEQ ID NO: 5754 - DNA, 25 bp, Artificial sequence
  Extension Primer
gtcagggaggcccttgataccgtgt

SEQ ID NO: 5755 - DNA, 22 bp, Artificial sequence
  Extension Primer
cagagcccagtttttggggaag

SEQ ID NO: 5756 - DNA, 25 bp, Artificial sequence
  Extension Primer
agaaccttgtgggaagtttgccgtc

SEQ ID NO: 5757 - DNA, 25 bp, Artificial sequence
  Extension Primer
atccataccctcttctattgtgtct

SEQ ID NO: 5758 - DNA, 25 bp, Artificial sequence
  Extension Primer
ttgcagatgtagctagacactataa

SEQ ID NO: 5759 - DNA, 25 bp, Artificial sequence
  Extension Primer
tttgcaatatcctgcaattgctatt

SEQ ID NO: 5760 - DNA, 25 bp, Artificial sequence
  Extension Primer
cattgggcacaattaccagaagagg

SEQ ID NO: 5761 - DNA, 25 bp, Artificial sequence
  Extension Primer
aagaagtaacatgtgataacgtatg

SEQ ID NO: 5762 - DNA, 25 bp, Artificial sequence
  Extension Primer
aatggattccacttaggattttgta

SEQ ID NO: 5763 - DNA, 25 bp, Artificial sequence
  Extension Primer
catttagtatttgaacaacagaaaa

SEQ ID NO: 5764 - DNA, 25 bp, Artificial sequence
  Extension Primer
aatamcaataataataataataaac

SEQ ID NO: 5765 - DNA, 25 bp, Artificial sequence
  Extension Primer
gtctgcagagactatggcttacaca

SEQ ID NO: 5766 - DNA, 25 bp, Artificial sequence
  Extension Primer
ttggggactttaaaaatcaggatta

SEQ ID NO: 5767 - DNA, 25 bp, Artificial sequence
  Extension Primer
gatacaaaagggggaaaaaaactaa

SEQ ID NO: 5768 - DNA, 25 bp, Artificial sequence
  Extension Primer
tatgtggataattaaaaaataagac

SEQ ID NO: 5769 - DNA, 25 bp, Artificial sequence
  Extension Primer
aaattcttgggagtttggcaagact

SEQ ID NO: 5770 - DNA, 25 bp, Artificial sequence
  Extension Primer
ggatgacccccaaattttatttcag

SEQ ID NO: 5771 - DNA, 25 bp, Artificial sequence
  Extension Primer
actatcttctactatacacaaaaat

SEQ ID NO: 5772 - DNA, 25 bp, Artificial sequence
  Extension Primer
atcatatcatgaaatcctatactcc

SEQ ID NO: 5773 - DNA, 25 bp, Artificial sequence
  Extension Primer
ctgaaaaatcaccttctaaaataga

SEQ ID NO: 5774 - DNA, 25 bp, Artificial sequence
  Extension Primer
aatatacacttattagtatagtatg

SEQ ID NO: 5775 - DNA, 25 bp, Artificial sequence
  Extension Primer
aaccaaggattccttcagctccaga

SEQ ID NO: 5776 - DNA, 25 bp, Artificial sequence
  Extension Primer
tttgtgatagggctctgttagagac

SEQ ID NO: 5777 - DNA, 25 bp, Artificial sequence
  Extension Primer
tattgtatctgtcagactgcattga

SEQ ID NO: 5778 - DNA, 25 bp, Artificial sequence
  Extension Primer
tgctagttattagcgtttcctccct

SEQ ID NO: 5779 - DNA, 25 bp, Artificial sequence
  Extension Primer
tatatacttttaatatttcccgcta

SEQ ID NO: 5780 - DNA, 25 bp, Artificial sequence
  Extension Primer
tgcaggaacagtctgggaattcagg

SEQ ID NO: 5781 - DNA, 25 bp, Artificial sequence
  Extension Primer
tttatctaataatggcctactggaa

SEQ ID NO: 5782 - DNA, 25 bp, Artificial sequence
  Extension Primer
cttgaattgactgatgagcccacct

SEQ ID NO: 5783 - DNA, 25 bp, Artificial sequence
  Extension Primer
cagctactgctgtttctcctggatg

SEQ ID NO: 5784 - DNA, 25 bp, Artificial sequence
  Extension Primer
acttcagtaaaaacagctcactttt

SEQ ID NO: 5785 - DNA, 25 bp, Artificial sequence
  Extension Primer
taattggttttaaatgagagaaaca

SEQ ID NO: 5786 - DNA, 25 bp, Artificial sequence
  Extension Primer
tggaggaaatatagcattgacacag

SEQ ID NO: 5787 - DNA, 25 bp, Artificial sequence
  Extension Primer
ataacatgctataaacaatgtgatt

SEQ ID NO: 5788 - DNA, 25 bp, Artificial sequence
  Extension Primer
gggacttctccctttatattcagtc

SEQ ID NO: 5789 - DNA, 25 bp, Artificial sequence
  Extension Primer
tttgttttctgttttctatgggagc

SEQ ID NO: 5790 - DNA, 25 bp, Artificial sequence
  Extension Primer
aagtgtttgggcttttcaattaaaa

SEQ ID NO: 5791 - DNA, 25 bp, Artificial sequence
  Extension Primer
gaatctattttctttattatcatta

SEQ ID NO: 5792 - DNA, 25 bp, Artificial sequence
  Extension Primer
ttttacctaagtcagtcccttcccc

SEQ ID NO: 5793 - DNA, 25 bp, Artificial sequence
  Extension Primer
attatcagattgggtctctacctag

SEQ ID NO: 5794 - DNA, 25 bp, Artificial sequence
  Extension Primer
aggaaaatgggcctaacacaaattt

SEQ ID NO: 5795 - DNA, 25 bp, Artificial sequence
  Extension Primer
cctggttccctttcttctgcatcty

SEQ ID NO: 5796 - DNA, 25 bp, Artificial sequence
  Extension Primer
gggattcctcatgctgagtaacaag

SEQ ID NO: 5797 - DNA, 25 bp, Artificial sequence
  Extension Primer
cacagagtctgctgctgctgcctaa

SEQ ID NO: 5798 - DNA, 25 bp, Artificial sequence
  Extension Primer
tgcagcccctcatctttaaacagaa

SEQ ID NO: 5799 - DNA, 25 bp, Artificial sequence
  Extension Primer
cgaatcaaggtaagcagtttgactt

SEQ ID NO: 5800 - DNA, 25 bp, Artificial sequence
  Extension Primer
tctacagtacccaggacagcttccg

SEQ ID NO: 5801 - DNA, 25 bp, Artificial sequence
  Extension Primer
tgactggcagagatcttgggagccc

SEQ ID NO: 5802 - DNA, 25 bp, Artificial sequence
  Extension Primer
atgtttatgtaagtaggtgctttac

SEQ ID NO: 5803 - DNA, 25 bp, Artificial sequence
  Extension Primer
cacttctgcctatgtattctcgttg

SEQ ID NO: 5804 - DNA, 25 bp, Artificial sequence
  Extension Primer
tttagagaatttaaataattgtctt

SEQ ID NO: 5805 - DNA, 25 bp, Artificial sequence
  Extension Primer
cataagtgaaaaaaataagttacag

SEQ ID NO: 5806 - DNA, 25 bp, Artificial sequence
  Extension Primer
aagtactgaagtagactctatgaac

SEQ ID NO: 5807 - DNA, 25 bp, Artificial sequence
  Extension Primer
tatgtttcccagttcctgacaagtt

SEQ ID NO: 5808 - DNA, 25 bp, Artificial sequence
  Extension Primer
gccatggtttttcctttaagacttt

SEQ ID NO: 5809 - DNA, 25 bp, Artificial sequence
  Extension Primer
agcattattatattcatggctattc

SEQ ID NO: 5810 - DNA, 25 bp, Artificial sequence
  Extension Primer
ttatgattagaacacattaaaaaac

SEQ ID NO: 5811 - DNA, 25 bp, Artificial sequence
  Extension Primer
tactgagatctaatctatataattt

SEQ ID NO: 5812 - DNA, 25 bp, Artificial sequence
  Extension Primer
ttctggtaccgactttcaaggatgc

SEQ ID NO: 5813 - DNA, 25 bp, Artificial sequence
  Extension Primer
ggtttgttttctgcatcaacacagc

SEQ ID NO: 5814 - DNA, 25 bp, Artificial sequence
  Extension Primer
gctggctatctggctgggaaaggaa

SEQ ID NO: 5815 - DNA, 25 bp, Artificial sequence
  Extension Primer
cacacttgctcctacctgccgaccc

SEQ ID NO: 5816 - DNA, 25 bp, Artificial sequence
  Extension Primer
tcgtgttgccgatcttgttacaggt

SEQ ID NO: 5817 - DNA, 25 bp, Artificial sequence
  Extension Primer
tacttaatctataccaagagacact

SEQ ID NO: 5818 - DNA, 25 bp, Artificial sequence
  Extension Primer
caacacctggatctgtccccgggtc

SEQ ID NO: 5819 - DNA, 25 bp, Artificial sequence
  Extension Primer
ctgtcaaagtaccaaattgagcatc

SEQ ID NO: 5820 - DNA, 25 bp, Artificial sequence
  Extension Primer
caactctagctgtaaagaaattgga

SEQ ID NO: 5821 - DNA, 25 bp, Artificial sequence
  Extension Primer
tcttatctataaggtggacaagaac

SEQ ID NO: 5822 - DNA, 25 bp, Artificial sequence
  Extension Primer
aagcaaccaccccagctgtgacttg

SEQ ID NO: 5823 - DNA, 25 bp, Artificial sequence
  Extension Primer
atagggcaggacagagccctttctg

SEQ ID NO: 5824 - DNA, 25 bp, Artificial sequence
  Extension Primer
ggatgcagtgactgatcaactgtcc

SEQ ID NO: 5825 - DNA, 25 bp, Artificial sequence
  Extension Primer
ctactggtggcaaaggctggaacaa

SEQ ID NO: 5826 - DNA, 25 bp, Artificial sequence
  Extension Primer
cacagccccctacaatccaaactac

SEQ ID NO: 5827 - DNA, 25 bp, Artificial sequence
  Extension Primer
ggggcttcctggcaccagccacatg

SEQ ID NO: 5828 - DNA, 25 bp, Artificial sequence
  Extension Primer
gattgtcggtgttgccagctctgtg

SEQ ID NO: 5829 - DNA, 25 bp, Artificial sequence
  Extension Primer
gtccattcttttcccttaggaccac

SEQ ID NO: 5830 - DNA, 25 bp, Artificial sequence
  Extension Primer
gtgggacaggccasgggagcagagc

SEQ ID NO: 5831 - DNA, 25 bp, Artificial sequence
  Extension Primer
tggccactgtgaaaggccggcccac

SEQ ID NO: 5832 - DNA, 25 bp, Artificial sequence
  Extension Primer
atggaatagggtagaagtaagggat

SEQ ID NO: 5833 - DNA, 25 bp, Artificial sequence
  Extension Primer
ataaagaggttggggtgcatcaggg

SEQ ID NO: 5834 - DNA, 25 bp, Artificial sequence
  Extension Primer
acgattccccctccatttggtcctg

SEQ ID NO: 5835 - DNA, 25 bp, Artificial sequence
  Extension Primer
gcagactttaaatataaaatatgag

SEQ ID NO: 5836 - DNA, 25 bp, Artificial sequence
  Extension Primer
atgaaggccaaaaagatgaaataat

SEQ ID NO: 5837 - DNA, 25 bp, Artificial sequence
  Extension Primer
aagctttgatatcaaaaattaagat

SEQ ID NO: 5838 - DNA, 25 bp, Artificial sequence
  Extension Primer
cccatactttcacagttgtaaagat

SEQ ID NO: 5839 - DNA, 25 bp, Artificial sequence
  Extension Primer
aatgaactacttcagtgttacttaa

SEQ ID NO: 5840 - DNA, 25 bp, Artificial sequence
  Extension Primer
ggaattctgaaaaatacagttgata

SEQ ID NO: 5841 - DNA, 25 bp, Artificial sequence
  Extension Primer
ttgaaaacataacttctaggtttga

SEQ ID NO: 5842 - DNA, 25 bp, Artificial sequence
  Extension Primer
aaaattctaacaattctatgttcac

SEQ ID NO: 5843 - DNA, 25 bp, Artificial sequence
  Extension Primer
tggataaccagactgaaaaaataaa

SEQ ID NO: 5844 - DNA, 25 bp, Artificial sequence
  Extension Primer
aaaaggattctgtgaaggtaaaaat

SEQ ID NO: 5845 - DNA, 25 bp, Artificial sequence
  Extension Primer
gcgaagccaagcgctccatcctttg

SEQ ID NO: 5846 - DNA, 25 bp, Artificial sequence
  Extension Primer
gcaagctgacctagggaatgygtca

SEQ ID NO: 5847 - DNA, 25 bp, Artificial sequence
  Extension Primer
tgggcacacacggatggaggctttt

SEQ ID NO: 5848 - DNA, 25 bp, Artificial sequence
  Extension Primer
agtgaattctcatcccyagtaccac

SEQ ID NO: 5849 - DNA, 25 bp, Artificial sequence
  Extension Primer
aatgttgaaggtacagatacagaca

SEQ ID NO: 5850 - DNA, 25 bp, Artificial sequence
  Extension Primer
acatcgatggcaagcgaggacatgc

SEQ ID NO: 5851 - DNA, 25 bp, Artificial sequence
  Extension Primer
gttgcaccattcacatgcttcccaa

SEQ ID NO: 5852 - DNA, 22 bp, Artificial sequence
  Extension Primer
cagagagggattggatgatggg

SEQ ID NO: 5853 - DNA, 25 bp, Artificial sequence
  Extension Primer
ggtccaatgattaaggctctgcatt

SEQ ID NO: 5854 - DNA, 25 bp, Artificial sequence
  Extension Primer
gcccctttgatagaaggagaggact

SEQ ID NO: 5855 - DNA, 25 bp, Artificial sequence
  Extension Primer
tgaccttgtaaatttctgtggccct

SEQ ID NO: 5856 - DNA, 25 bp, Artificial sequence
  Extension Primer
taaggccattcatcatcaaggccct

SEQ ID NO: 5857 - DNA, 25 bp, Artificial sequence
  Extension Primer
tgcccccccagttggagcccagcat

SEQ ID NO: 5858 - DNA, 25 bp, Artificial sequence
  Extension Primer
ttcgaagactgtagatgagagggtt

SEQ ID NO: 5859 - DNA, 25 bp, Artificial sequence
  Extension Primer
gaggtgaaccagaaagccatatttt

SEQ ID NO: 5860 - DNA, 25 bp, Artificial sequence
  Extension Primer
tactgttgtgagtgagatggtgaaa

SEQ ID NO: 5861 - DNA, 25 bp, Artificial sequence
  Extension Primer
ggatatcttgcatatttccaacatt

SEQ ID NO: 5862 - DNA, 25 bp, Artificial sequence
  Extension Primer
tttcattctcactcaaatcctctac

SEQ ID NO: 5863 - DNA, 25 bp, Artificial sequence
  Extension Primer
aagcacaccgaatgtgttagcatga

SEQ ID NO: 5864 - DNA, 25 bp, Artificial sequence
  Extension Primer
aagggtgacaagctggatggaaaaa

SEQ ID NO: 5865 - DNA, 25 bp, Artificial sequence
  Extension Primer
cacatctgtagtttttccacttaat

SEQ ID NO: 5866 - DNA, 25 bp, Artificial sequence
  Extension Primer
cacttatagtaggtggcagtttcct

SEQ ID NO: 5867 - DNA, 25 bp, Artificial sequence
  Extension Primer
ttttctcctttctgtttcttcatac

SEQ ID NO: 5868 - DNA, 25 bp, Artificial sequence
  Extension Primer
gtctgatagttgttaaccaagaata

SEQ ID NO: 5869 - DNA, 25 bp, Artificial sequence
  Extension Primer
gtgttacatttctcttcaagtggca

SEQ ID NO: 5870 - DNA, 25 bp, Artificial sequence
  Extension Primer
tagtggagaagaatgtatgcttcaa

SEQ ID NO: 5871 - DNA, 25 bp, Artificial sequence
  Extension Primer
ctgttttctccatggacctccattc

SEQ ID NO: 5872 - DNA, 25 bp, Artificial sequence
  Extension Primer
attgctcagtacccctggggagatg

SEQ ID NO: 5873 - DNA, 25 bp, Artificial sequence
  Extension Primer
gctcagagaggcctagtgaccttcc

SEQ ID NO: 5874 - DNA, 25 bp, Artificial sequence
  Extension Primer
gacaaaaggcagagtgtctcctcta

SEQ ID NO: 5875 - DNA, 25 bp, Artificial sequence
  Extension Primer
accacagtactgcgggtcttctttg

SEQ ID NO: 5876 - DNA, 25 bp, Artificial sequence
  Extension Primer
caccatcagcatcatctctatcagt

SEQ ID NO: 5877 - DNA, 25 bp, Artificial sequence
  Extension Primer
tcctgacatcatcactgcgctaaga

SEQ ID NO: 5878 - DNA, 25 bp, Artificial sequence
  Extension Primer
atcttattcatggtcaaatacctca

SEQ ID NO: 5879 - DNA, 25 bp, Artificial sequence
  Extension Primer
cataatataaacaccatcctggtac

SEQ ID NO: 5880 - DNA, 25 bp, Artificial sequence
  Extension Primer
gggtgacggtgcccacgtatctgtg

SEQ ID NO: 5881 - DNA, 25 bp, Artificial sequence
  Extension Primer
cacctggacacaggaaaaccaacac

SEQ ID NO: 5882 - DNA, 25 bp, Artificial sequence
  Extension Primer
gtactgcaaccagagtctccttcag

SEQ ID NO: 5883 - DNA, 25 bp, Artificial sequence
  Extension Primer
aaatagttgttttcactttcttcct

SEQ ID NO: 5884 - DNA, 25 bp, Artificial sequence
  Extension Primer
acaccccacaatcctcagggtcatc

SEQ ID NO: 5885 - DNA, 25 bp, Artificial sequence
  Extension Primer
gaaactattcacccaagcacagttg

SEQ ID NO: 5886 - DNA, 25 bp, Artificial sequence
  Extension Primer
acgcggggatgtattcaatamattc

SEQ ID NO: 5887 - DNA, 25 bp, Artificial sequence
  Extension Primer
gagttctttctatcctcttactgtg

SEQ ID NO: 5888 - DNA, 25 bp, Artificial sequence
  Extension Primer
aaggcagcctgccaggactctttgt

SEQ ID NO: 5889 - DNA, 25 bp, Artificial sequence
  Extension Primer
gacagcacttctgatggccgcagtg

SEQ ID NO: 5890 - DNA, 25 bp, Artificial sequence
  Extension Primer
tgattcattcccagtgagccctgtc

SEQ ID NO: 5891 - DNA, 25 bp, Artificial sequence
  Extension Primer
agctctacaaacactcttaaaggga

SEQ ID NO: 5892 - DNA, 25 bp, Artificial sequence
  Extension Primer
cctttaaaacactgttcatatcata

SEQ ID NO: 5893 - DNA, 25 bp, Artificial sequence
  Extension Primer
tcagacaggagactccagacaaata

SEQ ID NO: 5894 - DNA, 25 bp, Artificial sequence
  Extension Primer
tacaggctaaacatcatcagtgtgg

SEQ ID NO: 5895 - DNA, 25 bp, Artificial sequence
  Extension Primer
ttatttaaagttttcattcctgtgg

SEQ ID NO: 5896 - DNA, 25 bp, Artificial sequence
  Extension Primer
tcggggcttaaaagcatgatacagc

SEQ ID NO: 5897 - DNA, 25 bp, Artificial sequence
  Extension Primer
tgcaaataccagccagggcagactc

SEQ ID NO: 5898 - DNA, 25 bp, Artificial sequence
  Extension Primer
ttcaccactccattttctttaccca

SEQ ID NO: 5899 - DNA, 25 bp, Artificial sequence
  Extension Primer
aacacaagagatgtagcaggaacct

SEQ ID NO: 5900 - DNA, 25 bp, Artificial sequence
  Extension Primer
ctggacactcccctctgctggggtc

SEQ ID NO: 5901 - DNA, 25 bp, Artificial sequence
  Extension Primer
gcagatggactcatcactgaggaaa

SEQ ID NO: 5902 - DNA, 25 bp, Artificial sequence
  Extension Primer
acggctctcccagacgtgtgggtca

SEQ ID NO: 5903 - DNA, 25 bp, Artificial sequence
  Extension Primer
ctatgtaatgccacctccccacacc

SEQ ID NO: 5904 - DNA, 25 bp, Artificial sequence
  Extension Primer
ggtggggagaaaactgggagatggc

SEQ ID NO: 5905 - DNA, 25 bp, Artificial sequence
  Extension Primer
tacaccaggctcccctgtccccgac

SEQ ID NO: 5906 - DNA, 25 bp, Artificial sequence
  Extension Primer
ggggctcttctctgacgtgggggac

SEQ ID NO: 5907 - DNA, 25 bp, Artificial sequence
  Extension Primer
cagtctccttctgcttcctctgatg

SEQ ID NO: 5908 - DNA, 25 bp, Artificial sequence
  Extension Primer
gccattctatgacaaccagagtttt

SEQ ID NO: 5909 - DNA, 25 bp, Artificial sequence
  Extension Primer
ctcctcaggagttctcttaaggttt

SEQ ID NO: 5910 - DNA, 25 bp, Artificial sequence
  Extension Primer
gctcttacatgtataaaaataacta

SEQ ID NO: 5911 - DNA, 25 bp, Artificial sequence
  Extension Primer
ttatatgtaaaacagaatcattatc

SEQ ID NO: 5912 - DNA, 25 bp, Artificial sequence
  Extension Primer
acaccctgtactgagagtcaataaa

SEQ ID NO: 5913 - DNA, 25 bp, Artificial sequence
  Extension Primer
tatcatttggttgcagcaacaataa

SEQ ID NO: 5914 - DNA, 25 bp, Artificial sequence
  Extension Primer
actaccacatgtttctgaactatat

SEQ ID NO: 5915 - DNA, 25 bp, Artificial sequence
  Extension Primer
ataaaatacagcatgtagtccctat

SEQ ID NO: 5916 - DNA, 22 bp, Artificial sequence
  Extension Primer
agaaatcgaggtcacactcttt

SEQ ID NO: 5917 - DNA, 25 bp, Artificial sequence
  Extension Primer
actgtctttcttttagagatgaaga

SEQ ID NO: 5918 - DNA, 25 bp, Artificial sequence
  Extension Primer
ttttctaggtctaatcaataccaat

SEQ ID NO: 5919 - DNA, 25 bp, Artificial sequence
  Extension Primer
agaatgrgagaagaattgaagacaa

SEQ ID NO: 5920 - DNA, 25 bp, Artificial sequence
  Extension Primer
ctctgaagtggcccttttaaaaatg

SEQ ID NO: 5921 - DNA, 25 bp, Artificial sequence
  Extension Primer
catttgagggcaaaatattctggta

SEQ ID NO: 5922 - DNA, 25 bp, Artificial sequence
  Extension Primer
gggattcaattatttctttccctgc

SEQ ID NO: 5923 - DNA, 25 bp, Artificial sequence
  Extension Primer
atgctacacagaagcaatacaacac

SEQ ID NO: 5924 - DNA, 25 bp, Artificial sequence
  Extension Primer
ttcagtcagtaaataaatattcatt

SEQ ID NO: 5925 - DNA, 25 bp, Artificial sequence
  Extension Primer
aggkgattttaacagatggcatttt

SEQ ID NO: 5926 - DNA, 25 bp, Artificial sequence
  Extension Primer
ggagggtcaaatatcacagtgaata

SEQ ID NO: 5927 - DNA, 25 bp, Artificial sequence
  Extension Primer
agtggcactattataactyttctta

SEQ ID NO: 5928 - DNA, 25 bp, Artificial sequence
  Extension Primer
agggctgactgtacaaattcagtga

SEQ ID NO: 5929 - DNA, 25 bp, Artificial sequence
  Extension Primer
gtaggaagacaccttgtacctcaca

SEQ ID NO: 5930 - DNA, 25 bp, Artificial sequence
  Extension Primer
aagtattacagagcacttttacttc

SEQ ID NO: 5931 - DNA, 25 bp, Artificial sequence
  Extension Primer
tgacagaatcatagaaaagcataaa

SEQ ID NO: 5932 - DNA, 25 bp, Artificial sequence
  Extension Primer
aatgaatttagaaaaagatagaaaa

SEQ ID NO: 5933 - DNA, 25 bp, Artificial sequence
  Extension Primer
cagtaaggatttgggactttcrcac

SEQ ID NO: 5934 - DNA, 25 bp, Artificial sequence
  Extension Primer
ttcaccactccacttcatggtactt

SEQ ID NO: 5935 - DNA, 25 bp, Artificial sequence
  Extension Primer
gttccccagctgactttgrtaaaga

SEQ ID NO: 5936 - DNA, 25 bp, Artificial sequence
  Extension Primer
agtttccttggccttctagtgataa

SEQ ID NO: 5937 - DNA, 25 bp, Artificial sequence
  Extension Primer
attatttacaatggtgtaagatttt

SEQ ID NO: 5938 - DNA, 25 bp, Artificial sequence
  Extension Primer
ggttcaaagcagaacaggactgtgt

SEQ ID NO: 5939 - DNA, 25 bp, Artificial sequence
  Extension Primer
tccaagaacttaattacagtagtta

SEQ ID NO: 5940 - DNA, 25 bp, Artificial sequence
  Extension Primer
cacctaatacttttattaaattatc

SEQ ID NO: 5941 - DNA, 25 bp, Artificial sequence
  Extension Primer
acactagaatagttgccaatattat

SEQ ID NO: 5942 - DNA, 25 bp, Artificial sequence
  Extension Primer
gcaaataaataattatcttgttgtt

SEQ ID NO: 5943 - DNA, 25 bp, Artificial sequence
  Extension Primer
tttctgaaagggatgaaaataaatg

SEQ ID NO: 5944 - DNA, 25 bp, Artificial sequence
  Extension Primer
attccttggccaaatctgatttcca

SEQ ID NO: 5945 - DNA, 25 bp, Artificial sequence
  Extension Primer
ytctctctgactctgttactattta

SEQ ID NO: 5946 - DNA, 25 bp, Artificial sequence
  Extension Primer
actctayaagcacaacagtaagtta

SEQ ID NO: 5947 - DNA, 25 bp, Artificial sequence
  Extension Primer
aatatgagttgttctctacaagata

SEQ ID NO: 5948 - DNA, 25 bp, Artificial sequence
  Extension Primer
tggtcaagaaacacttgagtgtcta

SEQ ID NO: 5949 - DNA, 25 bp, Artificial sequence
  Extension Primer
tttgaattgtgtggattttgaacta

SEQ ID NO: 5950 - DNA, 25 bp, Artificial sequence
  Extension Primer
aagccagcattaacaaaattacata

SEQ ID NO: 5951 - DNA, 25 bp, Artificial sequence
  Extension Primer
rcaggtggtatttagataaacatga

SEQ ID NO: 5952 - DNA, 25 bp, Artificial sequence
  Extension Primer
ttattttgggaggatcatcataatt

SEQ ID NO: 5953 - DNA, 25 bp, Artificial sequence
  Extension Primer
gcccaaagcaatcccatgaatggtt

SEQ ID NO: 5954 - DNA, 25 bp, Artificial sequence
  Extension Primer
gtcctgaagataaaggactattcaa

SEQ ID NO: 5955 - DNA, 25 bp, Artificial sequence
  Extension Primer
cttttcttgtctttttctcattaga

SEQ ID NO: 5956 - DNA, 25 bp, Artificial sequence
  Extension Primer
agaaagtccagctttcaaacaagaa

SEQ ID NO: 5957 - DNA, 25 bp, Artificial sequence
  Extension Primer
aaatattctcttttgtaatacaatg

SEQ ID NO: 5958 - DNA, 25 bp, Artificial sequence
  Extension Primer
tattacttttcacttaatttcctcc

SEQ ID NO: 5959 - DNA, 25 bp, Artificial sequence
  Extension Primer
gttctatttaccataccctctgtta

SEQ ID NO: 5960 - DNA, 25 bp, Artificial sequence
  Extension Primer
acagaaaacaaatctcttttggaga

SEQ ID NO: 5961 - DNA, 25 bp, Artificial sequence
  Extension Primer
ttagtggtctcagcgacacacaact

SEQ ID NO: 5962 - DNA, 25 bp, Artificial sequence
  Extension Primer
acctcagaaactctcgattcacaga

SEQ ID NO: 5963 - DNA, 25 bp, Artificial sequence
  Extension Primer
attacctgcaataactctaagtctc

SEQ ID NO: 5964 - DNA, 22 bp, Artificial sequence
  Extension Primer
agcatcataataaaataaaacc

SEQ ID NO: 5965 - DNA, 25 bp, Artificial sequence
  Extension Primer
agtggatgaaggggatcaaaaggtt

SEQ ID NO: 5966 - DNA, 25 bp, Artificial sequence
  Extension Primer
cttaaatcactaatccttccattga

SEQ ID NO: 5967 - DNA, 25 bp, Artificial sequence
  Extension Primer
tatgtacaatctagagactttggat

SEQ ID NO: 5968 - DNA, 25 bp, Artificial sequence
  Extension Primer
tgtctgaaagtcttcatcagtagga

SEQ ID NO: 5969 - DNA, 25 bp, Artificial sequence
  Extension Primer
cttcttcgaggcaggtggaaattct

SEQ ID NO: 5970 - DNA, 25 bp, Artificial sequence
  Extension Primer
atgctaacatattcaagttgaacca

SEQ ID NO: 5971 - DNA, 25 bp, Artificial sequence
  Extension Primer
taatagttcctacaaagttgagaca

SEQ ID NO: 5972 - DNA, 25 bp, Artificial sequence
  Extension Primer
cttccctcaaagagaaaaattatgc

SEQ ID NO: 5973 - DNA, 25 bp, Artificial sequence
  Extension Primer
taagagttgatgataatacaaatac

SEQ ID NO: 5974 - DNA, 25 bp, Artificial sequence
  Extension Primer
ttgaatggaggactctccaggcata

SEQ ID NO: 5975 - DNA, 25 bp, Artificial sequence
  Extension Primer
tggggtcgcaaagagtcaaacacga

SEQ ID NO: 5976 - DNA, 25 bp, Artificial sequence
  Extension Primer
ttagtaaacacatctgtttcacctt

SEQ ID NO: 5977 - DNA, 25 bp, Artificial sequence
  Extension Primer
tgacttgaaacgaatgtcttcaaaa

SEQ ID NO: 5978 - DNA, 22 bp, Artificial sequence
  Extension Primer
gatctaatttaaagactatcaa

SEQ ID NO: 5979 - DNA, 25 bp, Artificial sequence
  Extension Primer
gtcaacgaatcccttttgagatcac

SEQ ID NO: 5980 - DNA, 25 bp, Artificial sequence
  Extension Primer
tacaatcccaagatgaacactggat

SEQ ID NO: 5981 - DNA, 25 bp, Artificial sequence
  Extension Primer
gcaggacttaaaatccccaaccrtg

SEQ ID NO: 5982 - DNA, 25 bp, Artificial sequence
  Extension Primer
tatagcaggagcttaataggaggag

SEQ ID NO: 5983 - DNA, 25 bp, Artificial sequence
  Extension Primer
ctgagctgctagtcaggaactgagc

SEQ ID NO: 5984 - DNA, 25 bp, Artificial sequence
  Extension Primer
cgttatgggtagagcatcccttggc

SEQ ID NO: 5985 - DNA, 25 bp, Artificial sequence
  Extension Primer
tcgcagtcctgatggttctgaatcc

SEQ ID NO: 5986 - DNA, 25 bp, Artificial sequence
  Extension Primer
tgcagcctgtactttccttagcaag

SEQ ID NO: 5987 - DNA, 25 bp, Artificial sequence
  Extension Primer
aaactatcaaacctgatggactaag

SEQ ID NO: 5988 - DNA, 25 bp, Artificial sequence
  Extension Primer
waaaaacagagtcattgctattcag

SEQ ID NO: 5989 - DNA, 25 bp, Artificial sequence
  Extension Primer
ttgagtcttaaaaaagcatgtctgt

SEQ ID NO: 5990 - DNA, 25 bp, Artificial sequence
  Extension Primer
acctgtgaatagttaattatcctcc

SEQ ID NO: 5991 - DNA, 25 bp, Artificial sequence
  Extension Primer
agctgatagccagctgggattgaga

SEQ ID NO: 5992 - DNA, 22 bp, Artificial sequence
  Extension Primer
aataatttcctcctgcataacc

SEQ ID NO: 5993 - DNA, 25 bp, Artificial sequence
  Extension Primer
tataactatcctaaactttcccagg

SEQ ID NO: 5994 - DNA, 22 bp, Artificial sequence
  Extension Primer
accccctggtcagcagcctgaa

SEQ ID NO: 5995 - DNA, 25 bp, Artificial sequence
  Extension Primer
aagagctggaggggatggggagtcc

SEQ ID NO: 5996 - DNA, 25 bp, Artificial sequence
  Extension Primer
cagttcctggsgctgatggcctaac

SEQ ID NO: 5997 - DNA, 25 bp, Artificial sequence
  Extension Primer
acatctcgcctgagacatgcaatac

SEQ ID NO: 5998 - DNA, 25 bp, Artificial sequence
  Extension Primer
tactgaatcacattagaaaatgtaa

SEQ ID NO: 5999 - DNA, 25 bp, Artificial sequence
  Extension Primer
cctgcaaagctccttctaatgattt

SEQ ID NO: 6000 - DNA, 25 bp, Artificial sequence
  Extension Primer
cttctgggccaacatcagtgactac

SEQ ID NO: 6001 - DNA, 25 bp, Artificial sequence
  Extension Primer
ggtctgattttgctttatcaatgag

SEQ ID NO: 6002 - DNA, 25 bp, Artificial sequence
  Extension Primer
taagcaggtttgcaggggctagrgc

SEQ ID NO: 6003 - DNA, 25 bp, Artificial sequence
  Extension Primer
ggctgtggtcggcatgctgactcag

SEQ ID NO: 6004 - DNA, 25 bp, Artificial sequence
  Extension Primer
ccagtgtgatcagcagccctgaaac

SEQ ID NO: 6005 - DNA, 25 bp, Artificial sequence
  Extension Primer
actcttgcctccatcagagcttagc

SEQ ID NO: 6006 - DNA, 25 bp, Artificial sequence
  Extension Primer
twcattttctagagtgacatcttgg

SEQ ID NO: 6007 - DNA, 25 bp, Artificial sequence
  Extension Primer
gctggccgggaagaccaatgcacac

SEQ ID NO: 6008 - DNA, 25 bp, Artificial sequence
  Extension Primer
aaggtgaggctagaattccagatag

SEQ ID NO: 6009 - DNA, 25 bp, Artificial sequence
  Extension Primer
tgaggaaaaccacttcatagcacac

SEQ ID NO: 6010 - DNA, 25 bp, Artificial sequence
  Extension Primer
catggtctgcagggaagaaagggtg

SEQ ID NO: 6011 - DNA, 25 bp, Artificial sequence
  Extension Primer
ggagctagaaggtgtctgtctgtga

SEQ ID NO: 6012 - DNA, 25 bp, Artificial sequence
  Extension Primer
tgctggactgtgtgatctcaggcta

SEQ ID NO: 6013 - DNA, 25 bp, Artificial sequence
  Extension Primer
ctggctgcagccggggcgtcttctc

SEQ ID NO: 6014 - DNA, 25 bp, Artificial sequence
  Extension Primer
tgctgctcactaataacctttcctc

SEQ ID NO: 6015 - DNA, 25 bp, Artificial sequence
  Extension Primer
aaggagaagtcttaaccactggatc

SEQ ID NO: 6016 - DNA, 25 bp, Artificial sequence
  Extension Primer
ggaagtccctaaggagctgcatttt

SEQ ID NO: 6017 - DNA, 25 bp, Artificial sequence
  Extension Primer
gtaggggtcccggtcccctggagtc

SEQ ID NO: 6018 - DNA, 25 bp, Artificial sequence
  Extension Primer
attcaggcttgagggaggcacagac

SEQ ID NO: 6019 - DNA, 25 bp, Artificial sequence
  Extension Primer
ggtgctgggtgcgcctagcacagag

SEQ ID NO: 6020 - DNA, 25 bp, Artificial sequence
  Extension Primer
atacaggtcagagggtcagctacag

SEQ ID NO: 6021 - DNA, 25 bp, Artificial sequence
  Extension Primer
gaccattctcttacccaccacccac

SEQ ID NO: 6022 - DNA, 25 bp, Artificial sequence
  Extension Primer
ctgtgtgttcagaacttgccaggtg

SEQ ID NO: 6023 - DNA, 25 bp, Artificial sequence
  Extension Primer
gcccttcagtgccctccactctatg

SEQ ID NO: 6024 - DNA, 25 bp, Artificial sequence
  Extension Primer
tygaatggcagcgatgctcagctca

SEQ ID NO: 6025 - DNA, 25 bp, Artificial sequence
  Extension Primer
tccagttggtaatcccttgcagacc

SEQ ID NO: 6026 - DNA, 25 bp, Artificial sequence
  Extension Primer
gctgaagaggtcaaactttgccaga

SEQ ID NO: 6027 - DNA, 25 bp, Artificial sequence
  Extension Primer
cttctgattgttttctakttccatt

SEQ ID NO: 6028 - DNA, 25 bp, Artificial sequence
  Extension Primer
ctggccaggaaactgacgctggaaa

SEQ ID NO: 6029 - DNA, 25 bp, Artificial sequence
  Extension Primer
cagcaggtcccagctgagaccygcc

SEQ ID NO: 6030 - DNA, 25 bp, Artificial sequence
  Extension Primer
gtcgacaccaygctgtgcagggcaa

SEQ ID NO: 6031 - DNA, 25 bp, Artificial sequence
  Extension Primer
ctcactaaccagccacccaaacccm

SEQ ID NO: 6032 - DNA, 25 bp, Artificial sequence
  Extension Primer
tataggtacacatagtgtgtttgcc

SEQ ID NO: 6033 - DNA, 25 bp, Artificial sequence
  Extension Primer
taacatggctcccctggagaaggaa

SEQ ID NO: 6034 - DNA, 25 bp, Artificial sequence
  Extension Primer
tcctgtcctcagagaggccttcccc

SEQ ID NO: 6035 - DNA, 25 bp, Artificial sequence
  Extension Primer
aaggagaatcagaaatattccaggg

SEQ ID NO: 6036 - DNA, 25 bp, Artificial sequence
  Extension Primer
gccctcttttctggtaccctgccct

SEQ ID NO: 6037 - DNA, 25 bp, Artificial sequence
  Extension Primer
agagggttgtaacttgatcctcttc

SEQ ID NO: 6038 - DNA, 25 bp, Artificial sequence
  Extension Primer
ctcctgggaggagggtgtgcttgcc

SEQ ID NO: 6039 - DNA, 25 bp, Artificial sequence
  Extension Primer
acctcyagcagcagatccgaggaca

SEQ ID NO: 6040 - DNA, 25 bp, Artificial sequence
  Extension Primer
tgggtgtgttgagacagatgtggaa

SEQ ID NO: 6041 - DNA, 25 bp, Artificial sequence
  Extension Primer
acctygtatgtttctcagagaggca

SEQ ID NO: 6042 - DNA, 25 bp, Artificial sequence
  Extension Primer
gtgtttaaaatccatactggtcgca

SEQ ID NO: 6043 - DNA, 25 bp, Artificial sequence
  Extension Primer
ccttcccaagccgtggccsaggcgc

SEQ ID NO: 6044 - DNA, 25 bp, Artificial sequence
  Extension Primer
tgtagataattcatttaatatttgt

SEQ ID NO: 6045 - DNA, 25 bp, Artificial sequence
  Extension Primer
tctctttttgtctttaactttcatc

SEQ ID NO: 6046 - DNA, 25 bp, Artificial sequence
  Extension Primer
ctcttaaaaatttaaaaattaccaa

SEQ ID NO: 6047 - DNA, 25 bp, Artificial sequence
  Extension Primer
ctagctcactgcctggcatgttaca

SEQ ID NO: 6048 - DNA, 25 bp, Artificial sequence
  Extension Primer
gagagcggattcatccttggagaag

SEQ ID NO: 6049 - DNA, 22 bp, Artificial sequence
  Extension Primer
gaaagtgattcctaagatgctt

SEQ ID NO: 6050 - DNA, 25 bp, Artificial sequence
  Extension Primer
acatataactatagtaccatttcaa

SEQ ID NO: 6051 - DNA, 25 bp, Artificial sequence
  Extension Primer
agaaaaaaagactccataaaactta

SEQ ID NO: 6052 - DNA, 25 bp, Artificial sequence
  Extension Primer
agtgcaggctatttctccttttgtg

SEQ ID NO: 6053 - DNA, 25 bp, Artificial sequence
  Extension Primer
catttctcaaaataatgctgcaaaa

SEQ ID NO: 6054 - DNA, 25 bp, Artificial sequence
  Extension Primer
tacacaaamaaagcatggtcactgc

SEQ ID NO: 6055 - DNA, 25 bp, Artificial sequence
  Extension Primer
gacagtatacggatagcattgtttt

SEQ ID NO: 6056 - DNA, 25 bp, Artificial sequence
  Extension Primer
ggaaatggaaaagaactgrtttttk

SEQ ID NO: 6057 - DNA, 25 bp, Artificial sequence
  Extension Primer
tttcttgagggttkgggagggtttt

SEQ ID NO: 6058 - DNA, 25 bp, Artificial sequence
  Extension Primer
ccaagcacattcctgcctctggatt

SEQ ID NO: 6059 - DNA, 25 bp, Artificial sequence
  Extension Primer
tctgtctccatggacttgctgacts

SEQ ID NO: 6060 - DNA, 25 bp, Artificial sequence
  Extension Primer
taacctaagtggtataattctgact

SEQ ID NO: 6061 - DNA, 25 bp, Artificial sequence
  Extension Primer
ctcctgctcccagctccaagccatc

SEQ ID NO: 6062 - DNA, 25 bp, Artificial sequence
  Extension Primer
agtttgatccctggtcaggaactag

SEQ ID NO: 6063 - DNA, 25 bp, Artificial sequence
  Extension Primer
tttcctggggatcacccagccgtcc

SEQ ID NO: 6064 - DNA, 25 bp, Artificial sequence
  Extension Primer
ctcctaattggcttagaactaaaca

SEQ ID NO: 6065 - DNA, 25 bp, Artificial sequence
  Extension Primer
agaacgctttttgttctaatgtttg

SEQ ID NO: 6066 - DNA, 25 bp, Artificial sequence
  Extension Primer
aagtgtttagtatagacttcagttt

SEQ ID NO: 6067 - DNA, 25 bp, Artificial sequence
  Extension Primer
gactgaaagaatacttccataattt

SEQ ID NO: 6068 - DNA, 25 bp, Artificial sequence
  Extension Primer
atgtaatctgtatccgtggaactgt

SEQ ID NO: 6069 - DNA, 25 bp, Artificial sequence
  Extension Primer
tggaaatacacttctcctttgrtgg

SEQ ID NO: 6070 - DNA, 25 bp, Artificial sequence
  Extension Primer
aggtgaacagctgccctatccaatg

SEQ ID NO: 6071 - DNA, 25 bp, Artificial sequence
  Extension Primer
atcattcacaacacacaacagagag

SEQ ID NO: 6072 - DNA, 25 bp, Artificial sequence
  Extension Primer
ttgcagtatatgggcttctcattgc

SEQ ID NO: 6073 - DNA, 25 bp, Artificial sequence
  Extension Primer
aaaacttcctgacaaagtcaatata

SEQ ID NO: 6074 - DNA, 25 bp, Artificial sequence
  Extension Primer
tgaaaacaaaatccaatagatactt

SEQ ID NO: 6075 - DNA, 25 bp, Artificial sequence
  Extension Primer
atattagccactggtcaaatgtttc

SEQ ID NO: 6076 - DNA, 25 bp, Artificial sequence
  Extension Primer
ctggcccttcacttgcattatctaa

SEQ ID NO: 6077 - DNA, 25 bp, Artificial sequence
  Extension Primer
ggaggaagttttatgtaaactttag

SEQ ID NO: 6078 - DNA, 25 bp, Artificial sequence
  Extension Primer
tgacagtcttccattaaggcaagtg

SEQ ID NO: 6079 - DNA, 25 bp, Artificial sequence
  Extension Primer
ttaagaatcttgagatgaattcaga

SEQ ID NO: 6080 - DNA, 25 bp, Artificial sequence
  Extension Primer
actcttttttcttgttacttacatg

SEQ ID NO: 6081 - DNA, 25 bp, Artificial sequence
  Extension Primer
actgaaatgtattctctagcttkgt

SEQ ID NO: 6082 - DNA, 25 bp, Artificial sequence
  Extension Primer
aatctaagctaaaggcacataaatc

SEQ ID NO: 6083 - DNA, 25 bp, Artificial sequence
  Extension Primer
tgaatgcaagaaaaatgtaacccac

SEQ ID NO: 6084 - DNA, 25 bp, Artificial sequence
  Extension Primer
agcaytgtgaagaagaaaaggtctt

SEQ ID NO: 6085 - DNA, 25 bp, Artificial sequence
  Extension Primer
aaaatacgtttaaaatgttgcatct

SEQ ID NO: 6086 - DNA, 25 bp, Artificial sequence
  Extension Primer
cccactgaatggcttgcgggatctt

SEQ ID NO: 6087 - DNA, 25 bp, Artificial sequence
  Extension Primer
cctagaatgcacatgcctctctctc

SEQ ID NO: 6088 - DNA, 25 bp, Artificial sequence
  Extension Primer
actgcatcactctctcaaggtccta

SEQ ID NO: 6089 - DNA, 25 bp, Artificial sequence
  Extension Primer
tctttttgaagttggaaaatcccga

SEQ ID NO: 6090 - DNA, 25 bp, Artificial sequence
  Extension Primer
tagaacatgagggccagtagagacg

SEQ ID NO: 6091 - DNA, 25 bp, Artificial sequence
  Extension Primer
acagtttccacaacatctccggggc

SEQ ID NO: 6092 - DNA, 25 bp, Artificial sequence
  Extension Primer
ctcygggccatttcaacaataaata

SEQ ID NO: 6093 - DNA, 25 bp, Artificial sequence
  Extension Primer
aaaattttcattcaccagactcttt

SEQ ID NO: 6094 - DNA, 25 bp, Artificial sequence
  Extension Primer
gaaaaaaaattggccaaattttcct

SEQ ID NO: 6095 - DNA, 25 bp, Artificial sequence
  Extension Primer
aaaatgattttggtatacataactg

SEQ ID NO: 6096 - DNA, 25 bp, Artificial sequence
  Extension Primer
taactggaaattgagcattcccaaa

SEQ ID NO: 6097 - DNA, 25 bp, Artificial sequence
  Extension Primer
gaagaaaagaaactaaacacataac

SEQ ID NO: 6098 - DNA, 25 bp, Artificial sequence
  Extension Primer
gaaatgaaagtgttgcacaccttaa

SEQ ID NO: 6099 - DNA, 25 bp, Artificial sequence
  Extension Primer
ggtagtctgggctggctcagaatgg

SEQ ID NO: 6100 - DNA, 25 bp, Artificial sequence
  Extension Primer
tctaggcctgacatgagaagccttc

SEQ ID NO: 6101 - DNA, 25 bp, Artificial sequence
  Extension Primer
agaaatgttgtaacactgaggcttc

SEQ ID NO: 6102 - DNA, 25 bp, Artificial sequence
  Extension Primer
gtcaccaaggatacttaaaataata

SEQ ID NO: 6103 - DNA, 25 bp, Artificial sequence
  Extension Primer
aatgggagatgctgttaccattggg

SEQ ID NO: 6104 - DNA, 25 bp, Artificial sequence
  Extension Primer
ttccggccacattctcactaacccc

SEQ ID NO: 6105 - DNA, 25 bp, Artificial sequence
  Extension Primer
gacatcaagtacatcgttgttcatg

SEQ ID NO: 6106 - DNA, 25 bp, Artificial sequence
  Extension Primer
gattgttacggggatatgaacacta

SEQ ID NO: 6107 - DNA, 25 bp, Artificial sequence
  Extension Primer
ttaccctgacagatgcctggtactt

SEQ ID NO: 6108 - DNA, 25 bp, Artificial sequence
  Extension Primer
gcttggttttcattcctcaagtctg

SEQ ID NO: 6109 - DNA, 25 bp, Artificial sequence
  Extension Primer
ttcctcttaagtattattggtgagt

SEQ ID NO: 6110 - DNA, 25 bp, Artificial sequence
  Extension Primer
tggaggttaaggcctttagggatta

SEQ ID NO: 6111 - DNA, 25 bp, Artificial sequence
  Extension Primer
aaaacgaagggaacaaaataagtcc

SEQ ID NO: 6112 - DNA, 25 bp, Artificial sequence
  Extension Primer
agcaaaaatacatcagcaaggatta

SEQ ID NO: 6113 - DNA, 25 bp, Artificial sequence
  Extension Primer
acatttyccccccgtaactgtcaag

SEQ ID NO: 6114 - DNA, 25 bp, Artificial sequence
  Extension Primer
taaggagcttaaaaaataaacayac

SEQ ID NO: 6115 - DNA, 25 bp, Artificial sequence
  Extension Primer
tcacagaagtttgaaattgtttcca

SEQ ID NO: 6116 - DNA, 25 bp, Artificial sequence
  Extension Primer
tacactatttctattgtaccatctc

SEQ ID NO: 6117 - DNA, 25 bp, Artificial sequence
  Extension Primer
gactctgcagataggaccaagttaa

SEQ ID NO: 6118 - DNA, 22 bp, Artificial sequence
  Extension Primer
aatgatttatagtttctttttc

SEQ ID NO: 6119 - DNA, 25 bp, Artificial sequence
  Extension Primer
gccctcagaagtctggaaacagtcc

SEQ ID NO: 6120 - DNA, 25 bp, Artificial sequence
  Extension Primer
aaaataatacarcattgkaaagcaa

SEQ ID NO: 6121 - DNA, 25 bp, Artificial sequence
  Extension Primer
tacacttacaacctaacttcaagga

SEQ ID NO: 6122 - DNA, 25 bp, Artificial sequence
  Extension Primer
tttcaggaggaagagggtattggag

SEQ ID NO: 6123 - DNA, 25 bp, Artificial sequence
  Extension Primer
aacacctcctatctgacccttccct

SEQ ID NO: 6124 - DNA, 25 bp, Artificial sequence
  Extension Primer
agaccagttccaagagggcattaac

SEQ ID NO: 6125 - DNA, 25 bp, Artificial sequence
  Extension Primer
cgggagtgagtactgttggtggtgt

SEQ ID NO: 6126 - DNA, 25 bp, Artificial sequence
  Extension Primer
tctgcctttctttggcttgtgcttc

SEQ ID NO: 6127 - DNA, 25 bp, Artificial sequence
  Extension Primer
acttgaagctattctaggcttctga

SEQ ID NO: 6128 - DNA, 22 bp, Artificial sequence
  Extension Primer
tgcaagtctgttgttactattt

SEQ ID NO: 6129 - DNA, 25 bp, Artificial sequence
  Extension Primer
tctttgtgacagttgcatggggttt

SEQ ID NO: 6130 - DNA, 25 bp, Artificial sequence
  Extension Primer
ctgtgattactttgtgcaaagatgt

SEQ ID NO: 6131 - DNA, 25 bp, Artificial sequence
  Extension Primer
tgcagaattttaggtggaccrtaaa

SEQ ID NO: 6132 - DNA, 25 bp, Artificial sequence
  Extension Primer
gggcagtcaagctctacatcctgtc

SEQ ID NO: 6133 - DNA, 25 bp, Artificial sequence
  Extension Primer
ccttttcaagagaatagcagataaa

SEQ ID NO: 6134 - DNA, 25 bp, Artificial sequence
  Extension Primer
gaagccacgatgtaatccgccaagg

SEQ ID NO: 6135 - DNA, 25 bp, Artificial sequence
  Extension Primer
ccacagtagatcccagatttgtcta

SEQ ID NO: 6136 - DNA, 25 bp, Artificial sequence
  Extension Primer
aagygaacactgggaggagggatga

SEQ ID NO: 6137 - DNA, 25 bp, Artificial sequence
  Extension Primer
agggtggggtggaaactaagagtct

SEQ ID NO: 6138 - DNA, 25 bp, Artificial sequence
  Extension Primer
gctgatccctagggattgtattatc

SEQ ID NO: 6139 - DNA, 25 bp, Artificial sequence
  Extension Primer
tgtttaacacaggcctgtggtttcc

SEQ ID NO: 6140 - DNA, 25 bp, Artificial sequence
  Extension Primer
acccatcttccatgatgcttcrgca

SEQ ID NO: 6141 - DNA, 25 bp, Artificial sequence
  Extension Primer
gtaaagtgagagtaccttcccaaaa

SEQ ID NO: 6142 - DNA, 25 bp, Artificial sequence
  Extension Primer
agaaaacataggctctgctgcctcc

SEQ ID NO: 6143 - DNA, 25 bp, Artificial sequence
  Extension Primer
cctttcttggcctttagcgtcaaca

SEQ ID NO: 6144 - DNA, 25 bp, Artificial sequence
  Extension Primer
ggaaatcttggcactaatactaatc

SEQ ID NO: 6145 - DNA, 25 bp, Artificial sequence
  Extension Primer
tcatcaggttgaaggagaggaaaac

SEQ ID NO: 6146 - DNA, 25 bp, Artificial sequence
  Extension Primer
taacttcagaccaaccagaggtcac

SEQ ID NO: 6147 - DNA, 25 bp, Artificial sequence
  Extension Primer
agctgggcttgagcatcagtccctt

SEQ ID NO: 6148 - DNA, 25 bp, Artificial sequence
  Extension Primer
cacccaccagcagagggaaagagga

SEQ ID NO: 6149 - DNA, 25 bp, Artificial sequence
  Extension Primer
tgacctccacctcttgctgcaggga

SEQ ID NO: 6150 - DNA, 25 bp, Artificial sequence
  Extension Primer
cgggctagagactttctgttgccaa

SEQ ID NO: 6151 - DNA, 25 bp, Artificial sequence
  Extension Primer
gtggaactcatgagtcagtgaggaa

SEQ ID NO: 6152 - DNA, 25 bp, Artificial sequence
  Extension Primer
cacctgccaatgcaggagacatggg

SEQ ID NO: 6153 - DNA, 22 bp, Artificial sequence
  Extension Primer
tgtctcacctcatcaagctggg

SEQ ID NO: 6154 - DNA, 22 bp, Artificial sequence
  Extension Primer
aggctctgggcacaaggaaggc

SEQ ID NO: 6155 - DNA, 25 bp, Artificial sequence
  Extension Primer
tggggtacacagcactctccaaggc

SEQ ID NO: 6156 - DNA, 25 bp, Artificial sequence
  Extension Primer
ccggacattgatggagagcagggca

SEQ ID NO: 6157 - DNA, 22 bp, Artificial sequence
  Extension Primer
gttcggggcggctggtgaacac

SEQ ID NO: 6158 - DNA, 25 bp, Artificial sequence
  Extension Primer
atgtctgtcccactgttttcatgca

SEQ ID NO: 6159 - DNA, 25 bp, Artificial sequence
  Extension Primer
cagagaagaatttcttaaatagata

SEQ ID NO: 6160 - DNA, 25 bp, Artificial sequence
  Extension Primer
gtatcagaaactaagctaaataaat

SEQ ID NO: 6161 - DNA, 25 bp, Artificial sequence
  Extension Primer
acagaaagaagtgctacacatagat

SEQ ID NO: 6162 - DNA, 25 bp, Artificial sequence
  Extension Primer
gagataacagttccgtacattatag

SEQ ID NO: 6163 - DNA, 25 bp, Artificial sequence
  Extension Primer
gagattatgcttcaatatggaatac

SEQ ID NO: 6164 - DNA, 25 bp, Artificial sequence
  Extension Primer
agactcactatgtaatgagacataa

SEQ ID NO: 6165 - DNA, 25 bp, Artificial sequence
  Extension Primer
ttgctacctggaacttatttcagtg

SEQ ID NO: 6166 - DNA, 25 bp, Artificial sequence
  Extension Primer
ctaacacaatactgtaaataaacta

SEQ ID NO: 6167 - DNA, 25 bp, Artificial sequence
  Extension Primer
ttcatgatttaaaggaccttaacaa

SEQ ID NO: 6168 - DNA, 25 bp, Artificial sequence
  Extension Primer
aaaaagatagtcctaaactgcaatc

SEQ ID NO: 6169 - DNA, 25 bp, Artificial sequence
  Extension Primer
ctcattatatatcacaatgcgataa

SEQ ID NO: 6170 - DNA, 25 bp, Artificial sequence
  Extension Primer
ggtttctaatttcattagattctga

SEQ ID NO: 6171 - DNA, 25 bp, Artificial sequence
  Extension Primer
tgtataatttttcgtcccactggta

SEQ ID NO: 6172 - DNA, 25 bp, Artificial sequence
  Extension Primer
aacacttgcttcaagtactctttaa

SEQ ID NO: 6173 - DNA, 25 bp, Artificial sequence
  Extension Primer
ctgttcccttctctaagtgtaaagt

SEQ ID NO: 6174 - DNA, 22 bp, Artificial sequence
  Extension Primer
caggtaacggggtagtttgttg

SEQ ID NO: 6175 - DNA, 25 bp, Artificial sequence
  Extension Primer
ggagatttagagagcaaacacaaca

SEQ ID NO: 6176 - DNA, 25 bp, Artificial sequence
  Extension Primer
cttaattctacaaaactttgcttag

SEQ ID NO: 6177 - DNA, 25 bp, Artificial sequence
  Extension Primer
gctaagaaaaattctctaaggaata

SEQ ID NO: 6178 - DNA, 25 bp, Artificial sequence
  Extension Primer
gcagccagtctcttctgctcattta

SEQ ID NO: 6179 - DNA, 25 bp, Artificial sequence
  Extension Primer
gatgcttctttgagaagatgtagac

SEQ ID NO: 6180 - DNA, 25 bp, Artificial sequence
  Extension Primer
aatcattgcatttccatttgatcct

SEQ ID NO: 6181 - DNA, 25 bp, Artificial sequence
  Extension Primer
cctgggacaaatacataaatgacca

SEQ ID NO: 6182 - DNA, 25 bp, Artificial sequence
  Extension Primer
tatattccagttcgaagtgaaaatg

SEQ ID NO: 6183 - DNA, 25 bp, Artificial sequence
  Extension Primer
gtacaatttgatgaattttgacaaa

SEQ ID NO: 6184 - DNA, 25 bp, Artificial sequence
  Extension Primer
ctaaactgatgaagagaaaagcagc

SEQ ID NO: 6185 - DNA, 25 bp, Artificial sequence
  Extension Primer
aaaaaaaaaactaygtaggagggaa

SEQ ID NO: 6186 - DNA, 25 bp, Artificial sequence
  Extension Primer
tcaccccaggtggagaatgagtgag

SEQ ID NO: 6187 - DNA, 25 bp, Artificial sequence
  Extension Primer
gcataaaattcttttcctcttccca

SEQ ID NO: 6188 - DNA, 25 bp, Artificial sequence
  Extension Primer
cctcctacgtgactgagatacctac

SEQ ID NO: 6189 - DNA, 25 bp, Artificial sequence
  Extension Primer
ttcttattgctgctgaaacaaatac

SEQ ID NO: 6190 - DNA, 25 bp, Artificial sequence
  Extension Primer
tccactttaaaattgtgttgagcac

SEQ ID NO: 6191 - DNA, 25 bp, Artificial sequence
  Extension Primer
caaaaaaaaaccatccccaagaggc

SEQ ID NO: 6192 - DNA, 25 bp, Artificial sequence
  Extension Primer
ttttctrcatataagaccaagctta

SEQ ID NO: 6193 - DNA, 25 bp, Artificial sequence
  Extension Primer
agcgcctgagaggctgggcgggaga

SEQ ID NO: 6194 - DNA, 25 bp, Artificial sequence
  Extension Primer
tggggggcccgtcgggtcccatctg

SEQ ID NO: 6195 - DNA, 25 bp, Artificial sequence
  Extension Primer
gacaggaagaaggtgaggccgagtc

SEQ ID NO: 6196 - DNA, 22 bp, Artificial sequence
  Extension Primer
tctggctgccatttggtaactg

SEQ ID NO: 6197 - DNA, 25 bp, Artificial sequence
  Extension Primer
ttagtgactaaaagatgctccttgt

SEQ ID NO: 6198 - DNA, 25 bp, Artificial sequence
  Extension Primer
tctcatccctcagaactcttgatgt

SEQ ID NO: 6199 - DNA, 25 bp, Artificial sequence
  Extension Primer
ccatccataacttcatggcgacrcc

SEQ ID NO: 6200 - DNA, 25 bp, Artificial sequence
  Extension Primer
gctagctctgggaagaaaaggttta

SEQ ID NO: 6201 - DNA, 25 bp, Artificial sequence
  Extension Primer
gaacctggacttgagtttctgtgtt

SEQ ID NO: 6202 - DNA, 25 bp, Artificial sequence
  Extension Primer
aaaacgccagctgatgcacttggag

SEQ ID NO: 6203 - DNA, 25 bp, Artificial sequence
  Extension Primer
ttacagaccgagagatcctgagcca

SEQ ID NO: 6204 - DNA, 25 bp, Artificial sequence
  Extension Primer
ccttctatcacttccctgccctgcg

SEQ ID NO: 6205 - DNA, 25 bp, Artificial sequence
  Extension Primer
ctgtccttttcatcctaacactatt

SEQ ID NO: 6206 - DNA, 25 bp, Artificial sequence
  Extension Primer
acacagtgtctacatcaaatgacat

SEQ ID NO: 6207 - DNA, 25 bp, Artificial sequence
  Extension Primer
ttttttccaattaatttctctttta

SEQ ID NO: 6208 - DNA, 25 bp, Artificial sequence
  Extension Primer
tgtttatgagaggtcagattttctt

SEQ ID NO: 6209 - DNA, 25 bp, Artificial sequence
  Extension Primer
tcaatcccatacttggaaaccacat

SEQ ID NO: 6210 - DNA, 25 bp, Artificial sequence
  Extension Primer
ggcttagtggtaaagaatctgctta

SEQ ID NO: 6211 - DNA, 25 bp, Artificial sequence
  Extension Primer
gaagatatgttagttttcatttttg

SEQ ID NO: 6212 - DNA, 25 bp, Artificial sequence
  Extension Primer
cagcaaagctgtcgaaacaaagtga

SEQ ID NO: 6213 - DNA, 25 bp, Artificial sequence
  Extension Primer
gcagtaayagttgattgtaccttga

SEQ ID NO: 6214 - DNA, 25 bp, Artificial sequence
  Extension Primer
cgttgcttaaayaagcatctatact

SEQ ID NO: 6215 - DNA, 25 bp, Artificial sequence
  Extension Primer
taaaatttcaatcttatatttgatc

SEQ ID NO: 6216 - DNA, 25 bp, Artificial sequence
  Extension Primer
tttgacaccaatgcagaataagtca

SEQ ID NO: 6217 - DNA, 25 bp, Artificial sequence
  Extension Primer
ccatgtgatttgaataaactgtctg

SEQ ID NO: 6218 - DNA, 25 bp, Artificial sequence
  Extension Primer
gtatctttactatgatgtctatgta

SEQ ID NO: 6219 - DNA, 25 bp, Artificial sequence
  Extension Primer
tccaatttgtcacaaatacaagtgc

SEQ ID NO: 6220 - DNA, 25 bp, Artificial sequence
  Extension Primer
aaaggtagtggtcttctgtagcagt

SEQ ID NO: 6221 - DNA, 25 bp, Artificial sequence
  Extension Primer
gttgtgggtcttatttttattagcc

SEQ ID NO: 6222 - DNA, 25 bp, Artificial sequence
  Extension Primer
tcgaagaactgaatttagataccca

SEQ ID NO: 6223 - DNA, 25 bp, Artificial sequence
  Extension Primer
gcttttcctgcacctcctgtctctc

SEQ ID NO: 6224 - DNA, 22 bp, Artificial sequence
  Extension Primer
acagaatcaggatgctgtgttt

SEQ ID NO: 6225 - DNA, 25 bp, Artificial sequence
  Extension Primer
ccccaaccaagggacacaggaaaga

SEQ ID NO: 6226 - DNA, 25 bp, Artificial sequence
  Extension Primer
tcccaggtggcccctcccctcygac

SEQ ID NO: 6227 - DNA, 25 bp, Artificial sequence
  Extension Primer
gacagggagtggaacagctggaaac

SEQ ID NO: 6228 - DNA, 25 bp, Artificial sequence
  Extension Primer
accacagctcggtccctggtgaatg

SEQ ID NO: 6229 - DNA, 25 bp, Artificial sequence
  Extension Primer
tctaactgggcatcctgtaatttta

SEQ ID NO: 6230 - DNA, 25 bp, Artificial sequence
  Extension Primer
ttccctcctgtcagcccctcctctc

SEQ ID NO: 6231 - DNA, 25 bp, Artificial sequence
  Extension Primer
gattaagcagtatctcgtctccact

SEQ ID NO: 6232 - DNA, 25 bp, Artificial sequence
  Extension Primer
ggggccccgacacagggcctttgta

SEQ ID NO: 6233 - DNA, 25 bp, Artificial sequence
  Extension Primer
cacgtggcctccatacagtgactcc

SEQ ID NO: 6234 - DNA, 25 bp, Artificial sequence
  Extension Primer
taaacagctgtggtcgcccaccatc

SEQ ID NO: 6235 - DNA, 25 bp, Artificial sequence
  Extension Primer
taatttgctatctgagaactcttct

SEQ ID NO: 6236 - DNA, 25 bp, Artificial sequence
  Extension Primer
ggcaaatccatattatcccctaatc

SEQ ID NO: 6237 - DNA, 25 bp, Artificial sequence
  Extension Primer
aataacactttaaatattatggttc

SEQ ID NO: 6238 - DNA, 25 bp, Artificial sequence
  Extension Primer
ccatagccagtaaagtaaaatcaag

SEQ ID NO: 6239 - DNA, 25 bp, Artificial sequence
  Extension Primer
acattttctactgctttctttctaa

SEQ ID NO: 6240 - DNA, 25 bp, Artificial sequence
  Extension Primer
tattggagtataggacagatgagcc

SEQ ID NO: 6241 - DNA, 25 bp, Artificial sequence
  Extension Primer
tacgctataggaggatgaaatgtgg

SEQ ID NO: 6242 - DNA, 25 bp, Artificial sequence
  Extension Primer
ggcaaggggaccttgtccaagaatc

SEQ ID NO: 6243 - DNA, 25 bp, Artificial sequence
  Extension Primer
cgggaaactgcgctgcacgtggcac

SEQ ID NO: 6244 - DNA, 25 bp, Artificial sequence
  Extension Primer
gggctggagggaggacatggtgggc

SEQ ID NO: 6245 - DNA, 25 bp, Artificial sequence
  Extension Primer
tgtgtttcagccttgccatgcacct

SEQ ID NO: 6246 - DNA, 25 bp, Artificial sequence
  Extension Primer
ggtgcagaccggggtgccatgcgga

SEQ ID NO: 6247 - DNA, 25 bp, Artificial sequence
  Extension Primer
cacctcaagacagagcccaacaggc

SEQ ID NO: 6248 - DNA, 25 bp, Artificial sequence
  Extension Primer
catacacattgaatgtatatttata

SEQ ID NO: 6249 - DNA, 25 bp, Artificial sequence
  Extension Primer
ccacaagagactaattgcaactcct

SEQ ID NO: 6250 - DNA, 25 bp, Artificial sequence
  Extension Primer
tttttaattggaagaaattgcttta

SEQ ID NO: 6251 - DNA, 25 bp, Artificial sequence
  Extension Primer
ctgagagcgcgccttggtgacaggg

SEQ ID NO: 6252 - DNA, 25 bp, Artificial sequence
  Extension Primer
ggagtggaggggggatgtggccaag

SEQ ID NO: 6253 - DNA, 25 bp, Artificial sequence
  Extension Primer
ccacatccaggggcacagagagccc

SEQ ID NO: 6254 - DNA, 25 bp, Artificial sequence
  Extension Primer
gtgtcaagtgcccctcatgggaaga

SEQ ID NO: 6255 - DNA, 25 bp, Artificial sequence
  Extension Primer
gtgggacctttaggagatcataaga

SEQ ID NO: 6256 - DNA, 25 bp, Artificial sequence
  Extension Primer
tgcagcctgtgcacttagagcccac

SEQ ID NO: 6257 - DNA, 25 bp, Artificial sequence
  Extension Primer
gcactgaatctatagattgctttgg

SEQ ID NO: 6258 - DNA, 25 bp, Artificial sequence
  Extension Primer
tccacaratctctacctaattaaca

SEQ ID NO: 6259 - DNA, 25 bp, Artificial sequence
  Extension Primer
atcaatgattacatttgatttttca

SEQ ID NO: 6260 - DNA, 25 bp, Artificial sequence
  Extension Primer
ccatatttaaataataataaggtcc

SEQ ID NO: 6261 - DNA, 25 bp, Artificial sequence
  Extension Primer
gcaaaatctagcatacttacagcac

SEQ ID NO: 6262 - DNA, 25 bp, Artificial sequence
  Extension Primer
cattttattaaaacttcttcaaccc

SEQ ID NO: 6263 - DNA, 25 bp, Artificial sequence
  Extension Primer
cccctaacgtgcctggtcactggcc

SEQ ID NO: 6264 - DNA, 25 bp, Artificial sequence
  Extension Primer
ctttatattttgaacgtagcatttg

SEQ ID NO: 6265 - DNA, 25 bp, Artificial sequence
  Extension Primer
tacgttagttcacctaaagacaatc

SEQ ID NO: 6266 - DNA, 25 bp, Artificial sequence
  Extension Primer
cccccatggggccagcccacctgag

SEQ ID NO: 6267 - DNA, 25 bp, Artificial sequence
  Extension Primer
gggatggtcccacattgcccactat

SEQ ID NO: 6268 - DNA, 25 bp, Artificial sequence
  Extension Primer
atgtcctggggagcagctggagaac

SEQ ID NO: 6269 - DNA, 25 bp, Artificial sequence
  Extension Primer
ccccaccacccctctgccatgtaat

SEQ ID NO: 6270 - DNA, 25 bp, Artificial sequence
  Extension Primer
gctgggtccagtccgcagtcagtaa

SEQ ID NO: 6271 - DNA, 25 bp, Artificial sequence
  Extension Primer
cagtgatgaggtcttstgcctgctt

SEQ ID NO: 6272 - DNA, 25 bp, Artificial sequence
  Extension Primer
gatgacattgttttcccaccaactc

SEQ ID NO: 6273 - DNA, 25 bp, Artificial sequence
  Extension Primer
gttcctctcctttcctttcctttca

SEQ ID NO: 6274 - DNA, 25 bp, Artificial sequence
  Extension Primer
gagaatgccgtttctttggctgtcc

SEQ ID NO: 6275 - DNA, 25 bp, Artificial sequence
  Extension Primer
agacatcttggtgagtcgctcctcc

SEQ ID NO: 6276 - DNA, 25 bp, Artificial sequence
  Extension Primer
agcttcccttggcttcacagaccac

SEQ ID NO: 6277 - DNA, 25 bp, Artificial sequence
  Extension Primer
tagtttcctacatgcttgtggcctc

SEQ ID NO: 6278 - DNA, 25 bp, Artificial sequence
  Extension Primer
gagtgtgaaggctagggcccrmcac

SEQ ID NO: 6279 - DNA, 25 bp, Artificial sequence
  Extension Primer
agagactgagggtggggagaaaagc

SEQ ID NO: 6280 - DNA, 25 bp, Artificial sequence
  Extension Primer
ttaaaaattgacagaattgaccaga

SEQ ID NO: 6281 - DNA, 25 bp, Artificial sequence
  Extension Primer
aatagtaaggaatgtctgaaatgtc

SEQ ID NO: 6282 - DNA, 25 bp, Artificial sequence
  Extension Primer
agaaattggttctcagacttcactg

SEQ ID NO: 6283 - DNA, 25 bp, Artificial sequence
  Extension Primer
tgcagctgaacaagtcaagttctaa

SEQ ID NO: 6284 - DNA, 25 bp, Artificial sequence
  Extension Primer
ggtccacactgacagacggacactc

SEQ ID NO: 6285 - DNA, 25 bp, Artificial sequence
  Extension Primer
cgatgtagaattaaacatgtgcaga

SEQ ID NO: 6286 - DNA, 25 bp, Artificial sequence
  Extension Primer
caaaggtccacctgttgactaagcc

SEQ ID NO: 6287 - DNA, 25 bp, Artificial sequence
  Extension Primer
ctaggtaccactcatggggagcatc

SEQ ID NO: 6288 - DNA, 25 bp, Artificial sequence
  Extension Primer
tgacctgtgaactttaattgggaag

SEQ ID NO: 6289 - DNA, 25 bp, Artificial sequence
  Extension Primer
tctcctccaggcggatggtcatggc

SEQ ID NO: 6290 - DNA, 25 bp, Artificial sequence
  Extension Primer
gaggygtgtcgatgaagtcaaaccc

SEQ ID NO: 6291 - DNA, 25 bp, Artificial sequence
  Extension Primer
tggtgtatggggatggttttcagga

SEQ ID NO: 6292 - DNA, 25 bp, Artificial sequence
  Extension Primer
cagcataaaggaagagtctggtggc

SEQ ID NO: 6293 - DNA, 22 bp, Artificial sequence
  Extension Primer
ccgggatgcrgggagctgagcc

SEQ ID NO: 6294 - DNA, 25 bp, Artificial sequence
  Extension Primer
gaggatgggctatgggtgtctttgg

SEQ ID NO: 6295 - DNA, 25 bp, Artificial sequence
  Extension Primer
gcattgtattttaactaagtattcc

SEQ ID NO: 6296 - DNA, 25 bp, Artificial sequence
  Extension Primer
atatgtcatttctttcattgtgaac

SEQ ID NO: 6297 - DNA, 25 bp, Artificial sequence
  Extension Primer
atgcaagtaaggatgactattccac

SEQ ID NO: 6298 - DNA, 25 bp, Artificial sequence
  Extension Primer
aagactgtcataattgtttgctgtg

SEQ ID NO: 6299 - DNA, 25 bp, Artificial sequence
  Extension Primer
ggtagctgcaaccatgcttgctcct

SEQ ID NO: 6300 - DNA, 25 bp, Artificial sequence
  Extension Primer
ctgcacatttcctgtgatttagtac

SEQ ID NO: 6301 - DNA, 25 bp, Artificial sequence
  Extension Primer
actctatttggaagcatgctcctct

SEQ ID NO: 6302 - DNA, 25 bp, Artificial sequence
  Extension Primer
ctcgcaaataaaaatgtggtctttg

SEQ ID NO: 6303 - DNA, 25 bp, Artificial sequence
  Extension Primer
rgttgagtcaattaacataatttga

SEQ ID NO: 6304 - DNA, 25 bp, Artificial sequence
  Extension Primer
cacagctgccagcaatccagttagg

SEQ ID NO: 6305 - DNA, 25 bp, Artificial sequence
  Extension Primer
gaatgcaatcaaatagccaaatgta

SEQ ID NO: 6306 - DNA, 25 bp, Artificial sequence
  Extension Primer
ctcccctaacctatcactagaagac

SEQ ID NO: 6307 - DNA, 25 bp, Artificial sequence
  Extension Primer
caggaacacggttacttatccaagt

SEQ ID NO: 6308 - DNA, 25 bp, Artificial sequence
  Extension Primer
atgagaactagtggatggtgctgtt

SEQ ID NO: 6309 - DNA, 25 bp, Artificial sequence
  Extension Primer
tgttctccctttactgtatttattc

SEQ ID NO: 6310 - DNA, 25 bp, Artificial sequence
  Extension Primer
tctttttctttgtcctttgtgtttt

SEQ ID NO: 6311 - DNA, 25 bp, Artificial sequence
  Extension Primer
gggttgagcactttcagatttaaca

SEQ ID NO: 6312 - DNA, 25 bp, Artificial sequence
  Extension Primer
crctcctctttgatttatttacaac

SEQ ID NO: 6313 - DNA, 25 bp, Artificial sequence
  Extension Primer
tttcaggtatacattaytggtttct

SEQ ID NO: 6314 - DNA, 25 bp, Artificial sequence
  Extension Primer
caccttggcctctctgtgagtctga

SEQ ID NO: 6315 - DNA, 25 bp, Artificial sequence
  Extension Primer
attcaagtgaatagtgatgatggtt

SEQ ID NO: 6316 - DNA, 25 bp, Artificial sequence
  Extension Primer
ctagaattgcaaagtttatttaagg

SEQ ID NO: 6317 - DNA, 25 bp, Artificial sequence
  Extension Primer
gcattatacaaaataggcagracat

SEQ ID NO: 6318 - DNA, 25 bp, Artificial sequence
  Extension Primer
gaatattaccactgtgtagaatacc

SEQ ID NO: 6319 - DNA, 25 bp, Artificial sequence
  Extension Primer
ggagaatggcattgaaacatgtata

SEQ ID NO: 6320 - DNA, 25 bp, Artificial sequence
  Extension Primer
acaatatgcattaggattagctgct

SEQ ID NO: 6321 - DNA, 25 bp, Artificial sequence
  Extension Primer
aagaaaacattaagctcagggrgac

SEQ ID NO: 6322 - DNA, 25 bp, Artificial sequence
  Extension Primer
aatagaaatcacaaagtcacattac

SEQ ID NO: 6323 - DNA, 25 bp, Artificial sequence
  Extension Primer
atgtgagatgaatcagcgtagtgta

SEQ ID NO: 6324 - DNA, 25 bp, Artificial sequence
  Extension Primer
aacactttctgaaagactgtctact

SEQ ID NO: 6325 - DNA, 25 bp, Artificial sequence
  Extension Primer
tatctcagatgttaaaggtacaaag

SEQ ID NO: 6326 - DNA, 25 bp, Artificial sequence
  Extension Primer
tacaggattgaaagttgaaaactag

SEQ ID NO: 6327 - DNA, 25 bp, Artificial sequence
  Extension Primer
attatgatctcttcaggctactttc

SEQ ID NO: 6328 - DNA, 25 bp, Artificial sequence
  Extension Primer
ctattaaggcaaagatgttcagtga

SEQ ID NO: 6329 - DNA, 25 bp, Artificial sequence
  Extension Primer
gacaagagcaaggatgtgaagacca

SEQ ID NO: 6330 - DNA, 25 bp, Artificial sequence
  Extension Primer
gagtaaatgctttctatcttgtgct

SEQ ID NO: 6331 - DNA, 25 bp, Artificial sequence
  Extension Primer
actgtctcctgtaaaatggttgggg

SEQ ID NO: 6332 - DNA, 25 bp, Artificial sequence
  Extension Primer
tttatgttattttttgagtaattca

SEQ ID NO: 6333 - DNA, 25 bp, Artificial sequence
  Extension Primer
cccccacaagctatctattaagaat

SEQ ID NO: 6334 - DNA, 25 bp, Artificial sequence
  Extension Primer
gagaagaaacataaacccaagccaa

SEQ ID NO: 6335 - DNA, 25 bp, Artificial sequence
  Extension Primer
ggaaacaccactagccctgccagtc

SEQ ID NO: 6336 - DNA, 25 bp, Artificial sequence
  Extension Primer
gaagtgagttctgtaacattggggg

SEQ ID NO: 6337 - DNA, 25 bp, Artificial sequence
  Extension Primer
ggtgatggacaggggagsctgatgc

SEQ ID NO: 6338 - DNA, 25 bp, Artificial sequence
  Extension Primer
attatttatacaaaattctgactca

SEQ ID NO: 6339 - DNA, 25 bp, Artificial sequence
  Extension Primer
tgacagtggtgagtgcttggggctg

SEQ ID NO: 6340 - DNA, 25 bp, Artificial sequence
  Extension Primer
atctatgctgtaccattttaaggga

SEQ ID NO: 6341 - DNA, 25 bp, Artificial sequence
  Extension Primer
taacatcattgcataatggcatagt

SEQ ID NO: 6342 - DNA, 25 bp, Artificial sequence
  Extension Primer
aacaacttcagaagataatgtcaca

SEQ ID NO: 6343 - DNA, 25 bp, Artificial sequence
  Extension Primer
grgatgctggaagtggatttagagc

SEQ ID NO: 6344 - DNA, 25 bp, Artificial sequence
  Extension Primer
aatagcatttataggatataaccat

SEQ ID NO: 6345 - DNA, 25 bp, Artificial sequence
  Extension Primer
aaggtggtcctaagaagataaaggt

SEQ ID NO: 6346 - DNA, 25 bp, Artificial sequence
  Extension Primer
cgtggaactggagattccttcatag

SEQ ID NO: 6347 - DNA, 25 bp, Artificial sequence
  Extension Primer
gagcaatcactcttgtaaagccctc

SEQ ID NO: 6348 - DNA, 25 bp, Artificial sequence
  Extension Primer
aaaaaaaagtgacagaaaaagagat

SEQ ID NO: 6349 - DNA, 25 bp, Artificial sequence
  Extension Primer
ttcgttttcattcaccccattctar

SEQ ID NO: 6350 - DNA, 25 bp, Artificial sequence
  Extension Primer
tggatgtgtaggactagaggaggaa

SEQ ID NO: 6351 - DNA, 25 bp, Artificial sequence
  Extension Primer
taggagataaccttcagaatatagg

SEQ ID NO: 6352 - DNA, 25 bp, Artificial sequence
  Extension Primer
gttccttgtaggctgtgccaacaga

SEQ ID NO: 6353 - DNA, 25 bp, Artificial sequence
  Extension Primer
atattagatgtatatttttaatccc

SEQ ID NO: 6354 - DNA, 25 bp, Artificial sequence
  Extension Primer
taaatgaaaataagcaaaccatcac

SEQ ID NO: 6355 - DNA, 25 bp, Artificial sequence
  Extension Primer
aagtttgtcaacagtaagccttatt

SEQ ID NO: 6356 - DNA, 25 bp, Artificial sequence
  Extension Primer
cattgcttcatccttctgtcatggc

SEQ ID NO: 6357 - DNA, 25 bp, Artificial sequence
  Extension Primer
ttgtttttttaatcctgattctgca

SEQ ID NO: 6358 - DNA, 25 bp, Artificial sequence
  Extension Primer
aaaccatcttggtaagttgatgaac

SEQ ID NO: 6359 - DNA, 25 bp, Artificial sequence
  Extension Primer
ggacgtggatgaacctcgaccgtat

SEQ ID NO: 6360 - DNA, 25 bp, Artificial sequence
  Extension Primer
caccagagccgctggccctcctcac

SEQ ID NO: 6361 - DNA, 25 bp, Artificial sequence
  Extension Primer
accgtcttatgggagggcctgtagg

SEQ ID NO: 6362 - DNA, 25 bp, Artificial sequence
  Extension Primer
gcaaactccagcaaaccacctcctc

SEQ ID NO: 6363 - DNA, 25 bp, Artificial sequence
  Extension Primer
tttttagactgtgacggaatcaaac

SEQ ID NO: 6364 - DNA, 25 bp, Artificial sequence
  Extension Primer
acatgggagacagacaggcagaagg

SEQ ID NO: 6365 - DNA, 25 bp, Artificial sequence
  Extension Primer
ctaaaatattatttgccccacgaaa

SEQ ID NO: 6366 - DNA, 25 bp, Artificial sequence
  Extension Primer
ggtcatgcagacagcaagggttggg

SEQ ID NO: 6367 - DNA, 25 bp, Artificial sequence
  Extension Primer
agggaggtcagatggatggtaaata

SEQ ID NO: 6368 - DNA, 25 bp, Artificial sequence
  Extension Primer
gtgacattcacatagaaagtcccat

SEQ ID NO: 6369 - DNA, 25 bp, Artificial sequence
  Extension Primer
gcctggccagctggttcctgttccc

SEQ ID NO: 6370 - DNA, 25 bp, Artificial sequence
  Extension Primer
ggaggggttaggtatcattaacagc

SEQ ID NO: 6371 - DNA, 25 bp, Artificial sequence
  Extension Primer
aaattaatgcttctgattgtagaac

SEQ ID NO: 6372 - DNA, 25 bp, Artificial sequence
  Extension Primer
aagatcagataagaaattcacctgc

SEQ ID NO: 6373 - DNA, 25 bp, Artificial sequence
  Extension Primer
aatatttctcacatatcttcattat

SEQ ID NO: 6374 - DNA, 25 bp, Artificial sequence
  Extension Primer
aatcctcaccatcacagccacaaat

SEQ ID NO: 6375 - DNA, 25 bp, Artificial sequence
  Extension Primer
tttcttttgaccacaagcagcaaca

SEQ ID NO: 6376 - DNA, 25 bp, Artificial sequence
  Extension Primer
gaaccagctaaaagataatatagtc

SEQ ID NO: 6377 - DNA, 25 bp, Artificial sequence
  Extension Primer
tggaaaagatttttgatctgtgttc

SEQ ID NO: 6378 - DNA, 25 bp, Artificial sequence
  Extension Primer
atgagttagcatttctatgactaaa

SEQ ID NO: 6379 - DNA, 25 bp, Artificial sequence
  Extension Primer
cagtcttacttaacagacattatac

SEQ ID NO: 6380 - DNA, 25 bp, Artificial sequence
  Extension Primer
tgattgttgaaaccaatatttgaac

SEQ ID NO: 6381 - DNA, 25 bp, Artificial sequence
  Extension Primer
aagggtatatcattgcagcctttgt

SEQ ID NO: 6382 - DNA, 25 bp, Artificial sequence
  Extension Primer
ttttgccttcttaattgttatttct

SEQ ID NO: 6383 - DNA, 25 bp, Artificial sequence
  Extension Primer
agggatgggtcattctagaaacaac

SEQ ID NO: 6384 - DNA, 25 bp, Artificial sequence
  Extension Primer
gaatgatctaagaattttgttgtct

SEQ ID NO: 6385 - DNA, 25 bp, Artificial sequence
  Extension Primer
tatttccaccaccttttactcttcc

SEQ ID NO: 6386 - DNA, 25 bp, Artificial sequence
  Extension Primer
tcagagctttattttttcattatac

SEQ ID NO: 6387 - DNA, 25 bp, Artificial sequence
  Extension Primer
tttgcatatgggcatgtrattttac

SEQ ID NO: 6388 - DNA, 25 bp, Artificial sequence
  Extension Primer
attttttctattccttcccatattt

SEQ ID NO: 6389 - DNA, 25 bp, Artificial sequence
  Extension Primer
aaaaaagaaacatctacaaaacaac

SEQ ID NO: 6390 - DNA, 25 bp, Artificial sequence
  Extension Primer
tagtgtgtattagactaagaccaaa

SEQ ID NO: 6391 - DNA, 25 bp, Artificial sequence
  Extension Primer
ttgtaatatgaattgttaaagtttg

SEQ ID NO: 6392 - DNA, 25 bp, Artificial sequence
  Extension Primer
taaaaatgtatggaatgtcccaatt

SEQ ID NO: 6393 - DNA, 25 bp, Artificial sequence
  Extension Primer
tatatcctgagattgttgagaaaac

SEQ ID NO: 6394 - DNA, 25 bp, Artificial sequence
  Extension Primer
tcaaagacgtcttaagtcttaaaga

SEQ ID NO: 6395 - DNA, 25 bp, Artificial sequence
  Extension Primer
cattgatataccttaaaaacataca

SEQ ID NO: 6396 - DNA, 25 bp, Artificial sequence
  Extension Primer
tatcagcgtagatcttcaacaatac

SEQ ID NO: 6397 - DNA, 25 bp, Artificial sequence
  Extension Primer
gggcagaagtctgcaaactttttct

SEQ ID NO: 6398 - DNA, 25 bp, Artificial sequence
  Extension Primer
gcttttccatgtaaaagggattcat

SEQ ID NO: 6399 - DNA, 25 bp, Artificial sequence
  Extension Primer
gttactacatactgaagaagatgac

SEQ ID NO: 6400 - DNA, 25 bp, Artificial sequence
  Extension Primer
cagcacccagcaagttaaaattcac

SEQ ID NO: 6401 - DNA, 25 bp, Artificial sequence
  Extension Primer
aggccacttcaagttacattttaac

SEQ ID NO: 6402 - DNA, 25 bp, Artificial sequence
  Extension Primer
atcatcttcaacaaatatgaccrac

SEQ ID NO: 6403 - DNA, 25 bp, Artificial sequence
  Extension Primer
tttttagaacctcaaattaattatg

SEQ ID NO: 6404 - DNA, 25 bp, Artificial sequence
  Extension Primer
ggaagaaaattgtctayaaaggata

SEQ ID NO: 6405 - DNA, 25 bp, Artificial sequence
  Extension Primer
aagttaaaagcccaatctcctaacc

SEQ ID NO: 6406 - DNA, 25 bp, Artificial sequence
  Extension Primer
gacagttgaattgcatgtccaccat

SEQ ID NO: 6407 - DNA, 25 bp, Artificial sequence
  Extension Primer
atctcttaacggagattgagagagc

SEQ ID NO: 6408 - DNA, 25 bp, Artificial sequence
  Extension Primer
aacaatgacttgtttatagggttga

SEQ ID NO: 6409 - DNA, 25 bp, Artificial sequence
  Extension Primer
ttttcacagcatgtgcactgatcca

SEQ ID NO: 6410 - DNA, 25 bp, Artificial sequence
  Extension Primer
atttgttttgacttgtatagaaatc

SEQ ID NO: 6411 - DNA, 25 bp, Artificial sequence
  Extension Primer
taatgaacatggtaggggagcgaac

SEQ ID NO: 6412 - DNA, 25 bp, Artificial sequence
  Extension Primer
tgatagcatcacaaaatctaaacca

SEQ ID NO: 6413 - DNA, 25 bp, Artificial sequence
  Extension Primer
agaacaaatgtaaataaacaagagc

SEQ ID NO: 6414 - DNA, 25 bp, Artificial sequence
  Extension Primer
ctggcagatataggctccaaggaca

SEQ ID NO: 6415 - DNA, 25 bp, Artificial sequence
  Extension Primer
gaaggcatggcagaagtagagggaa

SEQ ID NO: 6416 - DNA, 25 bp, Artificial sequence
  Extension Primer
caatgaaaaatctatacacagcgat

SEQ ID NO: 6417 - DNA, 25 bp, Artificial sequence
  Extension Primer
tcttgtgcacattatratttaggaa

SEQ ID NO: 6418 - DNA, 25 bp, Artificial sequence
  Extension Primer
agcatacttcttttctgtcctgcct

SEQ ID NO: 6419 - DNA, 25 bp, Artificial sequence
  Extension Primer
aatgtatgttttccctttacagcat

SEQ ID NO: 6420 - DNA, 25 bp, Artificial sequence
  Extension Primer
ttgaaatagaaatctggccttggaa

SEQ ID NO: 6421 - DNA, 25 bp, Artificial sequence
  Extension Primer
catcccacacctgtccttccragta

SEQ ID NO: 6422 - DNA, 25 bp, Artificial sequence
  Extension Primer
aaactcatatcccttcttcccaatc

SEQ ID NO: 6423 - DNA, 25 bp, Artificial sequence
  Extension Primer
aacaagygctttcccaagagttcag

SEQ ID NO: 6424 - DNA, 25 bp, Artificial sequence
  Extension Primer
acatatcacctagacttgtaatctt

SEQ ID NO: 6425 - DNA, 25 bp, Artificial sequence
  Extension Primer
tcttggctcctccctctcagccaac

SEQ ID NO: 6426 - DNA, 25 bp, Artificial sequence
  Extension Primer
gtctctggtttcctgtagtcttctc

SEQ ID NO: 6427 - DNA, 25 bp, Artificial sequence
  Extension Primer
atgagtggacaaacaaattgaacag

SEQ ID NO: 6428 - DNA, 25 bp, Artificial sequence
  Extension Primer
atttgcrtgttggcattcagctttt

SEQ ID NO: 6429 - DNA, 25 bp, Artificial sequence
  Extension Primer
aatggcttgcagaaggcatgcaaac

SEQ ID NO: 6430 - DNA, 25 bp, Artificial sequence
  Extension Primer
gccagcctcaggggtaacagactat

SEQ ID NO: 6431 - DNA, 25 bp, Artificial sequence
  Extension Primer
atggtcgctgcagggaaaccaaggt

SEQ ID NO: 6432 - DNA, 25 bp, Artificial sequence
  Extension Primer
cagttgtacgggcatctggtatagg

SEQ ID NO: 6433 - DNA, 25 bp, Artificial sequence
  Extension Primer
cagccctcctggtcagccctctatg

SEQ ID NO: 6434 - DNA, 25 bp, Artificial sequence
  Extension Primer
cgcttctaatggaaatcactcagtc

SEQ ID NO: 6435 - DNA, 25 bp, Artificial sequence
  Extension Primer
gctcttcacagctagagaaaagccc

SEQ ID NO: 6436 - DNA, 25 bp, Artificial sequence
  Extension Primer
ctgagccaccagggaagccyctgta

SEQ ID NO: 6437 - DNA, 25 bp, Artificial sequence
  Extension Primer
aaatgccttacaaatactccttttk

SEQ ID NO: 6438 - DNA, 25 bp, Artificial sequence
  Extension Primer
agttttttcctaattaatctcctta

SEQ ID NO: 6439 - DNA, 25 bp, Artificial sequence
  Extension Primer
ttaaaatgatgacgaataacgataa

SEQ ID NO: 6440 - DNA, 25 bp, Artificial sequence
  Extension Primer
tttacctttatacagaatgatgtat

SEQ ID NO: 6441 - DNA, 25 bp, Artificial sequence
  Extension Primer
aggaaaagttacatggaggagacag

SEQ ID NO: 6442 - DNA, 25 bp, Artificial sequence
  Extension Primer
aattagattttgccaagtcaaagta

SEQ ID NO: 6443 - DNA, 25 bp, Artificial sequence
  Extension Primer
tcagtataagaactgcctttccaca

SEQ ID NO: 6444 - DNA, 25 bp, Artificial sequence
  Extension Primer
ttctaactatagaagtttgtcaaag

SEQ ID NO: 6445 - DNA, 25 bp, Artificial sequence
  Extension Primer
gaactatctctccacagacaagaag

SEQ ID NO: 6446 - DNA, 25 bp, Artificial sequence
  Extension Primer
tgctctcataaacaaatgtcctctt

SEQ ID NO: 6447 - DNA, 25 bp, Artificial sequence
  Extension Primer
cagggtaccaatatgagcatctctc

SEQ ID NO: 6448 - DNA, 25 bp, Artificial sequence
  Extension Primer
aattaaattcaaactcacactggtt

SEQ ID NO: 6449 - DNA, 25 bp, Artificial sequence
  Extension Primer
acataaaccaatcccctgcaacatc

SEQ ID NO: 6450 - DNA, 25 bp, Artificial sequence
  Extension Primer
tgagccctggtagagtgccttttcc

SEQ ID NO: 6451 - DNA, 25 bp, Artificial sequence
  Extension Primer
caccatttaccaccagccaaagaca

SEQ ID NO: 6452 - DNA, 25 bp, Artificial sequence
  Extension Primer
gagtggtattcaataaccaagttct

SEQ ID NO: 6453 - DNA, 22 bp, Artificial sequence
  Extension Primer
tggtactagaaggagcagaaaa

SEQ ID NO: 6454 - DNA, 22 bp, Artificial sequence
  Extension Primer
gcaaataccctcagctgaacta

SEQ ID NO: 6455 - DNA, 25 bp, Artificial sequence
  Extension Primer
gcccagttctcaggaaggggaaaca

SEQ ID NO: 6456 - DNA, 25 bp, Artificial sequence
  Extension Primer
ttactggatttctstttcctcattc

SEQ ID NO: 6457 - DNA, 25 bp, Artificial sequence
  Extension Primer
ctcagccctagccctaaaggctcag

SEQ ID NO: 6458 - DNA, 25 bp, Artificial sequence
  Extension Primer
aatatatagccaatgaaaggaagag

SEQ ID NO: 6459 - DNA, 25 bp, Artificial sequence
  Extension Primer
tctaggttctagtagagcaagggta

SEQ ID NO: 6460 - DNA, 25 bp, Artificial sequence
  Extension Primer
ctccccctcacccagtgcaatgtca

SEQ ID NO: 6461 - DNA, 25 bp, Artificial sequence
  Extension Primer
atggattcttcaccatatgagccac

SEQ ID NO: 6462 - DNA, 25 bp, Artificial sequence
  Extension Primer
cagaaaccctgtctcccacacccag

SEQ ID NO: 6463 - DNA, 25 bp, Artificial sequence
  Extension Primer
gcaggcagtggaggtggggcggggg

SEQ ID NO: 6464 - DNA, 22 bp, Artificial sequence
  Extension Primer
tcctagttatctgggtgtgggg

SEQ ID NO: 6465 - DNA, 25 bp, Artificial sequence
  Extension Primer
aagactcccacgatgaaattcactc

SEQ ID NO: 6466 - DNA, 25 bp, Artificial sequence
  Extension Primer
acgctgggctagcttcccacagcag

SEQ ID NO: 6467 - DNA, 22 bp, Artificial sequence
  Extension Primer
ctccgtcactccagtctctgcc

SEQ ID NO: 6468 - DNA, 25 bp, Artificial sequence
  Extension Primer
ggggagcgtgtcatcttctggcatt

SEQ ID NO: 6469 - DNA, 25 bp, Artificial sequence
  Extension Primer
agatasataaaccccatgargccca

SEQ ID NO: 6470 - DNA, 25 bp, Artificial sequence
  Extension Primer
tggcagcrattctgttcttgccatt

SEQ ID NO: 6471 - DNA, 25 bp, Artificial sequence
  Extension Primer
attagctgaagcagggatgatcccc

SEQ ID NO: 6472 - DNA, 25 bp, Artificial sequence
  Extension Primer
atttcattcaacatcttagtgtata

SEQ ID NO: 6473 - DNA, 25 bp, Artificial sequence
  Extension Primer
aaacaacaacaaatatggctaaaaa

SEQ ID NO: 6474 - DNA, 25 bp, Artificial sequence
  Extension Primer
acaggaygcctacatgtagcttgac

SEQ ID NO: 6475 - DNA, 25 bp, Artificial sequence
  Extension Primer
taacctgcatcctctctttcttttc

SEQ ID NO: 6476 - DNA, 25 bp, Artificial sequence
  Extension Primer
ttaaggtttcaaaagatatgcttat

SEQ ID NO: 6477 - DNA, 25 bp, Artificial sequence
  Extension Primer
aattcatgtatctaaaaactaaagt

SEQ ID NO: 6478 - DNA, 25 bp, Artificial sequence
  Extension Primer
atgtaagtcacttctttagaactca

SEQ ID NO: 6479 - DNA, 25 bp, Artificial sequence
  Extension Primer
aatacgcagtgaaattcacatttta

SEQ ID NO: 6480 - DNA, 25 bp, Artificial sequence
  Extension Primer
tagtgtcctgtgcctattatcatta

SEQ ID NO: 6481 - DNA, 25 bp, Artificial sequence
  Extension Primer
tggacttatttagcatsttggcctc

SEQ ID NO: 6482 - DNA, 25 bp, Artificial sequence
  Extension Primer
ttccagaaatttttttcccccttcc

SEQ ID NO: 6483 - DNA, 25 bp, Artificial sequence
  Extension Primer
aatgacatgtttaagtacaataaaa

SEQ ID NO: 6484 - DNA, 25 bp, Artificial sequence
  Extension Primer
aatgatgagtacagagaaaacaaag

SEQ ID NO: 6485 - DNA, 25 bp, Artificial sequence
  Extension Primer
accattattatttgtgaattgattg

SEQ ID NO: 6486 - DNA, 25 bp, Artificial sequence
  Extension Primer
aaatagttaacaagggtcatctttt

SEQ ID NO: 6487 - DNA, 25 bp, Artificial sequence
  Extension Primer
tagctctataggaaggccaataarg

SEQ ID NO: 6488 - DNA, 25 bp, Artificial sequence
  Extension Primer
tgaagacattcaagaaaatttaagg

SEQ ID NO: 6489 - DNA, 22 bp, Artificial sequence
  Extension Primer
agcattcagtatctatttyaca

SEQ ID NO: 6490 - DNA, 25 bp, Artificial sequence
  Extension Primer
tacacataaatcaacgctgtaaaca

SEQ ID NO: 6491 - DNA, 25 bp, Artificial sequence
  Extension Primer
tgaatcactatattgtatacctgta

SEQ ID NO: 6492 - DNA, 25 bp, Artificial sequence
  Extension Primer
tcagggaataataatgaaattcaca

SEQ ID NO: 6493 - DNA, 25 bp, Artificial sequence
  Extension Primer
ttaaaaaattcaatttaatggataa

SEQ ID NO: 6494 - DNA, 25 bp, Artificial sequence
  Extension Primer
gcaactgaaggacaatagcaacaca

SEQ ID NO: 6495 - DNA, 25 bp, Artificial sequence
  Extension Primer
aaaaccctcaaaatatcaatcactc

SEQ ID NO: 6496 - DNA, 25 bp, Artificial sequence
  Extension Primer
cctcccgtgtgtcaggctacccatg

SEQ ID NO: 6497 - DNA, 25 bp, Artificial sequence
  Extension Primer
tcaatgagtggatttccttcacaga

SEQ ID NO: 6498 - DNA, 25 bp, Artificial sequence
  Extension Primer
ccaaggcacagactgactgacagag

SEQ ID NO: 6499 - DNA, 25 bp, Artificial sequence
  Extension Primer
gggaaaawatatatagacataaagc

SEQ ID NO: 6500 - DNA, 25 bp, Artificial sequence
  Extension Primer
gtcatgctatgaaacactaaacatt

SEQ ID NO: 6501 - DNA, 25 bp, Artificial sequence
  Extension Primer
caaaggaatacagtcagaactctaa

SEQ ID NO: 6502 - DNA, 25 bp, Artificial sequence
  Extension Primer
gtcacttctattctatccaggtatg

SEQ ID NO: 6503 - DNA, 25 bp, Artificial sequence
  Extension Primer
gtgtaactactattttctttcccag

SEQ ID NO: 6504 - DNA, 25 bp, Artificial sequence
  Extension Primer
taaaataatcaacawaaagtgattt

SEQ ID NO: 6505 - DNA, 25 bp, Artificial sequence
  Extension Primer
gtcggctgtgagtcggatcatagac

SEQ ID NO: 6506 - DNA, 25 bp, Artificial sequence
  Extension Primer
ggattagaactacattggatgtgag

SEQ ID NO: 6507 - DNA, 25 bp, Artificial sequence
  Extension Primer
cagcctgggtagtgccagctgtgtg

SEQ ID NO: 6508 - DNA, 25 bp, Artificial sequence
  Extension Primer
cacgataattaagcatctcgctagt

SEQ ID NO: 6509 - DNA, 25 bp, Artificial sequence
  Extension Primer
gcacagtaagcactcctttaactta

SEQ ID NO: 6510 - DNA, 25 bp, Artificial sequence
  Extension Primer
actcaggcaagaatattcaggatta

SEQ ID NO: 6511 - DNA, 25 bp, Artificial sequence
  Extension Primer
gctgtcctaagagccctgggagtaa

SEQ ID NO: 6512 - DNA, 25 bp, Artificial sequence
  Extension Primer
taggcagctccctcgcttgccctct

SEQ ID NO: 6513 - DNA, 25 bp, Artificial sequence
  Extension Primer
atttccaacatgcctgatgcaccaa

SEQ ID NO: 6514 - DNA, 25 bp, Artificial sequence
  Extension Primer
gactaattktaagtcccgtttgtgt

SEQ ID NO: 6515 - DNA, 25 bp, Artificial sequence
  Extension Primer
tcttgtgttaggtttttgttctagg

SEQ ID NO: 6516 - DNA, 25 bp, Artificial sequence
  Extension Primer
ccatgtatggrgywctggagctttt

SEQ ID NO: 6517 - DNA, 25 bp, Artificial sequence
  Extension Primer
cacccagactgcaaggtaatcccaa

SEQ ID NO: 6518 - DNA, 25 bp, Artificial sequence
  Extension Primer
ttttactgagtggaatttgcaagag

SEQ ID NO: 6519 - DNA, 25 bp, Artificial sequence
  Extension Primer
attacaagaagtttttacccactca

SEQ ID NO: 6520 - DNA, 25 bp, Artificial sequence
  Extension Primer
tacaaaggaagtcctgtctctcata

SEQ ID NO: 6521 - DNA, 25 bp, Artificial sequence
  Extension Primer
aagaaagcacaaggaaagaaatggg

SEQ ID NO: 6522 - DNA, 25 bp, Artificial sequence
  Extension Primer
aaccgaaaccagaaagtgaaaggag

SEQ ID NO: 6523 - DNA, 25 bp, Artificial sequence
  Extension Primer
tgaggtgtttgtaaacctcatgtct

SEQ ID NO: 6524 - DNA, 25 bp, Artificial sequence
  Extension Primer
tcttcctcccctgargctgcaagag

SEQ ID NO: 6525 - DNA, 25 bp, Artificial sequence
  Extension Primer
ccaaatcttcaaccacacctgccct

SEQ ID NO: 6526 - DNA, 25 bp, Artificial sequence
  Extension Primer
gtctgtcacagacttctatcactta

SEQ ID NO: 6527 - DNA, 25 bp, Artificial sequence
  Extension Primer
gctatctcaatattgcagaaagttt

SEQ ID NO: 6528 - DNA, 25 bp, Artificial sequence
  Extension Primer
caactgtatacaccctaactaccaa

SEQ ID NO: 6529 - DNA, 25 bp, Artificial sequence
  Extension Primer
ggacatagctcagagaagccgagaa

SEQ ID NO: 6530 - DNA, 22 bp, Artificial sequence
  Extension Primer
acttgtgtctgttttacttact

SEQ ID NO: 6531 - DNA, 25 bp, Artificial sequence
  Extension Primer
acactcagggttttctgtttattaa

SEQ ID NO: 6532 - DNA, 25 bp, Artificial sequence
  Extension Primer
acttttactgccttcacattactgc

SEQ ID NO: 6533 - DNA, 25 bp, Artificial sequence
  Extension Primer
cgtggatttcccctgaaataataaa

SEQ ID NO: 6534 - DNA, 25 bp, Artificial sequence
  Extension Primer
aaattctccttgattcttttacttc

SEQ ID NO: 6535 - DNA, 25 bp, Artificial sequence
  Extension Primer
tggcttccaggttcttctattgtgt

SEQ ID NO: 6536 - DNA, 25 bp, Artificial sequence
  Extension Primer
ggaatacgttaggcatattggtaag

SEQ ID NO: 6537 - DNA, 25 bp, Artificial sequence
  Extension Primer
tcctctttgtaggttatcatcagta

SEQ ID NO: 6538 - DNA, 25 bp, Artificial sequence
  Extension Primer
ttatgcccttgctttcagcccacaa

SEQ ID NO: 6539 - DNA, 25 bp, Artificial sequence
  Extension Primer
gattagagagtcctagacatgattt

SEQ ID NO: 6540 - DNA, 25 bp, Artificial sequence
  Extension Primer
acaatcagcaaggaaatggactcaa

SEQ ID NO: 6541 - DNA, 25 bp, Artificial sequence
  Extension Primer
ttctctgcatttcttaatgaagtts

SEQ ID NO: 6542 - DNA, 25 bp, Artificial sequence
  Extension Primer
tagaaaattttactcgcacaggata

SEQ ID NO: 6543 - DNA, 25 bp, Artificial sequence
  Extension Primer
cactgaggacaatagaagaaataac

SEQ ID NO: 6544 - DNA, 25 bp, Artificial sequence
  Extension Primer
agggaagtggaggttgaataaaaga

SEQ ID NO: 6545 - DNA, 25 bp, Artificial sequence
  Extension Primer
atagaygaaatacggaggaagaggg

SEQ ID NO: 6546 - DNA, 25 bp, Artificial sequence
  Extension Primer
ttctttggcaattggtagttatggg

SEQ ID NO: 6547 - DNA, 25 bp, Artificial sequence
  Extension Primer
tcaaggattgaaggggaaggaaaag

SEQ ID NO: 6548 - DNA, 25 bp, Artificial sequence
  Extension Primer
atcacagaaaatttcccagggaaca

SEQ ID NO: 6549 - DNA, 25 bp, Artificial sequence
  Extension Primer
acagcttatctttttatgtagtccc

SEQ ID NO: 6550 - DNA, 25 bp, Artificial sequence
  Extension Primer
ggctgaagcttaaatcagaaaaccc

SEQ ID NO: 6551 - DNA, 25 bp, Artificial sequence
  Extension Primer
gcatgtaactcagaagaagatggaa

SEQ ID NO: 6552 - DNA, 25 bp, Artificial sequence
  Extension Primer
ttttaccaaaattatactcatatcg

SEQ ID NO: 6553 - DNA, 25 bp, Artificial sequence
  Extension Primer
aaattcccttctttttgacctttat

SEQ ID NO: 6554 - DNA, 25 bp, Artificial sequence
  Extension Primer
ccttctgccagcgcgagcacctcct

SEQ ID NO: 6555 - DNA, 25 bp, Artificial sequence
  Extension Primer
ggcgtgggggcgctggggcacggtc

SEQ ID NO: 6556 - DNA, 25 bp, Artificial sequence
  Extension Primer
caggtatacagagaaacagagggcg

SEQ ID NO: 6557 - DNA, 25 bp, Artificial sequence
  Extension Primer
cgaagcgcacrcagagggggccctg

SEQ ID NO: 6558 - DNA, 25 bp, Artificial sequence
  Extension Primer
agaagctctgggacttggagtgaag

SEQ ID NO: 6559 - DNA, 25 bp, Artificial sequence
  Extension Primer
tgcagagctggagacaagggcctca

SEQ ID NO: 6560 - DNA, 25 bp, Artificial sequence
  Extension Primer
ggttgtgagaattaaaagagctata

SEQ ID NO: 6561 - DNA, 25 bp, Artificial sequence
  Extension Primer
aagctggggccagagaaattacatt

SEQ ID NO: 6562 - DNA, 25 bp, Artificial sequence
  Extension Primer
ctttcctgaccatttccttgagcaa

SEQ ID NO: 6563 - DNA, 25 bp, Artificial sequence
  Extension Primer
gaaggataaggggtgcctcccgctg

SEQ ID NO: 6564 - DNA, 25 bp, Artificial sequence
  Extension Primer
tgctcttgatctcccttaccttgtg

SEQ ID NO: 6565 - DNA, 22 bp, Artificial sequence
  Extension Primer
agaagacaagtaaataggcttt

SEQ ID NO: 6566 - DNA, 25 bp, Artificial sequence
  Extension Primer
atcacaatgaaagaactctaactca

SEQ ID NO: 6567 - DNA, 25 bp, Artificial sequence
  Extension Primer
accagaatgtagaggaagaggagga

SEQ ID NO: 6568 - DNA, 25 bp, Artificial sequence
  Extension Primer
acaaccttagaggccttgaggaagc

SEQ ID NO: 6569 - DNA, 25 bp, Artificial sequence
  Extension Primer
ggcaatccatagtatacaaaccaga

SEQ ID NO: 6570 - DNA, 25 bp, Artificial sequence
  Extension Primer
gagaagaaaccragctatatcacct

SEQ ID NO: 6571 - DNA, 25 bp, Artificial sequence
  Extension Primer
aatctgagtaaggctgaaagagctg

SEQ ID NO: 6572 - DNA, 25 bp, Artificial sequence
  Extension Primer
aaactttgtgcttatcttcttcctt

SEQ ID NO: 6573 - DNA, 25 bp, Artificial sequence
  Extension Primer
aataacaaacagtagtaataagtct

SEQ ID NO: 6574 - DNA, 25 bp, Artificial sequence
  Extension Primer
gttagtgagagataatgggataaga

SEQ ID NO: 6575 - DNA, 25 bp, Artificial sequence
  Extension Primer
tcctcagctataaaattcctctcta

SEQ ID NO: 6576 - DNA, 25 bp, Artificial sequence
  Extension Primer
tggacaggctattcctgacttcttc

SEQ ID NO: 6577 - DNA, 25 bp, Artificial sequence
  Extension Primer
gaagaagccccagccaagggtatta

SEQ ID NO: 6578 - DNA, 25 bp, Artificial sequence
  Extension Primer
tggggaaaataattttgyttaacta

SEQ ID NO: 6579 - DNA, 25 bp, Artificial sequence
  Extension Primer
agtacctgcaagatgttcttaggga

SEQ ID NO: 6580 - DNA, 25 bp, Artificial sequence
  Extension Primer
gagggggtgcagtattgaacagata

SEQ ID NO: 6581 - DNA, 25 bp, Artificial sequence
  Extension Primer
gaatgatgatctctagrtccatcca

SEQ ID NO: 6582 - DNA, 25 bp, Artificial sequence
  Extension Primer
cgatcaaaaataagggacaaggaaa

SEQ ID NO: 6583 - DNA, 25 bp, Artificial sequence
  Extension Primer
tgtagtgactactgaaccagttggc

SEQ ID NO: 6584 - DNA, 25 bp, Artificial sequence
  Extension Primer
gctggaactaagtgtttgcatgccg

SEQ ID NO: 6585 - DNA, 25 bp, Artificial sequence
  Extension Primer
tcccagacctgggagaacttgatca

SEQ ID NO: 6586 - DNA, 25 bp, Artificial sequence
  Extension Primer
cgttggccttctgggcagcctccac

SEQ ID NO: 6587 - DNA, 25 bp, Artificial sequence
  Extension Primer
ccaccaagtaggctccctgggtgtt

SEQ ID NO: 6588 - DNA, 25 bp, Artificial sequence
  Extension Primer
ttctcagtctccaccctggaccttc

SEQ ID NO: 6589 - DNA, 22 bp, Artificial sequence
  Extension Primer
wgagtatctaactattgagagg

SEQ ID NO: 6590 - DNA, 25 bp, Artificial sequence
  Extension Primer
ttctctaaygctgccggtgccaaag

SEQ ID NO: 6591 - DNA, 25 bp, Artificial sequence
  Extension Primer
ctgtgttcccatggtgcccacctga

SEQ ID NO: 6592 - DNA, 25 bp, Artificial sequence
  Extension Primer
aggagctttccccagggatcccaaa

SEQ ID NO: 6593 - DNA, 25 bp, Artificial sequence
  Extension Primer
agatgagaggtaaccagtagctgac

SEQ ID NO: 6594 - DNA, 25 bp, Artificial sequence
  Extension Primer
ccactctaatccattcctccctctt

SEQ ID NO: 6595 - DNA, 25 bp, Artificial sequence
  Extension Primer
cccccttcacctgtttctctactgc

SEQ ID NO: 6596 - DNA, 25 bp, Artificial sequence
  Extension Primer
tataggaaacccacttatggagata

SEQ ID NO: 6597 - DNA, 25 bp, Artificial sequence
  Extension Primer
gcatcccgctaacatgctcccctga

SEQ ID NO: 6598 - DNA, 25 bp, Artificial sequence
  Extension Primer
caatggctttttgtattcagaaaac

SEQ ID NO: 6599 - DNA, 25 bp, Artificial sequence
  Extension Primer
caaatcagctggactccacctttcc

SEQ ID NO: 6600 - DNA, 25 bp, Artificial sequence
  Extension Primer
acctaagacctgtttcttccacttc

SEQ ID NO: 6601 - DNA, 25 bp, Artificial sequence
  Extension Primer
ttgctttctgtgttatattttgttt

SEQ ID NO: 6602 - DNA, 25 bp, Artificial sequence
  Extension Primer
gagactccactgagagggtagggmc

SEQ ID NO: 6603 - DNA, 25 bp, Artificial sequence
  Extension Primer
gagcacagagagcctggcaaatctg

SEQ ID NO: 6604 - DNA, 25 bp, Artificial sequence
  Extension Primer
gatggaccacatgactgttcacarc

SEQ ID NO: 6605 - DNA, 25 bp, Artificial sequence
  Extension Primer
ccctccttacctagtcaaaagatgg

SEQ ID NO: 6606 - DNA, 25 bp, Artificial sequence
  Extension Primer
ttggttcctagcacacagtctcagt

SEQ ID NO: 6607 - DNA, 25 bp, Artificial sequence
  Extension Primer
aacaatccaataaagtaacactgtc

SEQ ID NO: 6608 - DNA, 25 bp, Artificial sequence
  Extension Primer
ggaggtataaggtctcacaatcaga

SEQ ID NO: 6609 - DNA, 25 bp, Artificial sequence
  Extension Primer
ggttctggcaagaacaccaaatgga

SEQ ID NO: 6610 - DNA, 25 bp, Artificial sequence
  Extension Primer
tggcctcagagtcatgccctatcct

SEQ ID NO: 6611 - DNA, 25 bp, Artificial sequence
  Extension Primer
cttccttcctctccttcccccaacc

SEQ ID NO: 6612 - DNA, 25 bp, Artificial sequence
  Extension Primer
aaaagagtaagacatgacttagcaa

SEQ ID NO: 6613 - DNA, 25 bp, Artificial sequence
  Extension Primer
ggtaattggctgtggctgagggagc

SEQ ID NO: 6614 - DNA, 25 bp, Artificial sequence
  Extension Primer
ttgtttgttccsacgggagttagga

SEQ ID NO: 6615 - DNA, 25 bp, Artificial sequence
  Extension Primer
aaatgagagtggtgagcagacctaa

SEQ ID NO: 6616 - DNA, 25 bp, Artificial sequence
  Extension Primer
ggaaactaagagtctytaaatccct

SEQ ID NO: 6617 - DNA, 25 bp, Artificial sequence
  Extension Primer
ctctcctggccccactggtggccct

SEQ ID NO: 6618 - DNA, 25 bp, Artificial sequence
  Extension Primer
accttcygaatcaaaactgggagca

SEQ ID NO: 6619 - DNA, 25 bp, Artificial sequence
  Extension Primer
ttttatggatgagaaaattcagcct

SEQ ID NO: 6620 - DNA, 25 bp, Artificial sequence
  Extension Primer
tgggattcccacaccccagccccga

SEQ ID NO: 6621 - DNA, 25 bp, Artificial sequence
  Extension Primer
cctggaacttcttcccaccgcagcc

SEQ ID NO: 6622 - DNA, 22 bp, Artificial sequence
  Extension Primer
ccaagacatgtgcttgacggca

SEQ ID NO: 6623 - DNA, 25 bp, Artificial sequence
  Extension Primer
ttcgtgtatgagcttatctgtcacc

SEQ ID NO: 6624 - DNA, 25 bp, Artificial sequence
  Extension Primer
tactggacatgctgcttttacttaa

SEQ ID NO: 6625 - DNA, 25 bp, Artificial sequence
  Extension Primer
aaaagatgctcatatgctcactttg

SEQ ID NO: 6626 - DNA, 25 bp, Artificial sequence
  Extension Primer
catagtccatgtcctgaacctctgc

SEQ ID NO: 6627 - DNA, 25 bp, Artificial sequence
  Extension Primer
agtaaattgatgaacttagaaattc

SEQ ID NO: 6628 - DNA, 25 bp, Artificial sequence
  Extension Primer
cttgtgtttttccctctctaataaa

SEQ ID NO: 6629 - DNA, 25 bp, Artificial sequence
  Extension Primer
ttagttgttggaawgtattctttta

SEQ ID NO: 6630 - DNA, 25 bp, Artificial sequence
  Extension Primer
gccrcctcattaacaacaaaagaca

SEQ ID NO: 6631 - DNA, 25 bp, Artificial sequence
  Extension Primer
aaaattgaaaatcctttccrtgttt

SEQ ID NO: 6632 - DNA, 25 bp, Artificial sequence
  Extension Primer
taggtgcctgagacatgaaaatgaa

SEQ ID NO: 6633 - DNA, 25 bp, Artificial sequence
  Extension Primer
agtagcatttggtcttatactamga

SEQ ID NO: 6634 - DNA, 25 bp, Artificial sequence
  Extension Primer
aaagctcttacattttagacagtaa

SEQ ID NO: 6635 - DNA, 25 bp, Artificial sequence
  Extension Primer
aattgaagcatcagcgcaccactgt

SEQ ID NO: 6636 - DNA, 25 bp, Artificial sequence
  Extension Primer
tcagaaggaggaatagctagtctgt

SEQ ID NO: 6637 - DNA, 25 bp, Artificial sequence
  Extension Primer
gagttaataaataacctggagcttt

SEQ ID NO: 6638 - DNA, 25 bp, Artificial sequence
  Extension Primer
gaactgtttgtgtaaatacttacta

SEQ ID NO: 6639 - DNA, 25 bp, Artificial sequence
  Extension Primer
gtatttagataaacatgaygaatat

SEQ ID NO: 6640 - DNA, 25 bp, Artificial sequence
  Extension Primer
tttcaaccaccattgyccctaytct

SEQ ID NO: 6641 - DNA, 25 bp, Artificial sequence
  Extension Primer
tcacttctattctatccaggtatgm

SEQ ID NO: 6642 - DNA, 25 bp, Artificial sequence
  Extension Primer
tggcagacacagtactttcttttat

SEQ ID NO: 6643 - DNA, 25 bp, Artificial sequence
  Extension Primer
cttccgctcactccctactcctctc

SEQ ID NO: 6644 - DNA, 25 bp, Artificial sequence
  Extension Primer
gcttagtttacatgttttcatacaa

SEQ ID NO: 6645 - DNA, 25 bp, Artificial sequence
  Extension Primer
acagacactctggacatttttaata

SEQ ID NO: 6646 - DNA, 25 bp, Artificial sequence
  Extension Primer
gtattatggtgcccataatgattaa

SEQ ID NO: 6647 - DNA, 25 bp, Artificial sequence
  Extension Primer
gctttaacacttgaaattctcttct

SEQ ID NO: 6648 - DNA, 25 bp, Artificial sequence
  Extension Primer
gaacacagaaatgcaaaaaactagc

SEQ ID NO: 6649 - DNA, 25 bp, Artificial sequence
  Extension Primer
gaaaaaaattaaagcattttaactg

SEQ ID NO: 6650 - DNA, 25 bp, Artificial sequence
  Extension Primer
tttgctcctttattgcttgtccaag

SEQ ID NO: 6651 - DNA, 25 bp, Artificial sequence
  Extension Primer
taatggatgaaattctacaacaaaa

SEQ ID NO: 6652 - DNA, 25 bp, Artificial sequence
  Extension Primer
gtatttttttctctcttctactttg

SEQ ID NO: 6653 - DNA, 25 bp, Artificial sequence
  Extension Primer
ggagctaagaaatgggactcttatt

SEQ ID NO: 6654 - DNA, 25 bp, Artificial sequence
  Extension Primer
atttgtctatcacaaatggcaaaaa

SEQ ID NO: 6655 - DNA, 25 bp, Artificial sequence
  Extension Primer
atgaaaaatgtaccagaactcagtg

SEQ ID NO: 6656 - DNA, 25 bp, Artificial sequence
  Extension Primer
cataacaatgcaaatatacttaaca

SEQ ID NO: 6657 - DNA, 25 bp, Artificial sequence
  Extension Primer
ccaggtttgagacttaaacttgact

SEQ ID NO: 6658 - DNA, 25 bp, Artificial sequence
  Extension Primer
taaaaaatctcaagcacagatcctt

SEQ ID NO: 6659 - DNA, 25 bp, Artificial sequence
  Extension Primer
gatttgtaattcttttagtaaatac

SEQ ID NO: 6660 - DNA, 25 bp, Artificial sequence
  Extension Primer
atagaaagrcacatagacccttacg

SEQ ID NO: 6661 - DNA, 25 bp, Artificial sequence
  Extension Primer
ggcctgatgttcctggtactatctt

SEQ ID NO: 6662 - DNA, 25 bp, Artificial sequence
  Extension Primer
ttctggtggcagaatcaggctcata

SEQ ID NO: 6663 - DNA, 25 bp, Artificial sequence
  Extension Primer
gaagcaaagacaaaaagtcagatgc

SEQ ID NO: 6664 - DNA, 25 bp, Artificial sequence
  Extension Primer
ttgtgaaagtagcaaccatcaataa

SEQ ID NO: 6665 - DNA, 25 bp, Artificial sequence
  Extension Primer
ggtagatatggaaaggaaaaggaag

SEQ ID NO: 6666 - DNA, 25 bp, Artificial sequence
  Extension Primer
agttgctacctaccacacagaccta

SEQ ID NO: 6667 - DNA, 25 bp, Artificial sequence
  Extension Primer
attggtatgaggagtgaaaaggtca

SEQ ID NO: 6668 - DNA, 25 bp, Artificial sequence
  Extension Primer
gttacatattcctacggtcaaacct

SEQ ID NO: 6669 - DNA, 25 bp, Artificial sequence
  Extension Primer
attcttygtaagttgaatatagggc

SEQ ID NO: 6670 - DNA, 25 bp, Artificial sequence
  Extension Primer
gagttatcacctkcgatcctgtctt

SEQ ID NO: 6671 - DNA, 22 bp, Artificial sequence
  Extension Primer
cagtctgtyagtgagctgtgat

SEQ ID NO: 6672 - DNA, 25 bp, Artificial sequence
  Extension Primer
cttccactcccactgtctctcgtta

SEQ ID NO: 6673 - DNA, 25 bp, Artificial sequence
  Extension Primer
agtagagcaagggtamtccctcttc

SEQ ID NO: 6674 - DNA, 25 bp, Artificial sequence
  Extension Primer
ggggcggctggtgaacacygtctgc

SEQ ID NO: 6675 - DNA, 25 bp, Artificial sequence
  Extension Primer
ggtattttgctctgggccatctcta

SEQ ID NO: 6676 - DNA, 25 bp, Artificial sequence
  Extension Primer
ctgccccagaacgcttcccytactc

SEQ ID NO: 6677 - DNA, 25 bp, Artificial sequence
  Extension Primer
tctctcacgatgaaaatagaacckg

SEQ ID NO: 6678 - DNA, 25 bp, Artificial sequence
  Extension Primer
cttggtttggttgctggtcaaactg

SEQ ID NO: 6679 - DNA, 25 bp, Artificial sequence
  Extension Primer
ctctgaaggaaggaattctgtcttg

SEQ ID NO: 6680 - DNA, 25 bp, Artificial sequence
  Extension Primer
agcatcctccttttctctgctcctc

SEQ ID NO: 6681 - DNA, 25 bp, Artificial sequence
  Extension Primer
aacagtcaagtctcatctgagtcca

SEQ ID NO: 6682 - DNA, 25 bp, Artificial sequence
  Extension Primer
aaccctggctagcacatctttagaa

SEQ ID NO: 6683 - DNA, 25 bp, Artificial sequence
  Extension Primer
ctgcttgagagaggctgaagagayg

SEQ ID NO: 6684 - DNA, 25 bp, Artificial sequence
  Extension Primer
atgcaggaratgttaaaggtggagg

SEQ ID NO: 6685 - DNA, 25 bp, Artificial sequence
  Extension Primer
tgaggtatttccttatgtaagactt

SEQ ID NO: 6686 - DNA, 25 bp, Artificial sequence
  Extension Primer
ctttccagtagtatccccttctttt

SEQ ID NO: 6687 - DNA, 25 bp, Artificial sequence
  Extension Primer
gctgttcataggccagcacctgttc

SEQ ID NO: 6688 - DNA, 25 bp, Artificial sequence
  Extension Primer
gaggcgccagcaccgtaaytgttct

SEQ ID NO: 6689 - DNA, 25 bp, Artificial sequence
  Extension Primer
tctggggccgagttgtagcaatgat

SEQ ID NO: 6690 - DNA, 25 bp, Artificial sequence
  Extension Primer
ggccaagtgtgatgcccttgttaca

SEQ ID NO: 6691 - DNA, 25 bp, Artificial sequence
  Extension Primer
atctcagcatgtcacactccctgtt

SEQ ID NO: 6692 - DNA, 25 bp, Artificial sequence
  Extension Primer
gacactgagccagcagatgccacaa

SEQ ID NO: 6693 - DNA, 25 bp, Artificial sequence
  Extension Primer
gatccctgtctcttttttgctaaca

SEQ ID NO: 6694 - DNA, 25 bp, Artificial sequence
  Extension Primer
acaaacattatttgagaccacaagc

SEQ ID NO: 6695 - DNA, 25 bp, Artificial sequence
  Extension Primer
acccaagtgttcaaagactcacagc

SEQ ID NO: 6696 - DNA, 25 bp, Artificial sequence
  Extension Primer
attttagytccccagagactgaacg

SEQ ID NO: 6697 - DNA, 25 bp, Artificial sequence
  Extension Primer
ttttttctgctcacgtccttccctc

SEQ ID NO: 6698 - DNA, 25 bp, Artificial sequence
  Extension Primer
gaacctgtgccctgcagtggaagca

SEQ ID NO: 6699 - DNA, 25 bp, Artificial sequence
  Extension Primer
ggatggcgcgagtygcccttcactg

SEQ ID NO: 6700 - DNA, 25 bp, Artificial sequence
  Extension Primer
tccagtggccatgaattcccatcct

SEQ ID NO: 6701 - DNA, 25 bp, Artificial sequence
  Extension Primer
ttyacaggttcaacaacagagatca

SEQ ID NO: 6702 - DNA, 25 bp, Artificial sequence
  Extension Primer
gggctccaaggtgaagcacaagatc

SEQ ID NO: 6703 - DNA, 25 bp, Artificial sequence
  Extension Primer
cctttttctgagccctgaatggtgg

SEQ ID NO: 6704 - DNA, 25 bp, Artificial sequence
  Extension Primer
ttgcacttggagcagaggagtcagc

SEQ ID NO: 6705 - DNA, 25 bp, Artificial sequence
  Extension Primer
tgcgatgccaactgcctgtcagaaa

SEQ ID NO: 6706 - DNA, 25 bp, Artificial sequence
  Extension Primer
ggttgtgggctacatggagttcata

SEQ ID NO: 6707 - DNA, 25 bp, Artificial sequence
  Extension Primer
taatcccagactggaccacccactc

SEQ ID NO: 6708 - DNA, 25 bp, Artificial sequence
  Extension Primer
csaagcacagtgccaccacattctt

SEQ ID NO: 6709 - DNA, 25 bp, Artificial sequence
  Extension Primer
tccacagatgcggctgcagcagtcc

SEQ ID NO: 6710 - DNA, 25 bp, Artificial sequence
  Extension Primer
ctctctgcaaatggcaggcaggggt

SEQ ID NO: 6711 - DNA, 25 bp, Artificial sequence
  Extension Primer
cccgtctgcccttaactttttyccc

SEQ ID NO: 6712 - DNA, 25 bp, Artificial sequence
  Extension Primer
gcgatattcatctgtaaataggaaa

SEQ ID NO: 6713 - DNA, 25 bp, Artificial sequence
  Extension Primer
aaggtccacaggcargcgcctcgtg

SEQ ID NO: 6714 - DNA, 25 bp, Artificial sequence
  Extension Primer
tggtcagccttggctagcaggcatg

SEQ ID NO: 6715 - DNA, 25 bp, Artificial sequence
  Extension Primer
gttcaccttgaggctttcatgccag

SEQ ID NO: 6716 - DNA, 25 bp, Artificial sequence
  Extension Primer
ggcaaggagtcgaggatcaaaggac

SEQ ID NO: 6717 - DNA, 25 bp, Artificial sequence
  Extension Primer
ccgtggggtttcaaagagttggaca

SEQ ID NO: 6718 - DNA, 25 bp, Artificial sequence
  Extension Primer
ctaaaggtgatgaaaatgaagtccc

SEQ ID NO: 6719 - DNA, 25 bp, Artificial sequence
  Extension Primer
ggctctctggcatggagttaccaag

SEQ ID NO: 6720 - DNA, 25 bp, Artificial sequence
  Extension Primer
agctcctttgaaagccacttgctgg

SEQ ID NO: 6721 - DNA, 25 bp, Artificial sequence
  Extension Primer
ttatgtggagaaactcagctcagcc

SEQ ID NO: 6722 - DNA, 25 bp, Artificial sequence
  Extension Primer
agtacaggctgcagatcagcatcac

SEQ ID NO: 6723 - DNA, 25 bp, Artificial sequence
  Extension Primer
tggaattttctatttgtgacaatgg

SEQ ID NO: 6724 - DNA, 25 bp, Artificial sequence
  Extension Primer
tttcagtaaatttggcttaagtaca

SEQ ID NO: 6725 - DNA, 25 bp, Artificial sequence
  Extension Primer
ttactttatttttaattgaaggata

SEQ ID NO: 6726 - DNA, 25 bp, Artificial sequence
  Extension Primer
tgaccttctacagagaagtgcttta

SEQ ID NO: 6727 - DNA, 25 bp, Artificial sequence
  Extension Primer
ttaatttttcctatttcaaataaca

SEQ ID NO: 6728 - DNA, 25 bp, Artificial sequence
  Extension Primer
tagtattcatcataaacaaagacag

SEQ ID NO: 6729 - DNA, 25 bp, Artificial sequence
  Extension Primer
tccaacagctaaagtctttttttcc

SEQ ID NO: 6730 - DNA, 25 bp, Artificial sequence
  Extension Primer
gaaactctcgattcacagaytacag

SEQ ID NO: 6731 - DNA, 25 bp, Artificial sequence
  Extension Primer
attcattgtgttccaagggtttttt

SEQ ID NO: 6732 - DNA, 25 bp, Artificial sequence
  Extension Primer
tagaaagggaggactcaattctcaa

SEQ ID NO: 6733 - DNA, 25 bp, Artificial sequence
  Extension Primer
agaggtccagatgttagctcgtgac

SEQ ID NO: 6734 - DNA, 25 bp, Artificial sequence
  Extension Primer
taaacatcagacagtcagtacaatt

SEQ ID NO: 6735 - DNA, 25 bp, Artificial sequence
  Extension Primer
ctcttatragtagtaggttacttta

SEQ ID NO: 6736 - DNA, 25 bp, Artificial sequence
  Extension Primer
cttctaatgtattttctgttctttt

SEQ ID NO: 6737 - DNA, 25 bp, Artificial sequence
  Extension Primer
gcaaaaagtcagatttgcaggactg

SEQ ID NO: 6738 - DNA, 25 bp, Artificial sequence
  Extension Primer
gacaaataggaaaattcagtaaatt

SEQ ID NO: 6739 - DNA, 25 bp, Artificial sequence
  Extension Primer
tttgctctgccccgttttccataat

SEQ ID NO: 6740 - DNA, 25 bp, Artificial sequence
  Extension Primer
tacattcacattgttttgtaactat

SEQ ID NO: 6741 - DNA, 25 bp, Artificial sequence
  Extension Primer
agggatggaatgtttcccaggaata

SEQ ID NO: 6742 - DNA, 25 bp, Artificial sequence
  Extension Primer
aagatgaaatgaactaaagrtatgt

SEQ ID NO: 6743 - DNA, 25 bp, Artificial sequence
  Extension Primer
taacaaaatgcrtattacagagtca

SEQ ID NO: 6744 - DNA, 25 bp, Artificial sequence
  Extension Primer
tgctgtacagcagaaaccaacayag

SEQ ID NO: 6745 - DNA, 25 bp, Artificial sequence
  Extension Primer
tcatgctgaatcagtggcaattacc

SEQ ID NO: 6746 - DNA, 25 bp, Artificial sequence
  Extension Primer
catagatgtatgtatgtatgtattt

SEQ ID NO: 6747 - DNA, 25 bp, Artificial sequence
  Extension Primer
catgatagggatccttacagcctca

SEQ ID NO: 6748 - DNA, 25 bp, Artificial sequence
  Extension Primer
ttagcccacagaaaggaaggctgaa

SEQ ID NO: 6749 - DNA, 25 bp, Artificial sequence
  Extension Primer
taagtaagacagtaaaggaatgaaa

SEQ ID NO: 6750 - DNA, 25 bp, Artificial sequence
  Extension Primer
acgccaatttccaagaacttctaca

SEQ ID NO: 6751 - DNA, 25 bp, Artificial sequence
  Extension Primer
tcagtatgtagtattacttaggctt

SEQ ID NO: 6752 - DNA, 25 bp, Artificial sequence
  Extension Primer
ctactctctcagcaaatttatatta

SEQ ID NO: 6753 - DNA, 25 bp, Artificial sequence
  Extension Primer
cattgtgttcaatactttacttaca

SEQ ID NO: 6754 - DNA, 25 bp, Artificial sequence
  Extension Primer
gggagccagggcacagttcgtaaaa

SEQ ID NO: 6755 - DNA, 25 bp, Artificial sequence
  Extension Primer
atcagaaagaaacgattcccatgaa

SEQ ID NO: 6756 - DNA, 25 bp, Artificial sequence
  Extension Primer
ctagaaattatagcaacagaattga

SEQ ID NO: 6757 - DNA, 25 bp, Artificial sequence
  Extension Primer
gttccctgagcacagtgagctctct

SEQ ID NO: 6758 - DNA, 25 bp, Artificial sequence
  Extension Primer
ttaggttagtgagcgtatttcttaa

SEQ ID NO: 6759 - DNA, 25 bp, Artificial sequence
  Extension Primer
cttagagggaagatcattatcatca

SEQ ID NO: 6760 - DNA, 25 bp, Artificial sequence
  Extension Primer
aaatgtatgcaaaactctttgaaaa

SEQ ID NO: 6761 - DNA, 25 bp, Artificial sequence
  Extension Primer
aatacaaatccaactgctcttcttt

SEQ ID NO: 6762 - DNA, 25 bp, Artificial sequence
  Extension Primer
tccattctgcagaactggaaaaact

SEQ ID NO: 6763 - DNA, 25 bp, Artificial sequence
  Extension Primer
gcaagagaatgatgaacaaaccaga

SEQ ID NO: 6764 - DNA, 25 bp, Artificial sequence
  Extension Primer
tccttttctttagtctctctactct

SEQ ID NO: 6765 - DNA, 25 bp, Artificial sequence
  Extension Primer
tayagtacagctaacgtgatcatgc

SEQ ID NO: 6766 - DNA, 25 bp, Artificial sequence
  Extension Primer
ctaaaggcacataaatcwagttacg

SEQ ID NO: 6767 - DNA, 25 bp, Artificial sequence
  Extension Primer
catctgtacaatgttataattctag

SEQ ID NO: 6768 - DNA, 25 bp, Artificial sequence
  Extension Primer
tatcttcttttttaaaagtaatacc

SEQ ID NO: 6769 - DNA, 25 bp, Artificial sequence
  Extension Primer
ctaaagctcttgcacgctyaataga

SEQ ID NO: 6770 - DNA, 25 bp, Artificial sequence
  Extension Primer
agttacygaaagaacatcattggtc

SEQ ID NO: 6771 - DNA, 25 bp, Artificial sequence
  Extension Primer
ggaaggaaaagaatatgtatggaaa

SEQ ID NO: 6772 - DNA, 25 bp, Artificial sequence
  Extension Primer
cattttaccaattttaattgtagcc

SEQ ID NO: 6773 - DNA, 25 bp, Artificial sequence
  Extension Primer
ttgctgggcacatttagaaaaaaat

SEQ ID NO: 6774 - DNA, 25 bp, Artificial sequence
  Extension Primer
agagctcttagtaaatctgtaatca

SEQ ID NO: 6775 - DNA, 25 bp, Artificial sequence
  Extension Primer
cttcaagctaaagagggataagaat

SEQ ID NO: 6776 - DNA, 25 bp, Artificial sequence
  Extension Primer
ctgctgagccaacgagccaccaatt

SEQ ID NO: 6777 - DNA, 25 bp, Artificial sequence
  Extension Primer
tcctctatgaaacctgaagccataa

SEQ ID NO: 6778 - DNA, 25 bp, Artificial sequence
  Extension Primer
agttctgtgtcatggaacaatgtat

SEQ ID NO: 6779 - DNA, 25 bp, Artificial sequence
  Extension Primer
ctagctcataccagtatggcatgac

SEQ ID NO: 6780 - DNA, 25 bp, Artificial sequence
  Extension Primer
cagagagccagggtacgggttagac

SEQ ID NO: 6781 - DNA, 25 bp, Artificial sequence
  Extension Primer
ctgccccagggcctttgcacagact

SEQ ID NO: 6782 - DNA, 25 bp, Artificial sequence
  Extension Primer
gaccagcaagtggaattgaggtgac

SEQ ID NO: 6783 - DNA, 25 bp, Artificial sequence
  Extension Primer
gcagccttcagcaaaagagattaaa

SEQ ID NO: 6784 - DNA, 25 bp, Artificial sequence
  Extension Primer
accggcatagaggaaacttcatcta

SEQ ID NO: 6785 - DNA, 25 bp, Artificial sequence
  Extension Primer
atatcacccttgttgggattctaac

SEQ ID NO: 6786 - DNA, 25 bp, Artificial sequence
  Extension Primer
gaaartcagtgtcacaccaaataaa

SEQ ID NO: 6787 - DNA, 25 bp, Artificial sequence
  Extension Primer
actgtcaactagatctggggagtcc

SEQ ID NO: 6788 - DNA, 25 bp, Artificial sequence
  Extension Primer
tggatgccatagcagcagagtaagg

SEQ ID NO: 6789 - DNA, 25 bp, Artificial sequence
  Extension Primer
tccttccctcgtggcagctgttgtc

SEQ ID NO: 6790 - DNA, 25 bp, Artificial sequence
  Extension Primer
gcatcccagtctccaggtccttcac

SEQ ID NO: 6791 - DNA, 25 bp, Artificial sequence
  Extension Primer
ggatttcatggtgatttcctgatgg

SEQ ID NO: 6792 - DNA, 25 bp, Artificial sequence
  Extension Primer
atcagagttctgacaaaggagatac

SEQ ID NO: 6793 - DNA, 25 bp, Artificial sequence
  Extension Primer
atgctgctgctgctgctgctaagtc

SEQ ID NO: 6794 - DNA, 25 bp, Artificial sequence
  Extension Primer
agtggcgttggggtaaactgcttga

SEQ ID NO: 6795 - DNA, 25 bp, Artificial sequence
  Extension Primer
caggatggtcacagtggtgcggttt

SEQ ID NO: 6796 - DNA, 25 bp, Artificial sequence
  Extension Primer
cttttgaagctggctcttaaaaatt

SEQ ID NO: 6797 - DNA, 25 bp, Artificial sequence
  Extension Primer
gtgagtcttcagaccctgactgaca

SEQ ID NO: 6798 - DNA, 25 bp, Artificial sequence
  Extension Primer
gagaggcagagacacacacacccag

SEQ ID NO: 6799 - DNA, 25 bp, Artificial sequence
  Extension Primer
tcttaaccttgtcctgtcccttgct

SEQ ID NO: 6800 - DNA, 22 bp, Artificial sequence
  Extension Primer
aagatcatcacactgaggtcag

SEQ ID NO: 6801 - DNA, 25 bp, Artificial sequence
  Extension Primer
aatttgggractcattttgagacca

SEQ ID NO: 6802 - DNA, 25 bp, Artificial sequence
  Extension Primer
atgctgtggagaccacacagcagac

SEQ ID NO: 6803 - DNA, 25 bp, Artificial sequence
  Extension Primer
gagacagggaaatcagggaaccaga

SEQ ID NO: 6804 - DNA, 25 bp, Artificial sequence
  Extension Primer
cattcctgacctcactgtttgactc

SEQ ID NO: 6805 - DNA, 25 bp, Artificial sequence
  Extension Primer
tttggattgattgatcacaagtgga

SEQ ID NO: 6806 - DNA, 25 bp, Artificial sequence
  Extension Primer
actagatgtccttgggtgagcgggg

SEQ ID NO: 6807 - DNA, 25 bp, Artificial sequence
  Extension Primer
gaagaggcacagagaggcagaagga

SEQ ID NO: 6808 - DNA, 25 bp, Artificial sequence
  Extension Primer
actggaggcttaaatgggacattgc

SEQ ID NO: 6809 - DNA, 25 bp, Artificial sequence
  Extension Primer
actgtagcagttcaggagagggaca

SEQ ID NO: 6810 - DNA, 25 bp, Artificial sequence
  Extension Primer
tgtccccatcactcttcatacctac

SEQ ID NO: 6811 - DNA, 25 bp, Artificial sequence
  Extension Primer
atagcaagcctgcgaggaagggact

SEQ ID NO: 6812 - DNA, 25 bp, Artificial sequence
  Extension Primer
ggacaaaatgaagaggcaggcaggg

SEQ ID NO: 6813 - DNA, 25 bp, Artificial sequence
  Extension Primer
tacactctgggacccagcacaggac

SEQ ID NO: 6814 - DNA, 25 bp, Artificial sequence
  Extension Primer
cccagggagaagggggcggagccag

SEQ ID NO: 6815 - DNA, 25 bp, Artificial sequence
  Extension Primer
gctatccccactctatgaacgcaca

SEQ ID NO: 6816 - DNA, 25 bp, Artificial sequence
  Extension Primer
tggagccagcccacatttggacctc

SEQ ID NO: 6817 - DNA, 25 bp, Artificial sequence
  Extension Primer
agagaccacaccaagagaagccacc

SEQ ID NO: 6818 - DNA, 25 bp, Artificial sequence
  Extension Primer
attarcttgtgaacaggctcccacc

SEQ ID NO: 6819 - DNA, 25 bp, Artificial sequence
  Extension Primer
cccctagaggaggaaatggcaaccc

SEQ ID NO: 6820 - DNA, 25 bp, Artificial sequence
  Extension Primer
gcttgccaggagcagaagaatcact

SEQ ID NO: 6821 - DNA, 25 bp, Artificial sequence
  Extension Primer
ttaactaataactgacatcacaccc

SEQ ID NO: 6822 - DNA, 25 bp, Artificial sequence
  Extension Primer
ttatgtgctcattgcacaagttgta

SEQ ID NO: 6823 - DNA, 25 bp, Artificial sequence
  Extension Primer
ctcaagaataattaattaatgktgt

SEQ ID NO: 6824 - DNA, 25 bp, Artificial sequence
  Extension Primer
gagttttaaaaccatgagttatgag

SEQ ID NO: 6825 - DNA, 25 bp, Artificial sequence
  Extension Primer
ttttggaatgaattgggtttgtagg

SEQ ID NO: 6826 - DNA, 25 bp, Artificial sequence
  Extension Primer
ggtggaataatttcaatttggaagt

SEQ ID NO: 6827 - DNA, 25 bp, Artificial sequence
  Extension Primer
tgtacacgctgatggatgattatgt

SEQ ID NO: 6828 - DNA, 25 bp, Artificial sequence
  Extension Primer
cagttcaaacaagaaatagtttagt

SEQ ID NO: 6829 - DNA, 25 bp, Artificial sequence
  Extension Primer
agttgcaagcttgtctgaaaaattg

SEQ ID NO: 6830 - DNA, 25 bp, Artificial sequence
  Extension Primer
ctaaaatcgcaatggyagcaaaaat

SEQ ID NO: 6831 - DNA, 25 bp, Artificial sequence
  Extension Primer
cagcctctcattttctcctcacaac

SEQ ID NO: 6832 - DNA, 25 bp, Artificial sequence
  Extension Primer
ttgatatgaaatagtagcttacaaa

SEQ ID NO: 6833 - DNA, 25 bp, Artificial sequence
  Extension Primer
crgatattaagcagaagatgctgat

SEQ ID NO: 6834 - DNA, 25 bp, Artificial sequence
  Extension Primer
aagaaagctctctatagcrtgacta

SEQ ID NO: 6835 - DNA, 25 bp, Artificial sequence
  Extension Primer
tgctttgcagtgaggtgttcttggt

SEQ ID NO: 6836 - DNA, 25 bp, Artificial sequence
  Extension Primer
agatattcaaataggcataatttag

SEQ ID NO: 6837 - DNA, 25 bp, Artificial sequence
  Extension Primer
cattgtaactagacttatggttggt

SEQ ID NO: 6838 - DNA, 25 bp, Artificial sequence
  Extension Primer
tgtaaatcttctccagcaccgttga

SEQ ID NO: 6839 - DNA, 25 bp, Artificial sequence
  Extension Primer
caattctatatgaactcttgatttt

SEQ ID NO: 6840 - DNA, 25 bp, Artificial sequence
  Extension Primer
gaggattatcatgcagtgaayattt

SEQ ID NO: 6841 - DNA, 25 bp, Artificial sequence
  Extension Primer
atgttgggcaggtggataacatcay

SEQ ID NO: 6842 - DNA, 25 bp, Artificial sequence
  Extension Primer
ataggaaatgagtagtatgctttaa

SEQ ID NO: 6843 - DNA, 25 bp, Artificial sequence
  Extension Primer
tgctggctcttttgctaatggrgga

SEQ ID NO: 6844 - DNA, 25 bp, Artificial sequence
  Extension Primer
aacatgttgtgaaaacagcatgagg

SEQ ID NO: 6845 - DNA, 25 bp, Artificial sequence
  Extension Primer
acagtatcaaaaacatgcaaataca

SEQ ID NO: 6846 - DNA, 25 bp, Artificial sequence
  Extension Primer
ggaataaagatgaaatgaactaaag

SEQ ID NO: 6847 - DNA, 25 bp, Artificial sequence
  Extension Primer
atttttttcaggcaactttgggttt

SEQ ID NO: 6848 - DNA, 25 bp, Artificial sequence
  Extension Primer
cttatactaaagcatgaaaagccta

SEQ ID NO: 6849 - DNA, 25 bp, Artificial sequence
  Extension Primer
cctttataacccaatgtcgaccact

SEQ ID NO: 6850 - DNA, 25 bp, Artificial sequence
  Extension Primer
ggacctgagtggacttcttgggtga

SEQ ID NO: 6851 - DNA, 25 bp, Artificial sequence
  Extension Primer
agaggatccagaagtcataccaagc

SEQ ID NO: 6852 - DNA, 25 bp, Artificial sequence
  Extension Primer
cataattttctataggggaaacagt

SEQ ID NO: 6853 - DNA, 25 bp, Artificial sequence
  Extension Primer
ttttctcatttatcagaargctctg

SEQ ID NO: 6854 - DNA, 25 bp, Artificial sequence
  Extension Primer
caacctggcaggaaacctttaagca

SEQ ID NO: 6855 - DNA, 25 bp, Artificial sequence
  Extension Primer
tctccttgctgtgggctttatgctc

SEQ ID NO: 6856 - DNA, 25 bp, Artificial sequence
  Extension Primer
aacaatgggcttaggttccaagcaa

SEQ ID NO: 6857 - DNA, 25 bp, Artificial sequence
  Extension Primer
aagcaaagacaaaaagtcagatgcy

SEQ ID NO: 6858 - DNA, 25 bp, Artificial sequence
  Extension Primer
agaggggaaatgaggtcaactctgc

SEQ ID NO: 6859 - DNA, 25 bp, Artificial sequence
  Extension Primer
agcctgtgacacattatctttgcca

SEQ ID NO: 6860 - DNA, 25 bp, Artificial sequence
  Extension Primer
tttcctmctctacttttattacccc

SEQ ID NO: 6861 - DNA, 25 bp, Artificial sequence
  Extension Primer
gaaaaatgggcatatgatagtacct

SEQ ID NO: 6862 - DNA, 25 bp, Artificial sequence
  Extension Primer
agtccagaagtaggctttaaggcaa

SEQ ID NO: 6863 - DNA, 25 bp, Artificial sequence
  Extension Primer
ctacagaatcaaattggttgaggga

SEQ ID NO: 6864 - DNA, 25 bp, Artificial sequence
  Extension Primer
aattcagtgtttatgtactttggtc

SEQ ID NO: 6865 - DNA, 25 bp, Artificial sequence
  Extension Primer
caggttcaggaaccgtcttggggaa

SEQ ID NO: 6866 - DNA, 25 bp, Artificial sequence
  Extension Primer
gtgatgtgtcagatttccagccgac

SEQ ID NO: 6867 - DNA, 25 bp, Artificial sequence
  Extension Primer
tgccagtgttctccagttgaaatca

SEQ ID NO: 6868 - DNA, 25 bp, Artificial sequence
  Extension Primer
agcagtctctttaataagtggtgcc

SEQ ID NO: 6869 - DNA, 25 bp, Artificial sequence
  Extension Primer
ttccatttctctctgatacaatcat

SEQ ID NO: 6870 - DNA, 25 bp, Artificial sequence
  Extension Primer
gcaaataaaagtatgatgatcagca

SEQ ID NO: 6871 - DNA, 25 bp, Artificial sequence
  Extension Primer
aatatcattgatggtgtttctacgg

SEQ ID NO: 6872 - DNA, 25 bp, Artificial sequence
  Extension Primer
gaactacctttattgttatttcatt

SEQ ID NO: 6873 - DNA, 25 bp, Artificial sequence
  Extension Primer
gtccctgcattgggtgagtgattcc

SEQ ID NO: 6874 - DNA, 25 bp, Artificial sequence
  Extension Primer
gggtcctcccttggggagtgggtac

SEQ ID NO: 6875 - DNA, 25 bp, Artificial sequence
  Extension Primer
cagtgcgcggccacaggccacgagc

SEQ ID NO: 6876 - DNA, 25 bp, Artificial sequence
  Extension Primer
agcctggcaaatctgytcatttctc

SEQ ID NO: 6877 - DNA, 25 bp, Artificial sequence
  Extension Primer
acagcttcatcacacaagctstgac

SEQ ID NO: 6878 - DNA, 25 bp, Artificial sequence
  Extension Primer
gatgaaatgggcttaatgcaagaca

SEQ ID NO: 6879 - DNA, 25 bp, Artificial sequence
  Extension Primer
tctggctcagacacatgcccctcac

SEQ ID NO: 6880 - DNA, 25 bp, Artificial sequence
  Extension Primer
ttttgtctgtcctgtctggagcctg

SEQ ID NO: 6881 - DNA, 25 bp, Artificial sequence
  Extension Primer
agctgtaagtgccagcatcttctga

SEQ ID NO: 6882 - DNA, 25 bp, Artificial sequence
  Extension Primer
gtccttgtytctctggggaactagc

SEQ ID NO: 6883 - DNA, 25 bp, Artificial sequence
  Extension Primer
atagagttcyctgaccagagattga

SEQ ID NO: 6884 - DNA, 25 bp, Artificial sequence
  Extension Primer
cacccagagggtaagtcattccttt

SEQ ID NO: 6885 - DNA, 25 bp, Artificial sequence
  Extension Primer
gcagacacctaaccagcaccaccac

SEQ ID NO: 6886 - DNA, 25 bp, Artificial sequence
  Extension Primer
attacgagacttggaggtcctttcc

SEQ ID NO: 6887 - DNA, 25 bp, Artificial sequence
  Extension Primer
aagcctctcattggacatgatgttc

SEQ ID NO: 6888 - DNA, 25 bp, Artificial sequence
  Extension Primer
taccctttccatgggctcttccygt

SEQ ID NO: 6889 - DNA, 25 bp, Artificial sequence
  Extension Primer
ctcagtcccagtgaaggtctacata

SEQ ID NO: 6890 - DNA, 25 bp, Artificial sequence
  Extension Primer
atcagagtccatggaaacggagtca

SEQ ID NO: 6891 - DNA, 25 bp, Artificial sequence
  Extension Primer
taggcaccacttkgcttttttctgc

SEQ ID NO: 6892 - DNA, 22 bp, Artificial sequence
  Extension Primer
ctctaacaacaagtatcaacat

SEQ ID NO: 6893 - DNA, 25 bp, Artificial sequence
  Extension Primer
atcccaagtrtagcccagggctgtc

SEQ ID NO: 6894 - DNA, 25 bp, Artificial sequence
  Extension Primer
tttaatagygccccgtagcccggag

SEQ ID NO: 6895 - DNA, 25 bp, Artificial sequence
  Extension Primer
accgcacgtggccgacagagggagc

SEQ ID NO: 6896 - DNA, 25 bp, Artificial sequence
  Extension Primer
agtattattaacaagtccactgaga

SEQ ID NO: 6897 - DNA, 25 bp, Artificial sequence
  Extension Primer
agcctttcccccacctccttccatc

SEQ ID NO: 6898 - DNA, 25 bp, Artificial sequence
  Extension Primer
tggtcacaaaaagagtcctcaaaat

SEQ ID NO: 6899 - DNA, 25 bp, Artificial sequence
  Extension Primer
cgagacctgcctcctcctgaggtgc

SEQ ID NO: 6900 - DNA, 22 bp, Artificial sequence
  Extension Primer
agcggtagaagatatagctccc

SEQ ID NO: 6901 - DNA, 25 bp, Artificial sequence
  Extension Primer
aagatcttgggatgaaagtggcagc

SEQ ID NO: 6902 - DNA, 25 bp, Artificial sequence
  Extension Primer
gcacaaggaaagaaatgggscgtca

SEQ ID NO: 6903 - DNA, 25 bp, Artificial sequence
  Extension Primer
tgacattgccaagggaaccacccga

SEQ ID NO: 6904 - DNA, 25 bp, Artificial sequence
  Extension Primer
gcttgcatctggcccctcgttcccc

SEQ ID NO: 6905 - DNA, 25 bp, Artificial sequence
  Extension Primer
gggggctgctcggcttccatacacc

SEQ ID NO: 6906 - DNA, 25 bp, Artificial sequence
  Extension Primer
ttgggacagtcgggcttattaggca

SEQ ID NO: 6907 - DNA, 25 bp, Artificial sequence
  Extension Primer
aacaagaaatgaacaaacaaaaccc

SEQ ID NO: 6908 - DNA, 25 bp, Artificial sequence
  Extension Primer
tccaccaccatcaggagtgaaggca

SEQ ID NO: 6909 - DNA, 25 bp, Artificial sequence
  Extension Primer
ttctccagaaggacttatggggtcc

SEQ ID NO: 6910 - DNA, 22 bp, Artificial sequence
  Extension Primer
tgccttctcccaaaactgatac

SEQ ID NO: 6911 - DNA, 25 bp, Artificial sequence
  Extension Primer
atgtatagaaaggctscagtmatta

SEQ ID NO: 6912 - DNA, 25 bp, Artificial sequence
  Extension Primer
tttgcatatatggaactgattattt

SEQ ID NO: 6913 - DNA, 25 bp, Artificial sequence
  Extension Primer
cctatactgtgttattctgcttcct

SEQ ID NO: 6914 - DNA, 25 bp, Artificial sequence
  Extension Primer
aattaggaaaaagatttttaagtcc

SEQ ID NO: 6915 - DNA, 25 bp, Artificial sequence
  Extension Primer
ttgctatcctaattgcagaggctac

SEQ ID NO: 6916 - DNA, 25 bp, Artificial sequence
  Extension Primer
gtttgcctctaggccatcttaattc

SEQ ID NO: 6917 - DNA, 25 bp, Artificial sequence
  Extension Primer
cctagcagacaggccatgawaaaac

SEQ ID NO: 6918 - DNA, 25 bp, Artificial sequence
  Extension Primer
ttrttttgaactctttatagagtaa

SEQ ID NO: 6919 - DNA, 25 bp, Artificial sequence
  Extension Primer
ccagctttcaaacaagaaytgttgt

SEQ ID NO: 6920 - DNA, 25 bp, Artificial sequence
  Extension Primer
taatattaatttagttacttactgc

SEQ ID NO: 6921 - DNA, 25 bp, Artificial sequence
  Extension Primer
attttacagacaagataactgaagg

SEQ ID NO: 6922 - DNA, 25 bp, Artificial sequence
  Extension Primer
acccaagactgacatagcatccttt

SEQ ID NO: 6923 - DNA, 25 bp, Artificial sequence
  Extension Primer
tatgtctgattcaagtccatccttc

SEQ ID NO: 6924 - DNA, 25 bp, Artificial sequence
  Extension Primer
caagccaagtcaatacttcataaga

SEQ ID NO: 6925 - DNA, 25 bp, Artificial sequence
  Extension Primer
agttctgacatgcccaagggaataa

SEQ ID NO: 6926 - DNA, 25 bp, Artificial sequence
  Extension Primer
tttggcaaaattgaaaatcctttcc

SEQ ID NO: 6927 - DNA, 25 bp, Artificial sequence
  Extension Primer
actgggcaaatttacaaagcttgtr

SEQ ID NO: 6928 - DNA, 25 bp, Artificial sequence
  Extension Primer
tttgcctaacaagtctttggatggt

SEQ ID NO: 6929 - DNA, 25 bp, Artificial sequence
  Extension Primer
tactgggcaaatttacaaagcttgt

SEQ ID NO: 6930 - DNA, 25 bp, Artificial sequence
  Extension Primer
actgtgattattagggagtggagta

SEQ ID NO: 6931 - DNA, 25 bp, Artificial sequence
  Extension Primer
gcaaaatcctgatcagttctgaata

SEQ ID NO: 6932 - DNA, 25 bp, Artificial sequence
  Extension Primer
acagtaaggargacataatttagaa

SEQ ID NO: 6933 - DNA, 25 bp, Artificial sequence
  Extension Primer
catcatagcttaatgataaaataat

SEQ ID NO: 6934 - DNA, 25 bp, Artificial sequence
  Extension Primer
tttaatggcttaggaaaagacaaca

SEQ ID NO: 6935 - DNA, 25 bp, Artificial sequence
  Extension Primer
tacattatgatcttctgaagctact

SEQ ID NO: 6936 - DNA, 25 bp, Artificial sequence
  Extension Primer
cctacacctcccaaactttatcatc

SEQ ID NO: 6937 - DNA, 25 bp, Artificial sequence
  Extension Primer
tttccttatcgtttttcatgtctca

SEQ ID NO: 6938 - DNA, 22 bp, Artificial sequence
  Extension Primer
gagattcctgggcctatatcca

SEQ ID NO: 6939 - DNA, 25 bp, Artificial sequence
  Extension Primer
gaagattggaagcaaaaccttgggt

SEQ ID NO: 6940 - DNA, 25 bp, Artificial sequence
  Extension Primer
aaaytaggtttgcagcagatttgac

SEQ ID NO: 6941 - DNA, 25 bp, Artificial sequence
  Extension Primer
aaaatctttgtgtttttattaaatc

SEQ ID NO: 6942 - DNA, 25 bp, Artificial sequence
  Extension Primer
agttcattattggattaccgccctt

SEQ ID NO: 6943 - DNA, 25 bp, Artificial sequence
  Extension Primer
cttggccatacatatacattatcca

SEQ ID NO: 6944 - DNA, 25 bp, Artificial sequence
  Extension Primer
tatagaggtacatctcctcacagaa

SEQ ID NO: 6945 - DNA, 25 bp, Artificial sequence
  Extension Primer
tggcagccaatgccagaagccagtc

SEQ ID NO: 6946 - DNA, 25 bp, Artificial sequence
  Extension Primer
tagcaacaagctataaaacaaagga

SEQ ID NO: 6947 - DNA, 25 bp, Artificial sequence
  Extension Primer
aacatcgtgcttatagctttgctcc

SEQ ID NO: 6948 - DNA, 25 bp, Artificial sequence
  Extension Primer
gtgcatcttgtctgaaaatgactcc

SEQ ID NO: 6949 - DNA, 25 bp, Artificial sequence
  Extension Primer
tgaagggcagaaatcaatacttgct

SEQ ID NO: 6950 - DNA, 25 bp, Artificial sequence
  Extension Primer
tagcatgattaaaaataattcccac

SEQ ID NO: 6951 - DNA, 25 bp, Artificial sequence
  Extension Primer
aaagcctctccacttagaaggctct

SEQ ID NO: 6952 - DNA, 25 bp, Artificial sequence
  Extension Primer
tccttcaactcacttcacacagagt

SEQ ID NO: 6953 - DNA, 25 bp, Artificial sequence
  Extension Primer
catcaaaatggaactatgaggtatg

SEQ ID NO: 6954 - DNA, 25 bp, Artificial sequence
  Extension Primer
atatttatgaagaagatttgcaggt

SEQ ID NO: 6955 - DNA, 25 bp, Artificial sequence
  Extension Primer
actgtgctacagagtgaagtcagtt

SEQ ID NO: 6956 - DNA, 25 bp, Artificial sequence
  Extension Primer
agaaagttagcaaaggaaaccagca

SEQ ID NO: 6957 - DNA, 25 bp, Artificial sequence
  Extension Primer
tctggtttagaaatacagggacctt

SEQ ID NO: 6958 - DNA, 25 bp, Artificial sequence
  Extension Primer
tgaaagtggctttaggtaggctgga

SEQ ID NO: 6959 - DNA, 25 bp, Artificial sequence
  Extension Primer
gaatctttaagtgtctccaaaagcc

SEQ ID NO: 6960 - DNA, 25 bp, Artificial sequence
  Extension Primer
cttgagtagtcattttgttggagga

SEQ ID NO: 6961 - DNA, 25 bp, Artificial sequence
  Extension Primer
cactcttttgaacatcatgggcact

SEQ ID NO: 6962 - DNA, 25 bp, Artificial sequence
  Extension Primer
tctgattcaagtccatccttcrgcc

SEQ ID NO: 6963 - DNA, 25 bp, Artificial sequence
  Extension Primer
ttaactgaggacagataacagggtc

SEQ ID NO: 6964 - DNA, 25 bp, Artificial sequence
  Extension Primer
acagactagacttaggtgggacaca

SEQ ID NO: 6965 - DNA, 25 bp, Artificial sequence
  Extension Primer
atccttggagatcaaagtgagtgcc

SEQ ID NO: 6966 - DNA, 25 bp, Artificial sequence
  Extension Primer
gagtcccaggagaactcttcaggca

SEQ ID NO: 6967 - DNA, 25 bp, Artificial sequence
  Extension Primer
aagcaatgaccrttaaacaaggcag

SEQ ID NO: 6968 - DNA, 25 bp, Artificial sequence
  Extension Primer
ccatcctgagctgtaaacagaccac

SEQ ID NO: 6969 - DNA, 25 bp, Artificial sequence
  Extension Primer
accagggccccgcggtgtggggcra

SEQ ID NO: 6970 - DNA, 25 bp, Artificial sequence
  Extension Primer
ggtggcggagggygaatgggaaggc

SEQ ID NO: 6971 - DNA, 25 bp, Artificial sequence
  Extension Primer
cctgtggctattcagcacttgaaat

SEQ ID NO: 6972 - DNA, 25 bp, Artificial sequence
  Extension Primer
gggtctaggggatgccatggtaccc

SEQ ID NO: 6973 - DNA, 25 bp, Artificial sequence
  Extension Primer
ctgtggtatacagtaggaccttgtt

SEQ ID NO: 6974 - DNA, 25 bp, Artificial sequence
  Extension Primer
attgcaatggctttctaactttcct

SEQ ID NO: 6975 - DNA, 25 bp, Artificial sequence
  Extension Primer
gcttcacagacacggcaaagcttaa

SEQ ID NO: 6976 - DNA, 25 bp, Artificial sequence
  Extension Primer
gaggatgacatttcaaacagaatgc

SEQ ID NO: 6977 - DNA, 25 bp, Artificial sequence
  Extension Primer
ttgctcttcgagcctcagtttcctc

SEQ ID NO: 6978 - DNA, 25 bp, Artificial sequence
  Extension Primer
ggaagaggagggtgcatggattttc

SEQ ID NO: 6979 - DNA, 25 bp, Artificial sequence
  Extension Primer
atggactctgatttatttccccact

SEQ ID NO: 6980 - DNA, 25 bp, Artificial sequence
  Extension Primer
atggccagacaaggggcacagatgc

SEQ ID NO: 6981 - DNA, 25 bp, Artificial sequence
  Extension Primer
actcattaagacacaggaattagcc

SEQ ID NO: 6982 - DNA, 25 bp, Artificial sequence
  Extension Primer
tttctctgctccaaactcggatgtt

SEQ ID NO: 6983 - DNA, 25 bp, Artificial sequence
  Extension Primer
tagttgcagcatatgaactcttgtt

SEQ ID NO: 6984 - DNA, 25 bp, Artificial sequence
  Extension Primer
gtgactggtgtgtggagtggtactt

SEQ ID NO: 6985 - DNA, 25 bp, Artificial sequence
  Extension Primer
agatgtccttgggtgagcggggrtt

SEQ ID NO: 6986 - DNA, 25 bp, Artificial sequence
  Extension Primer
ccaggggtgctcggcatgggcctag

SEQ ID NO: 6987 - DNA, 25 bp, Artificial sequence
  Extension Primer
ggagrggccaygttttgatagaaat

SEQ ID NO: 6988 - DNA, 25 bp, Artificial sequence
  Extension Primer
atctttcaagcagtaggcaccactt

SEQ ID NO: 6989 - DNA, 25 bp, Artificial sequence
  Extension Primer
ccagctctttcctatttattctctc

SEQ ID NO: 6990 - DNA, 25 bp, Artificial sequence
  Extension Primer
cctttgatagaaggagaggactsgg

SEQ ID NO: 6991 - DNA, 25 bp, Artificial sequence
  Extension Primer
ctgaggaggaagaaaaawaagacaa

SEQ ID NO: 6992 - DNA, 25 bp, Artificial sequence
  Extension Primer
cctcacgctgccttgggcatgaaac

SEQ ID NO: 6993 - DNA, 25 bp, Artificial sequence
  Extension Primer
acaatggatggctctgcagctggga

SEQ ID NO: 6994 - DNA, 25 bp, Artificial sequence
  Extension Primer
gatacagggtctgggaaaacacagg

SEQ ID NO: 6995 - DNA, 25 bp, Artificial sequence
  Extension Primer
gcattccggttggtagataagactc

SEQ ID NO: 6996 - DNA, 25 bp, Artificial sequence
  Extension Primer
ccaaggggctctgatgggtgttgct

SEQ ID NO: 6997 - DNA, 25 bp, Artificial sequence
  Extension Primer
ccagctctcatccagggctgacctt

SEQ ID NO: 6998 - DNA, 25 bp, Artificial sequence
  Extension Primer
ggccatggagaagtaatttttaccc

SEQ ID NO: 6999 - DNA, 25 bp, Artificial sequence
  Extension Primer
cccctttactctggtttgtctcccc

SEQ ID NO: 7000 - DNA, 25 bp, Artificial sequence
  Extension Primer
gtggtaccagtgatctgtatttgcc

SEQ ID NO: 7001 - DNA, 25 bp, Artificial sequence
  Extension Primer
agagcacgcgggctggcagaaggca

SEQ ID NO: 7002 - DNA, 25 bp, Artificial sequence
  Extension Primer
atcttkcctgaagtttctaagaggc

SEQ ID NO: 7003 - DNA, 25 bp, Artificial sequence
  Extension Primer
tatgatttgctgctttctcataaaa

SEQ ID NO: 7004 - DNA, 25 bp, Artificial sequence
  Extension Primer
ataggatttccacagacctagatta

SEQ ID NO: 7005 - DNA, 25 bp, Artificial sequence
  Extension Primer
cactgtgagtgacacgctgccagta

SEQ ID NO: 7006 - DNA, 22 bp, Artificial sequence
  Extension Primer
aaagaaagttctaaggaatttc

SEQ ID NO: 7007 - DNA, 25 bp, Artificial sequence
  Extension Primer
tagctaaamgtagctaattttagaa

SEQ ID NO: 7008 - DNA, 25 bp, Artificial sequence
  Extension Primer
caagaggaattcagaaaagagaaaa

SEQ ID NO: 7009 - DNA, 25 bp, Artificial sequence
  Extension Primer
crgcacaaaggatggagtgggagaa

SEQ ID NO: 7010 - DNA, 25 bp, Artificial sequence
  Extension Primer
aactccaatattaggaatgtgttat

SEQ ID NO: 7011 - DNA, 25 bp, Artificial sequence
  Extension Primer
gctactttcrgacatttgattttcc

SEQ ID NO: 7012 - DNA, 25 bp, Artificial sequence
  Extension Primer
gagaggtcagattttcttyagatat

SEQ ID NO: 7013 - DNA, 25 bp, Artificial sequence
  Extension Primer
taagttagagtcttcagaccacttt

SEQ ID NO: 7014 - DNA, 25 bp, Artificial sequence
  Extension Primer
atatttgagctgccatcttagccta

SEQ ID NO: 7015 - DNA, 25 bp, Artificial sequence
  Extension Primer
tgaagtgccttgaatctttctgact

SEQ ID NO: 7016 - DNA, 25 bp, Artificial sequence
  Extension Primer
tgaagaggaactacatactagaagg

SEQ ID NO: 7017 - DNA, 22 bp, Artificial sequence
  Extension Primer
gcacctcaggggctccaggctt

SEQ ID NO: 7018 - DNA, 25 bp, Artificial sequence
  Extension Primer
ctaaggaaggcataaaggtgtgttt

SEQ ID NO: 7019 - DNA, 25 bp, Artificial sequence
  Extension Primer
tacttctatatgatggaatcagact

SEQ ID NO: 7020 - DNA, 25 bp, Artificial sequence
  Extension Primer
ccagctcatttatttccttttattt

SEQ ID NO: 7021 - DNA, 25 bp, Artificial sequence
  Extension Primer
tgattgttggaactttgttctagga

SEQ ID NO: 7022 - DNA, 25 bp, Artificial sequence
  Extension Primer
accttttcttaaacctcggcatagc

SEQ ID NO: 7023 - DNA, 25 bp, Artificial sequence
  Extension Primer
tcagatatcatctctatgaagaaag

SEQ ID NO: 7024 - DNA, 25 bp, Artificial sequence
  Extension Primer
ttactgaactcacttgcatatcata

SEQ ID NO: 7025 - DNA, 25 bp, Artificial sequence
  Extension Primer
aaaagggttctatggccaagtaaat

SEQ ID NO: 7026 - DNA, 25 bp, Artificial sequence
  Extension Primer
tcttgggggcatatttcaaaagagt

SEQ ID NO: 7027 - DNA, 25 bp, Artificial sequence
  Extension Primer
agggattccattaaatcaggggcca

SEQ ID NO: 7028 - DNA, 25 bp, Artificial sequence
  Extension Primer
cctgtaggccaaaaaacagttaaac

SEQ ID NO: 7029 - DNA, 25 bp, Artificial sequence
  Extension Primer
actgttttatttaagagtctattcc

SEQ ID NO: 7030 - DNA, 25 bp, Artificial sequence
  Extension Primer
agcaaacagtggagatggactccga

SEQ ID NO: 7031 - DNA, 25 bp, Artificial sequence
  Extension Primer
ggaagtagttayagcttttgaagaa

SEQ ID NO: 7032 - DNA, 25 bp, Artificial sequence
  Extension Primer
atcactcatcaactttatcatactg

SEQ ID NO: 7033 - DNA, 25 bp, Artificial sequence
  Extension Primer
caatcaccctttaggaaaagatgac

SEQ ID NO: 7034 - DNA, 25 bp, Artificial sequence
  Extension Primer
gtagtcrtatcatacatccacactc

SEQ ID NO: 7035 - DNA, 25 bp, Artificial sequence
  Extension Primer
tatcacttgcttctagcaacacaga

SEQ ID NO: 7036 - DNA, 25 bp, Artificial sequence
  Extension Primer
ctatgggaatttcaagctcagaaaa

SEQ ID NO: 7037 - DNA, 25 bp, Artificial sequence
  Extension Primer
ctcctcacactggttgtagataagc

SEQ ID NO: 7038 - DNA, 25 bp, Artificial sequence
  Extension Primer
aggacatactaggcactgtgaatac

SEQ ID NO: 7039 - DNA, 25 bp, Artificial sequence
  Extension Primer
ctatgaattaaggtgtgtgtatgta

SEQ ID NO: 7040 - DNA, 25 bp, Artificial sequence
  Extension Primer
ctcagagtccactttctttttgaaa

SEQ ID NO: 7041 - DNA, 25 bp, Artificial sequence
  Extension Primer
cttcttcctagaaaataaggccaat

SEQ ID NO: 7042 - DNA, 25 bp, Artificial sequence
  Extension Primer
aattttacagagggtttagatttga

SEQ ID NO: 7043 - DNA, 25 bp, Artificial sequence
  Extension Primer
acccccaaaataaaaaataaataaa

SEQ ID NO: 7044 - DNA, 25 bp, Artificial sequence
  Extension Primer
aaggatacagaaggcagcaaagtca

SEQ ID NO: 7045 - DNA, 25 bp, Artificial sequence
  Extension Primer
cttcaggcagctcgatcgcctggtg

SEQ ID NO: 7046 - DNA, 25 bp, Artificial sequence
  Extension Primer
gaggctctgggttttcctggctcac

SEQ ID NO: 7047 - DNA, 25 bp, Artificial sequence
  Extension Primer
ctacttttctacattcttataaagc

SEQ ID NO: 7048 - DNA, 25 bp, Artificial sequence
  Extension Primer
agaggyaccactctggctggagacc

SEQ ID NO: 7049 - DNA, 25 bp, Artificial sequence
  Extension Primer
ccctttctcttgctctgagtcttat

SEQ ID NO: 7050 - DNA, 25 bp, Artificial sequence
  Extension Primer
cattgcttacaagtgaattgtttct

SEQ ID NO: 7051 - DNA, 25 bp, Artificial sequence
  Extension Primer
ttgaatgccttctctaaacattcta

SEQ ID NO: 7052 - DNA, 25 bp, Artificial sequence
  Extension Primer
ctgacagtatcagacaaataataat

SEQ ID NO: 7053 - DNA, 25 bp, Artificial sequence
  Extension Primer
tagttgtatccaaaatgtcacaaaa

SEQ ID NO: 7054 - DNA, 25 bp, Artificial sequence
  Extension Primer
acgactggacgtgtgtggttctgtg

SEQ ID NO: 7055 - DNA, 25 bp, Artificial sequence
  Extension Primer
agcagtaacatgaaggtattcactt

SEQ ID NO: 7056 - DNA, 25 bp, Artificial sequence
  Extension Primer
atgccatttaagagggtcaaaaaac

SEQ ID NO: 7057 - DNA, 25 bp, Artificial sequence
  Extension Primer
gctggggatggggtagggtggactc

SEQ ID NO: 7058 - DNA, 25 bp, Artificial sequence
  Extension Primer
tttacatctgtagtcttaggcaaaa

SEQ ID NO: 7059 - DNA, 25 bp, Artificial sequence
  Extension Primer
gagttgaattctagctttctttcct

SEQ ID NO: 7060 - DNA, 25 bp, Artificial sequence
  Extension Primer
ttgtgatgacagataaccctgtgat

SEQ ID NO: 7061 - DNA, 25 bp, Artificial sequence
  Extension Primer
atcacaaaaaaactttgaggtgggc

SEQ ID NO: 7062 - DNA, 25 bp, Artificial sequence
  Extension Primer
ctaatctttactgggaatttactac

SEQ ID NO: 7063 - DNA, 25 bp, Artificial sequence
  Extension Primer
ttccaacctctttccattttgacaa

SEQ ID NO: 7064 - DNA, 25 bp, Artificial sequence
  Extension Primer
aattctgatataaggacagcaaaat

SEQ ID NO: 7065 - DNA, 25 bp, Artificial sequence
  Extension Primer
ggcttttgacaaatcagaggatctt

SEQ ID NO: 7066 - DNA, 25 bp, Artificial sequence
  Extension Primer
attatttctcccaacaggcctgtcc

SEQ ID NO: 7067 - DNA, 25 bp, Artificial sequence
  Extension Primer
ggcggtgtactcagaggattggaga

SEQ ID NO: 7068 - DNA, 25 bp, Artificial sequence
  Extension Primer
acattcacatttcaggtatacatta

SEQ ID NO: 7069 - DNA, 25 bp, Artificial sequence
  Extension Primer
cttctgacctactagttgagttaca

SEQ ID NO: 7070 - DNA, 25 bp, Artificial sequence
  Extension Primer
taggaatcctttactgagcccttgg

SEQ ID NO: 7071 - DNA, 25 bp, Artificial sequence
  Extension Primer
aaaggggcatccttaccccaacctc

SEQ ID NO: 7072 - DNA, 25 bp, Artificial sequence
  Extension Primer
cacagcctgtaatgtttaaatttca

SEQ ID NO: 7073 - DNA, 25 bp, Artificial sequence
  Extension Primer
agatgaagaaccttcaagctctttc

SEQ ID NO: 7074 - DNA, 25 bp, Artificial sequence
  Extension Primer
gaaaattttatgttaaggaaactgg

SEQ ID NO: 7075 - DNA, 25 bp, Artificial sequence
  Extension Primer
aaaacttaccttaattctttcattt

SEQ ID NO: 7076 - DNA, 25 bp, Artificial sequence
  Extension Primer
ctttcccaaaacagtataaatacat

SEQ ID NO: 7077 - DNA, 25 bp, Artificial sequence
  Extension Primer
catccattgtggatttcaaaacatg

SEQ ID NO: 7078 - DNA, 25 bp, Artificial sequence
  Extension Primer
tacagttatcacgaagctaacagac

SEQ ID NO: 7079 - DNA, 25 bp, Artificial sequence
  Extension Primer
tggatgttgttctaatacatttggt

SEQ ID NO: 7080 - DNA, 25 bp, Artificial sequence
  Extension Primer
ataccctcagccaaaaagactcata

SEQ ID NO: 7081 - DNA, 25 bp, Artificial sequence
  Extension Primer
ttagagagctctgaagtagtaattt

SEQ ID NO: 7082 - DNA, 25 bp, Artificial sequence
  Extension Primer
ttctaagaagttgaaaagaatggtg

SEQ ID NO: 7083 - DNA, 25 bp, Artificial sequence
  Extension Primer
agtatttctcagttctgttcctctt

SEQ ID NO: 7084 - DNA, 25 bp, Artificial sequence
  Extension Primer
cttttccaacattcctagtactgat

SEQ ID NO: 7085 - DNA, 25 bp, Artificial sequence
  Extension Primer
ggagctgggatgttttagagcgtga

SEQ ID NO: 7086 - DNA, 25 bp, Artificial sequence
  Extension Primer
cagaaaagaattcactgaaaatacc

SEQ ID NO: 7087 - DNA, 25 bp, Artificial sequence
  Extension Primer
ctttggtacacctaatgatttttat

SEQ ID NO: 7088 - DNA, 25 bp, Artificial sequence
  Extension Primer
aggtggaagccagatcactgagtgc

SEQ ID NO: 7089 - DNA, 25 bp, Artificial sequence
  Extension Primer
aacagaggctcttctcaatgacaca

SEQ ID NO: 7090 - DNA, 25 bp, Artificial sequence
  Extension Primer
atgttgttggtaattcctttggaac

SEQ ID NO: 7091 - DNA, 25 bp, Artificial sequence
  Extension Primer
gtctccaggagaaatttagagcacc

SEQ ID NO: 7092 - DNA, 25 bp, Artificial sequence
  Extension Primer
atctatcccttgtttcattttgatt

SEQ ID NO: 7093 - DNA, 25 bp, Artificial sequence
  Extension Primer
gggaatatatcttggagcatgaatg

SEQ ID NO: 7094 - DNA, 25 bp, Artificial sequence
  Extension Primer
catatcttaattttaatactagaca

SEQ ID NO: 7095 - DNA, 25 bp, Artificial sequence
  Extension Primer
atgaggaaactgaggcccagacaga

SEQ ID NO: 7096 - DNA, 25 bp, Artificial sequence
  Extension Primer
agtgtacctgaagagttatcatcta

SEQ ID NO: 7097 - DNA, 25 bp, Artificial sequence
  Extension Primer
ggctcagggactcttcagagggaca

SEQ ID NO: 7098 - DNA, 25 bp, Artificial sequence
  Extension Primer
aggcctaaatataactacagttgtg

SEQ ID NO: 7099 - DNA, 25 bp, Artificial sequence
  Extension Primer
ttgaaaatccagagttctggttctc

SEQ ID NO: 7100 - DNA, 25 bp, Artificial sequence
  Extension Primer
attaatttgaattcaatttattctt

SEQ ID NO: 7101 - DNA, 25 bp, Artificial sequence
  Extension Primer
gctatttcctgatgaaytaatgaca

SEQ ID NO: 7102 - DNA, 25 bp, Artificial sequence
  Extension Primer
ctggttctttttggaattttatctc

SEQ ID NO: 7103 - DNA, 25 bp, Artificial sequence
  Extension Primer
ggcctgtgctcactacaaaagctgg

SEQ ID NO: 7104 - DNA, 25 bp, Artificial sequence
  Extension Primer
gtgactgctcccagatcccaggcac

SEQ ID NO: 7105 - DNA, 25 bp, Artificial sequence
  Extension Primer
agtgtctcttccacagtatgtcttg

SEQ ID NO: 7106 - DNA, 25 bp, Artificial sequence
  Extension Primer
acagacattttctcatttatcagaa

SEQ ID NO: 7107 - DNA, 25 bp, Artificial sequence
  Extension Primer
ttagcatcttatttaatcaagctac

SEQ ID NO: 7108 - DNA, 25 bp, Artificial sequence
  Extension Primer
attttctatttctactgtacctctc

SEQ ID NO: 7109 - DNA, 25 bp, Artificial sequence
  Extension Primer
ccccaagccagttgtttctgggacc

SEQ ID NO: 7110 - DNA, 25 bp, Artificial sequence
  Extension Primer
ctgcttattgtgtctctycaatayt

SEQ ID NO: 7111 - DNA, 25 bp, Artificial sequence
  Extension Primer
tcctctttccaatgaaggggatgcg

SEQ ID NO: 7112 - DNA, 25 bp, Artificial sequence
  Extension Primer
caggatcatccttcttttctggctc

SEQ ID NO: 7113 - DNA, 25 bp, Artificial sequence
  Extension Primer
tatactgtacaagtttgtctgcaaa

SEQ ID NO: 7114 - DNA, 25 bp, Artificial sequence
  Extension Primer
agtcatgaaacagaattcttctatt

SEQ ID NO: 7115 - DNA, 25 bp, Artificial sequence
  Extension Primer
gatttagataagggaggaatgtttt

SEQ ID NO: 7116 - DNA, 25 bp, Artificial sequence
  Extension Primer
catttcataggcagctttgtcacca

SEQ ID NO: 7117 - DNA, 25 bp, Artificial sequence
  Extension Primer
ttttaagacttctggagttaacatt

SEQ ID NO: 7118 - DNA, 25 bp, Artificial sequence
  Extension Primer
agcctcctactttctggtgtttatt

SEQ ID NO: 7119 - DNA, 25 bp, Artificial sequence
  Extension Primer
tgtactcgtttaatgctctgctgtc

SEQ ID NO: 7120 - DNA, 25 bp, Artificial sequence
  Extension Primer
gcacaaggaagcagattgcaagaaa

SEQ ID NO: 7121 - DNA, 25 bp, Artificial sequence
  Extension Primer
aaagatcctactgcatagcacaggg

SEQ ID NO: 7122 - DNA, 25 bp, Artificial sequence
  Extension Primer
gtgtgttgttgaatttctaagttat

SEQ ID NO: 7123 - DNA, 25 bp, Artificial sequence
  Extension Primer
aaggttgtcatttaatgagggctta

SEQ ID NO: 7124 - DNA, 25 bp, Artificial sequence
  Extension Primer
gtaggttcatccgttgtaacaaatg

SEQ ID NO: 7125 - DNA, 25 bp, Artificial sequence
  Extension Primer
catctcttatttcagttgtcttgtc

SEQ ID NO: 7126 - DNA, 25 bp, Artificial sequence
  Extension Primer
gtggctttgagaactgaaaaagcaa

SEQ ID NO: 7127 - DNA, 25 bp, Artificial sequence
  Extension Primer
aaattggagactggattctattttc

SEQ ID NO: 7128 - DNA, 25 bp, Artificial sequence
  Extension Primer
cttgattaaaaaacaatttccgttt

SEQ ID NO: 7129 - DNA, 22 bp, Artificial sequence
  Extension Primer
aactcttacttttttttcttat

SEQ ID NO: 7130 - DNA, 25 bp, Artificial sequence
  Extension Primer
cttggcctttctcagtccactcagg

SEQ ID NO: 7131 - DNA, 25 bp, Artificial sequence
  Extension Primer
cagcttagtgccctcctttttcttc

SEQ ID NO: 7132 - DNA, 25 bp, Artificial sequence
  Extension Primer
aaagttgctgatttctcctcactct

SEQ ID NO: 7133 - DNA, 25 bp, Artificial sequence
  Extension Primer
ctagaaagtgaaatgttacagtgtg

SEQ ID NO: 7134 - DNA, 25 bp, Artificial sequence
  Extension Primer
gctttccgcttctgagggtgacttc

SEQ ID NO: 7135 - DNA, 25 bp, Artificial sequence
  Extension Primer
gtccgggaagcaactagagatcttg

SEQ ID NO: 7136 - DNA, 25 bp, Artificial sequence
  Extension Primer
aatttcaatctcatagaatctagtt

SEQ ID NO: 7137 - DNA, 25 bp, Artificial sequence
  Extension Primer
gttttaaaaagctaatttaatagac

SEQ ID NO: 7138 - DNA, 25 bp, Artificial sequence
  Extension Primer
ttcggattaagttggtgagcatttt

SEQ ID NO: 7139 - DNA, 25 bp, Artificial sequence
  Extension Primer
catatgctttaaatacttaagtaag

SEQ ID NO: 7140 - DNA, 25 bp, Artificial sequence
  Extension Primer
atatgacatagccttgtagcagaat

SEQ ID NO: 7141 - DNA, 25 bp, Artificial sequence
  Extension Primer
gtcatttatagtcaaggtcacacca

SEQ ID NO: 7142 - DNA, 25 bp, Artificial sequence
  Extension Primer
ttgattctgactcaagacggagggc

SEQ ID NO: 7143 - DNA, 25 bp, Artificial sequence
  Extension Primer
aagagagttaagggctatagaagat

SEQ ID NO: 7144 - DNA, 25 bp, Artificial sequence
  Extension Primer
gcgtggtgttcctgcctgcctgcag

SEQ ID NO: 7145 - DNA, 25 bp, Artificial sequence
  Extension Primer
gggagctcagagtcttagccactgg

SEQ ID NO: 7146 - DNA, 22 bp, Artificial sequence
  Extension Primer
ttcgattatttaagcgaaagac

SEQ ID NO: 7147 - DNA, 25 bp, Artificial sequence
  Extension Primer
aaattctgcaawgccygcctttttt

SEQ ID NO: 7148 - DNA, 25 bp, Artificial sequence
  Extension Primer
ccacttccacctccacaaaggacac

SEQ ID NO: 7149 - DNA, 25 bp, Artificial sequence
  Extension Primer
taattgcgtctcttcgattctcacg

SEQ ID NO: 7150 - DNA, 25 bp, Artificial sequence
  Extension Primer
ccctgcacgcctgcatgatgagcca

SEQ ID NO: 7151 - DNA, 25 bp, Artificial sequence
  Extension Primer
caaaatttctgcatgtattccagcc

SEQ ID NO: 7152 - DNA, 25 bp, Artificial sequence
  Extension Primer
agcctttgtttgtaatgtgacaagt

SEQ ID NO: 7153 - DNA, 25 bp, Artificial sequence
  Extension Primer
aactcaataatgctgtagaggtgaa

SEQ ID NO: 7154 - DNA, 25 bp, Artificial sequence
  Extension Primer
aggatagtgagctgctcacagatac

SEQ ID NO: 7155 - DNA, 25 bp, Artificial sequence
  Extension Primer
tctgcaaggtaacaaagatagagaa

SEQ ID NO: 7156 - DNA, 25 bp, Artificial sequence
  Extension Primer
taataaacaataaccataagtgaaa

SEQ ID NO: 7157 - DNA, 25 bp, Artificial sequence
  Extension Primer
taagttatggaggaagggcttctgt

SEQ ID NO: 7158 - DNA, 25 bp, Artificial sequence
  Extension Primer
catatgtgtacacatttctatggga

SEQ ID NO: 7159 - DNA, 25 bp, Artificial sequence
  Extension Primer
gagaggagagagtcgaggatgaagt

SEQ ID NO: 7160 - DNA, 25 bp, Artificial sequence
  Extension Primer
aaagcaaatatggtggatacaaata

SEQ ID NO: 7161 - DNA, 25 bp, Artificial sequence
  Extension Primer
aataaactgtattctacctaccact

SEQ ID NO: 7162 - DNA, 25 bp, Artificial sequence
  Extension Primer
tgctcctggaggcaagctgatgata

SEQ ID NO: 7163 - DNA, 25 bp, Artificial sequence
  Extension Primer
ttatctgtgctctcatattttgtcc

SEQ ID NO: 7164 - DNA, 25 bp, Artificial sequence
  Extension Primer
tttgtatattgtctgtgactgtttt

SEQ ID NO: 7165 - DNA, 25 bp, Artificial sequence
  Extension Primer
cctaactgactctgcctgtttttca

SEQ ID NO: 7166 - DNA, 25 bp, Artificial sequence
  Extension Primer
tcacaccacacagcactatgttcta

SEQ ID NO: 7167 - DNA, 25 bp, Artificial sequence
  Extension Primer
cctggctttcgtctctgccctacag

SEQ ID NO: 7168 - DNA, 25 bp, Artificial sequence
  Extension Primer
acaatctgcctgcaacacagaagaa

SEQ ID NO: 7169 - DNA, 22 bp, Artificial sequence
  Extension Primer
atcctacattccttgtgtctaa

SEQ ID NO: 7170 - DNA, 25 bp, Artificial sequence
  Extension Primer
attttcagatatgaaaccataacaa

SEQ ID NO: 7171 - DNA, 25 bp, Artificial sequence
  Extension Primer
ctggcctgttggagggcctgggact

SEQ ID NO: 7172 - DNA, 25 bp, Artificial sequence
  Extension Primer
attttaatcctgcagcataactaac

SEQ ID NO: 7173 - DNA, 25 bp, Artificial sequence
  Extension Primer
ctcctyytcgtggaagaggtaatct

SEQ ID NO: 7174 - DNA, 25 bp, Artificial sequence
  Extension Primer
cttcaattggaagttcccttagaga

SEQ ID NO: 7175 - DNA, 25 bp, Artificial sequence
  Extension Primer
gctttatttggtcacaggatccatg

SEQ ID NO: 7176 - DNA, 25 bp, Artificial sequence
  Extension Primer
tgctacacttctgagtttatatcca

SEQ ID NO: 7177 - DNA, 25 bp, Artificial sequence
  Extension Primer
aaaagcagttaatcaactggcaagc

SEQ ID NO: 7178 - DNA, 22 bp, Artificial sequence
  Extension Primer
aattcaaattccctgcagcatt

SEQ ID NO: 7179 - DNA, 25 bp, Artificial sequence
  Extension Primer
aagtcctgtttaaattcccctagcg

SEQ ID NO: 7180 - DNA, 25 bp, Artificial sequence
  Extension Primer
aagatcttttggaaaataactgaat

SEQ ID NO: 7181 - DNA, 25 bp, Artificial sequence
  Extension Primer
cagtaaagtcacttcatagtgttga

SEQ ID NO: 7182 - DNA, 25 bp, Artificial sequence
  Extension Primer
tagttgtcactctaagtgagtgttt

SEQ ID NO: 7183 - DNA, 25 bp, Artificial sequence
  Extension Primer
tgagcaatagtttcttggagatcta

SEQ ID NO: 7184 - DNA, 25 bp, Artificial sequence
  Extension Primer
ccagtatatgtccctaagaaactta

SEQ ID NO: 7185 - DNA, 25 bp, Artificial sequence
  Extension Primer
atgctcctatctttggacacctgct

SEQ ID NO: 7186 - DNA, 25 bp, Artificial sequence
  Extension Primer
gatggtggttgaccctaggagagac

SEQ ID NO: 7187 - DNA, 25 bp, Artificial sequence
  Extension Primer
gtccaactctgtgcgaccccataga

SEQ ID NO: 7188 - DNA, 25 bp, Artificial sequence
  Extension Primer
tcccggcagaaaggaggggaaaggc

SEQ ID NO: 7189 - DNA, 25 bp, Artificial sequence
  Extension Primer
aatgaggttcacagtagctcgctta

SEQ ID NO: 7190 - DNA, 25 bp, Artificial sequence
  Extension Primer
tcctctgtgaagccttccccacctc

SEQ ID NO: 7191 - DNA, 25 bp, Artificial sequence
  Extension Primer
ccagaacaaatgaatgaaataaggt

SEQ ID NO: 7192 - DNA, 25 bp, Artificial sequence
  Extension Primer
aatggttatggagtaaggcacaact

SEQ ID NO: 7193 - DNA, 25 bp, Artificial sequence
  Extension Primer
ccttacaaccacctctgcacatcca

SEQ ID NO: 7194 - DNA, 25 bp, Artificial sequence
  Extension Primer
actgttgtgctgaaaattcctgtga

SEQ ID NO: 7195 - DNA, 25 bp, Artificial sequence
  Extension Primer
ttctcttttccacatggaactctca

SEQ ID NO: 7196 - DNA, 25 bp, Artificial sequence
  Extension Primer
ttcagaatgaacctaatgaattttg

SEQ ID NO: 7197 - DNA, 25 bp, Artificial sequence
  Extension Primer
caaatttgcttattctaccaacaat

SEQ ID NO: 7198 - DNA, 25 bp, Artificial sequence
  Extension Primer
gttctctgcacaaacttgaagtaaa

SEQ ID NO: 7199 - DNA, 25 bp, Artificial sequence
  Extension Primer
ccacagctgttctcragtaaatgtc

SEQ ID NO: 7200 - DNA, 25 bp, Artificial sequence
  Extension Primer
gcttcggcgcctgcgggcggggcga

SEQ ID NO: 7201 - DNA, 25 bp, Artificial sequence
  Extension Primer
ttagggtagatggtgtgtacctata

SEQ ID NO: 7202 - DNA, 25 bp, Artificial sequence
  Extension Primer
gctccttacctactgtctatctttc

SEQ ID NO: 7203 - DNA, 25 bp, Artificial sequence
  Extension Primer
ggttagtaccccaggtgttttgata

SEQ ID NO: 7204 - DNA, 25 bp, Artificial sequence
  Extension Primer
gccagggatagaggtgggattgggt

SEQ ID NO: 7205 - DNA, 25 bp, Artificial sequence
  Extension Primer
tacctcagcatattagatttctttc

SEQ ID NO: 7206 - DNA, 25 bp, Artificial sequence
  Extension Primer
acaaatccacatgttaatgtaggta

SEQ ID NO: 7207 - DNA, 25 bp, Artificial sequence
  Extension Primer
ggggtagcaggacgtgatgggtgtg

SEQ ID NO: 7208 - DNA, 25 bp, Artificial sequence
  Extension Primer
tctttgtttcatatttaagaaagaa

SEQ ID NO: 7209 - DNA, 25 bp, Artificial sequence
  Extension Primer
ttagcatcactctggtaaatgtact

SEQ ID NO: 7210 - DNA, 25 bp, Artificial sequence
  Extension Primer
tgagacatcagtgcccacaggtttg

SEQ ID NO: 7211 - DNA, 25 bp, Artificial sequence
  Extension Primer
aggcattttcttctaccagcacaag

SEQ ID NO: 7212 - DNA, 25 bp, Artificial sequence
  Extension Primer
aatatggaaatacacttctcctttg

SEQ ID NO: 7213 - DNA, 25 bp, Artificial sequence
  Extension Primer
agggttggaagataattagcaatgt

SEQ ID NO: 7214 - DNA, 25 bp, Artificial sequence
  Extension Primer
gccacacgatgtctgtggggcgctc

SEQ ID NO: 7215 - DNA, 25 bp, Artificial sequence
  Extension Primer
tcatctatgcagagaaacacagtga

SEQ ID NO: 7216 - DNA, 25 bp, Artificial sequence
  Extension Primer
tccatcataggttattataagatat

SEQ ID NO: 7217 - DNA, 25 bp, Artificial sequence
  Extension Primer
gacgtttcaaacgttacaattcctc

SEQ ID NO: 7218 - DNA, 25 bp, Artificial sequence
  Extension Primer
gatgaggacaactgagcatctgtaa

SEQ ID NO: 7219 - DNA, 22 bp, Artificial sequence
  Extension Primer
tgcaccacggtgtcctgaagca

SEQ ID NO: 7220 - DNA, 25 bp, Artificial sequence
  Extension Primer
atttaacatctctacttactgtgct

SEQ ID NO: 7221 - DNA, 25 bp, Artificial sequence
  Extension Primer
actggacccactgtgaggcaaatct

SEQ ID NO: 7222 - DNA, 25 bp, Artificial sequence
  Extension Primer
ataaaaatatttttgctaatacaaa

SEQ ID NO: 7223 - DNA, 25 bp, Artificial sequence
  Extension Primer
ggagtttaagttataatctctctct

SEQ ID NO: 7224 - DNA, 25 bp, Artificial sequence
  Extension Primer
aatttacctgctcatatgagaaaga

SEQ ID NO: 7225 - DNA, 25 bp, Artificial sequence
  Extension Primer
cttcattggtgtgagatgcgccttt

SEQ ID NO: 7226 - DNA, 25 bp, Artificial sequence
  Extension Primer
ttggagtttgcctgcttgtgttact

SEQ ID NO: 7227 - DNA, 25 bp, Artificial sequence
  Extension Primer
ctaccaaataaagcctgatggtgct

SEQ ID NO: 7228 - DNA, 25 bp, Artificial sequence
  Extension Primer
cctaaatcgttgatattggagtcat

SEQ ID NO: 7229 - DNA, 25 bp, Artificial sequence
  Extension Primer
atttgtggttgtttagaatggaggc

SEQ ID NO: 7230 - DNA, 25 bp, Artificial sequence
  Extension Primer
aaccttagccaatattttgtctcca

SEQ ID NO: 7231 - DNA, 25 bp, Artificial sequence
  Extension Primer
tgctccttaagatcactaatttctt

SEQ ID NO: 7232 - DNA, 25 bp, Artificial sequence
  Extension Primer
ggttctggggcaggggagtgtcttc

SEQ ID NO: 7233 - DNA, 22 bp, Artificial sequence
  Extension Primer
aattctgtgattctgtattttg

SEQ ID NO: 7234 - DNA, 25 bp, Artificial sequence
  Extension Primer
ggtttagggatggtgtggatggttt

SEQ ID NO: 7235 - DNA, 22 bp, Artificial sequence
  Extension Primer
attccctatgatccatcaattc

SEQ ID NO: 7236 - DNA, 25 bp, Artificial sequence
  Extension Primer
tctacttactgtgctstatgttacc

SEQ ID NO: 7237 - DNA, 25 bp, Artificial sequence
  Extension Primer
tgttttattttctataaggccctcc

SEQ ID NO: 7238 - DNA, 22 bp, Artificial sequence
  Extension Primer
caataaaggtttaaaatttgga

SEQ ID NO: 7239 - DNA, 25 bp, Artificial sequence
  Extension Primer
atcaagaacatatttatgagctata

SEQ ID NO: 7240 - DNA, 25 bp, Artificial sequence
  Extension Primer
ttaactgtgcctctgacagacacac

SEQ ID NO: 7241 - DNA, 25 bp, Artificial sequence
  Extension Primer
tttycacgctccactacccggggaa

SEQ ID NO: 7242 - DNA, 25 bp, Artificial sequence
  Extension Primer
ttactctcttctccatccttctccc

SEQ ID NO: 7243 - DNA, 25 bp, Artificial sequence
  Extension Primer
attatttggcccagtwgaaaaaagt

SEQ ID NO: 7244 - DNA, 25 bp, Artificial sequence
  Extension Primer
tgtgtgtgctctcgcagctagcagt

SEQ ID NO: 7245 - DNA, 25 bp, Artificial sequence
  Extension Primer
tttctggattttgtttctaattctt

SEQ ID NO: 7246 - DNA, 25 bp, Artificial sequence
  Extension Primer
ctcctcctaagagagttttttccct

SEQ ID NO: 7247 - DNA, 25 bp, Artificial sequence
  Extension Primer
tgacactcacaaaataagtagtcat

SEQ ID NO: 7248 - DNA, 25 bp, Artificial sequence
  Extension Primer
agcagtgcttacattaaaggcacaa

SEQ ID NO: 7249 - DNA, 25 bp, Artificial sequence
  Extension Primer
cttattctatacagctattagtgtc

SEQ ID NO: 7250 - DNA, 25 bp, Artificial sequence
  Extension Primer
tgggctgttctgagtttctggaact

SEQ ID NO: 7251 - DNA, 25 bp, Artificial sequence
  Extension Primer
gatggaaccatggtccaagatgaga

SEQ ID NO: 7252 - DNA, 25 bp, Artificial sequence
  Extension Primer
gcttcctactcaagtcttgtcctct

SEQ ID NO: 7253 - DNA, 25 bp, Artificial sequence
  Extension Primer
tcctggagacgcagacgtggctgtt

SEQ ID NO: 7254 - DNA, 25 bp, Artificial sequence
  Extension Primer
ggccgtgagttatgcttagagtatt

SEQ ID NO: 7255 - DNA, 25 bp, Artificial sequence
  Extension Primer
tggttgcgttgtcatttcactgtca

SEQ ID NO: 7256 - DNA, 25 bp, Artificial sequence
  Extension Primer
aggcacattgttagttacaacatct

SEQ ID NO: 7257 - DNA, 25 bp, Artificial sequence
  Extension Primer
ttttactaccactgatgtgacagga

SEQ ID NO: 7258 - DNA, 25 bp, Artificial sequence
  Extension Primer
gcatgactctgacattcttcaagca

SEQ ID NO: 7259 - DNA, 25 bp, Artificial sequence
  Extension Primer
acagcatgggcttgggcacaatata

SEQ ID NO: 7260 - DNA, 25 bp, Artificial sequence
  Extension Primer
graaaaccctcattccattgctcca

SEQ ID NO: 7261 - DNA, 25 bp, Artificial sequence
  Extension Primer
gtgggcagcaggcagaggggaagcg

SEQ ID NO: 7262 - DNA, 25 bp, Artificial sequence
  Extension Primer
gaggcctcttttgcccccttactgc

SEQ ID NO: 7263 - DNA, 25 bp, Artificial sequence
  Extension Primer
agctgccggaactctgtgttcaacc

SEQ ID NO: 7264 - DNA, 25 bp, Artificial sequence
  Extension Primer
ttacccctcgtgaattcaactctta

SEQ ID NO: 7265 - DNA, 25 bp, Artificial sequence
  Extension Primer
tctgatgtgaagccagcttgttccc

SEQ ID NO: 7266 - DNA, 25 bp, Artificial sequence
  Extension Primer
tgctgaagacactgagggccaamtg

SEQ ID NO: 7267 - DNA, 25 bp, Artificial sequence
  Extension Primer
ttacctttytccatcctgttttgtg

SEQ ID NO: 7268 - DNA, 25 bp, Artificial sequence
  Extension Primer
tgttgagagtctatcctttatcttc

SEQ ID NO: 7269 - DNA, 25 bp, Artificial sequence
  Extension Primer
cataattttcataagaatttgcatt

SEQ ID NO: 7270 - DNA, 25 bp, Artificial sequence
  Extension Primer
cacagagaacagggtaagtcacttt

SEQ ID NO: 7271 - DNA, 25 bp, Artificial sequence
  Extension Primer
aaagctcccagttctgtcaagaata

SEQ ID NO: 7272 - DNA, 25 bp, Artificial sequence
  Extension Primer
gtcaagcacccaggtctcttaatcc

SEQ ID NO: 7273 - DNA, 25 bp, Artificial sequence
  Extension Primer
tttctttcctcctttccttctgagt

SEQ ID NO: 7274 - DNA, 25 bp, Artificial sequence
  Extension Primer
cattcaagtgagtcacatggatttt

SEQ ID NO: 7275 - DNA, 25 bp, Artificial sequence
  Extension Primer
aagtctcagagacttaaaatcaagc

SEQ ID NO: 7276 - DNA, 25 bp, Artificial sequence
  Extension Primer
gtgtatttctgatttaatggcaaaa

SEQ ID NO: 7277 - DNA, 25 bp, Artificial sequence
  Extension Primer
ttaatcatcgcttctgtccctgcac

SEQ ID NO: 7278 - DNA, 25 bp, Artificial sequence
  Extension Primer
gctgctaagggacacagtgcttcca

SEQ ID NO: 7279 - DNA, 25 bp, Artificial sequence
  Extension Primer
aagggaaactatgagtagaagcaaa

SEQ ID NO: 7280 - DNA, 25 bp, Artificial sequence
  Extension Primer
gcagtctggtccatctttgcattcc

SEQ ID NO: 7281 - DNA, 25 bp, Artificial sequence
  Extension Primer
gggatgctccagtcacagaaaggta

SEQ ID NO: 7282 - DNA, 25 bp, Artificial sequence
  Extension Primer
gtctccacattcctcattctgcttg

SEQ ID NO: 7283 - DNA, 25 bp, Artificial sequence
  Extension Primer
acactcacaaaataagtagtcatrt

SEQ ID NO: 7284 - DNA, 25 bp, Artificial sequence
  Extension Primer
agtcaatcttctttctgtgaatgag

SEQ ID NO: 7285 - DNA, 25 bp, Artificial sequence
  Extension Primer
acaaaaatcaagttctggcacataa

SEQ ID NO: 7286 - DNA, 25 bp, Artificial sequence
  Extension Primer
tcttcaaatagctaaaatttaggag

SEQ ID NO: 7287 - DNA, 25 bp, Artificial sequence
  Extension Primer
tgataacaatcaggttaacagtaaa

SEQ ID NO: 7288 - DNA, 25 bp, Artificial sequence
  Extension Primer
aagaaaagctggggaccatctgggc

SEQ ID NO: 7289 - DNA, 25 bp, Artificial sequence
  Extension Primer
ctgttcagcaaacttaaaacacttc

SEQ ID NO: 7290 - DNA, 25 bp, Artificial sequence
  Extension Primer
ggagttaggagaatctccatcccag

SEQ ID NO: 7291 - DNA, 25 bp, Artificial sequence
  Extension Primer
aaattgaaaaggaacatagcaaaca

SEQ ID NO: 7292 - DNA, 25 bp, Artificial sequence
  Extension Primer
taatgactggaaggactctctgagg

SEQ ID NO: 7293 - DNA, 25 bp, Artificial sequence
  Extension Primer
ccactgcctatarcagcatttgttt

SEQ ID NO: 7294 - DNA, 25 bp, Artificial sequence
  Extension Primer
tattgataagatgaatttattgccg

SEQ ID NO: 7295 - DNA, 25 bp, Artificial sequence
  Extension Primer
ccctggtgtgagcaactctgatcca

SEQ ID NO: 7296 - DNA, 25 bp, Artificial sequence
  Extension Primer
tctttccagcatttggagaccacgc

SEQ ID NO: 7297 - DNA, 25 bp, Artificial sequence
  Extension Primer
gcgactgtcattaagatccatcagt

SEQ ID NO: 7298 - DNA, 25 bp, Artificial sequence
  Extension Primer
tcagtcatttttggcaccagggact

SEQ ID NO: 7299 - DNA, 25 bp, Artificial sequence
  Extension Primer
caggragtatcattggtagagtaga

SEQ ID NO: 7300 - DNA, 25 bp, Artificial sequence
  Extension Primer
cagataaagggcagtsaatatcttc

SEQ ID NO: 7301 - DNA, 25 bp, Artificial sequence
  Extension Primer
tctttggacacctgctstgcatgta

SEQ ID NO: 7302 - DNA, 25 bp, Artificial sequence
  Extension Primer
tactatatgatttccttattatgtt

SEQ ID NO: 7303 - DNA, 25 bp, Artificial sequence
  Extension Primer
agagaggcgggaggcagactagtga

SEQ ID NO: 7304 - DNA, 25 bp, Artificial sequence
  Extension Primer
ggctgcattctttatgactgcatac

SEQ ID NO: 7305 - DNA, 25 bp, Artificial sequence
  Extension Primer
acacatacaaacctagatgggtatg

SEQ ID NO: 7306 - DNA, 25 bp, Artificial sequence
  Extension Primer
tactaagtacactcaaataactgta

SEQ ID NO: 7307 - DNA, 25 bp, Artificial sequence
  Extension Primer
aagggatacaagcagagtcaaggtg

SEQ ID NO: 7308 - DNA, 25 bp, Artificial sequence
  Extension Primer
aggctgcacagcgagtgagtggtag

SEQ ID NO: 7309 - DNA, 25 bp, Artificial sequence
  Extension Primer
gaaacagtactggaggttccagcct

SEQ ID NO: 7310 - DNA, 25 bp, Artificial sequence
  Extension Primer
tgggcggcgcaccttacctggtctc

SEQ ID NO: 7311 - DNA, 25 bp, Artificial sequence
  Extension Primer
ccacctgggtggacaccagcagata

SEQ ID NO: 7312 - DNA, 25 bp, Artificial sequence
  Extension Primer
gtagcagatacaatctggagatgag

SEQ ID NO: 7313 - DNA, 25 bp, Artificial sequence
  Extension Primer
tttaaaatcaaaatgtattgctgac

SEQ ID NO: 7314 - DNA, 25 bp, Artificial sequence
  Extension Primer
tgcagatgtggagtmcaaawagggc

SEQ ID NO: 7315 - DNA, 25 bp, Artificial sequence
  Extension Primer
acccacatgtacacactcatgtata

SEQ ID NO: 7316 - DNA, 25 bp, Artificial sequence
  Extension Primer
tcgcaaagagtcggacacgacttag

SEQ ID NO: 7317 - DNA, 25 bp, Artificial sequence
  Extension Primer
ccaaatcttagaccctcattgttct

SEQ ID NO: 7318 - DNA, 25 bp, Artificial sequence
  Extension Primer
gttttcttcctcagattaaagttat

SEQ ID NO: 7319 - DNA, 25 bp, Artificial sequence
  Extension Primer
tttttgcttaagtgtatctcactca

SEQ ID NO: 7320 - DNA, 25 bp, Artificial sequence
  Extension Primer
aaggaataatattaccacactgtga

SEQ ID NO: 7321 - DNA, 25 bp, Artificial sequence
  Extension Primer
ttaatttctgtcatggcaccaccat

SEQ ID NO: 7322 - DNA, 25 bp, Artificial sequence
  Extension Primer
aaacacttctgagattctaaaactt

SEQ ID NO: 7323 - DNA, 25 bp, Artificial sequence
  Extension Primer
catgataaaaatacatcctcttaga

SEQ ID NO: 7324 - DNA, 25 bp, Artificial sequence
  Extension Primer
atgggatatgaaggagagtcataat

SEQ ID NO: 7325 - DNA, 25 bp, Artificial sequence
  Extension Primer
catcactttgaacagcagcctgtac

SEQ ID NO: 7326 - DNA, 25 bp, Artificial sequence
  Extension Primer
gagcttctattcctgcccactgaat

SEQ ID NO: 7327 - DNA, 25 bp, Artificial sequence
  Extension Primer
cttattccatatagttaggttgatt

SEQ ID NO: 7328 - DNA, 25 bp, Artificial sequence
  Extension Primer
agcttgagaggttgtctcagagaat

SEQ ID NO: 7329 - DNA, 25 bp, Artificial sequence
  Extension Primer
tcaggcatcttttaagattgtctca

SEQ ID NO: 7330 - DNA, 25 bp, Artificial sequence
  Extension Primer
gaaatccattcatactatgaaacct

SEQ ID NO: 7331 - DNA, 25 bp, Artificial sequence
  Extension Primer
gtgtagaaacaaattaagggatggt

SEQ ID NO: 7332 - DNA, 25 bp, Artificial sequence
  Extension Primer
cttttataagtaatcatttatatgc

SEQ ID NO: 7333 - DNA, 25 bp, Artificial sequence
  Extension Primer
gtggaacgccactgacagcactcct

SEQ ID NO: 7334 - DNA, 25 bp, Artificial sequence
  Extension Primer
aaaatattgactggtagtgtgcttc

SEQ ID NO: 7335 - DNA, 25 bp, Artificial sequence
  Extension Primer
tgaaagagttttccaataggtaata

SEQ ID NO: 7336 - DNA, 25 bp, Artificial sequence
  Extension Primer
aaaaagaatagatatttgtatatgt

SEQ ID NO: 7337 - DNA, 25 bp, Artificial sequence
  Extension Primer
cacccattgggcatatgactgtgta

SEQ ID NO: 7338 - DNA, 25 bp, Artificial sequence
  Extension Primer
ccagggtagtagctccagaagaaac

SEQ ID NO: 7339 - DNA, 25 bp, Artificial sequence
  Extension Primer
ttatctttatgctgaaagacctcac

SEQ ID NO: 7340 - DNA, 25 bp, Artificial sequence
  Extension Primer
gcagcgtccccttgaatggaattat

SEQ ID NO: 7341 - DNA, 25 bp, Artificial sequence
  Extension Primer
tttcccttaaacaaaaggataccac

SEQ ID NO: 7342 - DNA, 25 bp, Artificial sequence
  Extension Primer
cactggaagtattggaagacgtggg

SEQ ID NO: 7343 - DNA, 25 bp, Artificial sequence
  Extension Primer
gccccaaatgtctagaattttacta

SEQ ID NO: 7344 - DNA, 25 bp, Artificial sequence
  Extension Primer
agagtacttaccattagtttttaat

SEQ ID NO: 7345 - DNA, 25 bp, Artificial sequence
  Extension Primer
cacttcctttacaaatgaagaaatc

SEQ ID NO: 7346 - DNA, 25 bp, Artificial sequence
  Extension Primer
cactataaaggcagacatggcaacc

SEQ ID NO: 7347 - DNA, 25 bp, Artificial sequence
  Extension Primer
tctattacatttcattagtattccc

SEQ ID NO: 7348 - DNA, 25 bp, Artificial sequence
  Extension Primer
catcagaggatttaggggttccagg

SEQ ID NO: 7349 - DNA, 25 bp, Artificial sequence
  Extension Primer
atgggaagtgaccagatttatrgag

SEQ ID NO: 7350 - DNA, 25 bp, Artificial sequence
  Extension Primer
cctcatataacattatatagagttc

SEQ ID NO: 7351 - DNA, 25 bp, Artificial sequence
  Extension Primer
ctgaattagacccccaaaacttact

SEQ ID NO: 7352 - DNA, 25 bp, Artificial sequence
  Extension Primer
gccataatatgtagctcaaggaaaa

SEQ ID NO: 7353 - DNA, 25 bp, Artificial sequence
  Extension Primer
gggaagacgaaattgcagaagggga

SEQ ID NO: 7354 - DNA, 25 bp, Artificial sequence
  Extension Primer
cagtacttggggaaacctgagagtt

SEQ ID NO: 7355 - DNA, 25 bp, Artificial sequence
  Extension Primer
gcaagtcacattagatcaagtctcg

SEQ ID NO: 7356 - DNA, 25 bp, Artificial sequence
  Extension Primer
tctctcataatgcttggaaggaaga

SEQ ID NO: 7357 - DNA, 25 bp, Artificial sequence
  Extension Primer
ttcctgacaasaataaatgagctgt

SEQ ID NO: 7358 - DNA, 25 bp, Artificial sequence
  Extension Primer
cttgacatgatgtggagttttgttt

SEQ ID NO: 7359 - DNA, 25 bp, Artificial sequence
  Extension Primer
aacactgcaaaagttaagtgcaggt

SEQ ID NO: 7360 - DNA, 25 bp, Artificial sequence
  Extension Primer
tgttgtctggccctctctgagcctc

SEQ ID NO: 7361 - DNA, 22 bp, Artificial sequence
  Extension Primer
accatttctctctattgcttaa

SEQ ID NO: 7362 - DNA, 25 bp, Artificial sequence
  Extension Primer
agtacttcatttattcttttgagga

SEQ ID NO: 7363 - DNA, 22 bp, Artificial sequence
  Extension Primer
tagcagatatcatgctaaacat

SEQ ID NO: 7364 - DNA, 25 bp, Artificial sequence
  Extension Primer
ttggtggtgattttattctggtttt

SEQ ID NO: 7365 - DNA, 25 bp, Artificial sequence
  Extension Primer
ttctctctcactcaaagcctcctac

SEQ ID NO: 7366 - DNA, 25 bp, Artificial sequence
  Extension Primer
catttgtaaaaatgggactggagtg

SEQ ID NO: 7367 - DNA, 25 bp, Artificial sequence
  Extension Primer
ctcctgcctctttgatcctagaaaa

SEQ ID NO: 7368 - DNA, 25 bp, Artificial sequence
  Extension Primer
tcctcaatgatgtttttacatgtgt

SEQ ID NO: 7369 - DNA, 25 bp, Artificial sequence
  Extension Primer
ccacacactaagagggctagttcaa

SEQ ID NO: 7370 - DNA, 25 bp, Artificial sequence
  Extension Primer
caaataataaagttaagcattaagt

SEQ ID NO: 7371 - DNA, 25 bp, Artificial sequence
  Extension Primer
gaaaacacaggtgtaaatcttcatt

SEQ ID NO: 7372 - DNA, 25 bp, Artificial sequence
  Extension Primer
gtctcacttcctagactctggacac

SEQ ID NO: 7373 - DNA, 22 bp, Artificial sequence
  Extension Primer
ccacacccactgatggaaggta

SEQ ID NO: 7374 - DNA, 25 bp, Artificial sequence
  Extension Primer
tgacactcttaaccagagacgacca

SEQ ID NO: 7375 - DNA, 25 bp, Artificial sequence
  Extension Primer
gtcccttctgatcttaaaacaaatc

SEQ ID NO: 7376 - DNA, 25 bp, Artificial sequence
  Extension Primer
tggcckcattgagataaagagatgt

SEQ ID NO: 7377 - DNA, 25 bp, Artificial sequence
  Extension Primer
ccaaactgctagctcactacccttt

SEQ ID NO: 7378 - DNA, 25 bp, Artificial sequence
  Extension Primer
cattcccatggtgaagctctgttta

SEQ ID NO: 7379 - DNA, 25 bp, Artificial sequence
  Extension Primer
atggtggagattttggaaggggtga

SEQ ID NO: 7380 - DNA, 25 bp, Artificial sequence
  Extension Primer
cctgagattatacgtagaacaaaat

SEQ ID NO: 7381 - DNA, 25 bp, Artificial sequence
  Extension Primer
gtgatttccttctctctctctttac

SEQ ID NO: 7382 - DNA, 25 bp, Artificial sequence
  Extension Primer
ttgcatataaagtgacaagcctaat

SEQ ID NO: 7383 - DNA, 25 bp, Artificial sequence
  Extension Primer
tatccttttcaccctgtagcacagt

SEQ ID NO: 7384 - DNA, 22 bp, Artificial sequence
  Extension Primer
gcacaaattrtagtcagatagc

SEQ ID NO: 7385 - DNA, 25 bp, Artificial sequence
  Extension Primer
ctgcctcaatcttatcctctttaga

SEQ ID NO: 7386 - DNA, 25 bp, Artificial sequence
  Extension Primer
tgacaggagaacatccctgagataa

SEQ ID NO: 7387 - DNA, 25 bp, Artificial sequence
  Extension Primer
actgtctagattaaacattattgaa

SEQ ID NO: 7388 - DNA, 25 bp, Artificial sequence
  Extension Primer
acactacccatgggtctcacttctg

SEQ ID NO: 7389 - DNA, 25 bp, Artificial sequence
  Extension Primer
ggccacttactgagacctcagtcta

SEQ ID NO: 7390 - DNA, 25 bp, Artificial sequence
  Extension Primer
atgattttttggaacttgttttaat

SEQ ID NO: 7391 - DNA, 25 bp, Artificial sequence
  Extension Primer
agaatgcaaygagatatgattctag

SEQ ID NO: 7392 - DNA, 25 bp, Artificial sequence
  Extension Primer
taaatattacatgaataaagtaaat

SEQ ID NO: 7393 - DNA, 25 bp, Artificial sequence
  Extension Primer
gctcttcagacagctcgggtaagga

SEQ ID NO: 7394 - DNA, 25 bp, Artificial sequence
  Extension Primer
agagccattaatcattccatttgcg

SEQ ID NO: 7395 - DNA, 25 bp, Artificial sequence
  Extension Primer
tatgtagtcccctcttacattatac

SEQ ID NO: 7396 - DNA, 25 bp, Artificial sequence
  Extension Primer
taagctctgctgctgctgctaagtc

SEQ ID NO: 7397 - DNA, 25 bp, Artificial sequence
  Extension Primer
tctcttttttcttccatttagagtc

SEQ ID NO: 7398 - DNA, 25 bp, Artificial sequence
  Extension Primer
ggcagtagaaaagggtgaaaccaag

SEQ ID NO: 7399 - DNA, 25 bp, Artificial sequence
  Extension Primer
tggcataagaatttgagagtaggaa

SEQ ID NO: 7400 - DNA, 25 bp, Artificial sequence
  Extension Primer
aatttctacctttctgtttgaacaa

SEQ ID NO: 7401 - DNA, 25 bp, Artificial sequence
  Extension Primer
taatattcttttgaggctttaaaat

SEQ ID NO: 7402 - DNA, 25 bp, Artificial sequence
  Extension Primer
tgtctcaagccagcttatatggtaa

SEQ ID NO: 7403 - DNA, 25 bp, Artificial sequence
  Extension Primer
agggtaggaactgatgtgagcgaag

SEQ ID NO: 7404 - DNA, 22 bp, Artificial sequence
  Extension Primer
tatcccaagcctcatactctgc

SEQ ID NO: 7405 - DNA, 25 bp, Artificial sequence
  Extension Primer
atagacaaaaggccacgaagaaaga

SEQ ID NO: 7406 - DNA, 25 bp, Artificial sequence
  Extension Primer
gtgmtgtctttttatgctgatgtgc

SEQ ID NO: 7407 - DNA, 25 bp, Artificial sequence
  Extension Primer
ctctatgtctaygtttytattcctg

SEQ ID NO: 7408 - DNA, 25 bp, Artificial sequence
  Extension Primer
aagacagaaaacatttcacaacttc

SEQ ID NO: 7409 - DNA, 25 bp, Artificial sequence
  Extension Primer
agggggatttctctcagccaagtcc

SEQ ID NO: 7410 - DNA, 25 bp, Artificial sequence
  Extension Primer
gcagggtctggcacccccacccttt

SEQ ID NO: 7411 - DNA, 25 bp, Artificial sequence
  Extension Primer
gagcacagcctctcackgggctggg

SEQ ID NO: 7412 - DNA, 25 bp, Artificial sequence
  Extension Primer
gttctaaaatatcccaaccttttct

SEQ ID NO: 7413 - DNA, 25 bp, Artificial sequence
  Extension Primer
ctgttgtttcccagaaggggctggg

SEQ ID NO: 7414 - DNA, 25 bp, Artificial sequence
  Extension Primer
acctgtgatggctcccaataaagtt

SEQ ID NO: 7415 - DNA, 25 bp, Artificial sequence
  Extension Primer
ctctttaactgagttgtaacctggg

SEQ ID NO: 7416 - DNA, 25 bp, Artificial sequence
  Extension Primer
gaagaggatcatagtgggcttagtg

SEQ ID NO: 7417 - DNA, 25 bp, Artificial sequence
  Extension Primer
actgtggacagtggtatgacagttt

SEQ ID NO: 7418 - DNA, 25 bp, Artificial sequence
  Extension Primer
tgcactacataaacaaatttcctga

SEQ ID NO: 7419 - DNA, 25 bp, Artificial sequence
  Extension Primer
gactatatgcatacactcattttta

SEQ ID NO: 7420 - DNA, 25 bp, Artificial sequence
  Extension Primer
attttgatacagatgtactctctac

SEQ ID NO: 7421 - DNA, 25 bp, Artificial sequence
  Extension Primer
tggtagtgcagtcagtaaaaaatct

SEQ ID NO: 7422 - DNA, 22 bp, Artificial sequence
  Extension Primer
ggaccccataccctaaagcctg

SEQ ID NO: 7423 - DNA, 25 bp, Artificial sequence
  Extension Primer
gactggaaaacacagtccacggatt

SEQ ID NO: 7424 - DNA, 25 bp, Artificial sequence
  Extension Primer
caaaagagtgsaaaagctccagwrc

SEQ ID NO: 7425 - DNA, 25 bp, Artificial sequence
  Extension Primer
gagaagtactgttctcaggaacctt

SEQ ID NO: 7426 - DNA, 25 bp, Artificial sequence
  Extension Primer
tccctggaaaccagtagctatcagt

SEQ ID NO: 7427 - DNA, 25 bp, Artificial sequence
  Extension Primer
cttccatgaagaaactttgcaataa

SEQ ID NO: 7428 - DNA, 25 bp, Artificial sequence
  Extension Primer
actgagcaaggtggctatttcctaa

SEQ ID NO: 7429 - DNA, 25 bp, Artificial sequence
  Extension Primer
ctctcaaatcttttctccaatatac

SEQ ID NO: 7430 - DNA, 25 bp, Artificial sequence
  Extension Primer
ccgctcatctccactcattataccc

SEQ ID NO: 7431 - DNA, 25 bp, Artificial sequence
  Extension Primer
tcctcttatgtaggcatcatcctct

SEQ ID NO: 7432 - DNA, 25 bp, Artificial sequence
  Extension Primer
ggaagagcggggctagtccttactc

SEQ ID NO: 7433 - DNA, 25 bp, Artificial sequence
  Extension Primer
acccatcttcaacctactcstgatc

SEQ ID NO: 7434 - DNA, 25 bp, Artificial sequence
  Extension Primer
gatctgttctgactggttaacaaga

SEQ ID NO: 7435 - DNA, 25 bp, Artificial sequence
  Extension Primer
actggaaaacagcttaaaagaaaaa

SEQ ID NO: 7436 - DNA, 25 bp, Artificial sequence
  Extension Primer
gagtcttgaaatcagccggcccagg

SEQ ID NO: 7437 - DNA, 25 bp, Artificial sequence
  Extension Primer
atcaggcttaggcatcccgccccct

SEQ ID NO: 7438 - DNA, 25 bp, Artificial sequence
  Extension Primer
ttgtcaaccactcttacatttttat

SEQ ID NO: 7439 - DNA, 25 bp, Artificial sequence
  Extension Primer
gcctctctgtttacctgggcctgcg

SEQ ID NO: 7440 - DNA, 25 bp, Artificial sequence
  Extension Primer
caggtgctcggtacggagcaggggg

SEQ ID NO: 7441 - DNA, 25 bp, Artificial sequence
  Extension Primer
tcgagtcaaacagaagccttatctc

SEQ ID NO: 7442 - DNA, 25 bp, Artificial sequence
  Extension Primer
taaagacagctaatcatgatattat

SEQ ID NO: 7443 - DNA, 25 bp, Artificial sequence
  Extension Primer
acctttgccagctggtttccaatgg

SEQ ID NO: 7444 - DNA, 25 bp, Artificial sequence
  Extension Primer
aaggcccttctccaatcccggtgta

SEQ ID NO: 7445 - DNA, 25 bp, Artificial sequence
  Extension Primer
actgcctgaaaaaaagacagcaaat

SEQ ID NO: 7446 - DNA, 25 bp, Artificial sequence
  Extension Primer
tccaggaatgacttttactacatgg

SEQ ID NO: 7447 - DNA, 25 bp, Artificial sequence
  Extension Primer
caccctgacatgttcataaataact

SEQ ID NO: 7448 - DNA, 25 bp, Artificial sequence
  Extension Primer
gactgctgggtgctggccagagggg

SEQ ID NO: 7449 - DNA, 22 bp, Artificial sequence
  Extension Primer
aaacyggtgattttactctttc

SEQ ID NO: 7450 - DNA, 25 bp, Artificial sequence
  Extension Primer
taagtaaccatgtgatcatagatga

SEQ ID NO: 7451 - DNA, 25 bp, Artificial sequence
  Extension Primer
caaaaagaaaaaagtcaaggaatca

SEQ ID NO: 7452 - DNA, 25 bp, Artificial sequence
  Extension Primer
atttcatcaattgttatacaataac

SEQ ID NO: 7453 - DNA, 25 bp, Artificial sequence
  Extension Primer
ctgtctagctcactgtggaattcac

SEQ ID NO: 7454 - DNA, 25 bp, Artificial sequence
  Extension Primer
cactgctgaagacactgagggccaa

SEQ ID NO: 7455 - DNA, 25 bp, Artificial sequence
  Extension Primer
tgctgattggctggcattgtaaatg

SEQ ID NO: 7456 - DNA, 25 bp, Artificial sequence
  Extension Primer
cactacyaatgttatcattatcctt

SEQ ID NO: 7457 - DNA, 25 bp, Artificial sequence
  Extension Primer
attaattttctgagcatttgggtgg

SEQ ID NO: 7458 - DNA, 25 bp, Artificial sequence
  Extension Primer
ctggagagaaatgatgcatgcacac

SEQ ID NO: 7459 - DNA, 25 bp, Artificial sequence
  Extension Primer
tcacacctgataaaaattagcaatg

SEQ ID NO: 7460 - DNA, 25 bp, Artificial sequence
  Extension Primer
gactaatgaaaatattcatcaagat

SEQ ID NO: 7461 - DNA, 25 bp, Artificial sequence
  Extension Primer
attgacagagacactttaaaagagc

SEQ ID NO: 7462 - DNA, 25 bp, Artificial sequence
  Extension Primer
cctgtgcccaagaaactctttacaa

SEQ ID NO: 7463 - DNA, 25 bp, Artificial sequence
  Extension Primer
attcatttatattcacatcaatcag

SEQ ID NO: 7464 - DNA, 25 bp, Artificial sequence
  Extension Primer
cttttaatcattattcagattcagg

SEQ ID NO: 7465 - DNA, 25 bp, Artificial sequence
  Extension Primer
attaacttgcaattaaaatagctta

SEQ ID NO: 7466 - DNA, 25 bp, Artificial sequence
  Extension Primer
gcttgtcaagagtccaacctatgaa

SEQ ID NO: 7467 - DNA, 25 bp, Artificial sequence
  Extension Primer
atgagccagttgatatgtcattctt

SEQ ID NO: 7468 - DNA, 25 bp, Artificial sequence
  Extension Primer
atatgttattttaaatggtgacaca

SEQ ID NO: 7469 - DNA, 25 bp, Artificial sequence
  Extension Primer
tctgtgtttttcttggccattctac

SEQ ID NO: 7470 - DNA, 25 bp, Artificial sequence
  Extension Primer
accggagccctttgttagcgagaac

SEQ ID NO: 7471 - DNA, 25 bp, Artificial sequence
  Extension Primer
ggagagtcttttgattagtaaaatc

SEQ ID NO: 7472 - DNA, 25 bp, Artificial sequence
  Extension Primer
agctgtggtataggaagaagtgaac

SEQ ID NO: 7473 - DNA, 25 bp, Artificial sequence
  Extension Primer
cccttcccttttaaacaccataaac

SEQ ID NO: 7474 - DNA, 25 bp, Artificial sequence
  Extension Primer
tacaaaggcctctcttctgaagaca

SEQ ID NO: 7475 - DNA, 25 bp, Artificial sequence
  Extension Primer
ttgtgcggtgtatgtctgtgctgag

SEQ ID NO: 7476 - DNA, 25 bp, Artificial sequence
  Extension Primer
tccatctctgtgcgaccccatagac

SEQ ID NO: 7477 - DNA, 25 bp, Artificial sequence
  Extension Primer
tgatgagcctttgccctcaccatcc

SEQ ID NO: 7478 - DNA, 22 bp, Artificial sequence
  Extension Primer
tccaggctttgagctcctgggg

SEQ ID NO: 7479 - DNA, 25 bp, Artificial sequence
  Extension Primer
aagacattttctaaatacaaaagca

SEQ ID NO: 7480 - DNA, 25 bp, Artificial sequence
  Extension Primer
ttggagaaactctaccagaggcttc

SEQ ID NO: 7481 - DNA, 25 bp, Artificial sequence
  Extension Primer
atagcccccttttcctcaaaccaag

SEQ ID NO: 7482 - DNA, 25 bp, Artificial sequence
  Extension Primer
cttacagctgcacagggacagtgtc

SEQ ID NO: 7483 - DNA, 25 bp, Artificial sequence
  Extension Primer
gcccttgaaacgtaggttcagattc

SEQ ID NO: 7484 - DNA, 25 bp, Artificial sequence
  Extension Primer
ttatctgcratatttaatccaaatt

SEQ ID NO: 7485 - DNA, 25 bp, Artificial sequence
  Extension Primer
cagggagcattctatgcttcattgt

SEQ ID NO: 7486 - DNA, 25 bp, Artificial sequence
  Extension Primer
ggtgttttgcttatttctgaatctc

SEQ ID NO: 7487 - DNA, 25 bp, Artificial sequence
  Extension Primer
agaatcagttaggtgctgtttgtca

SEQ ID NO: 7488 - DNA, 25 bp, Artificial sequence
  Extension Primer
attggagaagccctctggtgttaat

SEQ ID NO: 7489 - DNA, 25 bp, Artificial sequence
  Extension Primer
attttgtgtattttgaggagtttta

SEQ ID NO: 7490 - DNA, 25 bp, Artificial sequence
  Extension Primer
tttgcaaagtgcttttaaaatttac

SEQ ID NO: 7491 - DNA, 25 bp, Artificial sequence
  Extension Primer
tagttcacaaaatacttctttctag

SEQ ID NO: 7492 - DNA, 25 bp, Artificial sequence
  Extension Primer
ttttttttgttgttgttgctttgcc

SEQ ID NO: 7493 - DNA, 25 bp, Artificial sequence
  Extension Primer
cttgccaaccaggagccatccctat

SEQ ID NO: 7494 - DNA, 25 bp, Artificial sequence
  Extension Primer
ccccgggttacccccaatgcaagca

SEQ ID NO: 7495 - DNA, 25 bp, Artificial sequence
  Extension Primer
cagatggtttgtgtgtgtggagtgc

SEQ ID NO: 7496 - DNA, 25 bp, Artificial sequence
  Extension Primer
agatactctgacgataaatggtgct

SEQ ID NO: 7497 - DNA, 25 bp, Artificial sequence
  Extension Primer
aacatataaacagtatcagccaaca

SEQ ID NO: 7498 - DNA, 25 bp, Artificial sequence
  Extension Primer
aattattctaccttaaatcttctat

SEQ ID NO: 7499 - DNA, 25 bp, Artificial sequence
  Extension Primer
ttaaagtttgttttccgttttgttt

SEQ ID NO: 7500 - DNA, 25 bp, Artificial sequence
  Extension Primer
gtgagattgatgggatgacacagca

SEQ ID NO: 7501 - DNA, 25 bp, Artificial sequence
  Extension Primer
atgttagttcctgttatacaacyta

SEQ ID NO: 7502 - DNA, 25 bp, Artificial sequence
  Extension Primer
aaaacaacaatagaaacgttctcaa

SEQ ID NO: 7503 - DNA, 25 bp, Artificial sequence
  Extension Primer
cagtgttgcagtttcatcacatcta

SEQ ID NO: 7504 - DNA, 25 bp, Artificial sequence
  Extension Primer
tttatcacagaatgaatttttgaag

SEQ ID NO: 7505 - DNA, 25 bp, Artificial sequence
  Extension Primer
cagcaacactgaattttccctcctg

SEQ ID NO: 7506 - DNA, 25 bp, Artificial sequence
  Extension Primer
tcccctacccatcttcaacctactc

SEQ ID NO: 7507 - DNA, 25 bp, Artificial sequence
  Extension Primer
gcaaacagggccatttttaatggac

SEQ ID NO: 7508 - DNA, 25 bp, Artificial sequence
  Extension Primer
acaactgagcagctgaactgatgtt

SEQ ID NO: 7509 - DNA, 25 bp, Artificial sequence
  Extension Primer
aaaaaaaaaaaaaaaaaagagggag

SEQ ID NO: 7510 - DNA, 25 bp, Artificial sequence
  Extension Primer
cacacacagcattcctgctgtcatc

SEQ ID NO: 7511 - DNA, 25 bp, Artificial sequence
  Extension Primer
tactttggtagtatgtggtttctag

SEQ ID NO: 7512 - DNA, 25 bp, Artificial sequence
  Extension Primer
aaatttttaattatagttgcctttg

SEQ ID NO: 7513 - DNA, 25 bp, Artificial sequence
  Extension Primer
ctacttaaaccattcagaatcctct

SEQ ID NO: 7514 - DNA, 25 bp, Artificial sequence
  Extension Primer
tgcaaattcattcatgaacttgatc

SEQ ID NO: 7515 - DNA, 25 bp, Artificial sequence
  Extension Primer
gctagtctctgagatattccatgaa

SEQ ID NO: 7516 - DNA, 25 bp, Artificial sequence
  Extension Primer
aaaaagatcttatggcccccgcaag

SEQ ID NO: 7517 - DNA, 25 bp, Artificial sequence
  Extension Primer
ttttgcttcatttatattctccttt

SEQ ID NO: 7518 - DNA, 25 bp, Artificial sequence
  Extension Primer
ggttttgtttttcgctaagaggata

SEQ ID NO: 7519 - DNA, 25 bp, Artificial sequence
  Extension Primer
atcaaatatacattgttttatttct

SEQ ID NO: 7520 - DNA, 25 bp, Artificial sequence
  Extension Primer
ccctagtgcccttccctagatatta

SEQ ID NO: 7521 - DNA, 25 bp, Artificial sequence
  Extension Primer
ttaaggaggagggaaagcgagctgg

SEQ ID NO: 7522 - DNA, 25 bp, Artificial sequence
  Extension Primer
tactccaattacaagttaaggaaaa

SEQ ID NO: 7523 - DNA, 25 bp, Artificial sequence
  Extension Primer
ctttactagccacaggaaaagctcc

SEQ ID NO: 7524 - DNA, 25 bp, Artificial sequence
  Extension Primer
ggagaatcatgttttgctcctgagt

SEQ ID NO: 7525 - DNA, 25 bp, Artificial sequence
  Extension Primer
tcagaagggaagcgacacttcaaat

SEQ ID NO: 7526 - DNA, 25 bp, Artificial sequence
  Extension Primer
cagttctctgaaagggtcagtaaaa

SEQ ID NO: 7527 - DNA, 25 bp, Artificial sequence
  Extension Primer
ggttttaggatatatagaaagaaga

SEQ ID NO: 7528 - DNA, 25 bp, Artificial sequence
  Extension Primer
gtttttcaaggctcaggagtgatta

SEQ ID NO: 7529 - DNA, 25 bp, Artificial sequence
  Extension Primer
tactgttttctgatggacaggctct

SEQ ID NO: 7530 - DNA, 25 bp, Artificial sequence
  Extension Primer
tattagatcttggggtggagggaac

SEQ ID NO: 7531 - DNA, 25 bp, Artificial sequence
  Extension Primer
ggctgatgctctgtgtgggtctttg

SEQ ID NO: 7532 - DNA, 25 bp, Artificial sequence
  Extension Primer
accgaatgtccgtcattactttact

SEQ ID NO: 7533 - DNA, 25 bp, Artificial sequence
  Extension Primer
cacagtttttgaaaaacataggaaa

SEQ ID NO: 7534 - DNA, 25 bp, Artificial sequence
  Extension Primer
gaatttccgaacagtcattatctgc

SEQ ID NO: 7535 - DNA, 25 bp, Artificial sequence
  Extension Primer
tgaacttgcatctttgttttgttcc

SEQ ID NO: 7536 - DNA, 25 bp, Artificial sequence
  Extension Primer
agctactcctcagtggcagaaaaac

SEQ ID NO: 7537 - DNA, 25 bp, Artificial sequence
  Extension Primer
atatgctgacacagatgctaaatga

SEQ ID NO: 7538 - DNA, 25 bp, Artificial sequence
  Extension Primer
gtttattctatatgatactgtagtt

SEQ ID NO: 7539 - DNA, 25 bp, Artificial sequence
  Extension Primer
cgctgttgccatggcacccacctgg

SEQ ID NO: 7540 - DNA, 25 bp, Artificial sequence
  Extension Primer
aggagaaaagcggcccaaatagagt

SEQ ID NO: 7541 - DNA, 25 bp, Artificial sequence
  Extension Primer
gaggtgtttgacaggcagatgaacc

SEQ ID NO: 7542 - DNA, 25 bp, Artificial sequence
  Extension Primer
gcgcttgaaggccttgccgcactcg

SEQ ID NO: 7543 - DNA, 25 bp, Artificial sequence
  Extension Primer
ctgaactaccagaacacggctttag

SEQ ID NO: 7544 - DNA, 25 bp, Artificial sequence
  Extension Primer
ccacatcgcacgagccagtgcagga

SEQ ID NO: 7545 - DNA, 25 bp, Artificial sequence
  Extension Primer
tcagattaagtaccagttcctcaga

SEQ ID NO: 7546 - DNA, 25 bp, Artificial sequence
  Extension Primer
ttgaaataaaattcatggcagtata

SEQ ID NO: 7547 - DNA, 25 bp, Artificial sequence
  Extension Primer
ctgtgaaagactacctctgttgttt

SEQ ID NO: 7548 - DNA, 25 bp, Artificial sequence
  Extension Primer
tttttaactacttaagagaatcttg

SEQ ID NO: 7549 - DNA, 25 bp, Artificial sequence
  Extension Primer
tatttacctaagtggagccttttgt

SEQ ID NO: 7550 - DNA, 25 bp, Artificial sequence
  Extension Primer
tatttgtatactgaatattagttac

SEQ ID NO: 7551 - DNA, 25 bp, Artificial sequence
  Extension Primer
attaaaaacatgaaaataaaaatag

SEQ ID NO: 7552 - DNA, 25 bp, Artificial sequence
  Extension Primer
gtgaaggagctctgagaacccctct

SEQ ID NO: 7553 - DNA, 25 bp, Artificial sequence
  Extension Primer
ccatccctcctccaaccctctcccc

SEQ ID NO: 7554 - DNA, 25 bp, Artificial sequence
  Extension Primer
gagtctaaacgatttgtttggattt

SEQ ID NO: 7555 - DNA, 25 bp, Artificial sequence
  Extension Primer
caggccgggtttccaattcattttt

SEQ ID NO: 7556 - DNA, 25 bp, Artificial sequence
  Extension Primer
taaaccaactgtgtacaggcaagtc

SEQ ID NO: 7557 - DNA, 22 bp, Artificial sequence
  Extension Primer
tcttgataataatatgcataag

SEQ ID NO: 7558 - DNA, 25 bp, Artificial sequence
  Extension Primer
agtttcatctagcagaggagaaaga

SEQ ID NO: 7559 - DNA, 25 bp, Artificial sequence
  Extension Primer
aaggcctaggcggctaggtgggagc

SEQ ID NO: 7560 - DNA, 25 bp, Artificial sequence
  Extension Primer
gatgttaacaagtaagcagtttggt

SEQ ID NO: 7561 - DNA, 25 bp, Artificial sequence
  Extension Primer
atcctgtagaaagtatttttcgatt

SEQ ID NO: 7562 - DNA, 25 bp, Artificial sequence
  Extension Primer
cttgtctattaacacttgcagaatt

SEQ ID NO: 7563 - DNA, 25 bp, Artificial sequence
  Extension Primer
tcaaccaactattgtccaatataaa

SEQ ID NO: 7564 - DNA, 25 bp, Artificial sequence
  Extension Primer
tattccagttcagccccactcacat

SEQ ID NO: 7565 - DNA, 25 bp, Artificial sequence
  Extension Primer
aactaccagaacacggctttagytc

SEQ ID NO: 7566 - DNA, 25 bp, Artificial sequence
  Extension Primer
tctgcagataatcatgagccaaaat

SEQ ID NO: 7567 - DNA, 25 bp, Artificial sequence
  Extension Primer
actctgttatgcccaaatgttacat

SEQ ID NO: 7568 - DNA, 25 bp, Artificial sequence
  Extension Primer
gatccttctctcctgactttggtga

SEQ ID NO: 7569 - DNA, 25 bp, Artificial sequence
  Extension Primer
ctggttatctattttacatatggta

SEQ ID NO: 7570 - DNA, 25 bp, Artificial sequence
  Extension Primer
caaagaaaccagcctgggaaatgaa

SEQ ID NO: 7571 - DNA, 25 bp, Artificial sequence
  Extension Primer
ctatggtgcaacagcaaaatgagca

SEQ ID NO: 7572 - DNA, 25 bp, Artificial sequence
  Extension Primer
gtttaaaggaagacaagaccaagag

SEQ ID NO: 7573 - DNA, 25 bp, Artificial sequence
  Extension Primer
tcacacattggacatttacaaaatg

SEQ ID NO: 7574 - DNA, 25 bp, Artificial sequence
  Extension Primer
tccagtcctctactaskgcctccca

SEQ ID NO: 7575 - DNA, 25 bp, Artificial sequence
  Extension Primer
gaaaaggatattcttgttctccata

SEQ ID NO: 7576 - DNA, 25 bp, Artificial sequence
  Extension Primer
tatttctcattcattcattcagcac

SEQ ID NO: 7577 - DNA, 22 bp, Artificial sequence
  Extension Primer
cattaaaaataattatatgtca

SEQ ID NO: 7578 - DNA, 25 bp, Artificial sequence
  Extension Primer
gatttggtgttataactattattag

SEQ ID NO: 7579 - DNA, 25 bp, Artificial sequence
  Extension Primer
gcctcacgtcttcaggttaactctt

SEQ ID NO: 7580 - DNA, 25 bp, Artificial sequence
  Extension Primer
ttaaattgttctatgaagagaaaat

SEQ ID NO: 7581 - DNA, 25 bp, Artificial sequence
  Extension Primer
gagttaagcaaatcagcatgggcat

SEQ ID NO: 7582 - DNA, 25 bp, Artificial sequence
  Extension Primer
gcctgaaataaaggtagttggttga

SEQ ID NO: 7583 - DNA, 25 bp, Artificial sequence
  Extension Primer
agacacaatctcaggaagatgaaga

SEQ ID NO: 7584 - DNA, 25 bp, Artificial sequence
  Extension Primer
tctaatgactcaactgcttaaattc

SEQ ID NO: 7585 - DNA, 25 bp, Artificial sequence
  Extension Primer
cacttgctccttcttggtcttactc

SEQ ID NO: 7586 - DNA, 25 bp, Artificial sequence
  Extension Primer
tgtttataattatagagacaagaaa

SEQ ID NO: 7587 - DNA, 25 bp, Artificial sequence
  Extension Primer
gaagaatcctgaaaataatcacaca

SEQ ID NO: 7588 - DNA, 22 bp, Artificial sequence
  Extension Primer
gttgtatgagtgacaggttcaa

SEQ ID NO: 7589 - DNA, 22 bp, Artificial sequence
  Extension Primer
gggagggmacaggcactgtctc

SEQ ID NO: 7590 - DNA, 25 bp, Artificial sequence
  Extension Primer
aaaattgcataatgttctatataac

SEQ ID NO: 7591 - DNA, 25 bp, Artificial sequence
  Extension Primer
cactgttttggaaaaaatgactaca

SEQ ID NO: 7592 - DNA, 25 bp, Artificial sequence
  Extension Primer
gactggcaaaaagtgtggattaaaa

SEQ ID NO: 7593 - DNA, 25 bp, Artificial sequence
  Extension Primer
aggaaagcaactgctactggaagag

SEQ ID NO: 7594 - DNA, 25 bp, Artificial sequence
  Extension Primer
aacacacaagggatgacttgagtgc

SEQ ID NO: 7595 - DNA, 25 bp, Artificial sequence
  Extension Primer
ctcatttatgcatcatttaaaataa

SEQ ID NO: 7596 - DNA, 25 bp, Artificial sequence
  Extension Primer
aaatacagattatttcaaaaaggtc

SEQ ID NO: 7597 - DNA, 25 bp, Artificial sequence
  Extension Primer
caatactgaaaatactgagtgtgag

SEQ ID NO: 7598 - DNA, 25 bp, Artificial sequence
  Extension Primer
mactgagagtcyggattccctaaag

SEQ ID NO: 7599 - DNA, 25 bp, Artificial sequence
  Extension Primer
ttttatttagacagaaggatgacag

SEQ ID NO: 7600 - DNA, 25 bp, Artificial sequence
  Extension Primer
aagtaaccggagaggtttgtttaga

SEQ ID NO: 7601 - DNA, 25 bp, Artificial sequence
  Extension Primer
gtatactgaaagtgtctggacagtt

SEQ ID NO: 7602 - DNA, 25 bp, Artificial sequence
  Extension Primer
cacatgcaagtatatacagaagctt

SEQ ID NO: 7603 - DNA, 25 bp, Artificial sequence
  Extension Primer
catgtgaagcactccacatattttg

SEQ ID NO: 7604 - DNA, 25 bp, Artificial sequence
  Extension Primer
aatttagttaaccatggtggaataa

SEQ ID NO: 7605 - DNA, 25 bp, Artificial sequence
  Extension Primer
ccataaatgcatgcaaagtagagca

SEQ ID NO: 7606 - DNA, 25 bp, Artificial sequence
  Extension Primer
atctcacaaaaatactgaggtactc

SEQ ID NO: 7607 - DNA, 22 bp, Artificial sequence
  Extension Primer
gccatccctatyatatgactcc

SEQ ID NO: 7608 - DNA, 25 bp, Artificial sequence
  Extension Primer
ttgcttatttctgaatctcyggctc

SEQ ID NO: 7609 - DNA, 25 bp, Artificial sequence
  Extension Primer
gtacagttggcatctggctttgttc

SEQ ID NO: 7610 - DNA, 25 bp, Artificial sequence
  Extension Primer
agagatgaaggtgcccgcccgcaga

SEQ ID NO: 7611 - DNA, 25 bp, Artificial sequence
  Extension Primer
ttataatgtcagagtgtccttggga

SEQ ID NO: 7612 - DNA, 25 bp, Artificial sequence
  Extension Primer
tcctgcagaaagcaccacygaaggc

SEQ ID NO: 7613 - DNA, 25 bp, Artificial sequence
  Extension Primer
tcctaaccactggactgacagggaa

SEQ ID NO: 7614 - DNA, 25 bp, Artificial sequence
  Extension Primer
aaagtatttttcgattygacccatt

SEQ ID NO: 7615 - DNA, 25 bp, Artificial sequence
  Extension Primer
ccaaagggtgggaggagtcattgta

SEQ ID NO: 7616 - DNA, 25 bp, Artificial sequence
  Extension Primer
ccacacagaaaagcgatgaaagaag

SEQ ID NO: 7617 - DNA, 25 bp, Artificial sequence
  Extension Primer
ttttagcttcctttctgtagtctta

SEQ ID NO: 7618 - DNA, 25 bp, Artificial sequence
  Extension Primer
gaatccagagaatgagaaaaagtga

SEQ ID NO: 7619 - DNA, 25 bp, Artificial sequence
  Extension Primer
aggaaaactaccaccagacagagga

SEQ ID NO: 7620 - DNA, 25 bp, Artificial sequence
  Extension Primer
catctggaaagtgggattatggtag

SEQ ID NO: 7621 - DNA, 25 bp, Artificial sequence
  Extension Primer
aagaaagagagaatcaagcctaaag

SEQ ID NO: 7622 - DNA, 25 bp, Artificial sequence
  Extension Primer
aacaaaaaaaacattcttacttttc

SEQ ID NO: 7623 - DNA, 25 bp, Artificial sequence
  Extension Primer
gaacaatattttgttttattttcaa

SEQ ID NO: 7624 - DNA, 25 bp, Artificial sequence
  Extension Primer
cagtggaggaaragttaagcatcat

SEQ ID NO: 7625 - DNA, 25 bp, Artificial sequence
  Extension Primer
acggaatatagcccaccaggctcct

SEQ ID NO: 7626 - DNA, 25 bp, Artificial sequence
  Extension Primer
agatacacaaacatagagaacaaat

SEQ ID NO: 7627 - DNA, 25 bp, Artificial sequence
  Extension Primer
cgacaggcaggggcaagtgtgggct

SEQ ID NO: 7628 - DNA, 25 bp, Artificial sequence
  Extension Primer
gcttaataaaatacatttttaagtt

SEQ ID NO: 7629 - DNA, 25 bp, Artificial sequence
  Extension Primer
accaaagacagaaytggtgacctcc

SEQ ID NO: 7630 - DNA, 25 bp, Artificial sequence
  Extension Primer
gtcagagcttttgcactcacacata

SEQ ID NO: 7631 - DNA, 25 bp, Artificial sequence
  Extension Primer
gtcctcatttggaatctgaaaggcc

SEQ ID NO: 7632 - DNA, 25 bp, Artificial sequence
  Extension Primer
ctctttgtgaccccatggactgtaa

SEQ ID NO: 7633 - DNA, 25 bp, Artificial sequence
  Extension Primer
aagtgatagtctctttttctgtcaa

SEQ ID NO: 7634 - DNA, 25 bp, Artificial sequence
  Extension Primer
aaggcaaaaaagtaaagtgacatgt

SEQ ID NO: 7635 - DNA, 25 bp, Artificial sequence
  Extension Primer
aggaaagtggtcatcccttagactg

SEQ ID NO: 7636 - DNA, 25 bp, Artificial sequence
  Extension Primer
caagaatttaatacataagcataac

SEQ ID NO: 7637 - DNA, 25 bp, Artificial sequence
  Extension Primer
aaaaataaatagttgagaaaactta

SEQ ID NO: 7638 - DNA, 25 bp, Artificial sequence
  Extension Primer
tagttttgtctgtcttccagaattg

SEQ ID NO: 7639 - DNA, 25 bp, Artificial sequence
  Extension Primer
tcctctgttctattttttctccttt

SEQ ID NO: 7640 - DNA, 25 bp, Artificial sequence
  Extension Primer
ggtagcactgtctatgttgtttatc

SEQ ID NO: 7641 - DNA, 25 bp, Artificial sequence
  Extension Primer
tttaccactggcaccattatattct

SEQ ID NO: 7642 - DNA, 25 bp, Artificial sequence
  Extension Primer
caggcagcagaagggggtgggaggc

SEQ ID NO: 7643 - DNA, 25 bp, Artificial sequence
  Extension Primer
tmattgcaaatacattgtgaatttc

SEQ ID NO: 7644 - DNA, 25 bp, Artificial sequence
  Extension Primer
tgagatataattgacatatagcatt

SEQ ID NO: 7645 - DNA, 25 bp, Artificial sequence
  Extension Primer
ggggtctttgttccctacttatcag

SEQ ID NO: 7646 - DNA, 25 bp, Artificial sequence
  Extension Primer
aactgttctattgggtctcacaact

SEQ ID NO: 7647 - DNA, 25 bp, Artificial sequence
  Extension Primer
taaatatttctttgctttacatctg

SEQ ID NO: 7648 - DNA, 25 bp, Artificial sequence
  Extension Primer
tcatttcagtttaacctgagaaagc

SEQ ID NO: 7649 - DNA, 25 bp, Artificial sequence
  Extension Primer
ggttctcacgctgtctagctcagaa

SEQ ID NO: 7650 - DNA, 25 bp, Artificial sequence
  Extension Primer
ctcctcttacgaaaaataaatgcta

SEQ ID NO: 7651 - DNA, 25 bp, Artificial sequence
  Extension Primer
acttcctctctccccaaaggaatcc

SEQ ID NO: 7652 - DNA, 25 bp, Artificial sequence
  Extension Primer
cagatttgttaggagaaagggagag

SEQ ID NO: 7653 - DNA, 25 bp, Artificial sequence
  Extension Primer
tgctggtagatgttactggtatcac

SEQ ID NO: 7654 - DNA, 25 bp, Artificial sequence
  Extension Primer
ttgaggtaatggggcatttgcaagt

SEQ ID NO: 7655 - DNA, 25 bp, Artificial sequence
  Extension Primer
actcactcagcaaaaagcaagcact

SEQ ID NO: 7656 - DNA, 25 bp, Artificial sequence
  Extension Primer
ctgacataagtcccttctggggtcc

SEQ ID NO: 7657 - DNA, 25 bp, Artificial sequence
  Extension Primer
cttacttcagacatgtaaactccca

SEQ ID NO: 7658 - DNA, 25 bp, Artificial sequence
  Extension Primer
ggaggcagcgctgagctcctgaggg

SEQ ID NO: 7659 - DNA, 25 bp, Artificial sequence
  Extension Primer
atcatcctctcatagctcgtgtcca

SEQ ID NO: 7660 - DNA, 25 bp, Artificial sequence
  Extension Primer
tactgcggaccaggcgtgcctgtyc

SEQ ID NO: 7661 - DNA, 22 bp, Artificial sequence
  Extension Primer
gataccatttcytctaaaatcc

SEQ ID NO: 7662 - DNA, 25 bp, Artificial sequence
  Extension Primer
tgaggcaaatgaaacattcaaatca

SEQ ID NO: 7663 - DNA, 25 bp, Artificial sequence
  Extension Primer
atggacacaaattttacattttatt

SEQ ID NO: 7664 - DNA, 22 bp, Artificial sequence
  Extension Primer
atagccccaaatacattgcctt

SEQ ID NO: 7665 - DNA, 25 bp, Artificial sequence
  Extension Primer
ccagctcagtctgactcaatgaaat

SEQ ID NO: 7666 - DNA, 25 bp, Artificial sequence
  Extension Primer
cagtgaaacagaatgggaaggggac

SEQ ID NO: 7667 - DNA, 25 bp, Artificial sequence
  Extension Primer
aaatggtaaaagttctagatttcag

SEQ ID NO: 7668 - DNA, 25 bp, Artificial sequence
  Extension Primer
atagcagagaactcggtattgggcc

SEQ ID NO: 7669 - DNA, 25 bp, Artificial sequence
  Extension Primer
aaagaacattccaagtaactaattt

SEQ ID NO: 7670 - DNA, 25 bp, Artificial sequence
  Extension Primer
tgtaatactaatccagtagatggtt

SEQ ID NO: 7671 - DNA, 25 bp, Artificial sequence
  Extension Primer
aaaattttgctgttagtataagtac

SEQ ID NO: 7672 - DNA, 25 bp, Artificial sequence
  Extension Primer
caagagagtacagtctttggagtca

SEQ ID NO: 7673 - DNA, 25 bp, Artificial sequence
  Extension Primer
aaactgctttaggaaaacaaatagt

SEQ ID NO: 7674 - DNA, 25 bp, Artificial sequence
  Extension Primer
gccagtttgcaagggcacaagatta

SEQ ID NO: 7675 - DNA, 25 bp, Artificial sequence
  Extension Primer
ctggtttaagacttcagcatgtcac

SEQ ID NO: 7676 - DNA, 25 bp, Artificial sequence
  Extension Primer
tgctctctcctctcaatctacgtca

SEQ ID NO: 7677 - DNA, 25 bp, Artificial sequence
  Extension Primer
caggagaagaatgaactcccagaaa

SEQ ID NO: 7678 - DNA, 25 bp, Artificial sequence
  Extension Primer
catttctacctctgttgcaatcact

SEQ ID NO: 7679 - DNA, 25 bp, Artificial sequence
  Extension Primer
aatgagagaacccagggatggagtc

SEQ ID NO: 7680 - DNA, 25 bp, Artificial sequence
  Extension Primer
ttcctagattactctgagaaattgc

SEQ ID NO: 7681 - DNA, 25 bp, Artificial sequence
  Extension Primer
taacatatacttaacgtaaaactta

SEQ ID NO: 7682 - DNA, 25 bp, Artificial sequence
  Extension Primer
gactgttattcagtgaaatgcytaa

SEQ ID NO: 7683 - DNA, 25 bp, Artificial sequence
  Extension Primer
ttccacctgatacattatttaattc

SEQ ID NO: 7684 - DNA, 25 bp, Artificial sequence
  Extension Primer
ttaacctggctatatttcaagtgtt

SEQ ID NO: 7685 - DNA, 25 bp, Artificial sequence
  Extension Primer
ctacggttattacctggaaggcgtc

SEQ ID NO: 7686 - DNA, 25 bp, Artificial sequence
  Extension Primer
ttttcttttctaagaaacccttcaa

SEQ ID NO: 7687 - DNA, 25 bp, Artificial sequence
  Extension Primer
attccactgctttctagtttgagtt

SEQ ID NO: 7688 - DNA, 25 bp, Artificial sequence
  Extension Primer
tcataaactaagcacatatgtctta

SEQ ID NO: 7689 - DNA, 25 bp, Artificial sequence
  Extension Primer
gcatgccggggcagcgtggggagag

SEQ ID NO: 7690 - DNA, 25 bp, Artificial sequence
  Extension Primer
gaggtataatgtaatagttggtgaa

SEQ ID NO: 7691 - DNA, 25 bp, Artificial sequence
  Extension Primer
cttaccataacagaccaccacgccg

SEQ ID NO: 7692 - DNA, 22 bp, Artificial sequence
  Extension Primer
gtggtctgtgagaggccttctg

SEQ ID NO: 7693 - DNA, 25 bp, Artificial sequence
  Extension Primer
aaacaaatttagaggtattgttagc

SEQ ID NO: 7694 - DNA, 25 bp, Artificial sequence
  Extension Primer
aggtagagaggacaatttcagtgtg

SEQ ID NO: 7695 - DNA, 25 bp, Artificial sequence
  Extension Primer
tgcccagccttaccctaagaaaaag

SEQ ID NO: 7696 - DNA, 25 bp, Artificial sequence
  Extension Primer
gggtttagactcagaagcctctaag

SEQ ID NO: 7697 - DNA, 25 bp, Artificial sequence
  Extension Primer
agtaaagacaatgatcagaatttca

SEQ ID NO: 7698 - DNA, 25 bp, Artificial sequence
  Extension Primer
cttgattatacactcacttgtaaga

SEQ ID NO: 7699 - DNA, 25 bp, Artificial sequence
  Extension Primer
ctagcgtattgtgtcatctcaaata

SEQ ID NO: 7700 - DNA, 25 bp, Artificial sequence
  Extension Primer
ccatgtgaatcagccrcccagaaac

SEQ ID NO: 7701 - DNA, 25 bp, Artificial sequence
  Extension Primer
aatctcaactgacatccttttgaaa

SEQ ID NO: 7702 - DNA, 25 bp, Artificial sequence
  Extension Primer
gcttggatgttttgaacatctggat

SEQ ID NO: 7703 - DNA, 25 bp, Artificial sequence
  Extension Primer
aagtcaaatcaaaataatgttcgcc

SEQ ID NO: 7704 - DNA, 25 bp, Artificial sequence
  Extension Primer
taattcctaactgattttgaaattg

SEQ ID NO: 7705 - DNA, 25 bp, Artificial sequence
  Extension Primer
cctggtctgcctccttggaactgct

SEQ ID NO: 7706 - DNA, 25 bp, Artificial sequence
  Extension Primer
tgaatggttccagtatttctgaccc

SEQ ID NO: 7707 - DNA, 25 bp, Artificial sequence
  Extension Primer
cttggtgctggtattgtaaattggt

SEQ ID NO: 7708 - DNA, 25 bp, Artificial sequence
  Extension Primer
cagcaccacrgcactcattatgtac

SEQ ID NO: 7709 - DNA, 25 bp, Artificial sequence
  Extension Primer
tctacaatccatatggcaaagtgct

SEQ ID NO: 7710 - DNA, 25 bp, Artificial sequence
  Extension Primer
acgttgttacccacattaatttcca

SEQ ID NO: 7711 - DNA, 25 bp, Artificial sequence
  Extension Primer
cgggaaatgtagttctaacatggtc

SEQ ID NO: 7712 - DNA, 25 bp, Artificial sequence
  Extension Primer
agccaaatataagaaatgaaaaact

SEQ ID NO: 7713 - DNA, 25 bp, Artificial sequence
  Extension Primer
gaccaggtgtcccgcccccctgctc

SEQ ID NO: 7714 - DNA, 25 bp, Artificial sequence
  Extension Primer
acgatatccacattttctctttccc

SEQ ID NO: 7715 - DNA, 25 bp, Artificial sequence
  Extension Primer
acaagggtaatggtccatgctgact

SEQ ID NO: 7716 - DNA, 25 bp, Artificial sequence
  Extension Primer
tattaactcactcaagagggacgca

SEQ ID NO: 7717 - DNA, 25 bp, Artificial sequence
  Extension Primer
aggctttgaaatgaagaggagggaa

SEQ ID NO: 7718 - DNA, 25 bp, Artificial sequence
  Extension Primer
ctgaaggagccaactcaggtcacat

SEQ ID NO: 7719 - DNA, 25 bp, Artificial sequence
  Extension Primer
gaaaattgagtcctgaacaaaagtc

SEQ ID NO: 7720 - DNA, 25 bp, Artificial sequence
  Extension Primer
gataacagtggctttcaggcttcct

SEQ ID NO: 7721 - DNA, 25 bp, Artificial sequence
  Extension Primer
tccagcttctaaattttgttctgtc

SEQ ID NO: 7722 - DNA, 25 bp, Artificial sequence
  Extension Primer
cacaaagggtctaaatgtgcctgcc

SEQ ID NO: 7723 - DNA, 25 bp, Artificial sequence
  Extension Primer
agagggggagatttataaaacatct

SEQ ID NO: 7724 - DNA, 25 bp, Artificial sequence
  Extension Primer
tgtcaaacaagtagttaaaatggaa

SEQ ID NO: 7725 - DNA, 25 bp, Artificial sequence
  Extension Primer
ttaactcatttctgaatctatttgt

SEQ ID NO: 7726 - DNA, 25 bp, Artificial sequence
  Extension Primer
gcaaataaacaaagttctactgtac

SEQ ID NO: 7727 - DNA, 25 bp, Artificial sequence
  Extension Primer
yggagctagaagagacttagcccac

SEQ ID NO: 7728 - DNA, 25 bp, Artificial sequence
  Extension Primer
actgttaggtatctgcctcagcctt

SEQ ID NO: 7729 - DNA, 25 bp, Artificial sequence
  Extension Primer
ctgtcttatatctacaagagaagta

SEQ ID NO: 7730 - DNA, 25 bp, Artificial sequence
  Extension Primer
gaagtaygaaacttttggattattt

SEQ ID NO: 7731 - DNA, 25 bp, Artificial sequence
  Extension Primer
acctgkgttaaattgttctgtaagc

SEQ ID NO: 7732 - DNA, 25 bp, Artificial sequence
  Extension Primer
gtactctgaatctcagctccaccac

SEQ ID NO: 7733 - DNA, 25 bp, Artificial sequence
  Extension Primer
gcacgcagacacacatacaaacaca

SEQ ID NO: 7734 - DNA, 25 bp, Artificial sequence
  Extension Primer
ggatccgggtttgtgtaatgaggtt

SEQ ID NO: 7735 - DNA, 25 bp, Artificial sequence
  Extension Primer
tgtgtttgctttaggtatattctga

SEQ ID NO: 7736 - DNA, 25 bp, Artificial sequence
  Extension Primer
aatttggggaaggttctctttaaca

SEQ ID NO: 7737 - DNA, 25 bp, Artificial sequence
  Extension Primer
atattctatatttgttattttcatt

SEQ ID NO: 7738 - DNA, 25 bp, Artificial sequence
  Extension Primer
tattctagtctattcatgcctgttt

SEQ ID NO: 7739 - DNA, 25 bp, Artificial sequence
  Extension Primer
gctgtttaacctcatgcttagaaca

SEQ ID NO: 7740 - DNA, 25 bp, Artificial sequence
  Extension Primer
agaacaaaacaaacgctaaggttga

SEQ ID NO: 7741 - DNA, 25 bp, Artificial sequence
  Extension Primer
acgccgagtccctcgtggagaccta

SEQ ID NO: 7742 - DNA, 25 bp, Artificial sequence
  Extension Primer
gccgttcaaatcctatatccgcagt

SEQ ID NO: 7743 - DNA, 25 bp, Artificial sequence
  Extension Primer
agaaggrcatgacagcaaagagcac

SEQ ID NO: 7744 - DNA, 25 bp, Artificial sequence
  Extension Primer
tgcaaatccacccgctaaataaagt

SEQ ID NO: 7745 - DNA, 25 bp, Artificial sequence
  Extension Primer
agcagtaagcttataaactaggggg

SEQ ID NO: 7746 - DNA, 25 bp, Artificial sequence
  Extension Primer
aagaatcacagaaatttataagaca

SEQ ID NO: 7747 - DNA, 25 bp, Artificial sequence
  Extension Primer
ctccaamacaaggaaacgtggaccc

SEQ ID NO: 7748 - DNA, 25 bp, Artificial sequence
  Extension Primer
ttacttataagccatagattgtgct

SEQ ID NO: 7749 - DNA, 25 bp, Artificial sequence
  Extension Primer
gtatttgcttcgacaggtgatctca

SEQ ID NO: 7750 - DNA, 25 bp, Artificial sequence
  Extension Primer
ctgattccacagttgttactggttt

SEQ ID NO: 7751 - DNA, 25 bp, Artificial sequence
  Extension Primer
ccacacagcgcaaccctcagaccay

SEQ ID NO: 7752 - DNA, 25 bp, Artificial sequence
  Extension Primer
tctacctttccatggtaacctcttc

SEQ ID NO: 7753 - DNA, 22 bp, Artificial sequence
  Extension Primer
tttctttagatgtcatctatct

SEQ ID NO: 7754 - DNA, 25 bp, Artificial sequence
  Extension Primer
gtgggtctggggaactaaatctaca

SEQ ID NO: 7755 - DNA, 25 bp, Artificial sequence
  Extension Primer
actttctttgttctcttgtaagcca

SEQ ID NO: 7756 - DNA, 25 bp, Artificial sequence
  Extension Primer
tcctgcctcttcttcatcctaaata

SEQ ID NO: 7757 - DNA, 25 bp, Artificial sequence
  Extension Primer
atttcagccatcccggctttttctg

SEQ ID NO: 7758 - DNA, 25 bp, Artificial sequence
  Extension Primer
gacaaaacatcttctgaagtatcac

SEQ ID NO: 7759 - DNA, 25 bp, Artificial sequence
  Extension Primer
cgacgttcccagggacccacagaaa

SEQ ID NO: 7760 - DNA, 25 bp, Artificial sequence
  Extension Primer
atattgcttcctgtatccaaactgg

SEQ ID NO: 7761 - DNA, 25 bp, Artificial sequence
  Extension Primer
tcactccaagtggagataagcccaa

SEQ ID NO: 7762 - DNA, 25 bp, Artificial sequence
  Extension Primer
cttttctacataaaagtgtttaata

SEQ ID NO: 7763 - DNA, 25 bp, Artificial sequence
  Extension Primer
cttattttgactgtttgattgaaag

SEQ ID NO: 7764 - DNA, 25 bp, Artificial sequence
  Extension Primer
gctcactatgcaaaatcaaaacaca

SEQ ID NO: 7765 - DNA, 25 bp, Artificial sequence
  Extension Primer
cttgagacagttagagtatagaggt

SEQ ID NO: 7766 - DNA, 25 bp, Artificial sequence
  Extension Primer
gtcaaatcttaatattcaagtaatg

SEQ ID NO: 7767 - DNA, 25 bp, Artificial sequence
  Extension Primer
cgtacatagaaaaaattaactctgt

SEQ ID NO: 7768 - DNA, 25 bp, Artificial sequence
  Extension Primer
tactaacccacccttaacaaggacc

SEQ ID NO: 7769 - DNA, 25 bp, Artificial sequence
  Extension Primer
ttcctgtacgtgctcctggcttgtg

SEQ ID NO: 7770 - DNA, 25 bp, Artificial sequence
  Extension Primer
gacagcttggcgggaagtccctgga

SEQ ID NO: 7771 - DNA, 25 bp, Artificial sequence
  Extension Primer
cccttcatctgaccaggcacacctc

SEQ ID NO: 7772 - DNA, 25 bp, Artificial sequence
  Extension Primer
tagaaaattcacctaaaatggagca

SEQ ID NO: 7773 - DNA, 25 bp, Artificial sequence
  Extension Primer
ctcctaaaagccccaccgatgctcc

SEQ ID NO: 7774 - DNA, 25 bp, Artificial sequence
  Extension Primer
tgatgtgaccactatgactcactga

SEQ ID NO: 7775 - DNA, 25 bp, Artificial sequence
  Extension Primer
gagccatgaagccggacaaacagac

SEQ ID NO: 7776 - DNA, 25 bp, Artificial sequence
  Extension Primer
ctggtgcacagtaagccctcatcaa

SEQ ID NO: 7777 - DNA, 25 bp, Artificial sequence
  Extension Primer
ctgtagttataacagactttgaact

SEQ ID NO: 7778 - DNA, 25 bp, Artificial sequence
  Extension Primer
gtgtttcaaaatgctgggaagagat

SEQ ID NO: 7779 - DNA, 25 bp, Artificial sequence
  Extension Primer
tactgcgttcatttgtatttaatgg

SEQ ID NO: 7780 - DNA, 25 bp, Artificial sequence
  Extension Primer
aactgaagcacagagaggtcaagta

SEQ ID NO: 7781 - DNA, 25 bp, Artificial sequence
  Extension Primer
ttgcaacctccagcaaatataaaga

SEQ ID NO: 7782 - DNA, 25 bp, Artificial sequence
  Extension Primer
aaagtcaaagaataatacatactgc

SEQ ID NO: 7783 - DNA, 25 bp, Artificial sequence
  Extension Primer
tgtctggtgcacgaccccaagaggt

SEQ ID NO: 7784 - DNA, 25 bp, Artificial sequence
  Extension Primer
tttgcctcagccttggctgctattt

SEQ ID NO: 7785 - DNA, 25 bp, Artificial sequence
  Extension Primer
cacttaggatgaatcatttcaccta

SEQ ID NO: 7786 - DNA, 25 bp, Artificial sequence
  Extension Primer
aagagytatggcaaatatgatatag

SEQ ID NO: 7787 - DNA, 25 bp, Artificial sequence
  Extension Primer
ttggcctttgcgatctaaagtaccg

SEQ ID NO: 7788 - DNA, 25 bp, Artificial sequence
  Extension Primer
cccayccccaacccttgccccacca

SEQ ID NO: 7789 - DNA, 25 bp, Artificial sequence
  Extension Primer
gctgtgaagttaagtttttaataat

SEQ ID NO: 7790 - DNA, 25 bp, Artificial sequence
  Extension Primer
tgactgatggtagagaaagaaggta

SEQ ID NO: 7791 - DNA, 25 bp, Artificial sequence
  Extension Primer
agatgtatccacaagtggaagcagg

SEQ ID NO: 7792 - DNA, 25 bp, Artificial sequence
  Extension Primer
ctcacacatgatctgcatgggtcag

SEQ ID NO: 7793 - DNA, 25 bp, Artificial sequence
  Extension Primer
gtactttgtgatggggtatcacctg

SEQ ID NO: 7794 - DNA, 25 bp, Artificial sequence
  Extension Primer
tttccttggctccccaatgcccaca

SEQ ID NO: 7795 - DNA, 25 bp, Artificial sequence
  Extension Primer
agaaatcaagagaagtcagtgcatc

SEQ ID NO: 7796 - DNA, 25 bp, Artificial sequence
  Extension Primer
gagaggttggagcgcgcagaattaa

SEQ ID NO: 7797 - DNA, 25 bp, Artificial sequence
  Extension Primer
ttcactctggatttctccgttgcct

SEQ ID NO: 7798 - DNA, 25 bp, Artificial sequence
  Extension Primer
actcttggacctcyctcctacccct

SEQ ID NO: 7799 - DNA, 25 bp, Artificial sequence
  Extension Primer
tactatcacatcccttgttcctttt

SEQ ID NO: 7800 - DNA, 25 bp, Artificial sequence
  Extension Primer
aatctaggaaactgacttctgggct

SEQ ID NO: 7801 - DNA, 25 bp, Artificial sequence
  Extension Primer
aaggacagtagcagcatctacccag

SEQ ID NO: 7802 - DNA, 25 bp, Artificial sequence
  Extension Primer
taaactgcacacagtccttgtccat

SEQ ID NO: 7803 - DNA, 25 bp, Artificial sequence
  Extension Primer
ggccatggaaatcacacagtgtctc

SEQ ID NO: 7804 - DNA, 25 bp, Artificial sequence
  Extension Primer
gtgcacaakgcgctggcattacaga

SEQ ID NO: 7805 - DNA, 25 bp, Artificial sequence
  Extension Primer
cagccctggaggagcaacaggtgcc

SEQ ID NO: 7806 - DNA, 25 bp, Artificial sequence
  Extension Primer
gaaggaaattgatgacttaaatgtg

SEQ ID NO: 7807 - DNA, 25 bp, Artificial sequence
  Extension Primer
taagcaaagcttacatgaaagtgac

SEQ ID NO: 7808 - DNA, 25 bp, Artificial sequence
  Extension Primer
ccagagccccttgctgcaggctttc

SEQ ID NO: 7809 - DNA, 25 bp, Artificial sequence
  Extension Primer
cagctttttattacttaatcacatc

SEQ ID NO: 7810 - DNA, 25 bp, Artificial sequence
  Extension Primer
cgacagtattgtgtgtatggtggca

SEQ ID NO: 7811 - DNA, 25 bp, Artificial sequence
  Extension Primer
aattaatcatgataacccagataga

SEQ ID NO: 7812 - DNA, 25 bp, Artificial sequence
  Extension Primer
gtattgtggraaaaaaaaaaaggta

SEQ ID NO: 7813 - DNA, 25 bp, Artificial sequence
  Extension Primer
acagatggttctttgagaagggaaa

SEQ ID NO: 7814 - DNA, 25 bp, Artificial sequence
  Extension Primer
accattagaccacaagggagattcc

SEQ ID NO: 7815 - DNA, 25 bp, Artificial sequence
  Extension Primer
ttctactaagctgtggagacctttt

SEQ ID NO: 7816 - DNA, 25 bp, Artificial sequence
  Extension Primer
tgagtaagtaaaagtccaactgctt

SEQ ID NO: 7817 - DNA, 25 bp, Artificial sequence
  Extension Primer
taaaactatttggaaatgcttatat

SEQ ID NO: 7818 - DNA, 25 bp, Artificial sequence
  Extension Primer
taatgtcagatcagcacaatacttt

SEQ ID NO: 7819 - DNA, 25 bp, Artificial sequence
  Extension Primer
cccttttgtctgcctagttttagat

SEQ ID NO: 7820 - DNA, 25 bp, Artificial sequence
  Extension Primer
gcccttatcatgttggttcattaaa

SEQ ID NO: 7821 - DNA, 25 bp, Artificial sequence
  Extension Primer
tgctgtgtgtagcagggtttctcaa

SEQ ID NO: 7822 - DNA, 25 bp, Artificial sequence
  Extension Primer
tcatctgtggttaattgagtaaaac

SEQ ID NO: 7823 - DNA, 25 bp, Artificial sequence
  Extension Primer
tcacaaggccctgacatccctcaag

SEQ ID NO: 7824 - DNA, 25 bp, Artificial sequence
  Extension Primer
gacggagttggggagggataaatta

SEQ ID NO: 7825 - DNA, 25 bp, Artificial sequence
  Extension Primer
ctattgaatgggtgagtctgtcatt

SEQ ID NO: 7826 - DNA, 25 bp, Artificial sequence
  Extension Primer
gtctatagaaccacatgtaaaaaat

SEQ ID NO: 7827 - DNA, 25 bp, Artificial sequence
  Extension Primer
gtcaaaatgttgatttatgttaagg

SEQ ID NO: 7828 - DNA, 25 bp, Artificial sequence
  Extension Primer
cataaatgacagtttttgtgtctgt

SEQ ID NO: 7829 - DNA, 25 bp, Artificial sequence
  Extension Primer
aacactgtatccatyagctatttca

SEQ ID NO: 7830 - DNA, 25 bp, Artificial sequence
  Extension Primer
ggtaatgagtagctatctgatcaaa

SEQ ID NO: 7831 - DNA, 25 bp, Artificial sequence
  Extension Primer
taatgtttatcaagtgctgttaagt

SEQ ID NO: 7832 - DNA, 25 bp, Artificial sequence
  Extension Primer
ataaagcaagctgaggctaccgtcc

SEQ ID NO: 7833 - DNA, 25 bp, Artificial sequence
  Extension Primer
tcatacaaaaccagagaagagggag

SEQ ID NO: 7834 - DNA, 25 bp, Artificial sequence
  Extension Primer
gtgaaatctgttgatagtgactctg

SEQ ID NO: 7835 - DNA, 25 bp, Artificial sequence
  Extension Primer
tgtcagtcaaaggcagagtattaag

SEQ ID NO: 7836 - DNA, 25 bp, Artificial sequence
  Extension Primer
aaatatgaaggaacttccattcttc

SEQ ID NO: 7837 - DNA, 25 bp, Artificial sequence
  Extension Primer
gtgttaatggggtccgcagctctat

SEQ ID NO: 7838 - DNA, 25 bp, Artificial sequence
  Extension Primer
tgtaataaaattataccaatgatta

SEQ ID NO: 7839 - DNA, 25 bp, Artificial sequence
  Extension Primer
tatatcattaaatttcaatttcccc

SEQ ID NO: 7840 - DNA, 25 bp, Artificial sequence
  Extension Primer
cactaaaatgtgaagttcagtgagg

SEQ ID NO: 7841 - DNA, 25 bp, Artificial sequence
  Extension Primer
ttaacaattcttwttgggtatagaa

SEQ ID NO: 7842 - DNA, 25 bp, Artificial sequence
  Extension Primer
ttttgtacatagtagtttgtacctc

SEQ ID NO: 7843 - DNA, 25 bp, Artificial sequence
  Extension Primer
aatcacagcaattgtttagaactta

SEQ ID NO: 7844 - DNA, 25 bp, Artificial sequence
  Extension Primer
attcctcccatgggaaacaatgatc

SEQ ID NO: 7845 - DNA, 25 bp, Artificial sequence
  Extension Primer
tatactcaagtatactgctgtttga

SEQ ID NO: 7846 - DNA, 25 bp, Artificial sequence
  Extension Primer
gcctcacatccaaaaagaaactgaa

SEQ ID NO: 7847 - DNA, 25 bp, Artificial sequence
  Extension Primer
tattagcagcatctgaaatatgaaa

SEQ ID NO: 7848 - DNA, 25 bp, Artificial sequence
  Extension Primer
caacctagaacagtacgagataaat

SEQ ID NO: 7849 - DNA, 25 bp, Artificial sequence
  Extension Primer
atgggaatattaatatttattatat

SEQ ID NO: 7850 - DNA, 25 bp, Artificial sequence
  Extension Primer
caagaatacctggaaaaataaaaat

SEQ ID NO: 7851 - DNA, 25 bp, Artificial sequence
  Extension Primer
taagtccttcttcacctccaattaa

SEQ ID NO: 7852 - DNA, 25 bp, Artificial sequence
  Extension Primer
attgttgatccacctgctttttctg

SEQ ID NO: 7853 - DNA, 25 bp, Artificial sequence
  Extension Primer
ccagactcttgcatcttcccatata

SEQ ID NO: 7854 - DNA, 25 bp, Artificial sequence
  Extension Primer
atggcaccggggtgtctgtgttgac

SEQ ID NO: 7855 - DNA, 25 bp, Artificial sequence
  Extension Primer
ccattctggcagagctgacatgaac

SEQ ID NO: 7856 - DNA, 25 bp, Artificial sequence
  Extension Primer
acaaagatgacagcaagtacaacag

SEQ ID NO: 7857 - DNA, 25 bp, Artificial sequence
  Extension Primer
atgtttagtggaagaggttgttaaa

SEQ ID NO: 7858 - DNA, 25 bp, Artificial sequence
  Extension Primer
tacgcctaccccctttaaaagaaag

SEQ ID NO: 7859 - DNA, 25 bp, Artificial sequence
  Extension Primer
tctccggccttcagccctgtgtact

SEQ ID NO: 7860 - DNA, 25 bp, Artificial sequence
  Extension Primer
gtattctattgggatcaatcttgaa

SEQ ID NO: 7861 - DNA, 25 bp, Artificial sequence
  Extension Primer
cagagaagactgaattattgtctck

SEQ ID NO: 7862 - DNA, 22 bp, Artificial sequence
  Extension Primer
gaccccttgactgaaggagcca

SEQ ID NO: 7863 - DNA, 25 bp, Artificial sequence
  Extension Primer
acatttgttcccttctcatcaaccc

SEQ ID NO: 7864 - DNA, 25 bp, Artificial sequence
  Extension Primer
ctcctctgtgaggctccaatatgcc

SEQ ID NO: 7865 - DNA, 25 bp, Artificial sequence
  Extension Primer
agacaaacttttaacagatttcttk

SEQ ID NO: 7866 - DNA, 25 bp, Artificial sequence
  Extension Primer
atgtttgaattaatttaaaactgtc

SEQ ID NO: 7867 - DNA, 25 bp, Artificial sequence
  Extension Primer
cagatttcagagtatttataactgc

SEQ ID NO: 7868 - DNA, 25 bp, Artificial sequence
  Extension Primer
ccaatttataagagaggcacactac

SEQ ID NO: 7869 - DNA, 25 bp, Artificial sequence
  Extension Primer
gaaatttccaaagtcttcctgcttt

SEQ ID NO: 7870 - DNA, 22 bp, Artificial sequence
  Extension Primer
ggttgataagactaaccggcta

SEQ ID NO: 7871 - DNA, 25 bp, Artificial sequence
  Extension Primer
aatattcaaattcatctttcaaaag

SEQ ID NO: 7872 - DNA, 25 bp, Artificial sequence
  Extension Primer
aaaaggggcccattttgagggctca

SEQ ID NO: 7873 - DNA, 25 bp, Artificial sequence
  Extension Primer
aataatgacaataggcttgcttgac

SEQ ID NO: 7874 - DNA, 25 bp, Artificial sequence
  Extension Primer
gagagctgargtgaagtgtaacctg

SEQ ID NO: 7875 - DNA, 25 bp, Artificial sequence
  Extension Primer
ggtagggggctggggtgggactctt

SEQ ID NO: 7876 - DNA, 25 bp, Artificial sequence
  Extension Primer
tggagggcagtcaggccagcagtta

SEQ ID NO: 7877 - DNA, 25 bp, Artificial sequence
  Extension Primer
gaaatgtattcaaaccagtkcaagt

SEQ ID NO: 7878 - DNA, 25 bp, Artificial sequence
  Extension Primer
atagccccaaatacattgccttyct

SEQ ID NO: 7879 - DNA, 25 bp, Artificial sequence
  Extension Primer
attwaaaaagtcaattcctcaagtc

SEQ ID NO: 7880 - DNA, 25 bp, Artificial sequence
  Extension Primer
gttaccttccttaagggaggatgca

SEQ ID NO: 7881 - DNA, 25 bp, Artificial sequence
  Extension Primer
agtcagtcaatttttttaatgtgtt

SEQ ID NO: 7882 - DNA, 25 bp, Artificial sequence
  Extension Primer
aagagatttagcatttcctcagact

SEQ ID NO: 7883 - DNA, 25 bp, Artificial sequence
  Extension Primer
atttctgtgcacagcagacctactc

SEQ ID NO: 7884 - DNA, 25 bp, Artificial sequence
  Extension Primer
gtgtctttgtagatggttacgtctg

SEQ ID NO: 7885 - DNA, 25 bp, Artificial sequence
  Extension Primer
tgtctagcacagggaactcagcttg

SEQ ID NO: 7886 - DNA, 25 bp, Artificial sequence
  Extension Primer
cccagtactaggaactgagtcatca

SEQ ID NO: 7887 - DNA, 25 bp, Artificial sequence
  Extension Primer
gggcactcagcttgtagttaccatc

SEQ ID NO: 7888 - DNA, 25 bp, Artificial sequence
  Extension Primer
cttattatctaataaaaggaaatgc

SEQ ID NO: 7889 - DNA, 25 bp, Artificial sequence
  Extension Primer
cattttaaggtctgctagggayttc

SEQ ID NO: 7890 - DNA, 25 bp, Artificial sequence
  Extension Primer
gccctcccacctgttacccttctcc

SEQ ID NO: 7891 - DNA, 25 bp, Artificial sequence
  Extension Primer
gtagttataacagactttgaactyt

SEQ ID NO: 7892 - DNA, 25 bp, Artificial sequence
  Extension Primer
tgatttgttcactgttgtatctcar

SEQ ID NO: 7893 - DNA, 22 bp, Artificial sequence
  Extension Primer
cctcatctgagctgtggccctg

SEQ ID NO: 7894 - DNA, 25 bp, Artificial sequence
  Extension Primer
tcctggtccaggctccaactctcag

SEQ ID NO: 7895 - DNA, 25 bp, Artificial sequence
  Extension Primer
attgtacttgagggcttattatgam

SEQ ID NO: 7896 - DNA, 25 bp, Artificial sequence
  Extension Primer
atgtcacactcaacctaatttaatg

SEQ ID NO: 7897 - DNA, 25 bp, Artificial sequence
  Extension Primer
taaacacattagtaaaaatgtcagg

SEQ ID NO: 7898 - DNA, 25 bp, Artificial sequence
  Extension Primer
aattccctgagtcttctcagggatc

SEQ ID NO: 7899 - DNA, 25 bp, Artificial sequence
  Extension Primer
caaatcactgtcactgggcaagcag

SEQ ID NO: 7900 - DNA, 25 bp, Artificial sequence
  Extension Primer
cagtgacttgaaaccaagaggaaaa

SEQ ID NO: 7901 - DNA, 25 bp, Artificial sequence
  Extension Primer
tgctaacttgctaattgctcttcct

SEQ ID NO: 7902 - DNA, 25 bp, Artificial sequence
  Extension Primer
cctcgactcaagtgacaggctcaac

SEQ ID NO: 7903 - DNA, 25 bp, Artificial sequence
  Extension Primer
cctccacccacatgaggggatgaaa

SEQ ID NO: 7904 - DNA, 25 bp, Artificial sequence
  Extension Primer
ttggggaatttggaaacatcccaca

SEQ ID NO: 7905 - DNA, 25 bp, Artificial sequence
  Extension Primer
tttttttgactattttagttctcaa

SEQ ID NO: 7906 - DNA, 25 bp, Artificial sequence
  Extension Primer
tactttgcattgtttacttttttcc

SEQ ID NO: 7907 - DNA, 25 bp, Artificial sequence
  Extension Primer
agttacaagttgcctgaattctata

SEQ ID NO: 7908 - DNA, 25 bp, Artificial sequence
  Extension Primer
tctacccatatgttaataacttcac

SEQ ID NO: 7909 - DNA, 25 bp, Artificial sequence
  Extension Primer
ggagcacaggactcttctcccaacg

SEQ ID NO: 7910 - DNA, 25 bp, Artificial sequence
  Extension Primer
ttaaaattgtaattatggagacagt

SEQ ID NO: 7911 - DNA, 25 bp, Artificial sequence
  Extension Primer
gataagaaatacatacttggaaaag

SEQ ID NO: 7912 - DNA, 25 bp, Artificial sequence
  Extension Primer
ggaccgggagggacactcgctggag

SEQ ID NO: 7913 - DNA, 25 bp, Artificial sequence
  Extension Primer
attggataagaggaggctggtaaca

SEQ ID NO: 7914 - DNA, 25 bp, Artificial sequence
  Extension Primer
atctcaccccacaatactgctcctc

SEQ ID NO: 7915 - DNA, 25 bp, Artificial sequence
  Extension Primer
ggcacaaaagggcaaatattgtatg

SEQ ID NO: 7916 - DNA, 25 bp, Artificial sequence
  Extension Primer
acaacatgccaggctgtctaggctc

SEQ ID NO: 7917 - DNA, 25 bp, Artificial sequence
  Extension Primer
ttccactagtaagaactgrttgtrg

SEQ ID NO: 7918 - DNA, 25 bp, Artificial sequence
  Extension Primer
cagggaccagtgtctgttcctcaay

SEQ ID NO: 7919 - DNA, 25 bp, Artificial sequence
  Extension Primer
agaatccttgcccttcttctgtatc

SEQ ID NO: 7920 - DNA, 25 bp, Artificial sequence
  Extension Primer
cagcctaacaccacatccttgtgag

SEQ ID NO: 7921 - DNA, 25 bp, Artificial sequence
  Extension Primer
tgccttaaaaaaaaaaaaaaagact

SEQ ID NO: 7922 - DNA, 25 bp, Artificial sequence
  Extension Primer
gatattataaaaatcaggaataatc

SEQ ID NO: 7923 - DNA, 25 bp, Artificial sequence
  Extension Primer
tggtaatgacagttccagtgtgaaa

SEQ ID NO: 7924 - DNA, 25 bp, Artificial sequence
  Extension Primer
ttgcccttcctctctgtccgtcaat

SEQ ID NO: 7925 - DNA, 25 bp, Artificial sequence
  Extension Primer
aagataaacctttattttarcattg

SEQ ID NO: 7926 - DNA, 25 bp, Artificial sequence
  Extension Primer
aggacaaagtccggtgtccctggtc

SEQ ID NO: 7927 - DNA, 25 bp, Artificial sequence
  Extension Primer
accagaggctgagcgatgtctggga

SEQ ID NO: 7928 - DNA, 25 bp, Artificial sequence
  Extension Primer
ccaagagacagtctaagctacggaa

SEQ ID NO: 7929 - DNA, 25 bp, Artificial sequence
  Extension Primer
tcatattgcagaaaatctgccttcc

SEQ ID NO: 7930 - DNA, 25 bp, Artificial sequence
  Extension Primer
aagaagggtcatagagtaaaagatg

SEQ ID NO: 7931 - DNA, 25 bp, Artificial sequence
  Extension Primer
taaggaagagatggtaagcagtcct

SEQ ID NO: 7932 - DNA, 25 bp, Artificial sequence
  Extension Primer
gggcctgagcctggactctgcccat

SEQ ID NO: 7933 - DNA, 25 bp, Artificial sequence
  Extension Primer
gaattcttattaaaactgggttcta

SEQ ID NO: 7934 - DNA, 25 bp, Artificial sequence
  Extension Primer
acagtattcaataattacttttctt

SEQ ID NO: 7935 - DNA, 25 bp, Artificial sequence
  Extension Primer
aaataaatgcaaacccaaatactgt

SEQ ID NO: 7936 - DNA, 25 bp, Artificial sequence
  Extension Primer
gtcctattctactccccttctccca

SEQ ID NO: 7937 - DNA, 25 bp, Artificial sequence
  Extension Primer
ttctccatgaatgcaactaagtttt

SEQ ID NO: 7938 - DNA, 25 bp, Artificial sequence
  Extension Primer
acctcaatttttacccaaggtccca

SEQ ID NO: 7939 - DNA, 25 bp, Artificial sequence
  Extension Primer
aggggcttggtttcctattaagtgc

SEQ ID NO: 7940 - DNA, 25 bp, Artificial sequence
  Extension Primer
cgatcagagaagtctctggatccca

SEQ ID NO: 7941 - DNA, 25 bp, Artificial sequence
  Extension Primer
tgtttctctttttgttaatcaaagt

SEQ ID NO: 7942 - DNA, 25 bp, Artificial sequence
  Extension Primer
tggctctgaaactccacctttgtca

SEQ ID NO: 7943 - DNA, 25 bp, Artificial sequence
  Extension Primer
ccttcagatgctgccctggggctgc

SEQ ID NO: 7944 - DNA, 25 bp, Artificial sequence
  Extension Primer
gcatctctgagcttcatttctttta

SEQ ID NO: 7945 - DNA, 25 bp, Artificial sequence
  Extension Primer
tgtcaactcataattttactgggac

SEQ ID NO: 7946 - DNA, 25 bp, Artificial sequence
  Extension Primer
ctctggaagctgtctctctggaaac

SEQ ID NO: 7947 - DNA, 25 bp, Artificial sequence
  Extension Primer
atggcatactcctcctttaagagca

SEQ ID NO: 7948 - DNA, 25 bp, Artificial sequence
  Extension Primer
ttcatttgtgtgctggagaggggat

SEQ ID NO: 7949 - DNA, 25 bp, Artificial sequence
  Extension Primer
cccaccaccgtcttcccccatccat

SEQ ID NO: 7950 - DNA, 25 bp, Artificial sequence
  Extension Primer
agtccagcgcccttgtctgtactcc

SEQ ID NO: 7951 - DNA, 25 bp, Artificial sequence
  Extension Primer
ggtcctgtgtttgaaactaggtgat

SEQ ID NO: 7952 - DNA, 25 bp, Artificial sequence
  Extension Primer
catcctctatcctccatactctcta

SEQ ID NO: 7953 - DNA, 25 bp, Artificial sequence
  Extension Primer
ccatttagtctgtagttagttaatc

SEQ ID NO: 7954 - DNA, 25 bp, Artificial sequence
  Extension Primer
ttgtgtgctaggcagtgtgtagttc

SEQ ID NO: 7955 - DNA, 25 bp, Artificial sequence
  Extension Primer
aataattgggtagtgacactatccc

SEQ ID NO: 7956 - DNA, 25 bp, Artificial sequence
  Extension Primer
tcctctcaagtgaaggaaagaactc

SEQ ID NO: 7957 - DNA, 25 bp, Artificial sequence
  Extension Primer
cacaataaaatcttattccttagta

SEQ ID NO: 7958 - DNA, 25 bp, Artificial sequence
  Extension Primer
atgagttgtcacaacttgattcttt

SEQ ID NO: 7959 - DNA, 25 bp, Artificial sequence
  Extension Primer
aaaggcatcagagacagtggaggaa

SEQ ID NO: 7960 - DNA, 25 bp, Artificial sequence
  Extension Primer
gtttgctcatctgtaagatgctcca

SEQ ID NO: 7961 - DNA, 25 bp, Artificial sequence
  Extension Primer
catgtgtcacataactcgttcctcc

SEQ ID NO: 7962 - DNA, 25 bp, Artificial sequence
  Extension Primer
aacatttctcaattgtgtagctggg

SEQ ID NO: 7963 - DNA, 25 bp, Artificial sequence
  Extension Primer
ctccccactcccctgctgatttgct

SEQ ID NO: 7964 - DNA, 25 bp, Artificial sequence
  Extension Primer
actgagaaaacatttttaatcaacc

SEQ ID NO: 7965 - DNA, 25 bp, Artificial sequence
  Extension Primer
ggccccctgaggagtctggggccgc

SEQ ID NO: 7966 - DNA, 22 bp, Artificial sequence
  Extension Primer
gtcccagccctagtagcatctt

SEQ ID NO: 7967 - DNA, 25 bp, Artificial sequence
  Extension Primer
aagtgggatttctgcagtttttcta

SEQ ID NO: 7968 - DNA, 25 bp, Artificial sequence
  Extension Primer
ttgttcgtacattttctgtatccca

SEQ ID NO: 7969 - DNA, 25 bp, Artificial sequence
  Extension Primer
taaataaaatgctctaacaaataat

SEQ ID NO: 7970 - DNA, 25 bp, Artificial sequence
  Extension Primer
attcctggagaagggctgagaatga

SEQ ID NO: 7971 - DNA, 25 bp, Artificial sequence
  Extension Primer
aaaagagagtgaaaactattatrtc

SEQ ID NO: 7972 - DNA, 25 bp, Artificial sequence
  Extension Primer
ggaggtatgtacctgagtaactgcc

SEQ ID NO: 7973 - DNA, 25 bp, Artificial sequence
  Extension Primer
ttcctccctcaatttaggtcttaat

SEQ ID NO: 7974 - DNA, 25 bp, Artificial sequence
  Extension Primer
gtgctgatgatgattagccatggag

SEQ ID NO: 7975 - DNA, 25 bp, Artificial sequence
  Extension Primer
acttttccccaaagaaacgaagtgc

SEQ ID NO: 7976 - DNA, 25 bp, Artificial sequence
  Extension Primer
gtatgtcagacatcaatatatactt

SEQ ID NO: 7977 - DNA, 25 bp, Artificial sequence
  Extension Primer
aaatttgttttgccattttaatagt

SEQ ID NO: 7978 - DNA, 25 bp, Artificial sequence
  Extension Primer
cccctcctgaaagtgtagttgctac

SEQ ID NO: 7979 - DNA, 25 bp, Artificial sequence
  Extension Primer
ctaggctcagtggcttttcaagtgt

SEQ ID NO: 7980 - DNA, 25 bp, Artificial sequence
  Extension Primer
ggcctctggaacacggtgtgcyggg

SEQ ID NO: 7981 - DNA, 25 bp, Artificial sequence
  Extension Primer
tagattccaatttgaaaattaaccc

SEQ ID NO: 7982 - DNA, 25 bp, Artificial sequence
  Extension Primer
ggcttcaccytggcttccgtattac

SEQ ID NO: 7983 - DNA, 25 bp, Artificial sequence
  Extension Primer
actgctgcttccagaccacacaccc

SEQ ID NO: 7984 - DNA, 25 bp, Artificial sequence
  Extension Primer
cagtggagagaaaacaacacaaaaa

SEQ ID NO: 7985 - DNA, 25 bp, Artificial sequence
  Extension Primer
gttatcagtccccgtggaatattta

SEQ ID NO: 7986 - DNA, 25 bp, Artificial sequence
  Extension Primer
gtgaatgccgcacacagacacttac

SEQ ID NO: 7987 - DNA, 25 bp, Artificial sequence
  Extension Primer
tattaatgggcactagtgctacatc

SEQ ID NO: 7988 - DNA, 25 bp, Artificial sequence
  Extension Primer
ttgagagtagtctgtttcttattct

SEQ ID NO: 7989 - DNA, 25 bp, Artificial sequence
  Extension Primer
caatggtgtatggtcatgcaggtgt

SEQ ID NO: 7990 - DNA, 25 bp, Artificial sequence
  Extension Primer
tggagtatttcctgccgtatcagta

SEQ ID NO: 7991 - DNA, 25 bp, Artificial sequence
  Extension Primer
tcctcatgttctgacttatccttct

SEQ ID NO: 7992 - DNA, 25 bp, Artificial sequence
  Extension Primer
tggaaggatagtacagcatgagggc

SEQ ID NO: 7993 - DNA, 25 bp, Artificial sequence
  Extension Primer
tcctccattctctgtagtcatccct

SEQ ID NO: 7994 - DNA, 25 bp, Artificial sequence
  Extension Primer
aagaaagaagaaaattgaaaactag

SEQ ID NO: 7995 - DNA, 25 bp, Artificial sequence
  Extension Primer
ytggtttttagccaaacttgacaga

SEQ ID NO: 7996 - DNA, 25 bp, Artificial sequence
  Extension Primer
ggcatcttagacacaatctgcccca

SEQ ID NO: 7997 - DNA, 25 bp, Artificial sequence
  Extension Primer
aagtagaccaggtgttctgcataga

SEQ ID NO: 7998 - DNA, 25 bp, Artificial sequence
  Extension Primer
gtaaagatgaaggatttgctacaat

SEQ ID NO: 7999 - DNA, 25 bp, Artificial sequence
  Extension Primer
caaccactcttcgcttccaagcctg

SEQ ID NO: 8000 - DNA, 25 bp, Artificial sequence
  Extension Primer
catggagatgacactgatgatgtat

SEQ ID NO: 8001 - DNA, 25 bp, Artificial sequence
  Extension Primer
ttgctctttttcactcttatcctca

SEQ ID NO: 8002 - DNA, 25 bp, Artificial sequence
  Extension Primer
acggtgaagaggaaaatatctcaca

SEQ ID NO: 8003 - DNA, 25 bp, Artificial sequence
  Extension Primer
taaattattgtgatattgcattgct

SEQ ID NO: 8004 - DNA, 25 bp, Artificial sequence
  Extension Primer
atatcatttgtgaaatgcttacctc

SEQ ID NO: 8005 - DNA, 25 bp, Artificial sequence
  Extension Primer
gcttcttcttgccaataacttctaa

SEQ ID NO: 8006 - DNA, 25 bp, Artificial sequence
  Extension Primer
tcctccagcatcaacaactataaac

SEQ ID NO: 8007 - DNA, 25 bp, Artificial sequence
  Extension Primer
gccctaagtatttcaagtttcccag

SEQ ID NO: 8008 - DNA, 25 bp, Artificial sequence
  Extension Primer
cggcagccgaccaggctcccccatc

SEQ ID NO: 8009 - DNA, 25 bp, Artificial sequence
  Extension Primer
accacatcratgcctrtttactaac

SEQ ID NO: 8010 - DNA, 25 bp, Artificial sequence
  Extension Primer
ccataaagctgattacaatactttc

SEQ ID NO: 8011 - DNA, 25 bp, Artificial sequence
  Extension Primer
gctcctaaggctgccctgggcagac

SEQ ID NO: 8012 - DNA, 25 bp, Artificial sequence
  Extension Primer
aaaagagtcagycagacaaaactta

SEQ ID NO: 8013 - DNA, 25 bp, Artificial sequence
  Extension Primer
ctgctttggatcggtattgttcctg

SEQ ID NO: 8014 - DNA, 25 bp, Artificial sequence
  Extension Primer
ttagccccaggtctcggcacacaag

SEQ ID NO: 8015 - DNA, 25 bp, Artificial sequence
  Extension Primer
tattggggcccgatttcatccatgc

SEQ ID NO: 8016 - DNA, 25 bp, Artificial sequence
  Extension Primer
tctggaggactggaactccgcatat

SEQ ID NO: 8017 - DNA, 25 bp, Artificial sequence
  Extension Primer
ggtccacatttttaaaatgtcttgt

SEQ ID NO: 8018 - DNA, 25 bp, Artificial sequence
  Extension Primer
gcttcggaaagtgccatcagcactc

SEQ ID NO: 8019 - DNA, 25 bp, Artificial sequence
  Extension Primer
tagaaaaaaggaatgcctcaaatgc

SEQ ID NO: 8020 - DNA, 25 bp, Artificial sequence
  Extension Primer
tttttcttatcgtttgctaaaaatt

SEQ ID NO: 8021 - DNA, 25 bp, Artificial sequence
  Extension Primer
ccactttcttcttggctccctttct

SEQ ID NO: 8022 - DNA, 25 bp, Artificial sequence
  Extension Primer
tccagaaactgcccaaaataaacac

SEQ ID NO: 8023 - DNA, 25 bp, Artificial sequence
  Extension Primer
attaattatctactcgttacccatt

SEQ ID NO: 8024 - DNA, 25 bp, Artificial sequence
  Extension Primer
attgtgagatgtgaggtgatgtaaa

SEQ ID NO: 8025 - DNA, 25 bp, Artificial sequence
  Extension Primer
tgcaaaatttaagaaaggccccaaa

SEQ ID NO: 8026 - DNA, 25 bp, Artificial sequence
  Extension Primer
taaatcagtcctaagccattttccc

SEQ ID NO: 8027 - DNA, 25 bp, Artificial sequence
  Extension Primer
aatgtattgtctctcaattatgaat

SEQ ID NO: 8028 - DNA, 25 bp, Artificial sequence
  Extension Primer
ggtgaagcaaggaaagattacaaag

SEQ ID NO: 8029 - DNA, 25 bp, Artificial sequence
  Extension Primer
agtccagcatagttaattattgaga

SEQ ID NO: 8030 - DNA, 25 bp, Artificial sequence
  Extension Primer
taaaagatttagctggtagttatag

SEQ ID NO: 8031 - DNA, 25 bp, Artificial sequence
  Extension Primer
acagtttctcctcttagaagcaggg

SEQ ID NO: 8032 - DNA, 25 bp, Artificial sequence
  Extension Primer
aaagacacaatttcatactctacta

SEQ ID NO: 8033 - DNA, 25 bp, Artificial sequence
  Extension Primer
tctcacattgaaaaaccctttgact

SEQ ID NO: 8034 - DNA, 25 bp, Artificial sequence
  Extension Primer
aaaaatgccaatcacacaaattaca

SEQ ID NO: 8035 - DNA, 25 bp, Artificial sequence
  Extension Primer
caaactaaggtcctaagacaatagc

SEQ ID NO: 8036 - DNA, 25 bp, Artificial sequence
  Extension Primer
aaatttctaataattcctgagtaat

SEQ ID NO: 8037 - DNA, 25 bp, Artificial sequence
  Extension Primer
ccagatggcgcacgcatgctaaatc

SEQ ID NO: 8038 - DNA, 25 bp, Artificial sequence
  Extension Primer
catcacaactttctttgttatcatt

SEQ ID NO: 8039 - DNA, 25 bp, Artificial sequence
  Extension Primer
catggctcagtggaattagctgtac

SEQ ID NO: 8040 - DNA, 25 bp, Artificial sequence
  Extension Primer
tttatagtggctttttttatattca

SEQ ID NO: 8041 - DNA, 25 bp, Artificial sequence
  Extension Primer
gtagtaagtccccaagtcatacctg

SEQ ID NO: 8042 - DNA, 25 bp, Artificial sequence
  Extension Primer
gcatatgttccagtaagccttcttc

SEQ ID NO: 8043 - DNA, 25 bp, Artificial sequence
  Extension Primer
taaccatgttctttatttagtcctt

SEQ ID NO: 8044 - DNA, 25 bp, Artificial sequence
  Extension Primer
agagatgtcgraaagtgagccaaag

SEQ ID NO: 8045 - DNA, 25 bp, Artificial sequence
  Extension Primer
taagacatttcctgatcttatttgt

SEQ ID NO: 8046 - DNA, 25 bp, Artificial sequence
  Extension Primer
tagctctctctgttttgtgtccatt

SEQ ID NO: 8047 - DNA, 25 bp, Artificial sequence
  Extension Primer
ttgaagtcaaccagtggaccaccag

SEQ ID NO: 8048 - DNA, 25 bp, Artificial sequence
  Extension Primer
gagaagaggtcacaccaaccagtca

SEQ ID NO: 8049 - DNA, 25 bp, Artificial sequence
  Extension Primer
gcagttctgtctctgggatttttat

SEQ ID NO: 8050 - DNA, 25 bp, Artificial sequence
  Extension Primer
tcaggcctttaatctaacttaattt

SEQ ID NO: 8051 - DNA, 25 bp, Artificial sequence
  Extension Primer
cactcaataacaatggctgccactt

SEQ ID NO: 8052 - DNA, 25 bp, Artificial sequence
  Extension Primer
atccagttcttacggactgtcccct

SEQ ID NO: 8053 - DNA, 25 bp, Artificial sequence
  Extension Primer
aatgatactattgtaatatcaattc

SEQ ID NO: 8054 - DNA, 25 bp, Artificial sequence
  Extension Primer
ctttagcaaagggctatccattcat

SEQ ID NO: 8055 - DNA, 25 bp, Artificial sequence
  Extension Primer
ttctctacttagcacctaaccacca

SEQ ID NO: 8056 - DNA, 25 bp, Artificial sequence
  Extension Primer
tagcagcttcagcctgtgggtttgc

SEQ ID NO: 8057 - DNA, 25 bp, Artificial sequence
  Extension Primer
gctccatgatgacgacaacagtagt

SEQ ID NO: 8058 - DNA, 25 bp, Artificial sequence
  Extension Primer
gtgaaaattatataaaattcaaatt

SEQ ID NO: 8059 - DNA, 25 bp, Artificial sequence
  Extension Primer
tctttatatcagtaaatagctgtga

SEQ ID NO: 8060 - DNA, 25 bp, Artificial sequence
  Extension Primer
tctttctayatgagaataaagtctg

SEQ ID NO: 8061 - DNA, 25 bp, Artificial sequence
  Extension Primer
agtgggccacatttggcctgcagac

SEQ ID NO: 8062 - DNA, 25 bp, Artificial sequence
  Extension Primer
ggtactggagctcctccgagcccac

SEQ ID NO: 8063 - DNA, 25 bp, Artificial sequence
  Extension Primer
aggctctttccgttattttactaac

SEQ ID NO: 8064 - DNA, 25 bp, Artificial sequence
  Extension Primer
tatccattttcaataccaggctcta

SEQ ID NO: 8065 - DNA, 25 bp, Artificial sequence
  Extension Primer
ctctgcagcaccacgtccccctggg

SEQ ID NO: 8066 - DNA, 25 bp, Artificial sequence
  Extension Primer
ttctttctgcctgatgctaaacttc

SEQ ID NO: 8067 - DNA, 25 bp, Artificial sequence
  Extension Primer
gacagcttaagcaacttgcccaaaa

SEQ ID NO: 8068 - DNA, 25 bp, Artificial sequence
  Extension Primer
ctttttaaaaggagagtattttgat

SEQ ID NO: 8069 - DNA, 25 bp, Artificial sequence
  Extension Primer
aatgacataacaaaggtaaagcact

SEQ ID NO: 8070 - DNA, 25 bp, Artificial sequence
  Extension Primer
agctgctgcgcttggcaccctcccc

SEQ ID NO: 8071 - DNA, 25 bp, Artificial sequence
  Extension Primer
aaagaaagttcagatttgtctacac

SEQ ID NO: 8072 - DNA, 25 bp, Artificial sequence
  Extension Primer
acacaacttgaccgttccaaaagst

SEQ ID NO: 8073 - DNA, 25 bp, Artificial sequence
  Extension Primer
tcagtgtctgccctttccaaggagc

SEQ ID NO: 8074 - DNA, 25 bp, Artificial sequence
  Extension Primer
ggagcttctgctcttgaacacgtgg

SEQ ID NO: 8075 - DNA, 25 bp, Artificial sequence
  Extension Primer
ggttggaggccccctccttgtcaag

SEQ ID NO: 8076 - DNA, 25 bp, Artificial sequence
  Extension Primer
ttcaatcagagtaatgaaggaaaaa

SEQ ID NO: 8077 - DNA, 25 bp, Artificial sequence
  Extension Primer
ctaaaagaacttttcctttaatgtg

SEQ ID NO: 8078 - DNA, 25 bp, Artificial sequence
  Extension Primer
gaatgyattattattccattttact

SEQ ID NO: 8079 - DNA, 25 bp, Artificial sequence
  Extension Primer
gtaaataaggtggtaagtaataygg

SEQ ID NO: 8080 - DNA, 25 bp, Artificial sequence
  Extension Primer
cctgctatcttgtttttattttact

SEQ ID NO: 8081 - DNA, 25 bp, Artificial sequence
  Extension Primer
gacaaacagtatcaaacaataagac

SEQ ID NO: 8082 - DNA, 25 bp, Artificial sequence
  Extension Primer
ctttgaaagtctccttctccactta

SEQ ID NO: 8083 - DNA, 25 bp, Artificial sequence
  Extension Primer
attcaaggaatattctaaacratta

SEQ ID NO: 8084 - DNA, 25 bp, Artificial sequence
  Extension Primer
gatctctgctgagcccctgtgtgyt

SEQ ID NO: 8085 - DNA, 25 bp, Artificial sequence
  Extension Primer
aaatctacatgccaagattttattc

SEQ ID NO: 8086 - DNA, 25 bp, Artificial sequence
  Extension Primer
gtttgaatcttcgttccaccattca

SEQ ID NO: 8087 - DNA, 25 bp, Artificial sequence
  Extension Primer
gcggctgtgcgctgggggctcactc

SEQ ID NO: 8088 - DNA, 25 bp, Artificial sequence
  Extension Primer
gttttgcaatgtccatcagcatctc

SEQ ID NO: 8089 - DNA, 25 bp, Artificial sequence
  Extension Primer
aattgccatatttataaattctgtt

SEQ ID NO: 8090 - DNA, 25 bp, Artificial sequence
  Extension Primer
gttttgcgatattttttttaccaag

SEQ ID NO: 8091 - DNA, 25 bp, Artificial sequence
  Extension Primer
tttcacgatgcctgaggcctgataa

SEQ ID NO: 8092 - DNA, 25 bp, Artificial sequence
  Extension Primer
cagatcagctctttaaaagctggga

SEQ ID NO: 8093 - DNA, 25 bp, Artificial sequence
  Extension Primer
agtctgggatcctccctggagacct

SEQ ID NO: 8094 - DNA, 25 bp, Artificial sequence
  Extension Primer
gagtgtcatttgattgggtctgtgc

SEQ ID NO: 8095 - DNA, 25 bp, Artificial sequence
  Extension Primer
tgggaagcttgagggctccgagtca

SEQ ID NO: 8096 - DNA, 25 bp, Artificial sequence
  Extension Primer
tatattttgcttctaggcaagcatc

SEQ ID NO: 8097 - DNA, 25 bp, Artificial sequence
  Extension Primer
agaagaggtcacaccaaccagtcay

SEQ ID NO: 8098 - DNA, 25 bp, Artificial sequence
  Extension Primer
ttaaggatgactgaagatccaagga

SEQ ID NO: 8099 - DNA, 25 bp, Artificial sequence
  Extension Primer
caagtgttataacaaagtgaggctc

SEQ ID NO: 8100 - DNA, 25 bp, Artificial sequence
  Extension Primer
ctgggctttgcatgttgagggcatc

SEQ ID NO: 8101 - DNA, 25 bp, Artificial sequence
  Extension Primer
ctgagcaaagttgctagccagaatc

SEQ ID NO: 8102 - DNA, 25 bp, Artificial sequence
  Extension Primer
tctcctaaaatgtgaacattatttc

SEQ ID NO: 8103 - DNA, 25 bp, Artificial sequence
  Extension Primer
ctcatatttcacatttggttatagc

SEQ ID NO: 8104 - DNA, 25 bp, Artificial sequence
  Extension Primer
tgaacacctgtgcatgaagcagtgc

SEQ ID NO: 8105 - DNA, 25 bp, Artificial sequence
  Extension Primer
tcagttaaacttcagcatgacttct

SEQ ID NO: 8106 - DNA, 25 bp, Artificial sequence
  Extension Primer
tagatccttgagtggaagctattta

SEQ ID NO: 8107 - DNA, 25 bp, Artificial sequence
  Extension Primer
ctaaaaatgtcccttasatgtaaca

SEQ ID NO: 8108 - DNA, 25 bp, Artificial sequence
  Extension Primer
tgttagtgcaaaatgcttctgtacc

SEQ ID NO: 8109 - DNA, 25 bp, Artificial sequence
  Extension Primer
gatgtttggtgtttcctgggagatc

SEQ ID NO: 8110 - DNA, 25 bp, Artificial sequence
  Extension Primer
aaaggtatgcactgtcccagactta

SEQ ID NO: 8111 - DNA, 25 bp, Artificial sequence
  Extension Primer
ccctggagaccagctgcagcaagga

SEQ ID NO: 8112 - DNA, 25 bp, Artificial sequence
  Extension Primer
cctctgcaacagagacttgtcttga

SEQ ID NO: 8113 - DNA, 25 bp, Artificial sequence
  Extension Primer
tccgtgatgccacacacaggagaac

SEQ ID NO: 8114 - DNA, 25 bp, Artificial sequence
  Extension Primer
tcttttgtttaactgtttctaagga

SEQ ID NO: 8115 - DNA, 25 bp, Artificial sequence
  Extension Primer
gtgggtctacccaggacaatcacac

SEQ ID NO: 8116 - DNA, 25 bp, Artificial sequence
  Extension Primer
tcccctgaccttttctttacagcat

SEQ ID NO: 8117 - DNA, 25 bp, Artificial sequence
  Extension Primer
gcccttgtttggcagctggtgataa

SEQ ID NO: 8118 - DNA, 22 bp, Artificial sequence
  Extension Primer
tagtcctaataataaccaaatg

SEQ ID NO: 8119 - DNA, 25 bp, Artificial sequence
  Extension Primer
caatgagtctgttgattgcaaagta

SEQ ID NO: 8120 - DNA, 25 bp, Artificial sequence
  Extension Primer
ttcagtatccgtggctctcatgtcc

SEQ ID NO: 8121 - DNA, 25 bp, Artificial sequence
  Extension Primer
accttgagtcttcagaaaagaagca

SEQ ID NO: 8122 - DNA, 25 bp, Artificial sequence
  Extension Primer
ctctatgaaaccatagattaatgat

SEQ ID NO: 8123 - DNA, 25 bp, Artificial sequence
  Extension Primer
gattggtggagaggggctctcactt

SEQ ID NO: 8124 - DNA, 25 bp, Artificial sequence
  Extension Primer
acagaataatgtttaagagcacagc

SEQ ID NO: 8125 - DNA, 25 bp, Artificial sequence
  Extension Primer
cacttgaggatgatcacggaactcc

SEQ ID NO: 8126 - DNA, 25 bp, Artificial sequence
  Extension Primer
aggtgaaacatttcctgttttgcta

SEQ ID NO: 8127 - DNA, 25 bp, Artificial sequence
  Extension Primer
aggcycagagattcagataactcay

SEQ ID NO: 8128 - DNA, 25 bp, Artificial sequence
  Extension Primer
ctctgtgacgggaaggtcgggagaa

SEQ ID NO: 8129 - DNA, 25 bp, Artificial sequence
  Extension Primer
caactgtgtcgaaagatggaagtta

SEQ ID NO: 8130 - DNA, 25 bp, Artificial sequence
  Extension Primer
agccctcagataggtttatcaccaa

SEQ ID NO: 8131 - DNA, 25 bp, Artificial sequence
  Extension Primer
caatagaagcaacccctccataccc

SEQ ID NO: 8132 - DNA, 25 bp, Artificial sequence
  Extension Primer
ccagaaagtaatatggtatgagaac

SEQ ID NO: 8133 - DNA, 25 bp, Artificial sequence
  Extension Primer
acaggaaagctatccaaggactgag

SEQ ID NO: 8134 - DNA, 25 bp, Artificial sequence
  Extension Primer
cagyagagccaggggcaagagggga

SEQ ID NO: 8135 - DNA, 25 bp, Artificial sequence
  Extension Primer
ccagaggagacaccttatgccccta

SEQ ID NO: 8136 - DNA, 25 bp, Artificial sequence
  Extension Primer
agaaccgttagttttcatttcattg

SEQ ID NO: 8137 - DNA, 25 bp, Artificial sequence
  Extension Primer
acctccccggcttccccatctcact

SEQ ID NO: 8138 - DNA, 25 bp, Artificial sequence
  Extension Primer
atatttttcctctctgtttctacaa

SEQ ID NO: 8139 - DNA, 25 bp, Artificial sequence
  Extension Primer
aaatattttgccccaatattttgcc

SEQ ID NO: 8140 - DNA, 25 bp, Artificial sequence
  Extension Primer
taactgtaggtttaatgtggtctca

SEQ ID NO: 8141 - DNA, 25 bp, Artificial sequence
  Extension Primer
acatgatcagctaacaaggcaccgt

SEQ ID NO: 8142 - DNA, 25 bp, Artificial sequence
  Extension Primer
gacagaggtgcttaccaggagaata

SEQ ID NO: 8143 - DNA, 25 bp, Artificial sequence
  Extension Primer
aaagcaaactytaaattaacctgaa

SEQ ID NO: 8144 - DNA, 25 bp, Artificial sequence
  Extension Primer
acccatcatattcacagattattcc

SEQ ID NO: 8145 - DNA, 25 bp, Artificial sequence
  Extension Primer
aagcacgaatgttgtccacacccta

SEQ ID NO: 8146 - DNA, 25 bp, Artificial sequence
  Extension Primer
ctttatttattcaactgacctctaa

SEQ ID NO: 8147 - DNA, 25 bp, Artificial sequence
  Extension Primer
atcagatttacagcaaatacaaaaa

SEQ ID NO: 8148 - DNA, 25 bp, Artificial sequence
  Extension Primer
ccagcgtgttctgaagagcaccagg

SEQ ID NO: 8149 - DNA, 22 bp, Artificial sequence
  Extension Primer
tttggattgggaagacttattt

SEQ ID NO: 8150 - DNA, 25 bp, Artificial sequence
  Extension Primer
taaaaaccttctgcgttcatccctt

SEQ ID NO: 8151 - DNA, 25 bp, Artificial sequence
  Extension Primer
gttgcagaggttggacaataataca

SEQ ID NO: 8152 - DNA, 25 bp, Artificial sequence
  Extension Primer
aaaacgactttaagtgtattggttg

SEQ ID NO: 8153 - DNA, 25 bp, Artificial sequence
  Extension Primer
gagatttcaactgaattgagaagct

SEQ ID NO: 8154 - DNA, 25 bp, Artificial sequence
  Extension Primer
gtagcttttcatgaacgtactatgt

SEQ ID NO: 8155 - DNA, 25 bp, Artificial sequence
  Extension Primer
atccttagtgaacactgagctttgc

SEQ ID NO: 8156 - DNA, 25 bp, Artificial sequence
  Extension Primer
ggatgaagacgagggatggagtgac

SEQ ID NO: 8157 - DNA, 25 bp, Artificial sequence
  Extension Primer
aatgttgataagaatactaaatagg

SEQ ID NO: 8158 - DNA, 25 bp, Artificial sequence
  Extension Primer
ctttgcaccatgatcaggccaaggc

SEQ ID NO: 8159 - DNA, 25 bp, Artificial sequence
  Extension Primer
atcaaccatgctacttgccactgta

SEQ ID NO: 8160 - DNA, 25 bp, Artificial sequence
  Extension Primer
ttattctttcctcaaatgcattatc

SEQ ID NO: 8161 - DNA, 25 bp, Artificial sequence
  Extension Primer
aaaaactgtgaaaatatgttgtatc

SEQ ID NO: 8162 - DNA, 25 bp, Artificial sequence
  Extension Primer
aatttgtagaattaaacataaactt

SEQ ID NO: 8163 - DNA, 25 bp, Artificial sequence
  Extension Primer
ctccactgcctgaatgtctccactt

SEQ ID NO: 8164 - DNA, 25 bp, Artificial sequence
  Extension Primer
gcaatattcaaggaatattctaaac

SEQ ID NO: 8165 - DNA, 25 bp, Artificial sequence
  Extension Primer
ctcacaaaggaccccaagttctaaa

SEQ ID NO: 8166 - DNA, 25 bp, Artificial sequence
  Extension Primer
gaatggcccgaaggcagagacacga

SEQ ID NO: 8167 - DNA, 25 bp, Artificial sequence
  Extension Primer
ctaacaaatgacattttcattggta

SEQ ID NO: 8168 - DNA, 25 bp, Artificial sequence
  Extension Primer
agcaacatctccagccttttaaatg

SEQ ID NO: 8169 - DNA, 25 bp, Artificial sequence
  Extension Primer
gcaggagggtcatatgggaactgct

SEQ ID NO: 8170 - DNA, 25 bp, Artificial sequence
  Extension Primer
gactctcctcttaactttcctatat

SEQ ID NO: 8171 - DNA, 25 bp, Artificial sequence
  Extension Primer
cctaaattataacattttgattttg

SEQ ID NO: 8172 - DNA, 25 bp, Artificial sequence
  Extension Primer
gtttggaacccttttctcctcaccc

SEQ ID NO: 8173 - DNA, 25 bp, Artificial sequence
  Extension Primer
cgtggtgtcagcttccgcatgcctt

SEQ ID NO: 8174 - DNA, 25 bp, Artificial sequence
  Extension Primer
gtattgtaaaaggaaaaggaagagg

SEQ ID NO: 8175 - DNA, 25 bp, Artificial sequence
  Extension Primer
ttattgctctatggatagttggtca

SEQ ID NO: 8176 - DNA, 25 bp, Artificial sequence
  Extension Primer
gaaacattcatttatcaatcttcct

SEQ ID NO: 8177 - DNA, 25 bp, Artificial sequence
  Extension Primer
tgacaccactgagctccgaggcagc

SEQ ID NO: 8178 - DNA, 25 bp, Artificial sequence
  Extension Primer
gattgtacttgagggcttattatga

SEQ ID NO: 8179 - DNA, 25 bp, Artificial sequence
  Extension Primer
agtaagtggaatttacattaatttt

SEQ ID NO: 8180 - DNA, 25 bp, Artificial sequence
  Extension Primer
tgcaaggaaaaaggcagggggcata

SEQ ID NO: 8181 - DNA, 25 bp, Artificial sequence
  Extension Primer
agtaaactcgaggtgtgtcgtccac

SEQ ID NO: 8182 - DNA, 25 bp, Artificial sequence
  Extension Primer
catgactgaagtctcagttgtaaac

SEQ ID NO: 8183 - DNA, 25 bp, Artificial sequence
  Extension Primer
gaacatggaccgggtcaaactccag

SEQ ID NO: 8184 - DNA, 25 bp, Artificial sequence
  Extension Primer
accatggcaggagagagcaaggctg

SEQ ID NO: 8185 - DNA, 25 bp, Artificial sequence
  Extension Primer
aaagtttcctctggacaacctagct

SEQ ID NO: 8186 - DNA, 25 bp, Artificial sequence
  Extension Primer
acactttcagtatggttcttcttag

SEQ ID NO: 8187 - DNA, 25 bp, Artificial sequence
  Extension Primer
tataagttcaaatgcttagatactt

SEQ ID NO: 8188 - DNA, 25 bp, Artificial sequence
  Extension Primer
tgggactttggacttggggaccctt

SEQ ID NO: 8189 - DNA, 25 bp, Artificial sequence
  Extension Primer
cccagatcaccatgttatcctctgc

SEQ ID NO: 8190 - DNA, 25 bp, Artificial sequence
  Extension Primer
gaaatggagttttgacttggcttaa

SEQ ID NO: 8191 - DNA, 25 bp, Artificial sequence
  Extension Primer
aagagaagcagggtgaacaaagtrc

SEQ ID NO: 8192 - DNA, 25 bp, Artificial sequence
  Extension Primer
aatagaagaggcagtgatgctctca

SEQ ID NO: 8193 - DNA, 25 bp, Artificial sequence
  Extension Primer
tatttcatattcggtctctgtaact

SEQ ID NO: 8194 - DNA, 25 bp, Artificial sequence
  Extension Primer
ctgacatgaccatcacagacagacg

SEQ ID NO: 8195 - DNA, 25 bp, Artificial sequence
  Extension Primer
ctattataccataaaaatgtcaagg

SEQ ID NO: 8196 - DNA, 25 bp, Artificial sequence
  Extension Primer
agtacatctcattttactgtttttg

SEQ ID NO: 8197 - DNA, 25 bp, Artificial sequence
  Extension Primer
tgaacctgaggcctcagcagtgaaa

SEQ ID NO: 8198 - DNA, 25 bp, Artificial sequence
  Extension Primer
acacagacacaccccgtggtcactg

SEQ ID NO: 8199 - DNA, 25 bp, Artificial sequence
  Extension Primer
cgaattaaaaaccaaaaaactgacc

SEQ ID NO: 8200 - DNA, 25 bp, Artificial sequence
  Extension Primer
aaaatgtcactggtaatatctgaag

SEQ ID NO: 8201 - DNA, 25 bp, Artificial sequence
  Extension Primer
gtgggaaattgtccgtcctccaaaa

SEQ ID NO: 8202 - DNA, 25 bp, Artificial sequence
  Extension Primer
ttttgaatcagtgagaaatttggga

SEQ ID NO: 8203 - DNA, 25 bp, Artificial sequence
  Extension Primer
acatacagatggtgaagcgcaccct

SEQ ID NO: 8204 - DNA, 22 bp, Artificial sequence
  Extension Primer
agggttcagaagcaaatcccaa

SEQ ID NO: 8205 - DNA, 25 bp, Artificial sequence
  Extension Primer
gaggctccctcctgcttgggtcttt

SEQ ID NO: 8206 - DNA, 25 bp, Artificial sequence
  Extension Primer
tttcacagcrgtcccacagagttta

SEQ ID NO: 8207 - DNA, 25 bp, Artificial sequence
  Extension Primer
agtggctaccattcattgaggcagc

SEQ ID NO: 8208 - DNA, 25 bp, Artificial sequence
  Extension Primer
cctttcaactaggtcctctacccat

SEQ ID NO: 8209 - DNA, 25 bp, Artificial sequence
  Extension Primer
tctccaagcacctatgtgcatgaca

SEQ ID NO: 8210 - DNA, 25 bp, Artificial sequence
  Extension Primer
ccatgttaaagcagcataaaaccag

SEQ ID NO: 8211 - DNA, 25 bp, Artificial sequence
  Extension Primer
ggttatacattctttcatacttaca

SEQ ID NO: 8212 - DNA, 25 bp, Artificial sequence
  Extension Primer
ccattatatttgtcctcttgtgaaa

SEQ ID NO: 8213 - DNA, 25 bp, Artificial sequence
  Extension Primer
agccctctgtttcactctgtaccat

SEQ ID NO: 8214 - DNA, 25 bp, Artificial sequence
  Extension Primer
tatggaacagctccgaggatctgcc

SEQ ID NO: 8215 - DNA, 25 bp, Artificial sequence
  Extension Primer
gattgacacctaactcaagattaca

SEQ ID NO: 8216 - DNA, 25 bp, Artificial sequence
  Extension Primer
aacctgccttacagtgcaggggatg

SEQ ID NO: 8217 - DNA, 25 bp, Artificial sequence
  Extension Primer
aactgtttaatgaaatggggagatg

SEQ ID NO: 8218 - DNA, 25 bp, Artificial sequence
  Extension Primer
ggagttgtgagaataggtccattta

SEQ ID NO: 8219 - DNA, 25 bp, Artificial sequence
  Extension Primer
gagaaaagtatcaggaaaaaaarac

SEQ ID NO: 8220 - DNA, 25 bp, Artificial sequence
  Extension Primer
gaagcctattaattgaagcctctct

SEQ ID NO: 8221 - DNA, 25 bp, Artificial sequence
  Extension Primer
ggcacgtgracacacaccgagggaa

SEQ ID NO: 8222 - DNA, 25 bp, Artificial sequence
  Extension Primer
acaggccgggatgggaggggctgct

SEQ ID NO: 8223 - DNA, 25 bp, Artificial sequence
  Extension Primer
aggacsggaatggcataagatgaat

SEQ ID NO: 8224 - DNA, 25 bp, Artificial sequence
  Extension Primer
ttctctggcacctcaagtgctctgt

SEQ ID NO: 8225 - DNA, 25 bp, Artificial sequence
  Extension Primer
acggagttgatgatayacctcaaac

SEQ ID NO: 8226 - DNA, 25 bp, Artificial sequence
  Extension Primer
ttctgatgtgtaatgcatttaaagg

SEQ ID NO: 8227 - DNA, 25 bp, Artificial sequence
  Extension Primer
taaaatgtcttgtyaggtatgggaa

SEQ ID NO: 8228 - DNA, 25 bp, Artificial sequence
  Extension Primer
tccactttagtggcctgataaccca

SEQ ID NO: 8229 - DNA, 25 bp, Artificial sequence
  Extension Primer
tattttgattctggcttttaatact

SEQ ID NO: 8230 - DNA, 25 bp, Artificial sequence
  Extension Primer
tagagaagaaagacacyctccccga

SEQ ID NO: 8231 - DNA, 25 bp, Artificial sequence
  Extension Primer
ctagtgaacagccagccacttgctt

SEQ ID NO: 8232 - DNA, 25 bp, Artificial sequence
  Extension Primer
ttgcattttgtaaagcccacacttt

SEQ ID NO: 8233 - DNA, 25 bp, Artificial sequence
  Extension Primer
caaaacttgtgttactcaaaattat

SEQ ID NO: 8234 - DNA, 25 bp, Artificial sequence
  Extension Primer
ttcctctttcatctctcctaaaaaa

SEQ ID NO: 8235 - DNA, 25 bp, Artificial sequence
  Extension Primer
tctgagatagaccttgtacctgcac

SEQ ID NO: 8236 - DNA, 25 bp, Artificial sequence
  Extension Primer
ggggaaacataaccctaaattggac

SEQ ID NO: 8237 - DNA, 25 bp, Artificial sequence
  Extension Primer
caggctacaccatgggacacttctt

SEQ ID NO: 8238 - DNA, 25 bp, Artificial sequence
  Extension Primer
aaggttagctagaagcaaackgtta

SEQ ID NO: 8239 - DNA, 25 bp, Artificial sequence
  Extension Primer
aatgtgacaaagcctttatccgttg

SEQ ID NO: 8240 - DNA, 25 bp, Artificial sequence
  Extension Primer
ytacttttttttttccttctaacta

SEQ ID NO: 8241 - DNA, 25 bp, Artificial sequence
  Extension Primer
tgaggcactaactagatagattctc

SEQ ID NO: 8242 - DNA, 25 bp, Artificial sequence
  Extension Primer
tagatccaggagcagacctttctca

SEQ ID NO: 8243 - DNA, 25 bp, Artificial sequence
  Extension Primer
aagcccacatgctctggagcaccca

SEQ ID NO: 8244 - DNA, 25 bp, Artificial sequence
  Extension Primer
ctcctcttagggccaaggagacttg

SEQ ID NO: 8245 - DNA, 25 bp, Artificial sequence
  Extension Primer
caagtaaatcaaacaacttgtcaac

SEQ ID NO: 8246 - DNA, 25 bp, Artificial sequence
  Extension Primer
caacatcagatccaacacagttatc

SEQ ID NO: 8247 - DNA, 25 bp, Artificial sequence
  Extension Primer
ttaaagtccatggggtcacaaaaga

SEQ ID NO: 8248 - DNA, 25 bp, Artificial sequence
  Extension Primer
gttggatttgttccagtgaatcaat

SEQ ID NO: 8249 - DNA, 25 bp, Artificial sequence
  Extension Primer
aatgaaatgtgatgacctttgaacg

SEQ ID NO: 8250 - DNA, 25 bp, Artificial sequence
  Extension Primer
actataaaatgccagacacataaga

SEQ ID NO: 8251 - DNA, 25 bp, Artificial sequence
  Extension Primer
aaagaagaaaaacacatagaagtgc

SEQ ID NO: 8252 - DNA, 25 bp, Artificial sequence
  Extension Primer
attttccaggcaagagtactggagt

SEQ ID NO: 8253 - DNA, 25 bp, Artificial sequence
  Extension Primer
ctttctgcctgatgctaaacttcrc

SEQ ID NO: 8254 - DNA, 25 bp, Artificial sequence
  Extension Primer
tttgaagcccctgtaacttagaact

SEQ ID NO: 8255 - DNA, 25 bp, Artificial sequence
  Extension Primer
agcgtggccacttctgaagaacaaa

SEQ ID NO: 8256 - DNA, 25 bp, Artificial sequence
  Extension Primer
caaggcccactaggggcgagtatgc

SEQ ID NO: 8257 - DNA, 25 bp, Artificial sequence
  Extension Primer
gaccttcctatatactctgcttggt

SEQ ID NO: 8258 - DNA, 25 bp, Artificial sequence
  Extension Primer
gatcaccactctaggttatctccac

SEQ ID NO: 8259 - DNA, 25 bp, Artificial sequence
  Extension Primer
tatttcagtgaatatggtagtctaa

SEQ ID NO: 8260 - DNA, 25 bp, Artificial sequence
  Extension Primer
tttgcaacagaagaatgggtacaga

SEQ ID NO: 8261 - DNA, 25 bp, Artificial sequence
  Extension Primer
gttgcccacaactgcctctgacctc

SEQ ID NO: 8262 - DNA, 25 bp, Artificial sequence
  Extension Primer
cacagctttctgtaaaaaagtagtt

SEQ ID NO: 8263 - DNA, 25 bp, Artificial sequence
  Extension Primer
aaatgcacagtaacttactgcagaa

SEQ ID NO: 8264 - DNA, 25 bp, Artificial sequence
  Extension Primer
gctatttcatttgaatatgtttttc

SEQ ID NO: 8265 - DNA, 25 bp, Artificial sequence
  Extension Primer
asttttcagttagaatcattcatct

SEQ ID NO: 8266 - DNA, 25 bp, Artificial sequence
  Extension Primer
ttttgtaagcagtggactaaaatat

SEQ ID NO: 8267 - DNA, 25 bp, Artificial sequence
  Extension Primer
tcttttgttggaaggcgtttaatag

SEQ ID NO: 8268 - DNA, 25 bp, Artificial sequence
  Extension Primer
atgccttgagcaatggaggatgctc

SEQ ID NO: 8269 - DNA, 25 bp, Artificial sequence
  Extension Primer
tttctgctttgtctttagagaatat

SEQ ID NO: 8270 - DNA, 25 bp, Artificial sequence
  Extension Primer
agaatgaactttttaagaggtatca

SEQ ID NO: 8271 - DNA, 25 bp, Artificial sequence
  Extension Primer
cttacctggtgaatagatatgaaag

SEQ ID NO: 8272 - DNA, 25 bp, Artificial sequence
  Extension Primer
tgcacacaagatggacacagttatc

SEQ ID NO: 8273 - DNA, 25 bp, Artificial sequence
  Extension Primer
gcttataacaccaccaggagaaact

SEQ ID NO: 8274 - DNA, 25 bp, Artificial sequence
  Extension Primer
gcatcccacgattcactgataggtc

SEQ ID NO: 8275 - DNA, 25 bp, Artificial sequence
  Extension Primer
gctggaggccacaaaaagaaatctt

SEQ ID NO: 8276 - DNA, 22 bp, Artificial sequence
  Extension Primer
gaccaaccccaagrgatggtgg

SEQ ID NO: 8277 - DNA, 25 bp, Artificial sequence
  Extension Primer
agctttgtaattctcttttatctac

SEQ ID NO: 8278 - DNA, 25 bp, Artificial sequence
  Extension Primer
cgcatctgcgtctctgctgcccaga

SEQ ID NO: 8279 - DNA, 25 bp, Artificial sequence
  Extension Primer
ccctgcgtggggtgaagcctgagga

SEQ ID NO: 8280 - DNA, 25 bp, Artificial sequence
  Extension Primer
ataattttacctctaactacgcctt

SEQ ID NO: 8281 - DNA, 25 bp, Artificial sequence
  Extension Primer
aaacaaaatgccattatgatttcta

SEQ ID NO: 8282 - DNA, 25 bp, Artificial sequence
  Extension Primer
tatcacctgccagaattagggaaga

SEQ ID NO: 8283 - DNA, 25 bp, Artificial sequence
  Extension Primer
agtccacaggttgaaaatgtgagag

SEQ ID NO: 8284 - DNA, 25 bp, Artificial sequence
  Extension Primer
aactgtaagatactaaaaggaaagc

SEQ ID NO: 8285 - DNA, 25 bp, Artificial sequence
  Extension Primer
caatgcatcaactgtcagaagagtc

SEQ ID NO: 8286 - DNA, 25 bp, Artificial sequence
  Extension Primer
tctayaccayacataggctcccacc

SEQ ID NO: 8287 - DNA, 25 bp, Artificial sequence
  Extension Primer
ccttaaaaattgctcagtgcttagg

SEQ ID NO: 8288 - DNA, 25 bp, Artificial sequence
  Extension Primer
agtctcagaattttctggcaacctc

SEQ ID NO: 8289 - DNA, 25 bp, Artificial sequence
  Extension Primer
ggggctgctgcctcttctgtcacag

SEQ ID NO: 8290 - DNA, 25 bp, Artificial sequence
  Extension Primer
aggtaaagtgcttgggaaagccctc

SEQ ID NO: 8291 - DNA, 25 bp, Artificial sequence
  Extension Primer
gaaagttaccacctccctgattctt

SEQ ID NO: 8292 - DNA, 25 bp, Artificial sequence
  Extension Primer
ttactacacttactcatctcagagt

SEQ ID NO: 8293 - DNA, 25 bp, Artificial sequence
  Extension Primer
taatttttcatcacgttatcactct

SEQ ID NO: 8294 - DNA, 25 bp, Artificial sequence
  Extension Primer
ggatgaacacaggaagcggctgatc

SEQ ID NO: 8295 - DNA, 25 bp, Artificial sequence
  Extension Primer
aaagccaggaaccagagcagagaga

SEQ ID NO: 8296 - DNA, 25 bp, Artificial sequence
  Extension Primer
tcagcatctcttgagctttttgagg

SEQ ID NO: 8297 - DNA, 25 bp, Artificial sequence
  Extension Primer
ccctttcactacgacaaggctgtga

SEQ ID NO: 8298 - DNA, 25 bp, Artificial sequence
  Extension Primer
gagcttagaaataagagttatacta

SEQ ID NO: 8299 - DNA, 25 bp, Artificial sequence
  Extension Primer
tcccaaagcagggtgcatctgtgag

SEQ ID NO: 8300 - DNA, 25 bp, Artificial sequence
  Extension Primer
gtcatatttctttccatacgacatg

SEQ ID NO: 8301 - DNA, 25 bp, Artificial sequence
  Extension Primer
acatgrgttttcatcttatttcccc

SEQ ID NO: 8302 - DNA, 25 bp, Artificial sequence
  Extension Primer
actgcatatcgtttagtttcccctc

SEQ ID NO: 8303 - DNA, 25 bp, Artificial sequence
  Extension Primer
tcagatatatgatttataaactttt

SEQ ID NO: 8304 - DNA, 25 bp, Artificial sequence
  Extension Primer
agaaaggctgacrctaaattcattt

SEQ ID NO: 8305 - DNA, 25 bp, Artificial sequence
  Extension Primer
aataatgtctggaacatgcctaaac

SEQ ID NO: 8306 - DNA, 25 bp, Artificial sequence
  Extension Primer
agcactttgtaattactgaattttc

SEQ ID NO: 8307 - DNA, 25 bp, Artificial sequence
  Extension Primer
ccaatgcctgcttaaccactgtgct

SEQ ID NO: 8308 - DNA, 25 bp, Artificial sequence
  Extension Primer
ttggggggaggggggtaagaaaagc

SEQ ID NO: 8309 - DNA, 25 bp, Artificial sequence
  Extension Primer
gcggaggaagaagacaggagagtgt

SEQ ID NO: 8310 - DNA, 25 bp, Artificial sequence
  Extension Primer
tggccctcatcctgtatcacacrcc

SEQ ID NO: 8311 - DNA, 25 bp, Artificial sequence
  Extension Primer
gcttgcttgtggtgtttggcactgg

SEQ ID NO: 8312 - DNA, 25 bp, Artificial sequence
  Extension Primer
aggtaacagaaatcagaacagcggc

SEQ ID NO: 8313 - DNA, 25 bp, Artificial sequence
  Extension Primer
aggaaacgaagctgacagataaagc

SEQ ID NO: 8314 - DNA, 25 bp, Artificial sequence
  Extension Primer
ccgtaaagcactcttcaagtggaag

SEQ ID NO: 8315 - DNA, 25 bp, Artificial sequence
  Extension Primer
ggaacatacttccaggggactgatc

SEQ ID NO: 8316 - DNA, 25 bp, Artificial sequence
  Extension Primer
caggctgatggaaagggtttagaca

SEQ ID NO: 8317 - DNA, 25 bp, Artificial sequence
  Extension Primer
tagaggtgatttaccattgagcatc

SEQ ID NO: 8318 - DNA, 25 bp, Artificial sequence
  Extension Primer
gaagccatgaccttgggcacccagy

SEQ ID NO: 8319 - DNA, 25 bp, Artificial sequence
  Extension Primer
tctctgtaaataaaaagctatragt

SEQ ID NO: 8320 - DNA, 25 bp, Artificial sequence
  Extension Primer
ctgtggtttcagcctgcacaatgaa

SEQ ID NO: 8321 - DNA, 25 bp, Artificial sequence
  Extension Primer
ttgtaactcatgggaaaaaggaaga

SEQ ID NO: 8322 - DNA, 25 bp, Artificial sequence
  Extension Primer
tatcttcttcatgggatgttctcca

SEQ ID NO: 8323 - DNA, 25 bp, Artificial sequence
  Extension Primer
gaggcycagagattcagataactca

SEQ ID NO: 8324 - DNA, 25 bp, Artificial sequence
  Extension Primer
cctgcctccagcttttgggccccgc

SEQ ID NO: 8325 - DNA, 25 bp, Artificial sequence
  Extension Primer
tcactgaataaacaagggtcattgg

SEQ ID NO: 8326 - DNA, 25 bp, Artificial sequence
  Extension Primer
attggrtaaaatatggtacattaga

SEQ ID NO: 8327 - DNA, 25 bp, Artificial sequence
  Extension Primer
tgaggatatcagctccctgtgaggc

SEQ ID NO: 8328 - DNA, 25 bp, Artificial sequence
  Extension Primer
catctttaggatatgatcttcccac

SEQ ID NO: 8329 - DNA, 25 bp, Artificial sequence
  Extension Primer
aatttgttattcccttctgtctctc

SEQ ID NO: 8330 - DNA, 25 bp, Artificial sequence
  Extension Primer
cattgccattttcttcaaaattctg

SEQ ID NO: 8331 - DNA, 25 bp, Artificial sequence
  Extension Primer
tagaaaaaatacaccccaactccaa

SEQ ID NO: 8332 - DNA, 25 bp, Artificial sequence
  Extension Primer
cttcacatgtgatacacagttaatg

SEQ ID NO: 8333 - DNA, 25 bp, Artificial sequence
  Extension Primer
gaagtcaagaccaaactgcccattw

SEQ ID NO: 8334 - DNA, 25 bp, Artificial sequence
  Extension Primer
aacagcagacagagaagtggactga

SEQ ID NO: 8335 - DNA, 25 bp, Artificial sequence
  Extension Primer
ctaaatgtcgggggagggggaggac

SEQ ID NO: 8336 - DNA, 25 bp, Artificial sequence
  Extension Primer
tgctgaatcaactcctatcttagtt

SEQ ID NO: 8337 - DNA, 25 bp, Artificial sequence
  Extension Primer
ctgaactttttatattctaagattc

SEQ ID NO: 8338 - DNA, 25 bp, Artificial sequence
  Extension Primer
caaggagaacaggcgcccctaaagc

SEQ ID NO: 8339 - DNA, 25 bp, Artificial sequence
  Extension Primer
caccggtgctacaaaatgttccttt

SEQ ID NO: 8340 - DNA, 25 bp, Artificial sequence
  Extension Primer
tttgtatacaatatttttacacata

SEQ ID NO: 8341 - DNA, 25 bp, Artificial sequence
  Extension Primer
ccaatattcttgcctgggaaatccc

SEQ ID NO: 8342 - DNA, 25 bp, Artificial sequence
  Extension Primer
ttatgttgccctctcttcctttgga

SEQ ID NO: 8343 - DNA, 25 bp, Artificial sequence
  Extension Primer
taaagggttagaaactagaaagaaa

SEQ ID NO: 8344 - DNA, 25 bp, Artificial sequence
  Extension Primer
gcattagccaagccaagatctgtat

SEQ ID NO: 8345 - DNA, 25 bp, Artificial sequence
  Extension Primer
gatgttctagaacaaaaatcacaat

SEQ ID NO: 8346 - DNA, 25 bp, Artificial sequence
  Extension Primer
gactcacaggttttcgtataaaata

SEQ ID NO: 8347 - DNA, 25 bp, Artificial sequence
  Extension Primer
cagtggcactagagaagaaagacac

SEQ ID NO: 8348 - DNA, 25 bp, Artificial sequence
  Extension Primer
ctcacttgcaaaacttaaccttgga

SEQ ID NO: 8349 - DNA, 25 bp, Artificial sequence
  Extension Primer
aaagatgtcttctaaagtggtagga

SEQ ID NO: 8350 - DNA, 25 bp, Artificial sequence
  Extension Primer
agcactgaataactgctggatgaat

SEQ ID NO: 8351 - DNA, 25 bp, Artificial sequence
  Extension Primer
tgagcttcttttggtcaatcttttt

SEQ ID NO: 8352 - DNA, 25 bp, Artificial sequence
  Extension Primer
cccttctgtaactattcaaactgat

SEQ ID NO: 8353 - DNA, 25 bp, Artificial sequence
  Extension Primer
caaatgaaaacctgctggaaaagga

SEQ ID NO: 8354 - DNA, 25 bp, Artificial sequence
  Extension Primer
tcaatcctcccaaaccctgtgagtc

SEQ ID NO: 8355 - DNA, 25 bp, Artificial sequence
  Extension Primer
taaatttatttagaacaatgtttct

SEQ ID NO: 8356 - DNA, 25 bp, Artificial sequence
  Extension Primer
ggggatgtgggaattctctccgtac

SEQ ID NO: 8357 - DNA, 25 bp, Artificial sequence
  Extension Primer
tctttccctcctctgcttcctgccc

SEQ ID NO: 8358 - DNA, 25 bp, Artificial sequence
  Extension Primer
aatgtgaatgtcaaaaatgcccttt

SEQ ID NO: 8359 - DNA, 25 bp, Artificial sequence
  Extension Primer
tgcagtagagttccctgtgctgtac

SEQ ID NO: 8360 - DNA, 25 bp, Artificial sequence
  Extension Primer
aatattttatattttgtaaatatca

SEQ ID NO: 8361 - DNA, 25 bp, Artificial sequence
  Extension Primer
aagcagttgttttctttgttagtat

SEQ ID NO: 8362 - DNA, 25 bp, Artificial sequence
  Extension Primer
tgcttatttagtggagtttcatttc

SEQ ID NO: 8363 - DNA, 25 bp, Artificial sequence
  Extension Primer
tgccagggatcagctgaatggtaaa

SEQ ID NO: 8364 - DNA, 25 bp, Artificial sequence
  Extension Primer
tgaggtcatcatagccccagtcctg

SEQ ID NO: 8365 - DNA, 25 bp, Artificial sequence
  Extension Primer
tatgacacacttaagtgtcttcatc

SEQ ID NO: 8366 - DNA, 25 bp, Artificial sequence
  Extension Primer
agaaccaggtggtgaaaccttggag

SEQ ID NO: 8367 - DNA, 25 bp, Artificial sequence
  Extension Primer
tcccacaaagcgaacatctccctaa

SEQ ID NO: 8368 - DNA, 25 bp, Artificial sequence
  Extension Primer
atcctggctctgtcacaccaaactg

SEQ ID NO: 8369 - DNA, 25 bp, Artificial sequence
  Extension Primer
ctctggccaaccatggagagctaaa

SEQ ID NO: 8370 - DNA, 25 bp, Artificial sequence
  Extension Primer
cttcttgcttgcttgttgattgcta

SEQ ID NO: 8371 - DNA, 25 bp, Artificial sequence
  Extension Primer
gtagatagctgactttgtttagatg

SEQ ID NO: 8372 - DNA, 25 bp, Artificial sequence
  Extension Primer
cctcctgttaccttaatttctatat

SEQ ID NO: 8373 - DNA, 25 bp, Artificial sequence
  Extension Primer
tcctctcttcacaggcccgggatgc

SEQ ID NO: 8374 - DNA, 25 bp, Artificial sequence
  Extension Primer
gtccaatgtataagataagattcat

SEQ ID NO: 8375 - DNA, 25 bp, Artificial sequence
  Extension Primer
aagaagagattgagaacatcaaagg

SEQ ID NO: 8376 - DNA, 25 bp, Artificial sequence
  Extension Primer
gtaggcacccaaaatatcaataaca

SEQ ID NO: 8377 - DNA, 25 bp, Artificial sequence
  Extension Primer
rtattatacagactgaagcaagtca

SEQ ID NO: 8378 - DNA, 25 bp, Artificial sequence
  Extension Primer
acgccccagctcagctgcacccaga

SEQ ID NO: 8379 - DNA, 25 bp, Artificial sequence
  Extension Primer
ccatcatcaccctggccacagtcct

SEQ ID NO: 8380 - DNA, 25 bp, Artificial sequence
  Extension Primer
gctttgacatcttccatttttagca

SEQ ID NO: 8381 - DNA, 25 bp, Artificial sequence
  Extension Primer
aacatcagagcatacagtacaaggt

SEQ ID NO: 8382 - DNA, 25 bp, Artificial sequence
  Extension Primer
gcttcattttactaagttcagccaa

SEQ ID NO: 8383 - DNA, 25 bp, Artificial sequence
  Extension Primer
ccttttaagaatttttggagaagat

SEQ ID NO: 8384 - DNA, 25 bp, Artificial sequence
  Extension Primer
gaagcaactcttctatttagtccac

SEQ ID NO: 8385 - DNA, 25 bp, Artificial sequence
  Extension Primer
tttaatgcttaatggaactctgctg

SEQ ID NO: 8386 - DNA, 25 bp, Artificial sequence
  Extension Primer
taaacataaagccagctaacccaac

SEQ ID NO: 8387 - DNA, 25 bp, Artificial sequence
  Extension Primer
taaayggagtcacgttgccctcatt

SEQ ID NO: 8388 - DNA, 25 bp, Artificial sequence
  Extension Primer
tctcaatgtrtctcaactstaagat

SEQ ID NO: 8389 - DNA, 25 bp, Artificial sequence
  Extension Primer
gagaaaagcaggggacaacttaaat

SEQ ID NO: 8390 - DNA, 25 bp, Artificial sequence
  Extension Primer
tctgttgcaaacacttctcaaaagg

SEQ ID NO: 8391 - DNA, 25 bp, Artificial sequence
  Extension Primer
ggtaattggactcagaattccaaga

SEQ ID NO: 8392 - DNA, 25 bp, Artificial sequence
  Extension Primer
tgggatcctgctgctgcccacactc

SEQ ID NO: 8393 - DNA, 25 bp, Artificial sequence
  Extension Primer
aatagacagaatccagatttatgat

SEQ ID NO: 8394 - DNA, 22 bp, Artificial sequence
  Extension Primer
gttggttgagtgagggaatggc

SEQ ID NO: 8395 - DNA, 22 bp, Artificial sequence
  Extension Primer
ggaaccctcatcacacatcatc

SEQ ID NO: 8396 - DNA, 25 bp, Artificial sequence
  Extension Primer
tgtgagacagagtcaagtggcaatg

SEQ ID NO: 8397 - DNA, 25 bp, Artificial sequence
  Extension Primer
aggcactaaaacaaaaaaaggagtt

SEQ ID NO: 8398 - DNA, 25 bp, Artificial sequence
  Extension Primer
catgtcagattcacagatggaatta

SEQ ID NO: 8399 - DNA, 25 bp, Artificial sequence
  Extension Primer
gcacatgactgaggaaccacgaaac

SEQ ID NO: 8400 - DNA, 25 bp, Artificial sequence
  Extension Primer
caatgacaaactgtggccttggaag

SEQ ID NO: 8401 - DNA, 25 bp, Artificial sequence
  Extension Primer
ttttccaggcaagagtactggaatg

SEQ ID NO: 8402 - DNA, 25 bp, Artificial sequence
  Extension Primer
ttttacctcctgggctttgggggag

SEQ ID NO: 8403 - DNA, 25 bp, Artificial sequence
  Extension Primer
agccgctggcagcagatcactcatg

SEQ ID NO: 8404 - DNA, 25 bp, Artificial sequence
  Extension Primer
gttcagtgcaccccttaaaatgaga

SEQ ID NO: 8405 - DNA, 25 bp, Artificial sequence
  Extension Primer
tcccactagacttaattagtcatgg

SEQ ID NO: 8406 - DNA, 25 bp, Artificial sequence
  Extension Primer
atttaacacgtaaccacataataca

SEQ ID NO: 8407 - DNA, 25 bp, Artificial sequence
  Extension Primer
tgctcaagctcttgggggtgaaagg

SEQ ID NO: 8408 - DNA, 25 bp, Artificial sequence
  Extension Primer
ttggtaatatgcataagtgtctack

SEQ ID NO: 8409 - DNA, 25 bp, Artificial sequence
  Extension Primer
gagatgatgagagagccagaggcaa

SEQ ID NO: 8410 - DNA, 25 bp, Artificial sequence
  Extension Primer
gggacatttcattcaaagaggatgt

SEQ ID NO: 8411 - DNA, 25 bp, Artificial sequence
  Extension Primer
tgacaacccagttcagtaaacaagc

SEQ ID NO: 8412 - DNA, 25 bp, Artificial sequence
  Extension Primer
ctcctacatttctctctgtcatagc

SEQ ID NO: 8413 - DNA, 25 bp, Artificial sequence
  Extension Primer
gagtgacttgcttcaggtacccttt

SEQ ID NO: 8414 - DNA, 25 bp, Artificial sequence
  Extension Primer
ggatttgtggagagaaggtgagtag

SEQ ID NO: 8415 - DNA, 25 bp, Artificial sequence
  Extension Primer
aggcaaacagcaagttaactaactg

SEQ ID NO: 8416 - DNA, 25 bp, Artificial sequence
  Extension Primer
acccaggccccctgcattgggagca

SEQ ID NO: 8417 - DNA, 25 bp, Artificial sequence
  Extension Primer
acattctctcttcaagaagctggca

SEQ ID NO: 8418 - DNA, 25 bp, Artificial sequence
  Extension Primer
gcctggctctgagaagggtaggaga

SEQ ID NO: 8419 - DNA, 25 bp, Artificial sequence
  Extension Primer
agcccaagggagaaaaatgaaatac

SEQ ID NO: 8420 - DNA, 25 bp, Artificial sequence
  Extension Primer
gataactaaaggctacagagatttc

SEQ ID NO: 8421 - DNA, 25 bp, Artificial sequence
  Extension Primer
aaaatctgttcttacatcttacact

SEQ ID NO: 8422 - DNA, 25 bp, Artificial sequence
  Extension Primer
agaaattcggacatagttatatctc

SEQ ID NO: 8423 - DNA, 25 bp, Artificial sequence
  Extension Primer
aagayatgcctttacattgccatcc

SEQ ID NO: 8424 - DNA, 25 bp, Artificial sequence
  Extension Primer
tacatacatatttcaaagtatttct

SEQ ID NO: 8425 - DNA, 25 bp, Artificial sequence
  Extension Primer
ctccagcacacgtgggccatacagc

SEQ ID NO: 8426 - DNA, 25 bp, Artificial sequence
  Extension Primer
ggtactcaataaatgaccacagatc

SEQ ID NO: 8427 - DNA, 25 bp, Artificial sequence
  Extension Primer
taaagatgtttagcacagagcctgg

SEQ ID NO: 8428 - DNA, 25 bp, Artificial sequence
  Extension Primer
atctcctgtcctttgcaagtgaagt

SEQ ID NO: 8429 - DNA, 25 bp, Artificial sequence
  Extension Primer
ctctgataagttatgtgatgttctt

SEQ ID NO: 8430 - DNA, 25 bp, Artificial sequence
  Extension Primer
ggcctctgggctgaactggcacctc

SEQ ID NO: 8431 - DNA, 25 bp, Artificial sequence
  Extension Primer
ggctgttaaaactaagaagggcaga

SEQ ID NO: 8432 - DNA, 25 bp, Artificial sequence
  Extension Primer
aggcatagcttgtccccggctcctg

SEQ ID NO: 8433 - DNA, 25 bp, Artificial sequence
  Extension Primer
acctccagttagaggataaatatct

SEQ ID NO: 8434 - DNA, 25 bp, Artificial sequence
  Extension Primer
aggagacaggccagtggttctcacc

SEQ ID NO: 8435 - DNA, 25 bp, Artificial sequence
  Extension Primer
gtacaacacttttgtataaatacat

SEQ ID NO: 8436 - DNA, 25 bp, Artificial sequence
  Extension Primer
cgagtctctgctttgaatyggtagc

SEQ ID NO: 8437 - DNA, 25 bp, Artificial sequence
  Extension Primer
gagatgtcctgatgtctgcaagtgc

SEQ ID NO: 8438 - DNA, 25 bp, Artificial sequence
  Extension Primer
caacctacttcagagaaacaagtaa

SEQ ID NO: 8439 - DNA, 25 bp, Artificial sequence
  Extension Primer
tcataccagggctcagagctgagag

SEQ ID NO: 8440 - DNA, 25 bp, Artificial sequence
  Extension Primer
cttcagtgtgaggtttgatgccctg

SEQ ID NO: 8441 - DNA, 25 bp, Artificial sequence
  Extension Primer
accgaagagagctgcacagagacaa

SEQ ID NO: 8442 - DNA, 25 bp, Artificial sequence
  Extension Primer
ctaaatagcaacaattttaaagatc

SEQ ID NO: 8443 - DNA, 25 bp, Artificial sequence
  Extension Primer
atttgctccaattaacagaagactg

SEQ ID NO: 8444 - DNA, 25 bp, Artificial sequence
  Extension Primer
cattttatgagcactaactgcattc

SEQ ID NO: 8445 - DNA, 25 bp, Artificial sequence
  Extension Primer
tgttcaatgaactttttacatcaga

SEQ ID NO: 8446 - DNA, 25 bp, Artificial sequence
  Extension Primer
agattcagagctctggccagaaata

SEQ ID NO: 8447 - DNA, 25 bp, Artificial sequence
  Extension Primer
tctcatcttccaggcagttaggagc

SEQ ID NO: 8448 - DNA, 25 bp, Artificial sequence
  Extension Primer
aaggggctgggtaagcatcagaaag

SEQ ID NO: 8449 - DNA, 25 bp, Artificial sequence
  Extension Primer
tggatcctccacaaatgtggaagac

SEQ ID NO: 8450 - DNA, 25 bp, Artificial sequence
  Extension Primer
ttccaggatttgacctagaaagaat

SEQ ID NO: 8451 - DNA, 25 bp, Artificial sequence
  Extension Primer
tggaaggtctggayggctgcccagg

SEQ ID NO: 8452 - DNA, 25 bp, Artificial sequence
  Extension Primer
tgccaattgtcattaaaacattttc

SEQ ID NO: 8453 - DNA, 25 bp, Artificial sequence
  Extension Primer
agtttggcccactaatgctcttatc

SEQ ID NO: 8454 - DNA, 25 bp, Artificial sequence
  Extension Primer
ccacagaaagctgcttgttgcattc

SEQ ID NO: 8455 - DNA, 25 bp, Artificial sequence
  Extension Primer
gccagcaagagaggttttgtgcaca

SEQ ID NO: 8456 - DNA, 25 bp, Artificial sequence
  Extension Primer
tcaggatgcagctccgaaggtctca

SEQ ID NO: 8457 - DNA, 25 bp, Artificial sequence
  Extension Primer
ctgtgaggtggtctctcagatccat

SEQ ID NO: 8458 - DNA, 25 bp, Artificial sequence
  Extension Primer
cctctatgcctcagatcccaaactt

SEQ ID NO: 8459 - DNA, 25 bp, Artificial sequence
  Extension Primer
gggctttgaaatgtgttttatcaca

SEQ ID NO: 8460 - DNA, 25 bp, Artificial sequence
  Extension Primer
gcaaacgagacatccggcgcctgta

SEQ ID NO: 8461 - DNA, 25 bp, Artificial sequence
  Extension Primer
atgaattaggcattagggagagatg

SEQ ID NO: 8462 - DNA, 25 bp, Artificial sequence
  Extension Primer
taatgatttggccccaatcctatct

SEQ ID NO: 8463 - DNA, 25 bp, Artificial sequence
  Extension Primer
ccatggcacctaaaaatgtccctta

SEQ ID NO: 8464 - DNA, 25 bp, Artificial sequence
  Extension Primer
agtattcttactttgttcactcagc

SEQ ID NO: 8465 - DNA, 25 bp, Artificial sequence
  Extension Primer
tcatcaaggcttcacatcatgtaaa

SEQ ID NO: 8466 - DNA, 25 bp, Artificial sequence
  Extension Primer
ttctccaaatttccgactttctgaa

SEQ ID NO: 8467 - DNA, 25 bp, Artificial sequence
  Extension Primer
actctcccttttttagtttttaagc

SEQ ID NO: 8468 - DNA, 25 bp, Artificial sequence
  Extension Primer
ccctggttccaaattactctgtgtg

SEQ ID NO: 8469 - DNA, 25 bp, Artificial sequence
  Extension Primer
tcaaggtccgaacacatgattcatc

SEQ ID NO: 8470 - DNA, 25 bp, Artificial sequence
  Extension Primer
ggcatttctgaaggcagtatattgg

SEQ ID NO: 8471 - DNA, 25 bp, Artificial sequence
  Extension Primer
atggtactgggctccatgtgccttg

SEQ ID NO: 8472 - DNA, 25 bp, Artificial sequence
  Extension Primer
aaagaatcaactttgtgaatgagaa

SEQ ID NO: 8473 - DNA, 25 bp, Artificial sequence
  Extension Primer
ggatgggaggagtgggtgggtgaag

SEQ ID NO: 8474 - DNA, 25 bp, Artificial sequence
  Extension Primer
agaccacatgtgggaagagtaacac

SEQ ID NO: 8475 - DNA, 25 bp, Artificial sequence
  Extension Primer
tcactcatattgtacagacagtagc

SEQ ID NO: 8476 - DNA, 25 bp, Artificial sequence
  Extension Primer
tcataactggtctctctgtaatctt

SEQ ID NO: 8477 - DNA, 25 bp, Artificial sequence
  Extension Primer
actcagcagygagatgggagggatg

SEQ ID NO: 8478 - DNA, 25 bp, Artificial sequence
  Extension Primer
tctctttagccaggctcagataaca

SEQ ID NO: 8479 - DNA, 25 bp, Artificial sequence
  Extension Primer
cccaggaattttctcagcccccaga

SEQ ID NO: 8480 - DNA, 25 bp, Artificial sequence
  Extension Primer
ccaggaattttctcagcccccagay

SEQ ID NO: 8481 - DNA, 25 bp, Artificial sequence
  Extension Primer
atgaaataactattcctattgtaga

SEQ ID NO: 8482 - DNA, 25 bp, Artificial sequence
  Extension Primer
aaatattaaccgtattgagcatcac

SEQ ID NO: 8483 - DNA, 25 bp, Artificial sequence
  Extension Primer
gaaggggagataacttgaagatgtc

SEQ ID NO: 8484 - DNA, 25 bp, Artificial sequence
  Extension Primer
actgaagcaattgataaactgagtt

SEQ ID NO: 8485 - DNA, 25 bp, Artificial sequence
  Extension Primer
tctcttcccgcctcatcttaagtac

SEQ ID NO: 8486 - DNA, 25 bp, Artificial sequence
  Extension Primer
ggttaaaattccaaaactgtaagga

SEQ ID NO: 8487 - DNA, 25 bp, Artificial sequence
  Extension Primer
aaatttaacaactgactcaccaaca

SEQ ID NO: 8488 - DNA, 25 bp, Artificial sequence
  Extension Primer
tcagtgaatctgaaaaaaacaaccc

SEQ ID NO: 8489 - DNA, 25 bp, Artificial sequence
  Extension Primer
tctcttacattccctgatctccact

SEQ ID NO: 8490 - DNA, 25 bp, Artificial sequence
  Extension Primer
gaaattagcaagggagaggagaaag

SEQ ID NO: 8491 - DNA, 25 bp, Artificial sequence
  Extension Primer
tcttcaggaagcactctgaagatcc

SEQ ID NO: 8492 - DNA, 25 bp, Artificial sequence
  Extension Primer
caggaagcactctgaagatcckccc

SEQ ID NO: 8493 - DNA, 25 bp, Artificial sequence
  Extension Primer
gtacgagtcacctgcagcacatcca

SEQ ID NO: 8494 - DNA, 25 bp, Artificial sequence
  Extension Primer
gatatttgtggcaaaacaaaagaac

SEQ ID NO: 8495 - DNA, 25 bp, Artificial sequence
  Extension Primer
ttcttgtaaacatgcttttctccct

SEQ ID NO: 8496 - DNA, 25 bp, Artificial sequence
  Extension Primer
tgatggccctcatcctgtatcacac

SEQ ID NO: 8497 - DNA, 25 bp, Artificial sequence
  Extension Primer
actcttggcacttagctcttcagac

SEQ ID NO: 8498 - DNA, 25 bp, Artificial sequence
  Extension Primer
taaccctactcgagcagagaggaaa

SEQ ID NO: 8499 - DNA, 25 bp, Artificial sequence
  Extension Primer
agaattcagataaataacacagtat

SEQ ID NO: 8500 - DNA, 25 bp, Artificial sequence
  Extension Primer
cttcacgcgggatgggggcaaatcc

SEQ ID NO: 8501 - DNA, 25 bp, Artificial sequence
  Extension Primer
aaggcttagagattgtgggccaagg

SEQ ID NO: 8502 - DNA, 25 bp, Artificial sequence
  Extension Primer
tctttcccatctctaratttcccca

SEQ ID NO: 8503 - DNA, 25 bp, Artificial sequence
  Extension Primer
ggcattatcctcctcgttccataac

SEQ ID NO: 8504 - DNA, 25 bp, Artificial sequence
  Extension Primer
gcctggaagtaggaacaagtcccct

SEQ ID NO: 8505 - DNA, 25 bp, Artificial sequence
  Extension Primer
aaaaaccctctgcaagttccactgc

SEQ ID NO: 8506 - DNA, 25 bp, Artificial sequence
  Extension Primer
caaggtcagggccaacgcggcgctc

SEQ ID NO: 8507 - DNA, 25 bp, Artificial sequence
  Extension Primer
agaaggacttcttgaccaggtctca

SEQ ID NO: 8508 - DNA, 25 bp, Artificial sequence
  Extension Primer
ataccccttaagtcaagcagcattg

SEQ ID NO: 8509 - DNA, 25 bp, Artificial sequence
  Extension Primer
ggtaaaagaagctggaaggcagttc

SEQ ID NO: 8510 - DNA, 25 bp, Artificial sequence
  Extension Primer
ttctagaagccaaaccccatctctc

SEQ ID NO: 8511 - DNA, 25 bp, Artificial sequence
  Extension Primer
tgttcttcctcttttgcctccactg

SEQ ID NO: 8512 - DNA, 25 bp, Artificial sequence
  Extension Primer
acaatgataattaccaatttctgga

SEQ ID NO: 8513 - DNA, 25 bp, Artificial sequence
  Extension Primer
actcttcagataaccaagacattaa

SEQ ID NO: 8514 - DNA, 25 bp, Artificial sequence
  Extension Primer
tgcaaactgccatccatctctcccc

SEQ ID NO: 8515 - DNA, 25 bp, Artificial sequence
  Extension Primer
acctctgcaccggaagcctcttats

SEQ ID NO: 8516 - DNA, 25 bp, Artificial sequence
  Extension Primer
tcctttccagctcggaacgtctccc

SEQ ID NO: 8517 - DNA, 25 bp, Artificial sequence
  Extension Primer
cgcatgctgaaactaagacctggtg

SEQ ID NO: 8518 - DNA, 25 bp, Artificial sequence
  Extension Primer
accttcctcatgtgccaagctcccc

SEQ ID NO: 8519 - DNA, 25 bp, Artificial sequence
  Extension Primer
aggggagcttacactggggtcttga

SEQ ID NO: 8520 - DNA, 25 bp, Artificial sequence
  Extension Primer
gcccaacagagctaacagtgatagt

SEQ ID NO: 8521 - DNA, 25 bp, Artificial sequence
  Extension Primer
tcttgaggtaactagcttcactatc

SEQ ID NO: 8522 - DNA, 25 bp, Artificial sequence
  Extension Primer
tgagaattaaataataattcgtatt

SEQ ID NO: 8523 - DNA, 25 bp, Artificial sequence
  Extension Primer
tgaacccaccaagggtcagcaaact

SEQ ID NO: 8524 - DNA, 25 bp, Artificial sequence
  Extension Primer
gagacattagctgatctctccagac

SEQ ID NO: 8525 - DNA, 25 bp, Artificial sequence
  Extension Primer
aggatgaaaaaccattttaaatact

SEQ ID NO: 8526 - DNA, 25 bp, Artificial sequence
  Extension Primer
tgcatttgtaacggatgcattaggc

SEQ ID NO: 8527 - DNA, 25 bp, Artificial sequence
  Extension Primer
aaaaacatgtttgtgcttacacctc

SEQ ID NO: 8528 - DNA, 25 bp, Artificial sequence
  Extension Primer
tcagctccacttctgtgctgctctg

SEQ ID NO: 8529 - DNA, 25 bp, Artificial sequence
  Extension Primer
ggcatgtttagtgtttgtaattaga

SEQ ID NO: 8530 - DNA, 25 bp, Artificial sequence
  Extension Primer
gtgtgtggttccctttcccactgtg

SEQ ID NO: 8531 - DNA, 25 bp, Artificial sequence
  Extension Primer
agggcactggcccggaagccagaag

SEQ ID NO: 8532 - DNA, 25 bp, Artificial sequence
  Extension Primer
gaatagttgtgttgaaattagcatc

SEQ ID NO: 8533 - DNA, 25 bp, Artificial sequence
  Extension Primer
cacagagtcatcaagaggatcagaa

SEQ ID NO: 8534 - DNA, 25 bp, Artificial sequence
  Extension Primer
agtcacttgcaattgtgcttctcat

SEQ ID NO: 8535 - DNA, 25 bp, Artificial sequence
  Extension Primer
tgcatggaaagttataaaggactat

SEQ ID NO: 8536 - DNA, 25 bp, Artificial sequence
  Extension Primer
attaacttaataatccaaagtgggg

SEQ ID NO: 8537 - DNA, 25 bp, Artificial sequence
  Extension Primer
tgtggttttccatattctttatgct

SEQ ID NO: 8538 - DNA, 25 bp, Artificial sequence
  Extension Primer
gaactgtgatccacagcatattaca

SEQ ID NO: 8539 - DNA, 25 bp, Artificial sequence
  Extension Primer
gagtcagggatgttctcccatacct

SEQ ID NO: 8540 - DNA, 25 bp, Artificial sequence
  Extension Primer
aattacatatttctgttaatgtttt

SEQ ID NO: 8541 - DNA, 25 bp, Artificial sequence
  Extension Primer
aggctagattaagcagtatatcttc

SEQ ID NO: 8542 - DNA, 25 bp, Artificial sequence
  Extension Primer
ktacctttttgttcaaaggaatgag

SEQ ID NO: 8543 - DNA, 25 bp, Artificial sequence
  Extension Primer
cttgagatggtgggaggaggaagac

SEQ ID NO: 8544 - DNA, 25 bp, Artificial sequence
  Extension Primer
ccttggtgctcccacaaaatctaat

SEQ ID NO: 8545 - DNA, 25 bp, Artificial sequence
  Extension Primer
ctttgatgtcccttgcaccttgccc

SEQ ID NO: 8546 - DNA, 25 bp, Artificial sequence
  Extension Primer
tgtattgtttatagtgtatctaact

SEQ ID NO: 8547 - DNA, 25 bp, Artificial sequence
  Extension Primer
gggacattgtgtggacatagctgat

SEQ ID NO: 8548 - DNA, 25 bp, Artificial sequence
  Extension Primer
gattggggacaacatcatgaaactt

SEQ ID NO: 8549 - DNA, 25 bp, Artificial sequence
  Extension Primer
cacacctgggtggccgagccttcct

SEQ ID NO: 8550 - DNA, 25 bp, Artificial sequence
  Extension Primer
aggccaggatccagactaagtgaca

SEQ ID NO: 8551 - DNA, 25 bp, Artificial sequence
  Extension Primer
gagccccatcacggtcatgagagca

SEQ ID NO: 8552 - DNA, 25 bp, Artificial sequence
  Extension Primer
gttagccagtaactggagctggagc

SEQ ID NO: 8553 - DNA, 25 bp, Artificial sequence
  Extension Primer
tgaaactgtwattaaaatttcaaag

SEQ ID NO: 8554 - DNA, 25 bp, Artificial sequence
  Extension Primer
catcacggcattatacyacgttaya

SEQ ID NO: 8555 - DNA, 25 bp, Artificial sequence
  Extension Primer
acacctgaaatcatccatctatgca

SEQ ID NO: 8556 - DNA, 25 bp, Artificial sequence
  Extension Primer
ggagggagcactggcccagggaagc

SEQ ID NO: 8557 - DNA, 25 bp, Artificial sequence
  Extension Primer
tttctaactatgatgagtgcttctt

SEQ ID NO: 8558 - DNA, 25 bp, Artificial sequence
  Extension Primer
accagtccatctctgcatatttgtt

SEQ ID NO: 8559 - DNA, 25 bp, Artificial sequence
  Extension Primer
gggactggctggaccagagtggcct

SEQ ID NO: 8560 - DNA, 25 bp, Artificial sequence
  Extension Primer
gttccctttggggagacagcagtgc

SEQ ID NO: 8561 - DNA, 25 bp, Artificial sequence
  Extension Primer
tttctacaaagtggcaggtgagaac

SEQ ID NO: 8562 - DNA, 25 bp, Artificial sequence
  Extension Primer
agcccacagcctcctgtctttcacc

SEQ ID NO: 8563 - DNA, 25 bp, Artificial sequence
  Extension Primer
agcaaaaataaatttcacttccatt

SEQ ID NO: 8564 - DNA, 25 bp, Artificial sequence
  Extension Primer
cagtgaacagactgatttccctccc

SEQ ID NO: 8565 - DNA, 25 bp, Artificial sequence
  Extension Primer
ggtctgccaggagttgacgatcaga

SEQ ID NO: 8566 - DNA, 25 bp, Artificial sequence
  Extension Primer
caagtgtaataaatccatgggcttt

SEQ ID NO: 8567 - DNA, 25 bp, Artificial sequence
  Extension Primer
cagatgcaaatctgaagtggggaga

SEQ ID NO: 8568 - DNA, 25 bp, Artificial sequence
  Extension Primer
tgacacataacaaattctcagtaaa

SEQ ID NO: 8569 - DNA, 25 bp, Artificial sequence
  Extension Primer
gtgagctgaaggatttctcccaatg

SEQ ID NO: 8570 - DNA, 25 bp, Artificial sequence
  Extension Primer
agtttaggtcattttgagctggggt

SEQ ID NO: 8571 - DNA, 25 bp, Artificial sequence
  Extension Primer
ccacttcaaatggcccttagaacac

SEQ ID NO: 8572 - DNA, 25 bp, Artificial sequence
  Extension Primer
tatttgattttgggctgtgctgggt

SEQ ID NO: 8573 - DNA, 25 bp, Artificial sequence
  Extension Primer
gtggttgggtgacctttgaccgcag

SEQ ID NO: 8574 - DNA, 25 bp, Artificial sequence
  Extension Primer
aagccccttcaccgtaacgaagttg

SEQ ID NO: 8575 - DNA, 25 bp, Artificial sequence
  Extension Primer
ggacacaggcaaagcattttgtgaa

SEQ ID NO: 8576 - DNA, 25 bp, Artificial sequence
  Extension Primer
aacacagcctttgaatgttggaagc

SEQ ID NO: 8577 - DNA, 25 bp, Artificial sequence
  Extension Primer
tccccacaggtctgtgcctttgccc

SEQ ID NO: 8578 - DNA, 25 bp, Artificial sequence
  Extension Primer
gcattatggagaaaatatacatagt

SEQ ID NO: 8579 - DNA, 25 bp, Artificial sequence
  Extension Primer
ctcagcaattcctgtgtgaacataa

SEQ ID NO: 8580 - DNA, 25 bp, Artificial sequence
  Extension Primer
tcaagcctttccatgaattcagaat

SEQ ID NO: 8581 - DNA, 25 bp, Artificial sequence
  Extension Primer
tgcccctccttcattcccaccttaa

SEQ ID NO: 8582 - DNA, 25 bp, Artificial sequence
  Extension Primer
ttgccttttcgagtatgtgacccaa

SEQ ID NO: 8583 - DNA, 25 bp, Artificial sequence
  Extension Primer
acggtgggcattcaactgacctgca

SEQ ID NO: 8584 - DNA, 25 bp, Artificial sequence
  Extension Primer
tttctaacttcctgggcacaaatgc

SEQ ID NO: 8585 - DNA, 25 bp, Artificial sequence
  Extension Primer
ctcatcattacaggccttcagctct

SEQ ID NO: 8586 - DNA, 25 bp, Artificial sequence
  Extension Primer
ttttgtttttaactggcaggtggtg

SEQ ID NO: 8587 - DNA, 25 bp, Artificial sequence
  Extension Primer
agtgaataatcataacagccaatag

SEQ ID NO: 8588 - DNA, 25 bp, Artificial sequence
  Extension Primer
tttttggaataatttatttccgagg

SEQ ID NO: 8589 - DNA, 25 bp, Artificial sequence
  Extension Primer
agggaagcttttattactggtaatt

SEQ ID NO: 8590 - DNA, 25 bp, Artificial sequence
  Extension Primer
gtctcccaytggaatttatctggta

SEQ ID NO: 8591 - DNA, 25 bp, Artificial sequence
  Extension Primer
cccctccattaaggaagtcctgtgg

SEQ ID NO: 8592 - DNA, 25 bp, Artificial sequence
  Extension Primer
gggaattttttttaagacacaggtg

SEQ ID NO: 8593 - DNA, 22 bp, Artificial sequence
  Extension Primer
tgggttggggaggctcgagtgg

SEQ ID NO: 8594 - DNA, 25 bp, Artificial sequence
  Extension Primer
caaggaatgttgagaggagatacag

SEQ ID NO: 8595 - DNA, 25 bp, Artificial sequence
  Extension Primer
cgcccgcccgcccgtctgaccttgt

SEQ ID NO: 8596 - DNA, 25 bp, Artificial sequence
  Extension Primer
ttcaaaggtgatcttcagcataaaa

SEQ ID NO: 8597 - DNA, 25 bp, Artificial sequence
  Extension Primer
agtcttcttttgtgaacgtatcaga

SEQ ID NO: 8598 - DNA, 25 bp, Artificial sequence
  Extension Primer
gcagcggtctttccatttactgatc

SEQ ID NO: 8599 - DNA, 25 bp, Artificial sequence
  Extension Primer
tgtactatttttaaaagctctccag

SEQ ID NO: 8600 - DNA, 25 bp, Artificial sequence
  Extension Primer
tgcagagtgatccggagggcaaaag

SEQ ID NO: 8601 - DNA, 25 bp, Artificial sequence
  Extension Primer
tttaaacctaaagctcttgcacgct

SEQ ID NO: 8602 - DNA, 25 bp, Artificial sequence
  Extension Primer
ttcccctgatacctgagaaaagtga

SEQ ID NO: 8603 - DNA, 25 bp, Artificial sequence
  Extension Primer
tcaccctgctctgacaggtgggaaa

SEQ ID NO: 8604 - DNA, 25 bp, Artificial sequence
  Extension Primer
cctgaatagcactagagttgaccct

SEQ ID NO: 8605 - DNA, 25 bp, Artificial sequence
  Extension Primer
acttttgacatccattagtctagat

SEQ ID NO: 8606 - DNA, 25 bp, Artificial sequence
  Extension Primer
gaaaggctttagtcccatcaggtga

SEQ ID NO: 8607 - DNA, 25 bp, Artificial sequence
  Extension Primer
ctccttatttatattaagactcagt

SEQ ID NO: 8608 - DNA, 25 bp, Artificial sequence
  Extension Primer
aaaacctcaagtcaagaaacattct

SEQ ID NO: 8609 - DNA, 25 bp, Artificial sequence
  Extension Primer
ttacactcttctagaatgttttaat

SEQ ID NO: 8610 - DNA, 25 bp, Artificial sequence
  Extension Primer
agatcatatggtaacagtggtgctt

SEQ ID NO: 8611 - DNA, 25 bp, Artificial sequence
  Extension Primer
tggtcagtgcagcatgggtgatggg

SEQ ID NO: 8612 - DNA, 25 bp, Artificial sequence
  Extension Primer
agggagactaactaaccttggagtc

SEQ ID NO: 8613 - DNA, 25 bp, Artificial sequence
  Extension Primer
gaaatgaatttgaaagcctctggtt

SEQ ID NO: 8614 - DNA, 25 bp, Artificial sequence
  Extension Primer
caaacggaagttaggaccattttca

SEQ ID NO: 8615 - DNA, 25 bp, Artificial sequence
  Extension Primer
cagataggatgtgaaggacgctgga

SEQ ID NO: 8616 - DNA, 25 bp, Artificial sequence
  Extension Primer
taaagtggggaagttcatagtttca

SEQ ID NO: 8617 - DNA, 25 bp, Artificial sequence
  Extension Primer
gtgtcattccaaaatctatttctcc

SEQ ID NO: 8618 - DNA, 25 bp, Artificial sequence
  Extension Primer
aagaggctgaaagtgtattgaggag

SEQ ID NO: 8619 - DNA, 25 bp, Artificial sequence
  Extension Primer
acatagaatgttaacaagctcctga

SEQ ID NO: 8620 - DNA, 25 bp, Artificial sequence
  Extension Primer
actgcacagtggtgagtctcagccc

SEQ ID NO: 8621 - DNA, 25 bp, Artificial sequence
  Extension Primer
ctttgaactgagactaagatttgct

SEQ ID NO: 8622 - DNA, 25 bp, Artificial sequence
  Extension Primer
gtgtaaggctcagtctctctcaccc

SEQ ID NO: 8623 - DNA, 25 bp, Artificial sequence
  Extension Primer
tctttttggctaccctggctcttct

SEQ ID NO: 8624 - DNA, 25 bp, Artificial sequence
  Extension Primer
gtaattggaaatgagcgctttgttg

SEQ ID NO: 8625 - DNA, 25 bp, Artificial sequence
  Extension Primer
gtaaatgcagtggttctggccctat

SEQ ID NO: 8626 - DNA, 25 bp, Artificial sequence
  Extension Primer
atattatgtacatgtgcaagtgttc

SEQ ID NO: 8627 - DNA, 25 bp, Artificial sequence
  Extension Primer
aacctggaaagggaaatcagcaaca

SEQ ID NO: 8628 - DNA, 25 bp, Artificial sequence
  Extension Primer
aggagaaagggaaccaaagacagaa

SEQ ID NO: 8629 - DNA, 25 bp, Artificial sequence
  Extension Primer
cctgctgttcactaacttaacttac

SEQ ID NO: 8630 - DNA, 25 bp, Artificial sequence
  Extension Primer
gggaggagtatattggagccacata

SEQ ID NO: 8631 - DNA, 25 bp, Artificial sequence
  Extension Primer
gtggaattgggagatgttgtttgct

SEQ ID NO: 8632 - DNA, 25 bp, Artificial sequence
  Extension Primer
taaagaagtctcatgtacccttcac

SEQ ID NO: 8633 - DNA, 25 bp, Artificial sequence
  Extension Primer
ctggggaaacagacaaatgcaaaac

SEQ ID NO: 8634 - DNA, 25 bp, Artificial sequence
  Extension Primer
atcaattcacaagggcttcccaggc

SEQ ID NO: 8635 - DNA, 25 bp, Artificial sequence
  Extension Primer
tttcacttccttgaacatctggact

SEQ ID NO: 8636 - DNA, 25 bp, Artificial sequence
  Extension Primer
cagtctagcttgatcaggaacacaa

SEQ ID NO: 8637 - DNA, 25 bp, Artificial sequence
  Extension Primer
gtcaggtttttattcactcctgttt

SEQ ID NO: 8638 - DNA, 25 bp, Artificial sequence
  Extension Primer
ataaaaccctgagctttatattcaa

SEQ ID NO: 8639 - DNA, 25 bp, Artificial sequence
  Extension Primer
tctctaggtctgcaaccatggtgcc

SEQ ID NO: 8640 - DNA, 25 bp, Artificial sequence
  Extension Primer
tgcctcccattggcccaatgtttaa

SEQ ID NO: 8641 - DNA, 25 bp, Artificial sequence
  Extension Primer
gactacctcaatattttgaaatacc

SEQ ID NO: 8642 - DNA, 25 bp, Artificial sequence
  Extension Primer
tattcaagccatctaacaaatctta

SEQ ID NO: 8643 - DNA, 25 bp, Artificial sequence
  Extension Primer
gggcaacctgcaaagagaagaggga

SEQ ID NO: 8644 - DNA, 25 bp, Artificial sequence
  Extension Primer
tgtggtgtggggaagggttcagagc

SEQ ID NO: 8645 - DNA, 25 bp, Artificial sequence
  Extension Primer
ccagtaggacaccattaccaaaaga

SEQ ID NO: 8646 - DNA, 25 bp, Artificial sequence
  Extension Primer
aaacctagataattgaagtgactca

SEQ ID NO: 8647 - DNA, 25 bp, Artificial sequence
  Extension Primer
gctagatgggaaagctcatatgttg

SEQ ID NO: 8648 - DNA, 25 bp, Artificial sequence
  Extension Primer
tgccctggcttctttccccttatcc

SEQ ID NO: 8649 - DNA, 25 bp, Artificial sequence
  Extension Primer
ctgatgttggtcaggtgatgttagc

SEQ ID NO: 8650 - DNA, 25 bp, Artificial sequence
  Extension Primer
aatgcaacagactgtggctaaatct

SEQ ID NO: 8651 - DNA, 25 bp, Artificial sequence
  Extension Primer
ccatctggtatgtgcccgtccccac

SEQ ID NO: 8652 - DNA, 25 bp, Artificial sequence
  Extension Primer
ttaaaaaaaaaaaaaaaaaaaacta

SEQ ID NO: 8653 - DNA, 25 bp, Artificial sequence
  Extension Primer
tgctgcccggcgcctggatcccaaa

SEQ ID NO: 8654 - DNA, 25 bp, Artificial sequence
  Extension Primer
cgtgacattaaagtcagtaaattcc

SEQ ID NO: 8655 - DNA, 25 bp, Artificial sequence
  Extension Primer
aggagggccagagcccaggtcagaa

SEQ ID NO: 8656 - DNA, 25 bp, Artificial sequence
  Extension Primer
cagggcccagggggcgagcccagaa

SEQ ID NO: 8657 - DNA, 25 bp, Artificial sequence
  Extension Primer
tgaagacaaatgtacataagacaaa

SEQ ID NO: 8658 - DNA, 25 bp, Artificial sequence
  Extension Primer
tcgagctgcacagggaaggtctcaa

SEQ ID NO: 8659 - DNA, 25 bp, Artificial sequence
  Extension Primer
cagggtgtaaagctcttaaaaaaaa

SEQ ID NO: 8660 - DNA, 25 bp, Artificial sequence
  Extension Primer
aggccttcccacaggaattgcattc

SEQ ID NO: 8661 - DNA, 25 bp, Artificial sequence
  Extension Primer
ctgagcctctggcatattccaccta

SEQ ID NO: 8662 - DNA, 25 bp, Artificial sequence
  Extension Primer
aaccattgcatagacagcagtaata

SEQ ID NO: 8663 - DNA, 25 bp, Artificial sequence
  Extension Primer
gcctctgcttgacacctgtttcccc

SEQ ID NO: 8664 - DNA, 25 bp, Artificial sequence
  Extension Primer
acacagagcactgtgcaacatccta

SEQ ID NO: 8665 - DNA, 25 bp, Artificial sequence
  Extension Primer
atctaatgtgattttatgtcctact

SEQ ID NO: 8666 - DNA, 25 bp, Artificial sequence
  Extension Primer
gagagcagagctctgcctcctgatt

SEQ ID NO: 8667 - DNA, 25 bp, Artificial sequence
  Extension Primer
ggaggtcacagaaaaaaatgattaa

SEQ ID NO: 8668 - DNA, 25 bp, Artificial sequence
  Extension Primer
atcacattctgcaaattaaatttca

SEQ ID NO: 8669 - DNA, 25 bp, Artificial sequence
  Extension Primer
atcatcacgcagaaacttataagga

SEQ ID NO: 8670 - DNA, 25 bp, Artificial sequence
  Extension Primer
acaatcactgtacactgaaaaatat

SEQ ID NO: 8671 - DNA, 25 bp, Artificial sequence
  Extension Primer
agggacctaactatcaccaaaagca

SEQ ID NO: 8672 - DNA, 25 bp, Artificial sequence
  Extension Primer
tgaaagtagaaattttagaacaaaa

SEQ ID NO: 8673 - DNA, 25 bp, Artificial sequence
  Extension Primer
ccttaatcctacccttccttcctcc

SEQ ID NO: 8674 - DNA, 25 bp, Artificial sequence
  Extension Primer
aatcattcctttgcttctctctatg

SEQ ID NO: 8675 - DNA, 25 bp, Artificial sequence
  Extension Primer
ccaggagctgggtggctttcgccgc

SEQ ID NO: 8676 - DNA, 22 bp, Artificial sequence
  Extension Primer
aagctgggaatctagtaaacag

SEQ ID NO: 8677 - DNA, 25 bp, Artificial sequence
  Extension Primer
cacaaagccaataaaactagggcaa

SEQ ID NO: 8678 - DNA, 25 bp, Artificial sequence
  Extension Primer
tcaatactcaatatactcaataaac

SEQ ID NO: 8679 - DNA, 25 bp, Artificial sequence
  Extension Primer
taaaaaaaaagaaagccaaatctta

SEQ ID NO: 8680 - DNA, 25 bp, Artificial sequence
  Extension Primer
aaatttgatgtataatcaagaataa

SEQ ID NO: 8681 - DNA, 25 bp, Artificial sequence
  Extension Primer
attaataatttaacrataagaaaag

SEQ ID NO: 8682 - DNA, 25 bp, Artificial sequence
  Extension Primer
tctgccactaattctctgtgtgaca

SEQ ID NO: 8683 - DNA, 25 bp, Artificial sequence
  Extension Primer
attacaaacttcatcttagaattta

SEQ ID NO: 8684 - DNA, 25 bp, Artificial sequence
  Extension Primer
ttcatgaggcagggaacggttttgt

SEQ ID NO: 8685 - DNA, 25 bp, Artificial sequence
  Extension Primer
tttttaaagkattcataaaataggs

SEQ ID NO: 8686 - DNA, 25 bp, Artificial sequence
  Extension Primer
acaagcatctggactatctgcctta

SEQ ID NO: 8687 - DNA, 25 bp, Artificial sequence
  Extension Primer
aggactaagcaggggcagatgaggt

SEQ ID NO: 8688 - DNA, 25 bp, Artificial sequence
  Extension Primer
caaaaagggatcattatgaacaaat

SEQ ID NO: 8689 - DNA, 25 bp, Artificial sequence
  Extension Primer
gcccacatgccagaaagcactctaa

SEQ ID NO: 8690 - DNA, 25 bp, Artificial sequence
  Extension Primer
aaagaaggtgaataagccctcagta

SEQ ID NO: 8691 - DNA, 25 bp, Artificial sequence
  Extension Primer
agatcaagaggaagaagagcatcta

SEQ ID NO: 8692 - DNA, 25 bp, Artificial sequence
  Extension Primer
aaatgctttgtgtgaaaataagaaa

SEQ ID NO: 8693 - DNA, 25 bp, Artificial sequence
  Extension Primer
ctcttcaaaatgatggtgtttattt

SEQ ID NO: 8694 - DNA, 25 bp, Artificial sequence
  Extension Primer
tccccaacctttttggcaccaagga

SEQ ID NO: 8695 - DNA, 25 bp, Artificial sequence
  Extension Primer
agatcatactagtccctactcctag

SEQ ID NO: 8696 - DNA, 25 bp, Artificial sequence
  Extension Primer
aatggaaactgtgattcacaagaga

SEQ ID NO: 8697 - DNA, 25 bp, Artificial sequence
  Extension Primer
cttcttcarttgcatcaggcctcca

SEQ ID NO: 8698 - DNA, 25 bp, Artificial sequence
  Extension Primer
gatggtatccctgagccatgtctaa

SEQ ID NO: 8699 - DNA, 25 bp, Artificial sequence
  Extension Primer
caagggaacagtacaagtattttga

SEQ ID NO: 8700 - DNA, 25 bp, Artificial sequence
  Extension Primer
cagtgatgattccactgattctcat

SEQ ID NO: 8701 - DNA, 25 bp, Artificial sequence
  Extension Primer
attgaaatagggaaatgacaaaagt

SEQ ID NO: 8702 - DNA, 25 bp, Artificial sequence
  Extension Primer
gggaagcgccatyggaagaaccact

SEQ ID NO: 8703 - DNA, 25 bp, Artificial sequence
  Extension Primer
gagtgacggaaattcagtgtacttt

SEQ ID NO: 8704 - DNA, 25 bp, Artificial sequence
  Extension Primer
tccaaattccatttggcaaagaata

SEQ ID NO: 8705 - DNA, 25 bp, Artificial sequence
  Extension Primer
atcctgcttgcaggccgtgagcttt

SEQ ID NO: 8706 - DNA, 25 bp, Artificial sequence
  Extension Primer
cgctgtcagtctcctgtctgccgag

SEQ ID NO: 8707 - DNA, 25 bp, Artificial sequence
  Extension Primer
ctctcaagagtcttttctagcacca

SEQ ID NO: 8708 - DNA, 25 bp, Artificial sequence
  Extension Primer
ctcgctccccgaccaattttctgaa

SEQ ID NO: 8709 - DNA, 25 bp, Artificial sequence
  Extension Primer
gtrtctgctgaaaacagcccccgac

SEQ ID NO: 8710 - DNA, 25 bp, Artificial sequence
  Extension Primer
ttttagatacttggggagccccgag

SEQ ID NO: 8711 - DNA, 25 bp, Artificial sequence
  Extension Primer
tttgctagatgccatagtgctggag

SEQ ID NO: 8712 - DNA, 25 bp, Artificial sequence
  Extension Primer
ggcttgaagaactgtattttgtcct

SEQ ID NO: 8713 - DNA, 25 bp, Artificial sequence
  Extension Primer
cacttatttatgtttcttccactgc

SEQ ID NO: 8714 - DNA, 25 bp, Artificial sequence
  Extension Primer
ggagcatgaatgsctccaaccaact

SEQ ID NO: 8715 - DNA, 25 bp, Artificial sequence
  Extension Primer
ctcactctyaactttgcacatttag

SEQ ID NO: 8716 - DNA, 25 bp, Artificial sequence
  Extension Primer
acaggattgaaaaggaacttagcac

SEQ ID NO: 8717 - DNA, 25 bp, Artificial sequence
  Extension Primer
tcttatcctgaattaagcattcctg

SEQ ID NO: 8718 - DNA, 25 bp, Artificial sequence
  Extension Primer
tcagttgtttccttcccattgacta

SEQ ID NO: 8719 - DNA, 25 bp, Artificial sequence
  Extension Primer
gttttattaacatctcctcattata

SEQ ID NO: 8720 - DNA, 25 bp, Artificial sequence
  Extension Primer
gaccatctgygttgtgctggggata

SEQ ID NO: 8721 - DNA, 25 bp, Artificial sequence
  Extension Primer
atggtagttttaaagaggggggcag

SEQ ID NO: 8722 - DNA, 25 bp, Artificial sequence
  Extension Primer
aggcagaatggtacagcctgtatac

SEQ ID NO: 8723 - DNA, 25 bp, Artificial sequence
  Extension Primer
tagattcctgcttcacaaactacca

SEQ ID NO: 8724 - DNA, 25 bp, Artificial sequence
  Extension Primer
ctctgacctcaactgtccaaataca

SEQ ID NO: 8725 - DNA, 25 bp, Artificial sequence
  Extension Primer
aatggttgatttcattaatattcag

SEQ ID NO: 8726 - DNA, 25 bp, Artificial sequence
  Extension Primer
gatcaacattaattgtggcaaaact

SEQ ID NO: 8727 - DNA, 25 bp, Artificial sequence
  Extension Primer
tcagcagccgctcctacaaacagtt

SEQ ID NO: 8728 - DNA, 25 bp, Artificial sequence
  Extension Primer
tacaaacagttmcttattgcatgga

SEQ ID NO: 8729 - DNA, 25 bp, Artificial sequence
  Extension Primer
gggaccgacatttcataatcaccac

SEQ ID NO: 8730 - DNA, 25 bp, Artificial sequence
  Extension Primer
actgccagttaacatgcatttcact

SEQ ID NO: 8731 - DNA, 25 bp, Artificial sequence
  Extension Primer
tcattcacactgacaattctgaaaa

SEQ ID NO: 8732 - DNA, 25 bp, Artificial sequence
  Extension Primer
ctgttccattcttgattcctgccca

SEQ ID NO: 8733 - DNA, 25 bp, Artificial sequence
  Extension Primer
ttgtcttcagaggctgagagcagac

SEQ ID NO: 8734 - DNA, 25 bp, Artificial sequence
  Extension Primer
aacacgttgatattttgattttgaa

SEQ ID NO: 8735 - DNA, 25 bp, Artificial sequence
  Extension Primer
actttacacactcaaataaacatgc

SEQ ID NO: 8736 - DNA, 25 bp, Artificial sequence
  Extension Primer
tagctagacactataakacacatgc

SEQ ID NO: 8737 - DNA, 25 bp, Artificial sequence
  Extension Primer
aaaaggtctgggatagagatgggca

SEQ ID NO: 8738 - DNA, 25 bp, Artificial sequence
  Extension Primer
tagtacaaggaaaggttgaaaataa

SEQ ID NO: 8739 - DNA, 25 bp, Artificial sequence
  Extension Primer
atggagccaagggacttcctgtttt

SEQ ID NO: 8740 - DNA, 25 bp, Artificial sequence
  Extension Primer
tgcctggaaaacctccttcttgaga

SEQ ID NO: 8741 - DNA, 25 bp, Artificial sequence
  Extension Primer
actgccttgaatgatatattgacac

SEQ ID NO: 8742 - DNA, 25 bp, Artificial sequence
  Extension Primer
gggcaggaagtcaataaagggtatg

SEQ ID NO: 8743 - DNA, 25 bp, Artificial sequence
  Extension Primer
atccagcattcaccctggacaggaa

SEQ ID NO: 8744 - DNA, 25 bp, Artificial sequence
  Extension Primer
tgatcaggccaacctgtgttcaaat

SEQ ID NO: 8745 - DNA, 25 bp, Artificial sequence
  Extension Primer
ctgtcctaaagaagggtaagagtaa

SEQ ID NO: 8746 - DNA, 25 bp, Artificial sequence
  Extension Primer
gcgttggggtaaactgcttgarcct

SEQ ID NO: 8747 - DNA, 25 bp, Artificial sequence
  Extension Primer
cagtgtaggaagagctgtattttag

SEQ ID NO: 8748 - DNA, 25 bp, Artificial sequence
  Extension Primer
ctggcttagtgaaagtttaaagatt

SEQ ID NO: 8749 - DNA, 25 bp, Artificial sequence
  Extension Primer
caacccaaggtggctccagcacatc

SEQ ID NO: 8750 - DNA, 25 bp, Artificial sequence
  Extension Primer
aggcaaagccataatttcctgttca

SEQ ID NO: 8751 - DNA, 25 bp, Artificial sequence
  Extension Primer
aagtmcatacaaataatggaattgt

SEQ ID NO: 8752 - DNA, 25 bp, Artificial sequence
  Extension Primer
agtgctccttctcatttatttcctt

SEQ ID NO: 8753 - DNA, 25 bp, Artificial sequence
  Extension Primer
ggaggccttgccccaaattgaccac

SEQ ID NO: 8754 - DNA, 25 bp, Artificial sequence
  Extension Primer
cttccctttcagtttaatcctacag

SEQ ID NO: 8755 - DNA, 25 bp, Artificial sequence
  Extension Primer
cagagaatccaaacactatccccct

SEQ ID NO: 8756 - DNA, 25 bp, Artificial sequence
  Extension Primer
tgtgagagtcaagttctgaccagta

SEQ ID NO: 8757 - DNA, 25 bp, Artificial sequence
  Extension Primer
gaaacctatgatcatcaaaacctga

SEQ ID NO: 8758 - DNA, 25 bp, Artificial sequence
  Extension Primer
agaaatcttcaggtctgtgtgaatt

SEQ ID NO: 8759 - DNA, 25 bp, Artificial sequence
  Extension Primer
tactgagtctagatgaatttgaaga

SEQ ID NO: 8760 - DNA, 25 bp, Artificial sequence
  Extension Primer
ttatatcgcaaagtgggaagactga

SEQ ID NO: 8761 - DNA, 22 bp, Artificial sequence
  Extension Primer
tctgcatttcttacgtctgagt

SEQ ID NO: 8762 - DNA, 25 bp, Artificial sequence
  Extension Primer
gactgatgaatttcaaagcccctaa

SEQ ID NO: 8763 - DNA, 25 bp, Artificial sequence
  Extension Primer
aactgcttaaggctgccaaggacag

SEQ ID NO: 8764 - DNA, 25 bp, Artificial sequence
  Extension Primer
gacagggctggaggcaaaggaatgt

SEQ ID NO: 8765 - DNA, 25 bp, Artificial sequence
  Extension Primer
ttaaaaatatttgatccactatggt

SEQ ID NO: 8766 - DNA, 25 bp, Artificial sequence
  Extension Primer
tacagatacccaggaagtgagtggc

SEQ ID NO: 8767 - DNA, 25 bp, Artificial sequence
  Extension Primer
gcatccccaggtagtaagtggcccc

SEQ ID NO: 8768 - DNA, 25 bp, Artificial sequence
  Extension Primer
catgactgaagcgacttagcatgca

SEQ ID NO: 8769 - DNA, 25 bp, Artificial sequence
  Extension Primer
aagyaaccgaagtaaaatcycagga

SEQ ID NO: 8770 - DNA, 25 bp, Artificial sequence
  Extension Primer
gaccaaactactaaaagtttggggc

SEQ ID NO: 8771 - DNA, 25 bp, Artificial sequence
  Extension Primer
atggataygcacaattgacaattta

SEQ ID NO: 8772 - DNA, 25 bp, Artificial sequence
  Extension Primer
gtttttactgctatactgttgtcct

SEQ ID NO: 8773 - DNA, 25 bp, Artificial sequence
  Extension Primer
tcctgtccatgggattctccaggta

SEQ ID NO: 8774 - DNA, 25 bp, Artificial sequence
  Extension Primer
ccaagttcttatcattcttctgatg

SEQ ID NO: 8775 - DNA, 25 bp, Artificial sequence
  Extension Primer
attgggcctgcatattatgagattg

SEQ ID NO: 8776 - DNA, 25 bp, Artificial sequence
  Extension Primer
tcccggataggactggaagttcctc

SEQ ID NO: 8777 - DNA, 25 bp, Artificial sequence
  Extension Primer
aaatagacaaagcaagtcacaaggc

SEQ ID NO: 8778 - DNA, 25 bp, Artificial sequence
  Extension Primer
ttagctcagttcaaacatcagtcag

SEQ ID NO: 8779 - DNA, 25 bp, Artificial sequence
  Extension Primer
attctcagtgaaaatgtgttgctga

SEQ ID NO: 8780 - DNA, 25 bp, Artificial sequence
  Extension Primer
aattcatttgccatagccaccttcc

SEQ ID NO: 8781 - DNA, 25 bp, Artificial sequence
  Extension Primer
tttgaggacacatttgaaaaaaggg

SEQ ID NO: 8782 - DNA, 25 bp, Artificial sequence
  Extension Primer
atacaaattctaatgtagaaacata

SEQ ID NO: 8783 - DNA, 25 bp, Artificial sequence
  Extension Primer
cggtacttaatcactgtggaaagaa

SEQ ID NO: 8784 - DNA, 25 bp, Artificial sequence
  Extension Primer
gcttattaaatgcaggttctaattc

SEQ ID NO: 8785 - DNA, 25 bp, Artificial sequence
  Extension Primer
ccagaggctcatgccacagttgcta

SEQ ID NO: 8786 - DNA, 25 bp, Artificial sequence
  Extension Primer
aactgccttgtcagttagttaccat

SEQ ID NO: 8787 - DNA, 25 bp, Artificial sequence
  Extension Primer
ggataccctttccatgggctcttcc

SEQ ID NO: 8788 - DNA, 25 bp, Artificial sequence
  Extension Primer
gtcctatgttttgagagccatccta

SEQ ID NO: 8789 - DNA, 25 bp, Artificial sequence
  Extension Primer
atcctgaagttattttccagcagag

SEQ ID NO: 8790 - DNA, 25 bp, Artificial sequence
  Extension Primer
caccatagagccgctggtctcccac

SEQ ID NO: 8791 - DNA, 25 bp, Artificial sequence
  Extension Primer
cttcttaaggtcttttytcttcatt

SEQ ID NO: 8792 - DNA, 25 bp, Artificial sequence
  Extension Primer
taaggcatgaatggtagagagaagg

SEQ ID NO: 8793 - DNA, 25 bp, Artificial sequence
  Extension Primer
taatcctcctgctaatgcaaagacc

SEQ ID NO: 8794 - DNA, 25 bp, Artificial sequence
  Extension Primer
gctgattctcctgcaaggtcttccc

SEQ ID NO: 8795 - DNA, 25 bp, Artificial sequence
  Extension Primer
aggccctaccccaaactaaacattg

SEQ ID NO: 8796 - DNA, 25 bp, Artificial sequence
  Extension Primer
atagtttggtgtatcaggggagaac

SEQ ID NO: 8797 - DNA, 25 bp, Artificial sequence
  Extension Primer
ttgacagaaatgggactactgggct

SEQ ID NO: 8798 - DNA, 25 bp, Artificial sequence
  Extension Primer
acttttaagtaaccttaaactaata

SEQ ID NO: 8799 - DNA, 25 bp, Artificial sequence
  Extension Primer
accccaggggcacgtctaatatctg

SEQ ID NO: 8800 - DNA, 25 bp, Artificial sequence
  Extension Primer
tcctctagctatttcctttatagtg

SEQ ID NO: 8801 - DNA, 25 bp, Artificial sequence
  Extension Primer
tratgctgtaaaaactgtggtctaa

SEQ ID NO: 8802 - DNA, 25 bp, Artificial sequence
  Extension Primer
gtctactatgtgatttgcaagaatt

SEQ ID NO: 8803 - DNA, 25 bp, Artificial sequence
  Extension Primer
gcctattcagtgttgtttcctttaa

SEQ ID NO: 8804 - DNA, 25 bp, Artificial sequence
  Extension Primer
gctaggccaagagaaaacagccaag

SEQ ID NO: 8805 - DNA, 25 bp, Artificial sequence
  Extension Primer
cttatgactgtgggcagaactcttt

SEQ ID NO: 8806 - DNA, 25 bp, Artificial sequence
  Extension Primer
ttacagatgggagctcattgatagc

SEQ ID NO: 8807 - DNA, 25 bp, Artificial sequence
  Extension Primer
tcatgcatgtaagaagaaacaccaa

SEQ ID NO: 8808 - DNA, 25 bp, Artificial sequence
  Extension Primer
accacacacaaaaagaagaaactct

SEQ ID NO: 8809 - DNA, 25 bp, Artificial sequence
  Extension Primer
tggtgctcatgttccgtggatcttt

SEQ ID NO: 8810 - DNA, 25 bp, Artificial sequence
  Extension Primer
ttgtgatcttaaggtggacatatat

SEQ ID NO: 8811 - DNA, 25 bp, Artificial sequence
  Extension Primer
aagcatctatatgtgcaggactcat

SEQ ID NO: 8812 - DNA, 25 bp, Artificial sequence
  Extension Primer
ggtcttaaaamaattatgaaaaaaa

SEQ ID NO: 8813 - DNA, 25 bp, Artificial sequence
  Extension Primer
tatggaataattcagatatttttct

SEQ ID NO: 8814 - DNA, 25 bp, Artificial sequence
  Extension Primer
taagccccacgtgtggtctttgctg

SEQ ID NO: 8815 - DNA, 25 bp, Artificial sequence
  Extension Primer
tgtgctgggggaacaattcaggcca

SEQ ID NO: 8816 - DNA, 25 bp, Artificial sequence
  Extension Primer
agcaaaaggcagctcaagatgtcac

SEQ ID NO: 8817 - DNA, 25 bp, Artificial sequence
  Extension Primer
agggaagactctgaccgcccggaag

SEQ ID NO: 8818 - DNA, 25 bp, Artificial sequence
  Extension Primer
agcaagggagcaatcaggattcaag

SEQ ID NO: 8819 - DNA, 25 bp, Artificial sequence
  Extension Primer
acacaatgcccaggcactcatattg

SEQ ID NO: 8820 - DNA, 25 bp, Artificial sequence
  Extension Primer
tatctgtgtgaagatatatcctgag

SEQ ID NO: 8821 - DNA, 25 bp, Artificial sequence
  Extension Primer
ctggggagaaaggcagtaatagacc

SEQ ID NO: 8822 - DNA, 25 bp, Artificial sequence
  Extension Primer
aatgaaaaggggtcagggaaaagag

SEQ ID NO: 8823 - DNA, 25 bp, Artificial sequence
  Extension Primer
cccaggggttgctccctggaataag

SEQ ID NO: 8824 - DNA, 25 bp, Artificial sequence
  Extension Primer
aaagaaaaaaacacgatttctgagc

SEQ ID NO: 8825 - DNA, 25 bp, Artificial sequence
  Extension Primer
gtcagggaaaagagkgttgcagatt

SEQ ID NO: 8826 - DNA, 25 bp, Artificial sequence
  Extension Primer
ttggtgttgaaataaagagaacatt

SEQ ID NO: 8827 - DNA, 25 bp, Artificial sequence
  Extension Primer
tgccatgcctctagtctggcayttt

SEQ ID NO: 8828 - DNA, 25 bp, Artificial sequence
  Extension Primer
cctgagcactttcttgtctctgggc

SEQ ID NO: 8829 - DNA, 25 bp, Artificial sequence
  Extension Primer
caatcacttgggcctttcaagatga

SEQ ID NO: 8830 - DNA, 25 bp, Artificial sequence
  Extension Primer
atggtgagtgggcgttcggggtgct

SEQ ID NO: 8831 - DNA, 25 bp, Artificial sequence
  Extension Primer
tccwtaccccttcctcaccctttac

SEQ ID NO: 8832 - DNA, 25 bp, Artificial sequence
  Extension Primer
actggactagccactgtcagcagac

SEQ ID NO: 8833 - DNA, 25 bp, Artificial sequence
  Extension Primer
gatctcatttgctgtatgtgggatt

SEQ ID NO: 8834 - DNA, 25 bp, Artificial sequence
  Extension Primer
acccccggggctgtcaaaagggcac

SEQ ID NO: 8835 - DNA, 25 bp, Artificial sequence
  Extension Primer
tattagactaaggaggcaaagctga

SEQ ID NO: 8836 - DNA, 25 bp, Artificial sequence
  Extension Primer
tagaaagaaatatgtgacaccagat

SEQ ID NO: 8837 - DNA, 25 bp, Artificial sequence
  Extension Primer
taggtaaatccttttgtgacccaca

SEQ ID NO: 8838 - DNA, 25 bp, Artificial sequence
  Extension Primer
gagggacagtggacctgttscggat

SEQ ID NO: 8839 - DNA, 25 bp, Artificial sequence
  Extension Primer
ctccctcacgtgcttcctatgcaga

SEQ ID NO: 8840 - DNA, 25 bp, Artificial sequence
  Extension Primer
aataaacacatttgttgtaaatgat

SEQ ID NO: 8841 - DNA, 25 bp, Artificial sequence
  Extension Primer
tgattaaacttctaaacattcagag

SEQ ID NO: 8842 - DNA, 25 bp, Artificial sequence
  Extension Primer
tatatcattttcagagttatggcta

SEQ ID NO: 8843 - DNA, 25 bp, Artificial sequence
  Extension Primer
ccctcctcatcctgctttccagtca

SEQ ID NO: 8844 - DNA, 25 bp, Artificial sequence
  Extension Primer
aatttagaatgctaatgagttaagt

SEQ ID NO: 8845 - DNA, 22 bp, Artificial sequence
  Extension Primer
ttttgtttttggtggtgacagt

SEQ ID NO: 8846 - DNA, 25 bp, Artificial sequence
  Extension Primer
gaaccaactgtactagcaaattatt

SEQ ID NO: 8847 - DNA, 25 bp, Artificial sequence
  Extension Primer
agagagagggagagagaaggaaggc

SEQ ID NO: 8848 - DNA, 25 bp, Artificial sequence
  Extension Primer
tgtgtcagttttgcttcgtatattt

SEQ ID NO: 8849 - DNA, 25 bp, Artificial sequence
  Extension Primer
ctgcaggtggattttttacctccca

SEQ ID NO: 8850 - DNA, 25 bp, Artificial sequence
  Extension Primer
gtttccacttttcgtttttcaagag

SEQ ID NO: 8851 - DNA, 25 bp, Artificial sequence
  Extension Primer
tgggtattagcttatgcgtgtcacc

SEQ ID NO: 8852 - DNA, 25 bp, Artificial sequence
  Extension Primer
taaaaacatctatttggaatgtagc

SEQ ID NO: 8853 - DNA, 22 bp, Artificial sequence
  Extension Primer
tgatgttcccagattgactcct

SEQ ID NO: 8854 - DNA, 25 bp, Artificial sequence
  Extension Primer
gattacttctctcacaatgttagac

SEQ ID NO: 8855 - DNA, 25 bp, Artificial sequence
  Extension Primer
cactctcattgttctaartagttaa

SEQ ID NO: 8856 - DNA, 25 bp, Artificial sequence
  Extension Primer
cgctcttcagcgcttcctgggtcct

SEQ ID NO: 8857 - DNA, 25 bp, Artificial sequence
  Extension Primer
tccttccctcacccctgaagtctag

SEQ ID NO: 8858 - DNA, 25 bp, Artificial sequence
  Extension Primer
cttgagcagttgtctcatatactca

SEQ ID NO: 8859 - DNA, 25 bp, Artificial sequence
  Extension Primer
cagtaatatttacaattccttctcc

SEQ ID NO: 8860 - DNA, 25 bp, Artificial sequence
  Extension Primer
caaccacggcacacgcgggcccagc

SEQ ID NO: 8861 - DNA, 25 bp, Artificial sequence
  Extension Primer
tcagcgytgtccagcaagttcccaa

SEQ ID NO: 8862 - DNA, 25 bp, Artificial sequence
  Extension Primer
caacacatatacatatgtataaaag

SEQ ID NO: 8863 - DNA, 25 bp, Artificial sequence
  Extension Primer
tgcagcatgaggagatgattctgtg

SEQ ID NO: 8864 - DNA, 25 bp, Artificial sequence
  Extension Primer
gctccagaaagccccctccatcctc

SEQ ID NO: 8865 - DNA, 25 bp, Artificial sequence
  Extension Primer
agcccagcaggagcccagcagaagc

SEQ ID NO: 8866 - DNA, 25 bp, Artificial sequence
  Extension Primer
attttatattttaagtgtacagttc

SEQ ID NO: 8867 - DNA, 25 bp, Artificial sequence
  Extension Primer
gtcaactggcttgccaggacaaaag

SEQ ID NO: 8868 - DNA, 25 bp, Artificial sequence
  Extension Primer
tgggagagatgaagcaagtatcaca

SEQ ID NO: 8869 - DNA, 25 bp, Artificial sequence
  Extension Primer
taaccgagttcctatgatgtactgg

SEQ ID NO: 8870 - DNA, 25 bp, Artificial sequence
  Extension Primer
acaaaatagatggtcaatagtaagc

SEQ ID NO: 8871 - DNA, 25 bp, Artificial sequence
  Extension Primer
tgaatgtaagcaataatacaggaag

SEQ ID NO: 8872 - DNA, 25 bp, Artificial sequence
  Extension Primer
ttcttgatagatttgtgcaaagcct

SEQ ID NO: 8873 - DNA, 25 bp, Artificial sequence
  Extension Primer
tatcaatatttatagaagactaaaa

SEQ ID NO: 8874 - DNA, 25 bp, Artificial sequence
  Extension Primer
atcccttgtgttagaagaacattct

SEQ ID NO: 8875 - DNA, 25 bp, Artificial sequence
  Extension Primer
tttytctaacaccattgtctctgag

SEQ ID NO: 8876 - DNA, 25 bp, Artificial sequence
  Extension Primer
gacgtactttgggagagacgtactt

SEQ ID NO: 8877 - DNA, 25 bp, Artificial sequence
  Extension Primer
acttaacctttcaagatttcagttt

SEQ ID NO: 8878 - DNA, 25 bp, Artificial sequence
  Extension Primer
aaaaattactttaaacgtggcaaag

SEQ ID NO: 8879 - DNA, 25 bp, Artificial sequence
  Extension Primer
ttctgcaaaaacatgtggtttattw

SEQ ID NO: 8880 - DNA, 25 bp, Artificial sequence
  Extension Primer
actcctatagctaaaaggagagtat

SEQ ID NO: 8881 - DNA, 25 bp, Artificial sequence
  Extension Primer
atagaaattctgtttagttttttgg

SEQ ID NO: 8882 - DNA, 25 bp, Artificial sequence
  Extension Primer
agatagtcacaaatgcctccaccgc

SEQ ID NO: 8883 - DNA, 25 bp, Artificial sequence
  Extension Primer
tggggggaaaaaaccctacatgaaa

SEQ ID NO: 8884 - DNA, 25 bp, Artificial sequence
  Extension Primer
cattatcaaaaccaaggtgctattt

SEQ ID NO: 8885 - DNA, 25 bp, Artificial sequence
  Extension Primer
gaaagtgaaaggagaagtgagagtg

SEQ ID NO: 8886 - DNA, 25 bp, Artificial sequence
  Extension Primer
ttagtctccattgtagctgtgaaga

SEQ ID NO: 8887 - DNA, 25 bp, Artificial sequence
  Extension Primer
gaattcaaacagacyyaagcaggca

SEQ ID NO: 8888 - DNA, 25 bp, Artificial sequence
  Extension Primer
tgaaaataagaaaygatgcccaact

SEQ ID NO: 8889 - DNA, 22 bp, Artificial sequence
  Extension Primer
caggaccaggaactgagagaga

SEQ ID NO: 8890 - DNA, 25 bp, Artificial sequence
  Extension Primer
aaaaaaaaaaaacctgttcccatga

SEQ ID NO: 8891 - DNA, 25 bp, Artificial sequence
  Extension Primer
aaactttactaaagtggaaaastgc

SEQ ID NO: 8892 - DNA, 25 bp, Artificial sequence
  Extension Primer
gagtgattaatcttatttcaaggta

SEQ ID NO: 8893 - DNA, 25 bp, Artificial sequence
  Extension Primer
acagatacagacacagggcctccac

SEQ ID NO: 8894 - DNA, 25 bp, Artificial sequence
  Extension Primer
tatgaggtcactcatgatttacaga

SEQ ID NO: 8895 - DNA, 25 bp, Artificial sequence
  Extension Primer
atggtaaatccaccaaacaattama

SEQ ID NO: 8896 - DNA, 25 bp, Artificial sequence
  Extension Primer
gccctgttccctaacacagtaagga

SEQ ID NO: 8897 - DNA, 25 bp, Artificial sequence
  Extension Primer
gaatrgaccttgttgacttatggag

SEQ ID NO: 8898 - DNA, 25 bp, Artificial sequence
  Extension Primer
attaccttcaggcccttaaataaga

SEQ ID NO: 8899 - DNA, 25 bp, Artificial sequence
  Extension Primer
aataatgttttaaagaaagaaaata

SEQ ID NO: 8900 - DNA, 25 bp, Artificial sequence
  Extension Primer
ccagtgacattgtaaattttaatct

SEQ ID NO: 8901 - DNA, 25 bp, Artificial sequence
  Extension Primer
attgttattagagacctagttaaag

SEQ ID NO: 8902 - DNA, 25 bp, Artificial sequence
  Extension Primer
atttaaaatattaggtgactagaca

SEQ ID NO: 8903 - DNA, 25 bp, Artificial sequence
  Extension Primer
gaagtacaggatgccatgtgttata

SEQ ID NO: 8904 - DNA, 25 bp, Artificial sequence
  Extension Primer
agacctgaacactccaaaggatata

SEQ ID NO: 8905 - DNA, 25 bp, Artificial sequence
  Extension Primer
aatttcggtagagaaaaggtgtgtc

SEQ ID NO: 8906 - DNA, 25 bp, Artificial sequence
  Extension Primer
ttacattttcagcagaaacacttaa

SEQ ID NO: 8907 - DNA, 25 bp, Artificial sequence
  Extension Primer
tatttccaataacagctctcatttt

SEQ ID NO: 8908 - DNA, 25 bp, Artificial sequence
  Extension Primer
agcagttctctctcagatgtgtctt

SEQ ID NO: 8909 - DNA, 25 bp, Artificial sequence
  Extension Primer
aacgccaatacactccctcttaaat

SEQ ID NO: 8910 - DNA, 25 bp, Artificial sequence
  Extension Primer
cctactcaaatctgcttttgaatcc

SEQ ID NO: 8911 - DNA, 25 bp, Artificial sequence
  Extension Primer
aactatccaattgtgacaacttgtt

SEQ ID NO: 8912 - DNA, 25 bp, Artificial sequence
  Extension Primer
gaagagtctgtttcaaattcaaatg

SEQ ID NO: 8913 - DNA, 25 bp, Artificial sequence
  Extension Primer
atgccagggcactggaaagttctaa

SEQ ID NO: 8914 - DNA, 25 bp, Artificial sequence
  Extension Primer
tttttgctttttcatactgttcatg

SEQ ID NO: 8915 - DNA, 25 bp, Artificial sequence
  Extension Primer
tgggtttattctacttggagtatac

SEQ ID NO: 8916 - DNA, 25 bp, Artificial sequence
  Extension Primer
gctatgctttatgaggaagatcaca

SEQ ID NO: 8917 - DNA, 25 bp, Artificial sequence
  Extension Primer
cgtcatgtaaactttatgaagaaat

SEQ ID NO: 8918 - DNA, 25 bp, Artificial sequence
  Extension Primer
ctgccctccctgggctctgggtttg

SEQ ID NO: 8919 - DNA, 25 bp, Artificial sequence
  Extension Primer
ttcatttccgtagattagtatgtcc

SEQ ID NO: 8920 - DNA, 25 bp, Artificial sequence
  Extension Primer
ctgcctacaagtgtcttttccaaca

SEQ ID NO: 8921 - DNA, 25 bp, Artificial sequence
  Extension Primer
actttagtgggtagaatcaccaaac

SEQ ID NO: 8922 - DNA, 22 bp, Artificial sequence
  Extension Primer
caataatgtatgggtcagctat

SEQ ID NO: 8923 - DNA, 25 bp, Artificial sequence
  Extension Primer
attttggctgaactcacattttttt

SEQ ID NO: 8924 - DNA, 25 bp, Artificial sequence
  Extension Primer
ttttcctttgacttttttagcgaac

SEQ ID NO: 8925 - DNA, 25 bp, Artificial sequence
  Extension Primer
tctctagcaccttctctagcataac

SEQ ID NO: 8926 - DNA, 25 bp, Artificial sequence
  Extension Primer
tcataaaagtttgtaagaaggaaaa

SEQ ID NO: 8927 - DNA, 25 bp, Artificial sequence
  Extension Primer
tgacgtctgcaaacaccagtgaata

SEQ ID NO: 8928 - DNA, 25 bp, Artificial sequence
  Extension Primer
gccctattctgcgggagacttgctc

SEQ ID NO: 8929 - DNA, 25 bp, Artificial sequence
  Extension Primer
tagaagataaaggcaaagaggactt

SEQ ID NO: 8930 - DNA, 25 bp, Artificial sequence
  Extension Primer
cttcccaaattaataaatagactct

SEQ ID NO: 8931 - DNA, 25 bp, Artificial sequence
  Extension Primer
aggagagataaggcttcacctgtga

SEQ ID NO: 8932 - DNA, 25 bp, Artificial sequence
  Extension Primer
gggtgtggtggctcttaacaggtca

SEQ ID NO: 8933 - DNA, 25 bp, Artificial sequence
  Extension Primer
tttattttagtactctactggcttc

SEQ ID NO: 8934 - DNA, 25 bp, Artificial sequence
  Extension Primer
cctcctctcccaccccccaggtttg

SEQ ID NO: 8935 - DNA, 25 bp, Artificial sequence
  Extension Primer
ggtttgctctggggccacagcctca

SEQ ID NO: 8936 - DNA, 25 bp, Artificial sequence
  Extension Primer
gtctgagggtctctgagtggacttt

SEQ ID NO: 8937 - DNA, 25 bp, Artificial sequence
  Extension Primer
atctcctgcattccactgcaaaacc

SEQ ID NO: 8938 - DNA, 25 bp, Artificial sequence
  Extension Primer
gattcgcttgaaaaccgacgcggag

SEQ ID NO: 8939 - DNA, 25 bp, Artificial sequence
  Extension Primer
ggtgaattttatgttatgcatatta

SEQ ID NO: 8940 - DNA, 25 bp, Artificial sequence
  Extension Primer
gaacttctatcttgaccacccctta

SEQ ID NO: 8941 - DNA, 25 bp, Artificial sequence
  Extension Primer
aacaacacaaaacataggctcttca

SEQ ID NO: 8942 - DNA, 25 bp, Artificial sequence
  Extension Primer
ttttcacctcatttagtaaccctcc

SEQ ID NO: 8943 - DNA, 25 bp, Artificial sequence
  Extension Primer
tatcaactcaaagaatgaaagagcc

SEQ ID NO: 8944 - DNA, 25 bp, Artificial sequence
  Extension Primer
tctcagagtgcagtgtttatatacc

SEQ ID NO: 8945 - DNA, 25 bp, Artificial sequence
  Extension Primer
gtatcaatatctttgaagcccaatg

SEQ ID NO: 8946 - DNA, 25 bp, Artificial sequence
  Extension Primer
agcccaagttccaaagtaaacgatt

SEQ ID NO: 8947 - DNA, 25 bp, Artificial sequence
  Extension Primer
ttttaatgatgctgctgtcataatg

SEQ ID NO: 8948 - DNA, 25 bp, Artificial sequence
  Extension Primer
acccccactcgggccagcagaagct

SEQ ID NO: 8949 - DNA, 25 bp, Artificial sequence
  Extension Primer
agaggtttataaatgtgctccctcc

SEQ ID NO: 8950 - DNA, 22 bp, Artificial sequence
  Extension Primer
gatgagaacatgcttttgctcc

SEQ ID NO: 8951 - DNA, 25 bp, Artificial sequence
  Extension Primer
gactgccactggggcactccggacc

SEQ ID NO: 8952 - DNA, 25 bp, Artificial sequence
  Extension Primer
gagaacctatctaatttgagcttca

SEQ ID NO: 8953 - DNA, 25 bp, Artificial sequence
  Extension Primer
ggtggctctagaaaaaaatcccttc

SEQ ID NO: 8954 - DNA, 25 bp, Artificial sequence
  Extension Primer
agagtcttgaggaaagtcttcattt

SEQ ID NO: 8955 - DNA, 25 bp, Artificial sequence
  Extension Primer
actgaaaggtgagagatgyygaggg

SEQ ID NO: 8956 - DNA, 25 bp, Artificial sequence
  Extension Primer
ccctctatccaaaacaatgtattca

SEQ ID NO: 8957 - DNA, 25 bp, Artificial sequence
  Extension Primer
ggcatctcatggctgagcacaaccc

SEQ ID NO: 8958 - DNA, 25 bp, Artificial sequence
  Extension Primer
aatgtaaaaggacaaagcgattctt

SEQ ID NO: 8959 - DNA, 25 bp, Artificial sequence
  Extension Primer
gtcacacacactcatgcgagaaaga

SEQ ID NO: 8960 - DNA, 25 bp, Artificial sequence
  Extension Primer
gtaaatgtggaaaagccttttccca

SEQ ID NO: 8961 - DNA, 25 bp, Artificial sequence
  Extension Primer
aggagcggagcacacatgcacagtg

SEQ ID NO: 8962 - DNA, 25 bp, Artificial sequence
  Extension Primer
acctttgttcacctaaataacagag

SEQ ID NO: 8963 - DNA, 25 bp, Artificial sequence
  Extension Primer
acagcccttccctgatcctctgcca

SEQ ID NO: 8964 - DNA, 22 bp, Artificial sequence
  Extension Primer
aaggtgcgtgcgccccgcgtgc

SEQ ID NO: 8965 - DNA, 25 bp, Artificial sequence
  Extension Primer
ggttgttgcctcacacactgcttca

SEQ ID NO: 8966 - DNA, 25 bp, Artificial sequence
  Extension Primer
acacraacagaattttatgcagata

SEQ ID NO: 8967 - DNA, 25 bp, Artificial sequence
  Extension Primer
ccatrtatctgcataaaattctgtt

SEQ ID NO: 8968 - DNA, 25 bp, Artificial sequence
  Extension Primer
atagcaggaaggaaaaagatgtgtg

SEQ ID NO: 8969 - DNA, 25 bp, Artificial sequence
  Extension Primer
acctgtaaaaattataggaaattca

SEQ ID NO: 8970 - DNA, 25 bp, Artificial sequence
  Extension Primer
ggataaacaacaaggtcctaccgta

SEQ ID NO: 8971 - DNA, 25 bp, Artificial sequence
  Extension Primer
tgatacctaggttaaatagtcagaa

SEQ ID NO: 8972 - DNA, 25 bp, Artificial sequence
  Extension Primer
ttgtcaattcctcccaaagagagtg

SEQ ID NO: 8973 - DNA, 25 bp, Artificial sequence
  Extension Primer
tctaagctgggatcccagttatgac

SEQ ID NO: 8974 - DNA, 25 bp, Artificial sequence
  Extension Primer
actctccaccgattcataaagctcc

SEQ ID NO: 8975 - DNA, 25 bp, Artificial sequence
  Extension Primer
taacaataatagtcatttctaaaat

SEQ ID NO: 8976 - DNA, 25 bp, Artificial sequence
  Extension Primer
aattgctttacaatactggtttgat

SEQ ID NO: 8977 - DNA, 25 bp, Artificial sequence
  Extension Primer
gtcctttccaacttggcagggtcca

SEQ ID NO: 8978 - DNA, 25 bp, Artificial sequence
  Extension Primer
tcataaattcagaattattttgatc

SEQ ID NO: 8979 - DNA, 25 bp, Artificial sequence
  Extension Primer
tccctgagagggaggtggggtcctc

SEQ ID NO: 8980 - DNA, 25 bp, Artificial sequence
  Extension Primer
gttagaatagttaagaaaactgaat

SEQ ID NO: 8981 - DNA, 25 bp, Artificial sequence
  Extension Primer
gtaagatttcacacatttaaaactg

SEQ ID NO: 8982 - DNA, 25 bp, Artificial sequence
  Extension Primer
acctcatgcatgtctccatcaacaa

SEQ ID NO: 8983 - DNA, 25 bp, Artificial sequence
  Extension Primer
gtctcattatcaggaaaatggactc

SEQ ID NO: 8984 - DNA, 22 bp, Artificial sequence
  Extension Primer
tcagggttagaagtctgaaact

SEQ ID NO: 8985 - DNA, 25 bp, Artificial sequence
  Extension Primer
aatctaattacaagagaacacattc

SEQ ID NO: 8986 - DNA, 25 bp, Artificial sequence
  Extension Primer
cctgcgtctgcagattgcggtgttc

SEQ ID NO: 8987 - DNA, 25 bp, Artificial sequence
  Extension Primer
atggactcrgggaggggtgagtgtg

SEQ ID NO: 8988 - DNA, 25 bp, Artificial sequence
  Extension Primer
gcctggggaagggacatgacactag

SEQ ID NO: 8989 - DNA, 25 bp, Artificial sequence
  Extension Primer
ccaagaaaaatgcagagaaacttta

SEQ ID NO: 8990 - DNA, 25 bp, Artificial sequence
  Extension Primer
ctgttttaccactgatgtgattttc

SEQ ID NO: 8991 - DNA, 25 bp, Artificial sequence
  Extension Primer
gaggacataaagatcctgggtgctg

SEQ ID NO: 8992 - DNA, 25 bp, Artificial sequence
  Extension Primer
gtaggagcgtgtacatgtattcata

SEQ ID NO: 8993 - DNA, 25 bp, Artificial sequence
  Extension Primer
aggtcttgttaaacacacagcagga

SEQ ID NO: 8994 - DNA, 25 bp, Artificial sequence
  Extension Primer
gccatggaccgctgatcctgctccg

SEQ ID NO: 8995 - DNA, 25 bp, Artificial sequence
  Extension Primer
aatacaatggactttattctagcag

SEQ ID NO: 8996 - DNA, 25 bp, Artificial sequence
  Extension Primer
ccaaacttgtgtggtccttagattc

SEQ ID NO: 8997 - DNA, 25 bp, Artificial sequence
  Extension Primer
atatagaaaatacactgatgcacta

SEQ ID NO: 8998 - DNA, 25 bp, Artificial sequence
  Extension Primer
gccaggcacacgacacagctctccc

SEQ ID NO: 8999 - DNA, 25 bp, Artificial sequence
  Extension Primer
ggactcrgggaggggtgagtgtgya

SEQ ID NO: 9000 - DNA, 25 bp, Artificial sequence
  Extension Primer
tcagttacatagaaaattattctct

SEQ ID NO: 9001 - DNA, 25 bp, Artificial sequence
  Extension Primer
gaacctcagtttcaccatctctgcg

SEQ ID NO: 9002 - DNA, 25 bp, Artificial sequence
  Extension Primer
gtttgatacggtgttaagaatgatg

SEQ ID NO: 9003 - DNA, 25 bp, Artificial sequence
  Extension Primer
gaatatccctatcatgtcatctgtc

SEQ ID NO: 9004 - DNA, 25 bp, Artificial sequence
  Extension Primer
actgatgtattattcatttgtaaag

SEQ ID NO: 9005 - DNA, 25 bp, Artificial sequence
  Extension Primer
caaaggcatataaaacattttagat

SEQ ID NO: 9006 - DNA, 25 bp, Artificial sequence
  Extension Primer
tgatgggtatgggaaagggaaaaay

SEQ ID NO: 9007 - DNA, 25 bp, Artificial sequence
  Extension Primer
ttcataactcctctgtcagacaaat

SEQ ID NO: 9008 - DNA, 25 bp, Artificial sequence
  Extension Primer
gcaacataattgtcctcatttcaca

SEQ ID NO: 9009 - DNA, 25 bp, Artificial sequence
  Extension Primer
taagaaattaggagataaaagtcta

SEQ ID NO: 9010 - DNA, 25 bp, Artificial sequence
  Extension Primer
tctggaagagacagacacagataaa

SEQ ID NO: 9011 - DNA, 25 bp, Artificial sequence
  Extension Primer
atcccgactctccatgttcacagca

SEQ ID NO: 9012 - DNA, 25 bp, Artificial sequence
  Extension Primer
tgcagtctgcatatacastcctgga

SEQ ID NO: 9013 - DNA, 25 bp, Artificial sequence
  Extension Primer
gtcttgacatctgctgacgggaggg

SEQ ID NO: 9014 - DNA, 25 bp, Artificial sequence
  Extension Primer
gggggctctgcagccagcccaccca

SEQ ID NO: 9015 - DNA, 25 bp, Artificial sequence
  Extension Primer
tatagtttgtactattcctatttaa

SEQ ID NO: 9016 - DNA, 25 bp, Artificial sequence
  Extension Primer
gagatgtaattgaaaacacccaagg

SEQ ID NO: 9017 - DNA, 25 bp, Artificial sequence
  Extension Primer
agtggctgggcaatcagagctcggc

SEQ ID NO: 9018 - DNA, 25 bp, Artificial sequence
  Extension Primer
tttttttttagctctaatattacac

SEQ ID NO: 9019 - DNA, 25 bp, Artificial sequence
  Extension Primer
acttggcatacgccaagcgaaagaa

SEQ ID NO: 9020 - DNA, 25 bp, Artificial sequence
  Extension Primer
agaatagaagaaagcatgtcattca

SEQ ID NO: 9021 - DNA, 25 bp, Artificial sequence
  Extension Primer
ttgacaaggactaaattaaacacga

SEQ ID NO: 9022 - DNA, 25 bp, Artificial sequence
  Extension Primer
aytrtgttattttcccaaattttat

SEQ ID NO: 9023 - DNA, 25 bp, Artificial sequence
  Extension Primer
atctaaattaaggttgctgggctgc

SEQ ID NO: 9024 - DNA, 25 bp, Artificial sequence
  Extension Primer
aaaatagcacgtaggctataagtaa

SEQ ID NO: 9025 - DNA, 25 bp, Artificial sequence
  Extension Primer
cttaagatggttttatattcctgaa

SEQ ID NO: 9026 - DNA, 25 bp, Artificial sequence
  Extension Primer
agtcatcrtaaaagcacccctccca

SEQ ID NO: 9027 - DNA, 25 bp, Artificial sequence
  Extension Primer
aaaaagagaaatctaaaaatagtgc

SEQ ID NO: 9028 - DNA, 25 bp, Artificial sequence
  Extension Primer
ctgatttactaagtttgaggcacac

SEQ ID NO: 9029 - DNA, 25 bp, Artificial sequence
  Extension Primer
aactcccacaccagtttctgtaatg

SEQ ID NO: 9030 - DNA, 25 bp, Artificial sequence
  Extension Primer
gagttaaattaatcatgggttaaaa

SEQ ID NO: 9031 - DNA, 25 bp, Artificial sequence
  Extension Primer
cttagagactaaaccaccaccaacc

SEQ ID NO: 9032 - DNA, 25 bp, Artificial sequence
  Extension Primer
gaatgtattctgctcattctagccc

SEQ ID NO: 9033 - DNA, 25 bp, Artificial sequence
  Extension Primer
gctatrcagttcctcaggactttcc

SEQ ID NO: 9034 - DNA, 25 bp, Artificial sequence
  Extension Primer
tcaagcttccatcacggcattatac

SEQ ID NO: 9035 - DNA, 25 bp, Artificial sequence
  Extension Primer
gacaagccaccaaatacccagaccc

SEQ ID NO: 9036 - DNA, 25 bp, Artificial sequence
  Extension Primer
ttcagtacagtttttscccccttcc

SEQ ID NO: 9037 - DNA, 25 bp, Artificial sequence
  Extension Primer
tataaatgcatggatctgagcagag

SEQ ID NO: 9038 - DNA, 25 bp, Artificial sequence
  Extension Primer
tataatttaattcactaaagttttc

SEQ ID NO: 9039 - DNA, 25 bp, Artificial sequence
  Extension Primer
ctctccactgggctggttctgagga

SEQ ID NO: 9040 - DNA, 25 bp, Artificial sequence
  Extension Primer
actttctctgcacagccctggtgga

SEQ ID NO: 9041 - DNA, 25 bp, Artificial sequence
  Extension Primer
gggacaccccagagccactttttca

SEQ ID NO: 9042 - DNA, 25 bp, Artificial sequence
  Extension Primer
gtaatgagtgctgtgtccttaaaga

SEQ ID NO: 9043 - DNA, 25 bp, Artificial sequence
  Extension Primer
agcacctgtgaaacattctgaccta

SEQ ID NO: 9044 - DNA, 25 bp, Artificial sequence
  Extension Primer
aacaaacctagtcataaggggctcc

SEQ ID NO: 9045 - DNA, 25 bp, Artificial sequence
  Extension Primer
ggggtgcttttaygatgactgtgac

SEQ ID NO: 9046 - DNA, 25 bp, Artificial sequence
  Extension Primer
tcagaattgccagcccccataatca

SEQ ID NO: 9047 - DNA, 25 bp, Artificial sequence
  Extension Primer
agattttaacactaccaattttaac

SEQ ID NO: 9048 - DNA, 25 bp, Artificial sequence
  Extension Primer
tgctaaattccctaagatggaagtg

SEQ ID NO: 9049 - DNA, 25 bp, Artificial sequence
  Extension Primer
gtatttgtttttctctgtctgactt

SEQ ID NO: 9050 - DNA, 25 bp, Artificial sequence
  Extension Primer
aacttctggggaatttgaatagaac

SEQ ID NO: 9051 - DNA, 25 bp, Artificial sequence
  Extension Primer
cattttagatgccttaaagaatcaa

SEQ ID NO: 9052 - DNA, 25 bp, Artificial sequence
  Extension Primer
gcattattcctgatgacagtaccat

SEQ ID NO: 9053 - DNA, 25 bp, Artificial sequence
  Extension Primer
gctagctctgttctggaaaataaaa

SEQ ID NO: 9054 - DNA, 22 bp, Artificial sequence
  Extension Primer
ttctaagcaagccatgctcaat

SEQ ID NO: 9055 - DNA, 25 bp, Artificial sequence
  Extension Primer
tgacagaaaggatcctttgatttag

SEQ ID NO: 9056 - DNA, 25 bp, Artificial sequence
  Extension Primer
acactagcagactggatttgtaatc

SEQ ID NO: 9057 - DNA, 25 bp, Artificial sequence
  Extension Primer
tgtttatcccagggactattttctc

SEQ ID NO: 9058 - DNA, 25 bp, Artificial sequence
  Extension Primer
tgtgcattcaacatagcttgtaaac

SEQ ID NO: 9059 - DNA, 25 bp, Artificial sequence
  Extension Primer
ttgccttctctgtccccatctcccc

SEQ ID NO: 9060 - DNA, 25 bp, Artificial sequence
  Extension Primer
ctcacttttatgtgaatctttctta

SEQ ID NO: 9061 - DNA, 25 bp, Artificial sequence
  Extension Primer
cctactgtccttttataaatacttg

SEQ ID NO: 9062 - DNA, 25 bp, Artificial sequence
  Extension Primer
tcaatgagctctgagttcaaccacg

SEQ ID NO: 9063 - DNA, 25 bp, Artificial sequence
  Extension Primer
cagagaaaaggaggatgctcaaaag

SEQ ID NO: 9064 - DNA, 25 bp, Artificial sequence
  Extension Primer
attattgtaaagctgaaacttttct

SEQ ID NO: 9065 - DNA, 25 bp, Artificial sequence
  Extension Primer
ttatccctcccctagccctttccca

SEQ ID NO: 9066 - DNA, 25 bp, Artificial sequence
  Extension Primer
attcgcaatctgatgtcctgactgt

SEQ ID NO: 9067 - DNA, 25 bp, Artificial sequence
  Extension Primer
tatttaaaaagaggctggtgatgtg

SEQ ID NO: 9068 - DNA, 25 bp, Artificial sequence
  Extension Primer
tgaaggataattacaatattgtgat

SEQ ID NO: 9069 - DNA, 25 bp, Artificial sequence
  Extension Primer
acattcagccagttgtgtggatttt

SEQ ID NO: 9070 - DNA, 22 bp, Artificial sequence
  Extension Primer
aagggttgaacacttgctgtca

SEQ ID NO: 9071 - DNA, 25 bp, Artificial sequence
  Extension Primer
tggacttatttcctccttcaagagt

SEQ ID NO: 9072 - DNA, 25 bp, Artificial sequence
  Extension Primer
tttttaaatgtgcgtattaattttt

SEQ ID NO: 9073 - DNA, 25 bp, Artificial sequence
  Extension Primer
gagagctgatgggtgctcccaggct

SEQ ID NO: 9074 - DNA, 25 bp, Artificial sequence
  Extension Primer
tcagagaaggtgggagccagcatac

SEQ ID NO: 9075 - DNA, 25 bp, Artificial sequence
  Extension Primer
tttctgttccagtgtttccatctat

SEQ ID NO: 9076 - DNA, 25 bp, Artificial sequence
  Extension Primer
tgccagtaaataaaagtttccagtg

SEQ ID NO: 9077 - DNA, 25 bp, Artificial sequence
  Extension Primer
cttgagccgcgggtgtggaggagca

SEQ ID NO: 9078 - DNA, 25 bp, Artificial sequence
  Extension Primer
aactcggcttctccccacagaacac

SEQ ID NO: 9079 - DNA, 25 bp, Artificial sequence
  Extension Primer
acaaaatcttactttatcttgtgct

SEQ ID NO: 9080 - DNA, 25 bp, Artificial sequence
  Extension Primer
gagttctgtactttcggtccagggc

SEQ ID NO: 9081 - DNA, 25 bp, Artificial sequence
  Extension Primer
tgagggcctacttccgaagtggctc

SEQ ID NO: 9082 - DNA, 25 bp, Artificial sequence
  Extension Primer
tccaattaatcctgctccccactaa

SEQ ID NO: 9083 - DNA, 25 bp, Artificial sequence
  Extension Primer
ccttgttttgatttcaaagaaaata

SEQ ID NO: 9084 - DNA, 25 bp, Artificial sequence
  Extension Primer
gtggcttgaccgacagaactgaatc

SEQ ID NO: 9085 - DNA, 25 bp, Artificial sequence
  Extension Primer
gtgggctggagtactcaggtgtgtc

SEQ ID NO: 9086 - DNA, 25 bp, Artificial sequence
  Extension Primer
cttacttcctcaataagtggtactt

SEQ ID NO: 9087 - DNA, 25 bp, Artificial sequence
  Extension Primer
ataacgatgccaaatgatgccttac

SEQ ID NO: 9088 - DNA, 25 bp, Artificial sequence
  Extension Primer
tgatctctgatgttcagtcagtgtc

SEQ ID NO: 9089 - DNA, 25 bp, Artificial sequence
  Extension Primer
aaagaaaattcaatattgggttcat

SEQ ID NO: 9090 - DNA, 25 bp, Artificial sequence
  Extension Primer
tgcaagtgtaggggcagaggggaca

SEQ ID NO: 9091 - DNA, 25 bp, Artificial sequence
  Extension Primer
ggggtaatttatgccgtcacctttc

SEQ ID NO: 9092 - DNA, 25 bp, Artificial sequence
  Extension Primer
ataccagtgggttcaagaatgagtt

SEQ ID NO: 9093 - DNA, 25 bp, Artificial sequence
  Extension Primer
aggaatttagagcaaggggtaaaca

SEQ ID NO: 9094 - DNA, 25 bp, Artificial sequence
  Extension Primer
tgtagcagctgggtctttgttgaat

SEQ ID NO: 9095 - DNA, 25 bp, Artificial sequence
  Extension Primer
attttttagaactttttggtaactc

SEQ ID NO: 9096 - DNA, 25 bp, Artificial sequence
  Extension Primer
tagtttataaaagtttcagtttcct

SEQ ID NO: 9097 - DNA, 25 bp, Artificial sequence
  Extension Primer
aagaaatccaccacaagaaacatca

SEQ ID NO: 9098 - DNA, 25 bp, Artificial sequence
  Extension Primer
agacttaaaagcagctaaaacatat

SEQ ID NO: 9099 - DNA, 25 bp, Artificial sequence
  Extension Primer
ctcttattacatcattaatctatct

SEQ ID NO: 9100 - DNA, 25 bp, Artificial sequence
  Extension Primer
taattattgataagacattcaacta

SEQ ID NO: 9101 - DNA, 25 bp, Artificial sequence
  Extension Primer
ccagtggggttttagtacctatatc

SEQ ID NO: 9102 - DNA, 25 bp, Artificial sequence
  Extension Primer
gtggtacagtctctgagactctgct

SEQ ID NO: 9103 - DNA, 25 bp, Artificial sequence
  Extension Primer
caagaagcctaagaagctgtctcct

SEQ ID NO: 9104 - DNA, 25 bp, Artificial sequence
  Extension Primer
aaaccaacaaataacaaaagtcaca

SEQ ID NO: 9105 - DNA, 25 bp, Artificial sequence
  Extension Primer
ggaaaaattaaatgaagcaggtttt

SEQ ID NO: 9106 - DNA, 25 bp, Artificial sequence
  Extension Primer
tcttcagaagaactcatctacaagt

SEQ ID NO: 9107 - DNA, 25 bp, Artificial sequence
  Extension Primer
gcaccccaagacccagtaaacacaa

SEQ ID NO: 9108 - DNA, 25 bp, Artificial sequence
  Extension Primer
aacagcagaattactcatagctccc

SEQ ID NO: 9109 - DNA, 25 bp, Artificial sequence
  Extension Primer
gtggggactatccctcagagatcaa

SEQ ID NO: 9110 - DNA, 25 bp, Artificial sequence
  Extension Primer
acatatatttagtaggtatgcacac

SEQ ID NO: 9111 - DNA, 25 bp, Artificial sequence
  Extension Primer
aygaaaagacaaatttctgttgctt

SEQ ID NO: 9112 - DNA, 25 bp, Artificial sequence
  Extension Primer
acttctttccatggcattgaccttg

SEQ ID NO: 9113 - DNA, 25 bp, Artificial sequence
  Extension Primer
aaacagtaaaaagtggaaatccctt

SEQ ID NO: 9114 - DNA, 25 bp, Artificial sequence
  Extension Primer
actcctgccagcatttttaaatgaa

SEQ ID NO: 9115 - DNA, 25 bp, Artificial sequence
  Extension Primer
atagtgtgaacaattttactagaga

SEQ ID NO: 9116 - DNA, 25 bp, Artificial sequence
  Extension Primer
cctgcacaccccccatgtacttctt

SEQ ID NO: 9117 - DNA, 25 bp, Artificial sequence
  Extension Primer
tgacagtgtcttcactgtctccctc

SEQ ID NO: 9118 - DNA, 25 bp, Artificial sequence
  Extension Primer
aagtctgaaaagctcacttattccg

SEQ ID NO: 9119 - DNA, 25 bp, Artificial sequence
  Extension Primer
gtcattgcagtcaatcaccttaaaa

SEQ ID NO: 9120 - DNA, 25 bp, Artificial sequence
  Extension Primer
gtctgagagtcagaagttccttcca

SEQ ID NO: 9121 - DNA, 25 bp, Artificial sequence
  Extension Primer
cgtgtgtcactgtgccctgagctgc

SEQ ID NO: 9122 - DNA, 25 bp, Artificial sequence
  Extension Primer
ggctcagagrttaaagcatttgcct

SEQ ID NO: 9123 - DNA, 25 bp, Artificial sequence
  Extension Primer
gctccctcgagtttctggaagacac

SEQ ID NO: 9124 - DNA, 25 bp, Artificial sequence
  Extension Primer
tgctgctttgtgagaataaaggcag

SEQ ID NO: 9125 - DNA, 25 bp, Artificial sequence
  Extension Primer
tatccaaagtaaacagtaattatga

SEQ ID NO: 9126 - DNA, 25 bp, Artificial sequence
  Extension Primer
caggttttattttctcaagagtaca

SEQ ID NO: 9127 - DNA, 25 bp, Artificial sequence
  Extension Primer
tacttaatttccttaaagttgagtt

SEQ ID NO: 9128 - DNA, 25 bp, Artificial sequence
  Extension Primer
acttagctattttctttagatgtgt

SEQ ID NO: 9129 - DNA, 25 bp, Artificial sequence
  Extension Primer
tcatattcaaaagctaagattcaac

SEQ ID NO: 9130 - DNA, 25 bp, Artificial sequence
  Extension Primer
tgttagtaatatgagtaggtctggt

SEQ ID NO: 9131 - DNA, 25 bp, Artificial sequence
  Extension Primer
tgcctgaaagatcttcatattacct

SEQ ID NO: 9132 - DNA, 25 bp, Artificial sequence
  Extension Primer
gcataattgctaagtgtgggaatat

SEQ ID NO: 9133 - DNA, 25 bp, Artificial sequence
  Extension Primer
ggcaaaaacaatacagtgtgatggt

SEQ ID NO: 9134 - DNA, 25 bp, Artificial sequence
  Extension Primer
tctatcctccatactctctayacca

SEQ ID NO: 9135 - DNA, 25 bp, Artificial sequence
  Extension Primer
ggggcagggagagggcggatggtga

SEQ ID NO: 9136 - DNA, 25 bp, Artificial sequence
  Extension Primer
ctgtcagttcaagagggcagctttc

SEQ ID NO: 9137 - DNA, 25 bp, Artificial sequence
  Extension Primer
ccagctctaaacaccttcagatgtt

SEQ ID NO: 9138 - DNA, 25 bp, Artificial sequence
  Extension Primer
agcaagtcagctcatggctgaaaca

SEQ ID NO: 9139 - DNA, 25 bp, Artificial sequence
  Extension Primer
tgcaggcttggggcaaggaaggcag

SEQ ID NO: 9140 - DNA, 25 bp, Artificial sequence
  Extension Primer
ttaagattgctttaactgaggtaac

SEQ ID NO: 9141 - DNA, 25 bp, Artificial sequence
  Extension Primer
ttcactaggaaataaaacaggtaca

SEQ ID NO: 9142 - DNA, 25 bp, Artificial sequence
  Extension Primer
acatgggaaacaaattttttaaact

SEQ ID NO: 9143 - DNA, 25 bp, Artificial sequence
  Extension Primer
cctccatccaggcataacaattcta

SEQ ID NO: 9144 - DNA, 25 bp, Artificial sequence
  Extension Primer
agtagatccagaaaaagatatcatc

SEQ ID NO: 9145 - DNA, 25 bp, Artificial sequence
  Extension Primer
aaagttcattcctctagtctrgtag

SEQ ID NO: 9146 - DNA, 25 bp, Artificial sequence
  Extension Primer
ggatgagtaggagttcaccaagtgg

SEQ ID NO: 9147 - DNA, 25 bp, Artificial sequence
  Extension Primer
tcatggctacagaatataaaacccc

SEQ ID NO: 9148 - DNA, 25 bp, Artificial sequence
  Extension Primer
gcttaatttcagaagtggttagata

SEQ ID NO: 9149 - DNA, 25 bp, Artificial sequence
  Extension Primer
tagacaagcaggggatgatagagga

SEQ ID NO: 9150 - DNA, 25 bp, Artificial sequence
  Extension Primer
tctctttcctgagacttctgaaggg

SEQ ID NO: 9151 - DNA, 25 bp, Artificial sequence
  Extension Primer
acggctgagactctaagacatggct

SEQ ID NO: 9152 - DNA, 25 bp, Artificial sequence
  Extension Primer
cttttgaaatgcagcacactttgtt

SEQ ID NO: 9153 - DNA, 25 bp, Artificial sequence
  Extension Primer
gtctccttccttatgaagatgatgg

SEQ ID NO: 9154 - DNA, 25 bp, Artificial sequence
  Extension Primer
atccaaagaaagttacttagttcac

SEQ ID NO: 9155 - DNA, 25 bp, Artificial sequence
  Extension Primer
aactgagtttggtggtgggttcgta

SEQ ID NO: 9156 - DNA, 25 bp, Artificial sequence
  Extension Primer
gacagtgtcttcactgtctccctcy

SEQ ID NO: 9157 - DNA, 25 bp, Artificial sequence
  Extension Primer
ttctaggactggatgacctgttgcc

SEQ ID NO: 9158 - DNA, 25 bp, Artificial sequence
  Extension Primer
gatataatatattaagtttagacag

SEQ ID NO: 9159 - DNA, 25 bp, Artificial sequence
  Extension Primer
gagtgcaggcctgggagtcaggctt

SEQ ID NO: 9160 - DNA, 22 bp, Artificial sequence
  Extension Primer
atggggaggaaaaacttctacc

SEQ ID NO: 9161 - DNA, 25 bp, Artificial sequence
  Extension Primer
tgaactgcagaatggacttttactg

SEQ ID NO: 9162 - DNA, 25 bp, Artificial sequence
  Extension Primer
atttatcacaatttggcaagataca

SEQ ID NO: 9163 - DNA, 22 bp, Artificial sequence
  Extension Primer
tgagaacgccttctctaaactg

SEQ ID NO: 9164 - DNA, 25 bp, Artificial sequence
  Extension Primer
actattttcctcattgtttttccaa

SEQ ID NO: 9165 - DNA, 25 bp, Artificial sequence
  Extension Primer
cccaagcacagttgygatcatattg

SEQ ID NO: 9166 - DNA, 25 bp, Artificial sequence
  Extension Primer
aatgattgtgctttctcaagtgtat

SEQ ID NO: 9167 - DNA, 25 bp, Artificial sequence
  Extension Primer
ggtgtttgtggcaaaacttgaattg

SEQ ID NO: 9168 - DNA, 25 bp, Artificial sequence
  Extension Primer
ctccctggggtggggagataaaata

SEQ ID NO: 9169 - DNA, 25 bp, Artificial sequence
  Extension Primer
accrctgctttgtgaaccttctctt

SEQ ID NO: 9170 - DNA, 25 bp, Artificial sequence
  Extension Primer
cagccaggtccaaatctctcactac

SEQ ID NO: 9171 - DNA, 25 bp, Artificial sequence
  Extension Primer
caattctgagggattctttcattca

SEQ ID NO: 9172 - DNA, 25 bp, Artificial sequence
  Extension Primer
tttgcaccttgcacagtgctcggca

SEQ ID NO: 9173 - DNA, 25 bp, Artificial sequence
  Extension Primer
tttcatttggctaagaatacatggc

SEQ ID NO: 9174 - DNA, 25 bp, Artificial sequence
  Extension Primer
cagtcttaaggaagcaacatgagcc

SEQ ID NO: 9175 - DNA, 25 bp, Artificial sequence
  Extension Primer
acctggcgcataccactaatggaaa

SEQ ID NO: 9176 - DNA, 25 bp, Artificial sequence
  Extension Primer
aataacaaacatggagaagaggaaa

SEQ ID NO: 9177 - DNA, 25 bp, Artificial sequence
  Extension Primer
gaaaatcacaaggtcatgacagaac

SEQ ID NO: 9178 - DNA, 25 bp, Artificial sequence
  Extension Primer
cctgtataacaagctgccacggaat

SEQ ID NO: 9179 - DNA, 25 bp, Artificial sequence
  Extension Primer
ctgctgctctctgatgttcccttgc

SEQ ID NO: 9180 - DNA, 25 bp, Artificial sequence
  Extension Primer
atggagtccctgagtatcttttgga

SEQ ID NO: 9181 - DNA, 25 bp, Artificial sequence
  Extension Primer
ctttgttaactcctgacttgtcacc

SEQ ID NO: 9182 - DNA, 22 bp, Artificial sequence
  Extension Primer
gtggaaaagcaaacttttcaga

SEQ ID NO: 9183 - DNA, 25 bp, Artificial sequence
  Extension Primer
gtttagggatggtgtggatggttty

SEQ ID NO: 9184 - DNA, 25 bp, Artificial sequence
  Extension Primer
tgcaaagtgcttttaaaatttacyc

SEQ ID NO: 9185 - DNA, 25 bp, Artificial sequence
  Extension Primer
aagcattaagtraggagaaaacttt

SEQ ID NO: 9186 - DNA, 25 bp, Artificial sequence
  Extension Primer
ggtcacaagaattgggcccaactta

SEQ ID NO: 9187 - DNA, 25 bp, Artificial sequence
  Extension Primer
tcaaaacagtggtgagaatataagt

SEQ ID NO: 9188 - DNA, 25 bp, Artificial sequence
  Extension Primer
ccatgcacagaaaatcaccaaactc

SEQ ID NO: 9189 - DNA, 25 bp, Artificial sequence
  Extension Primer
gaattagcctcatcagataatgaag

SEQ ID NO: 9190 - DNA, 25 bp, Artificial sequence
  Extension Primer
ccaatatgagcatctcccagacagc

SEQ ID NO: 9191 - DNA, 25 bp, Artificial sequence
  Extension Primer
atccactcctgccagtcctgcctga

SEQ ID NO: 9192 - DNA, 25 bp, Artificial sequence
  Extension Primer
cacatgatcaggagtccttggaatt

SEQ ID NO: 9193 - DNA, 25 bp, Artificial sequence
  Extension Primer
agacgtgagagctagttccctgacc

SEQ ID NO: 9194 - DNA, 25 bp, Artificial sequence
  Extension Primer
gggctggttcctgtgtgagcgtcca

SEQ ID NO: 9195 - DNA, 25 bp, Artificial sequence
  Extension Primer
aacctgaacccactaaaaaagtctt

SEQ ID NO: 9196 - DNA, 25 bp, Artificial sequence
  Extension Primer
cacttcacactgtcatttgttcaaa

SEQ ID NO: 9197 - DNA, 25 bp, Artificial sequence
  Extension Primer
ctcgagtacaaccccaacaggtagg

SEQ ID NO: 9198 - DNA, 25 bp, Artificial sequence
  Extension Primer
aacagagtaagtatgggactcttaa

SEQ ID NO: 9199 - DNA, 25 bp, Artificial sequence
  Extension Primer
ayttgtaaagcctagtctgattttt

SEQ ID NO: 9200 - DNA, 25 bp, Artificial sequence
  Extension Primer
tcattctaagtctaacatacaaaaa

SEQ ID NO: 9201 - DNA, 25 bp, Artificial sequence
  Extension Primer
cttggcagggttatttctccggttg

SEQ ID NO: 9202 - DNA, 25 bp, Artificial sequence
  Extension Primer
tccaatgcctggttttcagtttctc

SEQ ID NO: 9203 - DNA, 25 bp, Artificial sequence
  Extension Primer
tctgatgttgtgactgttttctcca

SEQ ID NO: 9204 - DNA, 25 bp, Artificial sequence
  Extension Primer
gaaggtggaattaaggaagggaggc

SEQ ID NO: 9205 - DNA, 25 bp, Artificial sequence
  Extension Primer
gcataactcctttctagtagcttct

SEQ ID NO: 9206 - DNA, 25 bp, Artificial sequence
  Extension Primer
tttgaagtgttaatatattaaaata

SEQ ID NO: 9207 - DNA, 25 bp, Artificial sequence
  Extension Primer
ttctgttatccacttgaaaattacc

SEQ ID NO: 9208 - DNA, 25 bp, Artificial sequence
  Extension Primer
actgaggagtagcaaaggaaacagc

SEQ ID NO: 9209 - DNA, 25 bp, Artificial sequence
  Extension Primer
ttgaacaccaaacccttagctcaac

SEQ ID NO: 9210 - DNA, 25 bp, Artificial sequence
  Extension Primer
acctctaacgccagaggtaacaacc

SEQ ID NO: 9211 - DNA, 25 bp, Artificial sequence
  Extension Primer
ttcattaaattgattcacttagaaa

SEQ ID NO: 9212 - DNA, 25 bp, Artificial sequence
  Extension Primer
ggggcgctcacccattgcttcactg

SEQ ID NO: 9213 - DNA, 25 bp, Artificial sequence
  Extension Primer
gctggaagggaacactgtaatattk

SEQ ID NO: 9214 - DNA, 25 bp, Artificial sequence
  Extension Primer
tcttatgtaaactccatgggtaagc

SEQ ID NO: 9215 - DNA, 25 bp, Artificial sequence
  Extension Primer
ttcccttactaagccttgagttcct

SEQ ID NO: 9216 - DNA, 25 bp, Artificial sequence
  Extension Primer
ttagaaacatgtcaatgattctcct

SEQ ID NO: 9217 - DNA, 25 bp, Artificial sequence
  Extension Primer
gaaagaggagtgatgtaagcatgcc

SEQ ID NO: 9218 - DNA, 25 bp, Artificial sequence
  Extension Primer
atgacaaascaagaatgcagagaaa

SEQ ID NO: 9219 - DNA, 25 bp, Artificial sequence
  Extension Primer
tttcccactggcagaagccccatga

SEQ ID NO: 9220 - DNA, 25 bp, Artificial sequence
  Extension Primer
aggggaatgagggagtggaaggggg

SEQ ID NO: 9221 - DNA, 25 bp, Artificial sequence
  Extension Primer
gtgagaacagtctacttcagatcca

SEQ ID NO: 9222 - DNA, 25 bp, Artificial sequence
  Extension Primer
ggcaatctgcttccactgcaaagaa

SEQ ID NO: 9223 - DNA, 25 bp, Artificial sequence
  Extension Primer
atgtgctgggtaataagaatgacac

SEQ ID NO: 9224 - DNA, 25 bp, Artificial sequence
  Extension Primer
aataggaggcaagccaacccccacc

SEQ ID NO: 9225 - DNA, 25 bp, Artificial sequence
  Extension Primer
gggtggcttcagttaataatgtcca

SEQ ID NO: 9226 - DNA, 25 bp, Artificial sequence
  Extension Primer
tgtgttcagctgttgcatctatgat

SEQ ID NO: 9227 - DNA, 25 bp, Artificial sequence
  Extension Primer
aatgtagtaarttgcaacaaataca

SEQ ID NO: 9228 - DNA, 25 bp, Artificial sequence
  Extension Primer
catgtcaactcagttgctccagact

SEQ ID NO: 9229 - DNA, 22 bp, Artificial sequence
  Extension Primer
cttccggaaggggcaccggggc

SEQ ID NO: 9230 - DNA, 25 bp, Artificial sequence
  Extension Primer
ccgttcgtccccgtgtgccctcaac

SEQ ID NO: 9231 - DNA, 25 bp, Artificial sequence
  Extension Primer
tctcttgtagccaaatcgctgcttc

SEQ ID NO: 9232 - DNA, 25 bp, Artificial sequence
  Extension Primer
gccactgtaactgcttgcttgtcac

SEQ ID NO: 9233 - DNA, 25 bp, Artificial sequence
  Extension Primer
arggaacaagccgagggtttcttct

SEQ ID NO: 9234 - DNA, 25 bp, Artificial sequence
  Extension Primer
taaaatattgaaaacttcttaaaag

SEQ ID NO: 9235 - DNA, 25 bp, Artificial sequence
  Extension Primer
ggctcttcgtgctgatgcctgtaag

SEQ ID NO: 9236 - DNA, 25 bp, Artificial sequence
  Extension Primer
ccctccctgacaaagatgcacactc

SEQ ID NO: 9237 - DNA, 25 bp, Artificial sequence
  Extension Primer
gacaatcaattcagcagataaaaat

SEQ ID NO: 9238 - DNA, 25 bp, Artificial sequence
  Extension Primer
cttcactgtggaaataaatagtaaa

SEQ ID NO: 9239 - DNA, 25 bp, Artificial sequence
  Extension Primer
ctttggccttcaatctttcccgtat

SEQ ID NO: 9240 - DNA, 25 bp, Artificial sequence
  Extension Primer
atatttagagatttcccttctcagt

SEQ ID NO: 9241 - DNA, 25 bp, Artificial sequence
  Extension Primer
ccaatagcttgaaaagaataatatg

SEQ ID NO: 9242 - DNA, 25 bp, Artificial sequence
  Extension Primer
atctaggtgttctaggcctttctcc

SEQ ID NO: 9243 - DNA, 25 bp, Artificial sequence
  Extension Primer
ttcaacaagaggaaagatgcttgag

SEQ ID NO: 9244 - DNA, 25 bp, Artificial sequence
  Extension Primer
catccaagtgactgctcttctactg

SEQ ID NO: 9245 - DNA, 25 bp, Artificial sequence
  Extension Primer
tgtctatagcaagcaactccaactt

SEQ ID NO: 9246 - DNA, 25 bp, Artificial sequence
  Extension Primer
acctgcagccaggcgtctgaacata

SEQ ID NO: 9247 - DNA, 25 bp, Artificial sequence
  Extension Primer
tgaaaataattacttctacatctgc

SEQ ID NO: 9248 - DNA, 25 bp, Artificial sequence
  Extension Primer
ttctaaacagaaagggggagataat

SEQ ID NO: 9249 - DNA, 25 bp, Artificial sequence
  Extension Primer
tttatttyttttccccattgactta

SEQ ID NO: 9250 - DNA, 25 bp, Artificial sequence
  Extension Primer
tagggaaggatggcagctccccaca

SEQ ID NO: 9251 - DNA, 25 bp, Artificial sequence
  Extension Primer
aaatataaccatttagaactacttc

SEQ ID NO: 9252 - DNA, 25 bp, Artificial sequence
  Extension Primer
tttcctacacataagtgtttcctaa

SEQ ID NO: 9253 - DNA, 25 bp, Artificial sequence
  Extension Primer
ctgattcatatagatgttacatgac

SEQ ID NO: 9254 - DNA, 25 bp, Artificial sequence
  Extension Primer
ctacctaaagagtggcccccaaacc

SEQ ID NO: 9255 - DNA, 25 bp, Artificial sequence
  Extension Primer
gctaaacacttttaaacattccatt

SEQ ID NO: 9256 - DNA, 25 bp, Artificial sequence
  Extension Primer
ctggtgtttgacttcaaatctaagc

SEQ ID NO: 9257 - DNA, 25 bp, Artificial sequence
  Extension Primer
ggtgtgagaactcaaagtggaataa

SEQ ID NO: 9258 - DNA, 25 bp, Artificial sequence
  Extension Primer
agactcatccattcatcaaaaccaa

SEQ ID NO: 9259 - DNA, 25 bp, Artificial sequence
  Extension Primer
gtaaggatacagatgagattggact

SEQ ID NO: 9260 - DNA, 25 bp, Artificial sequence
  Extension Primer
tcaagtgcttttcaaatatgttcaa

SEQ ID NO: 9261 - DNA, 25 bp, Artificial sequence
  Extension Primer
ttccaaattaatgttacaatactac

SEQ ID NO: 9262 - DNA, 25 bp, Artificial sequence
  Extension Primer
cagcttcaaatatctttaaacctta

SEQ ID NO: 9263 - DNA, 25 bp, Artificial sequence
  Extension Primer
tagtgcttagtcttggtgtaatttt

SEQ ID NO: 9264 - DNA, 25 bp, Artificial sequence
  Extension Primer
gggatcagaacccatgacttcctta

SEQ ID NO: 9265 - DNA, 25 bp, Artificial sequence
  Extension Primer
actgagaggtaactccaacctcaaa

SEQ ID NO: 9266 - DNA, 25 bp, Artificial sequence
  Extension Primer
cacacgatgtgcctcactatgagcc

SEQ ID NO: 9267 - DNA, 25 bp, Artificial sequence
  Extension Primer
aagataagatasataaaccccatga

SEQ ID NO: 9268 - DNA, 25 bp, Artificial sequence
  Extension Primer
ttcctaatttttcagctttactctt

SEQ ID NO: 9269 - DNA, 25 bp, Artificial sequence
  Extension Primer
cagctcagacttctcatcctgtgaa

SEQ ID NO: 9270 - DNA, 25 bp, Artificial sequence
  Extension Primer
acttaaatcccttctcatttccata

SEQ ID NO: 9271 - DNA, 25 bp, Artificial sequence
  Extension Primer
aagaaagttcagcctcggacgcacc

SEQ ID NO: 9272 - DNA, 25 bp, Artificial sequence
  Extension Primer
actgtaactgtgagctagaaggaaa

SEQ ID NO: 9273 - DNA, 25 bp, Artificial sequence
  Extension Primer
cctatataagtttaagtatattttt

SEQ ID NO: 9274 - DNA, 22 bp, Artificial sequence
  Extension Primer
ctggttcctgagataccccaca

SEQ ID NO: 9275 - DNA, 25 bp, Artificial sequence
  Extension Primer
ctgtgcctacttgtccacttgcatt

SEQ ID NO: 9276 - DNA, 25 bp, Artificial sequence
  Extension Primer
ctttttaaacagcgcgttttcattc

SEQ ID NO: 9277 - DNA, 25 bp, Artificial sequence
  Extension Primer
tgttcttgtcagaattcttccagaa

SEQ ID NO: 9278 - DNA, 25 bp, Artificial sequence
  Extension Primer
tagaaatgaagaatgcctttgatgg

SEQ ID NO: 9279 - DNA, 25 bp, Artificial sequence
  Extension Primer
aggagagaaccagattgattactta

SEQ ID NO: 9280 - DNA, 25 bp, Artificial sequence
  Extension Primer
tcataacccagctaattcctcatcc

SEQ ID NO: 9281 - DNA, 25 bp, Artificial sequence
  Extension Primer
tcaaaaagtttatttataccgatgg

SEQ ID NO: 9282 - DNA, 25 bp, Artificial sequence
  Extension Primer
tacttgaactgccatccttactcca

SEQ ID NO: 9283 - DNA, 25 bp, Artificial sequence
  Extension Primer
aagattctgagttagttcgttataa

SEQ ID NO: 9284 - DNA, 25 bp, Artificial sequence
  Extension Primer
agccagacttagagtaaatttagcc

SEQ ID NO: 9285 - DNA, 25 bp, Artificial sequence
  Extension Primer
aggatgaaatggaaaccaagtatca

SEQ ID NO: 9286 - DNA, 25 bp, Artificial sequence
  Extension Primer
ttatttaaaaatggttcattttccc

SEQ ID NO: 9287 - DNA, 25 bp, Artificial sequence
  Extension Primer
aacctgaaaatgccaccttcccaag

SEQ ID NO: 9288 - DNA, 25 bp, Artificial sequence
  Extension Primer
ccgttctccaaaggacataacaagg

SEQ ID NO: 9289 - DNA, 25 bp, Artificial sequence
  Extension Primer
atcaaaacatagatggttagacccc

SEQ ID NO: 9290 - DNA, 25 bp, Artificial sequence
  Extension Primer
gttaaggcccataaaattatgcaat

SEQ ID NO: 9291 - DNA, 25 bp, Artificial sequence
  Extension Primer
acaccaaatgagttggagtacaagc

SEQ ID NO: 9292 - DNA, 25 bp, Artificial sequence
  Extension Primer
gttgtttgggattttatttgctctc

SEQ ID NO: 9293 - DNA, 25 bp, Artificial sequence
  Extension Primer
tcttgtgtgtttttaagctaataag

SEQ ID NO: 9294 - DNA, 25 bp, Artificial sequence
  Extension Primer
gtgtttgggagatttgcaagcttta

SEQ ID NO: 9295 - DNA, 25 bp, Artificial sequence
  Extension Primer
gccagtatcactcaccaatgagcaa

SEQ ID NO: 9296 - DNA, 25 bp, Artificial sequence
  Extension Primer
ctaaaagcactgaatcaaatgttat

SEQ ID NO: 9297 - DNA, 25 bp, Artificial sequence
  Extension Primer
aataacaatgaactgtgagtattga

SEQ ID NO: 9298 - DNA, 25 bp, Artificial sequence
  Extension Primer
cccagcgcccacacctcccccatga

SEQ ID NO: 9299 - DNA, 25 bp, Artificial sequence
  Extension Primer
ctctgtgtccagaaggaggcttgca

SEQ ID NO: 9300 - DNA, 25 bp, Artificial sequence
  Extension Primer
cgtgtggacagacgtggccacaacc

SEQ ID NO: 9301 - DNA, 25 bp, Artificial sequence
  Extension Primer
gccctcctttaaaaagctgtgtgct

SEQ ID NO: 9302 - DNA, 25 bp, Artificial sequence
  Extension Primer
aagcctgaaattaatttcctgaaat

SEQ ID NO: 9303 - DNA, 25 bp, Artificial sequence
  Extension Primer
gaaagagatgtggcgttcttcattt

SEQ ID NO: 9304 - DNA, 25 bp, Artificial sequence
  Extension Primer
ttggagaatggctgggagtgtaaca

SEQ ID NO: 9305 - DNA, 25 bp, Artificial sequence
  Extension Primer
atcgcccgcgcagacagaaacagag

SEQ ID NO: 9306 - DNA, 25 bp, Artificial sequence
  Extension Primer
caggactgacagttcatattccaaa

SEQ ID NO: 9307 - DNA, 25 bp, Artificial sequence
  Extension Primer
gctcaggagattatttggaacaatt

SEQ ID NO: 9308 - DNA, 25 bp, Artificial sequence
  Extension Primer
ccagccccaccaggattcttgggag

SEQ ID NO: 9309 - DNA, 25 bp, Artificial sequence
  Extension Primer
gcgcaacaaaaccacaaggacttcg

SEQ ID NO: 9310 - DNA, 25 bp, Artificial sequence
  Extension Primer
gctrtttattggacagtgaagaatg

SEQ ID NO: 9311 - DNA, 25 bp, Artificial sequence
  Extension Primer
cctacctcttaggacattacagata

SEQ ID NO: 9312 - DNA, 25 bp, Artificial sequence
  Extension Primer
gtccctggcagcagggatcattact

SEQ ID NO: 9313 - DNA, 25 bp, Artificial sequence
  Extension Primer
aaaattatcttactcatatgtgtgc

SEQ ID NO: 9314 - DNA, 25 bp, Artificial sequence
  Extension Primer
tattgataacttgaatttaaaaagc

SEQ ID NO: 9315 - DNA, 25 bp, Artificial sequence
  Extension Primer
agtgggtgggcgcaagaagtyaagg

SEQ ID NO: 9316 - DNA, 25 bp, Artificial sequence
  Extension Primer
acgtaaagagtgctgctttatgggg

SEQ ID NO: 9317 - DNA, 25 bp, Artificial sequence
  Extension Primer
tgattatagaaattttggaaggaga

SEQ ID NO: 9318 - DNA, 25 bp, Artificial sequence
  Extension Primer
ctcatttcttctttacaaggaaccc

SEQ ID NO: 9319 - DNA, 25 bp, Artificial sequence
  Extension Primer
ctgtggacrgtcctctgtcaatrgg

SEQ ID NO: 9320 - DNA, 25 bp, Artificial sequence
  Extension Primer
ggtatgcagatgggcagaaaaagtg

SEQ ID NO: 9321 - DNA, 25 bp, Artificial sequence
  Extension Primer
agaaggaaaatgaaatgcaagaatc

SEQ ID NO: 9322 - DNA, 25 bp, Artificial sequence
  Extension Primer
agctgtagtgtatagattgtggcat

SEQ ID NO: 9323 - DNA, 25 bp, Artificial sequence
  Extension Primer
catgtttattcttgaaaacattcca

SEQ ID NO: 9324 - DNA, 25 bp, Artificial sequence
  Extension Primer
gatggtgacaggcagtcatatcttt

SEQ ID NO: 9325 - DNA, 25 bp, Artificial sequence
  Extension Primer
tttcatttttttattgtaatgatgg

SEQ ID NO: 9326 - DNA, 25 bp, Artificial sequence
  Extension Primer
caagaaaaaatgtagaagggatgac

SEQ ID NO: 9327 - DNA, 25 bp, Artificial sequence
  Extension Primer
acagggaccacgtaccacgcgatta

SEQ ID NO: 9328 - DNA, 25 bp, Artificial sequence
  Extension Primer
tgaagataccaaaagcaagagatga

SEQ ID NO: 9329 - DNA, 25 bp, Artificial sequence
  Extension Primer
tagcttagaactcagaagggtttag

SEQ ID NO: 9330 - DNA, 25 bp, Artificial sequence
  Extension Primer
aatgaataaataatcccattgtact

SEQ ID NO: 9331 - DNA, 25 bp, Artificial sequence
  Extension Primer
gaagtaattttaaatgggcaaagac

SEQ ID NO: 9332 - DNA, 25 bp, Artificial sequence
  Extension Primer
gaaaggttggggaagaaatatactc

SEQ ID NO: 9333 - DNA, 25 bp, Artificial sequence
  Extension Primer
actttggtagccatggaaagatgcc

SEQ ID NO: 9334 - DNA, 22 bp, Artificial sequence
  Extension Primer
ttgaaatgaaagcactccataa

SEQ ID NO: 9335 - DNA, 25 bp, Artificial sequence
  Extension Primer
aattaaargatacatttttgagagt

SEQ ID NO: 9336 - DNA, 25 bp, Artificial sequence
  Extension Primer
ctcagcaaccaaactctaaatcaac

SEQ ID NO: 9337 - DNA, 25 bp, Artificial sequence
  Extension Primer
cagaagtggaaacagagggagcaga

SEQ ID NO: 9338 - DNA, 25 bp, Artificial sequence
  Extension Primer
aattgtcaggactcatgtctttact

SEQ ID NO: 9339 - DNA, 22 bp, Artificial sequence
  Extension Primer
tgctttgttgtaggtggctatc

SEQ ID NO: 9340 - DNA, 25 bp, Artificial sequence
  Extension Primer
ctgctaaaaagaaagaacaaataaa

SEQ ID NO: 9341 - DNA, 25 bp, Artificial sequence
  Extension Primer
atgatgatttcagagcagaaggaaa

SEQ ID NO: 9342 - DNA, 25 bp, Artificial sequence
  Extension Primer
tgaatttttatgactaccttgtgag

SEQ ID NO: 9343 - DNA, 25 bp, Artificial sequence
  Extension Primer
tattaggaggaaataacagattatg

SEQ ID NO: 9344 - DNA, 25 bp, Artificial sequence
  Extension Primer
ttcccgggcctgccactcaccctcc

SEQ ID NO: 9345 - DNA, 25 bp, Artificial sequence
  Extension Primer
agagaggagccaaggggttagatgc

SEQ ID NO: 9346 - DNA, 25 bp, Artificial sequence
  Extension Primer
atccattttgaactgatttcttggc

SEQ ID NO: 9347 - DNA, 25 bp, Artificial sequence
  Extension Primer
aactgagatctggggttctcactct

SEQ ID NO: 9348 - DNA, 25 bp, Artificial sequence
  Extension Primer
aacacaacaagtcttcctcacagca

SEQ ID NO: 9349 - DNA, 25 bp, Artificial sequence
  Extension Primer
gcttcataccataaggtagtgaaca

SEQ ID NO: 9350 - DNA, 25 bp, Artificial sequence
  Extension Primer
aaaatgttaccgttctctacatcta

SEQ ID NO: 9351 - DNA, 25 bp, Artificial sequence
  Extension Primer
acagacagcatcaaggccccagaca

SEQ ID NO: 9352 - DNA, 25 bp, Artificial sequence
  Extension Primer
tcagtccacttctttataggagtca

SEQ ID NO: 9353 - DNA, 25 bp, Artificial sequence
  Extension Primer
taaaaaatgctacatggcatgcagg

SEQ ID NO: 9354 - DNA, 25 bp, Artificial sequence
  Extension Primer
tgaaatgaaattccactgattccca

SEQ ID NO: 9355 - DNA, 25 bp, Artificial sequence
  Extension Primer
taaaagaggtgaggttggaaacatg

SEQ ID NO: 9356 - DNA, 25 bp, Artificial sequence
  Extension Primer
aatacttattatttgagaggaaaac

SEQ ID NO: 9357 - DNA, 25 bp, Artificial sequence
  Extension Primer
tggtaacctttaaagtcctactcta

SEQ ID NO: 9358 - DNA, 25 bp, Artificial sequence
  Extension Primer
ataaaacatccctcacactccaact

SEQ ID NO: 9359 - DNA, 25 bp, Artificial sequence
  Extension Primer
ggcagtgtctagacatacacggttc

SEQ ID NO: 9360 - DNA, 25 bp, Artificial sequence
  Extension Primer
gtagcttttctttgaactagacatc

SEQ ID NO: 9361 - DNA, 25 bp, Artificial sequence
  Extension Primer
cttgactgacagtctctctaaagtt

SEQ ID NO: 9362 - DNA, 25 bp, Artificial sequence
  Extension Primer
ggaaaaaaaaaaaaaacagaagatg

SEQ ID NO: 9363 - DNA, 25 bp, Artificial sequence
  Extension Primer
agaatcaaaactgacccattttggt

SEQ ID NO: 9364 - DNA, 25 bp, Artificial sequence
  Extension Primer
tttacagcatcctctagtaccccca

SEQ ID NO: 9365 - DNA, 25 bp, Artificial sequence
  Extension Primer
ttgtgttcttttacacaaatgagtg

SEQ ID NO: 9366 - DNA, 25 bp, Artificial sequence
  Extension Primer
gaagactcaacatattttctccctt

SEQ ID NO: 9367 - DNA, 25 bp, Artificial sequence
  Extension Primer
ttcatgaggagcctgcctgagagac

SEQ ID NO: 9368 - DNA, 25 bp, Artificial sequence
  Extension Primer
ttactagctgcatgatggtaggcaa

SEQ ID NO: 9369 - DNA, 25 bp, Artificial sequence
  Extension Primer
aacatgagggttttgcagtgtgctt

SEQ ID NO: 9370 - DNA, 25 bp, Artificial sequence
  Extension Primer
aagcacatttatagagtcccgtcac

SEQ ID NO: 9371 - DNA, 25 bp, Artificial sequence
  Extension Primer
taacttcaatcataatttctataca

SEQ ID NO: 9372 - DNA, 25 bp, Artificial sequence
  Extension Primer
gatgaagaaggattcctaagggctt

SEQ ID NO: 9373 - DNA, 25 bp, Artificial sequence
  Extension Primer
acacaggacactggagaacctggca

SEQ ID NO: 9374 - DNA, 25 bp, Artificial sequence
  Extension Primer
ccccaaccatctatgtccaatacaa

SEQ ID NO: 9375 - DNA, 25 bp, Artificial sequence
  Extension Primer
gtcaaaactccacggactcttctca

SEQ ID NO: 9376 - DNA, 25 bp, Artificial sequence
  Extension Primer
ctgctaaattataagaaatccccaa

SEQ ID NO: 9377 - DNA, 25 bp, Artificial sequence
  Extension Primer
ggagctgggctcaatgatctgataa

SEQ ID NO: 9378 - DNA, 25 bp, Artificial sequence
  Extension Primer
aattttgccacatttaaatactaat

SEQ ID NO: 9379 - DNA, 25 bp, Artificial sequence
  Extension Primer
tacttctttggaaagcccatgtttt

SEQ ID NO: 9380 - DNA, 25 bp, Artificial sequence
  Extension Primer
aagagcttattcttggatgggacac

SEQ ID NO: 9381 - DNA, 25 bp, Artificial sequence
  Extension Primer
ggatacgttacaaattcaaagaccc

SEQ ID NO: 9382 - DNA, 25 bp, Artificial sequence
  Extension Primer
cctcattctccatgaagcaagatgt

SEQ ID NO: 9383 - DNA, 25 bp, Artificial sequence
  Extension Primer
attccttccagattctgttattatt

SEQ ID NO: 9384 - DNA, 25 bp, Artificial sequence
  Extension Primer
cagatctgccagcccctcttttacc

SEQ ID NO: 9385 - DNA, 25 bp, Artificial sequence
  Extension Primer
ttttatctgattttcaggtgttcta

SEQ ID NO: 9386 - DNA, 25 bp, Artificial sequence
  Extension Primer
ctattcgatgctcagttagacacac

SEQ ID NO: 9387 - DNA, 25 bp, Artificial sequence
  Extension Primer
atcttgtgataaaccataatggaaa

SEQ ID NO: 9388 - DNA, 25 bp, Artificial sequence
  Extension Primer
tcaaaagaatcaaaacactgatgtt

SEQ ID NO: 9389 - DNA, 25 bp, Artificial sequence
  Extension Primer
atgtaaagtggtgaacacaattaga

SEQ ID NO: 9390 - DNA, 25 bp, Artificial sequence
  Extension Primer
tgcacctaaaattttgttgggttct

SEQ ID NO: 9391 - DNA, 25 bp, Artificial sequence
  Extension Primer
tgagccatgcaaataatttggatgc

SEQ ID NO: 9392 - DNA, 25 bp, Artificial sequence
  Extension Primer
agggmacataaaccatgagatattt

SEQ ID NO: 9393 - DNA, 25 bp, Artificial sequence
  Extension Primer
agcaggaaactacagatatagagac

SEQ ID NO: 9394 - DNA, 25 bp, Artificial sequence
  Extension Primer
aatgaatgcataaatgtggtaaaca

SEQ ID NO: 9395 - DNA, 25 bp, Artificial sequence
  Extension Primer
ctggattagaatggtgaaagtatga

SEQ ID NO: 9396 - DNA, 25 bp, Artificial sequence
  Extension Primer
agacagacgttgaacgagcaaggag

SEQ ID NO: 9397 - DNA, 25 bp, Artificial sequence
  Extension Primer
ttccaataatttaaaggagtgaaaa

SEQ ID NO: 9398 - DNA, 25 bp, Artificial sequence
  Extension Primer
tcatatacatttcaaacacaatccc

SEQ ID NO: 9399 - DNA, 25 bp, Artificial sequence
  Extension Primer
aggccttctgstgctggccacccac

SEQ ID NO: 9400 - DNA, 25 bp, Artificial sequence
  Extension Primer
actcagagtccttcctggtggagca

SEQ ID NO: 9401 - DNA, 25 bp, Artificial sequence
  Extension Primer
tttctcctgtcagagtgtgctttca

SEQ ID NO: 9402 - DNA, 25 bp, Artificial sequence
  Extension Primer
aagcaaggaaaccaacattctctgg

SEQ ID NO: 9403 - DNA, 25 bp, Artificial sequence
  Extension Primer
taaactgttccctgacatcaggtga

SEQ ID NO: 9404 - DNA, 25 bp, Artificial sequence
  Extension Primer
tctgagtgatctccaaaacagactg

SEQ ID NO: 9405 - DNA, 25 bp, Artificial sequence
  Extension Primer
tttgattctgccatctaacaagcca

SEQ ID NO: 9406 - DNA, 25 bp, Artificial sequence
  Extension Primer
gaaaaagctccggcagttggccact

SEQ ID NO: 9407 - DNA, 25 bp, Artificial sequence
  Extension Primer
gctgggcttttccctgactccctca

SEQ ID NO: 9408 - DNA, 25 bp, Artificial sequence
  Extension Primer
aaatattaatagcatgagatttagg

SEQ ID NO: 9409 - DNA, 25 bp, Artificial sequence
  Extension Primer
aacaggacaacagattgctcttcag

SEQ ID NO: 9410 - DNA, 25 bp, Artificial sequence
  Extension Primer
tgtgggccccatgaggcagcactcc

SEQ ID NO: 9411 - DNA, 25 bp, Artificial sequence
  Extension Primer
taggtaaactatatccaagaattac

SEQ ID NO: 9412 - DNA, 25 bp, Artificial sequence
  Extension Primer
ccaagtagcacaggcaagatagaga

SEQ ID NO: 9413 - DNA, 25 bp, Artificial sequence
  Extension Primer
gcaaatatgaatacgtagagtctac

SEQ ID NO: 9414 - DNA, 25 bp, Artificial sequence
  Extension Primer
gtattttaaaaacatcacccagcct

SEQ ID NO: 9415 - DNA, 25 bp, Artificial sequence
  Extension Primer
gaggccctcagagttacaagtaaac

SEQ ID NO: 9416 - DNA, 25 bp, Artificial sequence
  Extension Primer
atttaagggacttgcctggagtcac

SEQ ID NO: 9417 - DNA, 25 bp, Artificial sequence
  Extension Primer
attcagataggttataagtaaaaat

SEQ ID NO: 9418 - DNA, 25 bp, Artificial sequence
  Extension Primer
atgaagcctgagggatctggttctc

SEQ ID NO: 9419 - DNA, 25 bp, Artificial sequence
  Extension Primer
tgtctttgcccaacactatttctta

SEQ ID NO: 9420 - DNA, 25 bp, Artificial sequence
  Extension Primer
cagttgttcaaggaggaagaggaga

SEQ ID NO: 9421 - DNA, 25 bp, Artificial sequence
  Extension Primer
agatgatgaatgataattaaagtta

SEQ ID NO: 9422 - DNA, 25 bp, Artificial sequence
  Extension Primer
aaagtgaaagtttgccacagtgtac

SEQ ID NO: 9423 - DNA, 25 bp, Artificial sequence
  Extension Primer
gttttctgtgctcgtaaattaaaca

SEQ ID NO: 9424 - DNA, 25 bp, Artificial sequence
  Extension Primer
catttggtctgtttcagcaggtggt

SEQ ID NO: 9425 - DNA, 25 bp, Artificial sequence
  Extension Primer
tgagaagggcagggatgcacaggca

SEQ ID NO: 9426 - DNA, 25 bp, Artificial sequence
  Extension Primer
ataaaatggttaaaatggtaacttt

SEQ ID NO: 9427 - DNA, 25 bp, Artificial sequence
  Extension Primer
ctatgttataaaccaaatattcatg

SEQ ID NO: 9428 - DNA, 25 bp, Artificial sequence
  Extension Primer
ggtaccataatgtgggggatggggc

SEQ ID NO: 9429 - DNA, 25 bp, Artificial sequence
  Extension Primer
cactgtatttcaccaccatataccc

SEQ ID NO: 9430 - DNA, 25 bp, Artificial sequence
  Extension Primer
ttccaagtgagtgagaactctyggc

SEQ ID NO: 9431 - DNA, 25 bp, Artificial sequence
  Extension Primer
agtctccatctctactccacccaat

SEQ ID NO: 9432 - DNA, 25 bp, Artificial sequence
  Extension Primer
cctatgccatcagctctccagctct

SEQ ID NO: 9433 - DNA, 25 bp, Artificial sequence
  Extension Primer
atatcttagtagtagaaattataca

SEQ ID NO: 9434 - DNA, 25 bp, Artificial sequence
  Extension Primer
acattaacacaaaactgctttgata

SEQ ID NO: 9435 - DNA, 25 bp, Artificial sequence
  Extension Primer
acacacagacacagacatgctagtt

SEQ ID NO: 9436 - DNA, 25 bp, Artificial sequence
  Extension Primer
ggatgattgcttctgagtcatttgc

SEQ ID NO: 9437 - DNA, 25 bp, Artificial sequence
  Extension Primer
tctggccatgatgctaaagggtcac

SEQ ID NO: 9438 - DNA, 25 bp, Artificial sequence
  Extension Primer
ggtaccgtagggctcatatattagc

SEQ ID NO: 9439 - DNA, 25 bp, Artificial sequence
  Extension Primer
atatggtaaatccaccaaacaatta

SEQ ID NO: 9440 - DNA, 25 bp, Artificial sequence
  Extension Primer
cacgagacgagacgagtggaggggc

SEQ ID NO: 9441 - DNA, 25 bp, Artificial sequence
  Extension Primer
gccaggaacccatttccatggcaac

SEQ ID NO: 9442 - DNA, 25 bp, Artificial sequence
  Extension Primer
ctagtacagatcagcctgccatcca

SEQ ID NO: 9443 - DNA, 25 bp, Artificial sequence
  Extension Primer
atacacacatacacataaaataaaa

SEQ ID NO: 9444 - DNA, 25 bp, Artificial sequence
  Extension Primer
gactattttaataaactccaggcaa

SEQ ID NO: 9445 - DNA, 25 bp, Artificial sequence
  Extension Primer
aaaacatggtgtgactacaatggaa

SEQ ID NO: 9446 - DNA, 25 bp, Artificial sequence
  Extension Primer
attggatgcttactattgttcatat

SEQ ID NO: 9447 - DNA, 25 bp, Artificial sequence
  Extension Primer
aagaaatttttaaactcctgctccc

SEQ ID NO: 9448 - DNA, 25 bp, Artificial sequence
  Extension Primer
cattgctcacgtgctaggtgcggac

SEQ ID NO: 9449 - DNA, 25 bp, Artificial sequence
  Extension Primer
aagcacatttatagagtcccgtcac

SEQ ID NO: 9450 - DNA, 25 bp, Artificial sequence
  Extension Primer
taatcccgctactgccccactcaac

SEQ ID NO: 9451 - DNA, 22 bp, Artificial sequence
  Extension Primer
agggactccttcaccctcatct

SEQ ID NO: 9452 - DNA, 25 bp, Artificial sequence
  Extension Primer
atcatatcaacgaattaaccaaaat

SEQ ID NO: 9453 - DNA, 25 bp, Artificial sequence
  Extension Primer
aaaattacctacagtttggctctta

SEQ ID NO: 9454 - DNA, 25 bp, Artificial sequence
  Extension Primer
aatgaaacgcacgtccactgctgag

SEQ ID NO: 9455 - DNA, 25 bp, Artificial sequence
  Extension Primer
tactagaaatatgccaaaataacac

SEQ ID NO: 9456 - DNA, 25 bp, Artificial sequence
  Extension Primer
taagctgagtaataggtacattttt

SEQ ID NO: 9457 - DNA, 25 bp, Artificial sequence
  Extension Primer
cctgcactgtggtcccttgctggtt

SEQ ID NO: 9458 - DNA, 25 bp, Artificial sequence
  Extension Primer
ctgtcctccgtagtggctgtatcaa

SEQ ID NO: 9459 - DNA, 25 bp, Artificial sequence
  Extension Primer
ttccacaaagcacacgctgaagaga

SEQ ID NO: 9460 - DNA, 25 bp, Artificial sequence
  Extension Primer
gatcaagacatwtcaaactttcttt

SEQ ID NO: 9461 - DNA, 25 bp, Artificial sequence
  Extension Primer
gacatwtcaaactttctttrggagt

SEQ ID NO: 9462 - DNA, 25 bp, Artificial sequence
  Extension Primer
agaactgattcaaggtaacccactt

SEQ ID NO: 9463 - DNA, 25 bp, Artificial sequence
  Extension Primer
gtgctatattaatggcagtttattg

SEQ ID NO: 9464 - DNA, 25 bp, Artificial sequence
  Extension Primer
gcaaatatgaatacgtagagtctac

SEQ ID NO: 9465 - DNA, 25 bp, Artificial sequence
  Extension Primer
gtattttaaaaacatcacccagcct

SEQ ID NO: 9466 - DNA, 25 bp, Artificial sequence
  Extension Primer
gaggccctcagagttacaagtaaac

SEQ ID NO: 9467 - DNA, 25 bp, Artificial sequence
  Extension Primer
agatcacaagcctctgtttgtatca

SEQ ID NO: 9468 - DNA, 25 bp, Artificial sequence
  Extension Primer
tgtttagaagttgttaacattgggc

SEQ ID NO: 9469 - DNA, 25 bp, Artificial sequence
  Extension Primer
tatttgtggctttgcagtttgatct

SEQ ID NO: 9470 - DNA, 25 bp, Artificial sequence
  Extension Primer
cagtgctggctggtcatccatattt

SEQ ID NO: 9471 - DNA, 22 bp, Artificial sequence
  Extension Primer
aaatccacagataatctgttca

SEQ ID NO: 9472 - DNA, 25 bp, Artificial sequence
  Extension Primer
cggtctactgcactccccaccagca

SEQ ID NO: 9473 - DNA, 25 bp, Artificial sequence
  Extension Primer
tgggttgggaagatcccctggagga

SEQ ID NO: 9474 - DNA, 25 bp, Artificial sequence
  Extension Primer
aagagcttattcttggatgggacac

SEQ ID NO: 9475 - DNA, 25 bp, Artificial sequence
  Extension Primer
agagaaaacacatcatccatgtcca

SEQ ID NO: 9476 - DNA, 25 bp, Artificial sequence
  Extension Primer
attcagaggtaaacacattcatctt

SEQ ID NO: 9477 - DNA, 22 bp, Artificial sequence
  Extension Primer
cttttagtcaagtccaaaagta

SEQ ID NO: 9478 - DNA, 25 bp, Artificial sequence
  Extension Primer
atgcttaggagattgtgcagtgtaa

SEQ ID NO: 9479 - DNA, 25 bp, Artificial sequence
  Extension Primer
gtactccgtgttcacacgagttact

SEQ ID NO: 9480 - DNA, 25 bp, Artificial sequence
  Extension Primer
tcctcatttctcaccatcctcgcct

SEQ ID NO: 9481 - DNA, 25 bp, Artificial sequence
  Extension Primer
aagtcttcagtggttcctcaacaca

SEQ ID NO: 9482 - DNA, 25 bp, Artificial sequence
  Extension Primer
atagcaagccctaaataattttatg

SEQ ID NO: 9483 - DNA, 25 bp, Artificial sequence
  Extension Primer
atccagaaaattggattaaagrtat

SEQ ID NO: 9484 - DNA, 25 bp, Artificial sequence
  Extension Primer
tctcccttctgtttaatccaacctg

SEQ ID NO: 9485 - DNA, 25 bp, Artificial sequence
  Extension Primer
atttattgcttaagtgatgccatgc

SEQ ID NO: 9486 - DNA, 25 bp, Artificial sequence
  Extension Primer
gtcatatctggttctttgcaacccc

SEQ ID NO: 9487 - DNA, 25 bp, Artificial sequence
  Extension Primer
gagcgcggagtcgccagggcagagc

SEQ ID NO: 9488 - DNA, 25 bp, Artificial sequence
  Extension Primer
ttccatagttgaggcacacgggctc

SEQ ID NO: 9489 - DNA, 25 bp, Artificial sequence
  Extension Primer
tctcaggytcactggttcctgcatc

SEQ ID NO: 9490 - DNA, 25 bp, Artificial sequence
  Extension Primer
aaacctggggaccatggatattttt

SEQ ID NO: 9491 - DNA, 25 bp, Artificial sequence
  Extension Primer
acgggactttwgtgtacttacttca

SEQ ID NO: 9492 - DNA, 25 bp, Artificial sequence
  Extension Primer
atttaagggacttgcctggagtcac

SEQ ID NO: 9493 - DNA, 25 bp, Artificial sequence
  Extension Primer
attcagataggttataagtaaaaat

SEQ ID NO: 9494 - DNA, 25 bp, Artificial sequence
  Extension Primer
atgaagcctgagggatctggttctc

SEQ ID NO: 9495 - DNA, 25 bp, Artificial sequence
  Extension Primer
tgtctttgcccaacactatttctta

SEQ ID NO: 9496 - DNA, 25 bp, Artificial sequence
  Extension Primer
cagttgttcaaggaggaagaggaga

SEQ ID NO: 9497 - DNA, 25 bp, Artificial sequence
  Extension Primer
agatgatgaatgataattaaagtta

SEQ ID NO: 9498 - DNA, 25 bp, Artificial sequence
  Extension Primer
aaagtgaaagtttgccacagtgtac

SEQ ID NO: 9499 - DNA, 25 bp, Artificial sequence
  Extension Primer
gttttctgtgctcgtaaattaaaca

SEQ ID NO: 9500 - DNA, 25 bp, Artificial sequence
  Extension Primer
catttggtctgtttcagcaggtggt

SEQ ID NO: 9501 - DNA, 25 bp, Artificial sequence
  Extension Primer
tgagaagggcagggatgcacaggca

SEQ ID NO: 9502 - DNA, 25 bp, Artificial sequence
  Extension Primer
ataaaatggttaaaatggtaacttt

SEQ ID NO: 9503 - DNA, 25 bp, Artificial sequence
  Extension Primer
ctatgttataaaccaaatattcatg

SEQ ID NO: 9504 - DNA, 25 bp, Artificial sequence
  Extension Primer
ggtaccataatgtgggggatggggc

SEQ ID NO: 9505 - DNA, 25 bp, Artificial sequence
  Extension Primer
cactgtatttcaccaccatataccc

SEQ ID NO: 9506 - DNA, 22 bp, Artificial sequence
  Extension Primer
gtagaaaaagttaatattgata

SEQ ID NO: 9507 - DNA, 25 bp, Artificial sequence
  Extension Primer
tgaatcacaatttgttatataatac

SEQ ID NO: 9508 - DNA, 25 bp, Artificial sequence
  Extension Primer
catcaccgtcctatttatgcttggg

SEQ ID NO: 9509 - DNA, 25 bp, Artificial sequence
  Extension Primer
gtcttaccagtaggtatagaggcac

SEQ ID NO: 9510 - DNA, 25 bp, Artificial sequence
  Extension Primer
tttgttaaaaccagtaaagcaacac

SEQ ID NO: 9511 - DNA, 25 bp, Artificial sequence
  Extension Primer
cctatttcatagtctgtgaaacatc

SEQ ID NO: 9512 - DNA, 25 bp, Artificial sequence
  Extension Primer
tgagggaggcctccaaataacaacc

SEQ ID NO: 9513 - DNA, 25 bp, Artificial sequence
  Extension Primer
acatgtataaccttaatttcttaca

SEQ ID NO: 9514 - DNA, 25 bp, Artificial sequence
  Extension Primer
ttctatgtgaacttctttcgtgttg

SEQ ID NO: 9515 - DNA, 25 bp, Artificial sequence
  Extension Primer
atatctttcctgtcattactaattt

SEQ ID NO: 9516 - DNA, 25 bp, Artificial sequence
  Extension Primer
ctgggaacatgttaataatgctaat

SEQ ID NO: 9517 - DNA, 25 bp, Artificial sequence
  Extension Primer
atatgtgtttttttcagtcacttgt

SEQ ID NO: 9518 - DNA, 25 bp, Artificial sequence
  Extension Primer
ccaagcgtccatcattacagccccc

SEQ ID NO: 9519 - DNA, 25 bp, Artificial sequence
  Extension Primer
actcgtgtccagggaacaagagtag

SEQ ID NO: 9520 - DNA, 25 bp, Artificial sequence
  Extension Primer
ctgaatttaatttgtaccctcttat

SEQ ID NO: 9521 - DNA, 25 bp, Artificial sequence
  Extension Primer
tattgattggttgactgattagttc

SEQ ID NO: 9522 - DNA, 25 bp, Artificial sequence
  Extension Primer
tctctagttaacctatatatgaaac

SEQ ID NO: 9523 - DNA, 25 bp, Artificial sequence
  Extension Primer
agggcggtgggtgcctcaggtggca

SEQ ID NO: 9524 - DNA, 25 bp, Artificial sequence
  Extension Primer
aattctagaaactggatgtgctaaa

SEQ ID NO: 9525 - DNA, 25 bp, Artificial sequence
  Extension Primer
gtagggccagcaccatggactcagg

SEQ ID NO: 9526 - DNA, 25 bp, Artificial sequence
  Extension Primer
ccccaaccatctatgtccaatacaa

SEQ ID NO: 9527 - DNA, 25 bp, Artificial sequence
  Extension Primer
gagaattattttttacacctattca

SEQ ID NO: 9528 - DNA, 25 bp, Artificial sequence
  Extension Primer
attcctttgatcttgtattggtgct

SEQ ID NO: 9529 - DNA, 22 bp, Artificial sequence
  Extension Primer
ccaaagggtgaatgttccctgc

SEQ ID NO: 9530 - DNA, 25 bp, Artificial sequence
  Extension Primer
aggcctaggtatattcccatgaatg

SEQ ID NO: 9531 - DNA, 25 bp, Artificial sequence
  Extension Primer
acagcgctgtgtgagtttagggtat

SEQ ID NO: 9532 - DNA, 25 bp, Artificial sequence
  Extension Primer
taggagatatatatatatatagttt

SEQ ID NO: 9533 - DNA, 25 bp, Artificial sequence
  Extension Primer
cacwggggccaccaaggacgagacc

SEQ ID NO: 9534 - DNA, 25 bp, Artificial sequence
  Extension Primer
aacagggyccagagggccaggrtga

SEQ ID NO: 9535 - DNA, 25 bp, Artificial sequence
  Extension Primer
ataaaatagaaaggcagcctcggga

SEQ ID NO: 9536 - DNA, 25 bp, Artificial sequence
  Extension Primer
cacacttgaatgcttacagcaaatt

SEQ ID NO: 9537 - DNA, 25 bp, Artificial sequence
  Extension Primer
cctggggaaggaaggaaggatgtga

SEQ ID NO: 9538 - DNA, 25 bp, Artificial sequence
  Extension Primer
acctgcaacctgcgctgcggtgatg

SEQ ID NO: 9539 - DNA, 25 bp, Artificial sequence
  Extension Primer
gtcaaaactccacggactcttctca

SEQ ID NO: 9540 - DNA, 25 bp, Artificial sequence
  Extension Primer
ataatgtactaataatgtgatgtat

SEQ ID NO: 9541 - DNA, 25 bp, Artificial sequence
  Extension Primer
ctctccaggggtagaagaagcatga

SEQ ID NO: 9542 - DNA, 22 bp, Artificial sequence
  Extension Primer
ccctatacatatgtcaggtggc

SEQ ID NO: 9543 - DNA, 25 bp, Artificial sequence
  Extension Primer
aaagattgtgttttttaaaaactat

SEQ ID NO: 9544 - DNA, 25 bp, Artificial sequence
  Extension Primer
tatgggaggtgcctgtgtaacattt

SEQ ID NO: 9545 - DNA, 25 bp, Artificial sequence
  Extension Primer
cctgggagtggacgtgtgtgtctgt

SEQ ID NO: 9546 - DNA, 25 bp, Artificial sequence
  Extension Primer
aacatgagggttttgcagtgtgctt

SEQ ID NO: 9547 - DNA, 25 bp, Artificial sequence
  Extension Primer
gtgagctcctgagcctctatctcct

SEQ ID NO: 9548 - DNA, 25 bp, Artificial sequence
  Extension Primer
ttcctgcctttcacaccccagcaag

SEQ ID NO: 9549 - DNA, 25 bp, Artificial sequence
  Extension Primer
taacttcaatcataatttctataca

SEQ ID NO: 9550 - DNA, 25 bp, Artificial sequence
  Extension Primer
aggagggcccagagcatctggagag

SEQ ID NO: 9551 - DNA, 25 bp, Artificial sequence
  Extension Primer
ctgcctgattgaccagcggggctgc

SEQ ID NO: 9552 - DNA, 25 bp, Artificial sequence
  Extension Primer
acctgctacaaaaatgtagggaaaa

SEQ ID NO: 9553 - DNA, 25 bp, Artificial sequence
  Extension Primer
acattagtgaggaatagaataaaat

SEQ ID NO: 9554 - DNA, 25 bp, Artificial sequence
  Extension Primer
cattatcgggcagtagtagtggcaa

SEQ ID NO: 9555 - DNA, 25 bp, Artificial sequence
  Extension Primer
aggtaataattcagggttgttcact

SEQ ID NO: 9556 - DNA, 25 bp, Artificial sequence
  Extension Primer
gaacaagggtgagaacaaggagcca

SEQ ID NO: 9557 - DNA, 25 bp, Artificial sequence
  Extension Primer
catgggaccgaagaactgagttttc

SEQ ID NO: 9558 - DNA, 25 bp, Artificial sequence
  Extension Primer
caccctgccctggaaggtcccacac

SEQ ID NO: 9559 - DNA, 25 bp, Artificial sequence
  Extension Primer
actcagtttaggtcatctgcacacc

SEQ ID NO: 9560 - DNA, 25 bp, Artificial sequence
  Extension Primer
tgattttttttctttgagtcgacaa

SEQ ID NO: 9561 - DNA, 25 bp, Artificial sequence
  Extension Primer
ctgatagccagggccaggttgttta

SEQ ID NO: 9562 - DNA, 25 bp, Artificial sequence
  Extension Primer
caaaacccagtgctttatgacctgc

SEQ ID NO: 9563 - DNA, 25 bp, Artificial sequence
  Extension Primer
accttcatccccaccactgaagata

SEQ ID NO: 9564 - DNA, 25 bp, Artificial sequence
  Extension Primer
tctgtttatttcagacacacactaa

SEQ ID NO: 9565 - DNA, 25 bp, Artificial sequence
  Extension Primer
gcaataattcttgccctgtctatct

SEQ ID NO: 9566 - DNA, 25 bp, Artificial sequence
  Extension Primer
ggagctgggctcaatgatctgataa

SEQ ID NO: 9567 - DNA, 25 bp, Artificial sequence
  Extension Primer
ctcttctttctggtcacattgactg

SEQ ID NO: 9568 - DNA, 25 bp, Artificial sequence
  Extension Primer
gccccaatccagaacatgctcagga

SEQ ID NO: 9569 - DNA, 25 bp, Artificial sequence
  Extension Primer
ttttctcatcttttaaatgggagtg

SEQ ID NO: 9570 - DNA, 25 bp, Artificial sequence
  Extension Primer
ggttaacaccattttagagctcatg

SEQ ID NO: 9571 - DNA, 25 bp, Artificial sequence
  Extension Primer
agacaagaccctctcattcaaaatc

SEQ ID NO: 9572 - DNA, 25 bp, Artificial sequence
  Extension Primer
aggattgtctgggaagaggatctgt

SEQ ID NO: 9573 - DNA, 25 bp, Artificial sequence
  Extension Primer
tagaaattatcagacatcttcctac

SEQ ID NO: 9574 - DNA, 25 bp, Artificial sequence
  Extension Primer
tatttgttttcttataggtataaag

SEQ ID NO: 9575 - DNA, 22 bp, Artificial sequence
  Extension Primer
ttccagtcccaagagagctccc

SEQ ID NO: 9576 - DNA, 25 bp, Artificial sequence
  Extension Primer
ccctggctgagtgcctttcacatcc

SEQ ID NO: 9577 - DNA, 25 bp, Artificial sequence
  Extension Primer
gcttctacattttctcacttctcag

SEQ ID NO: 9578 - DNA, 25 bp, Artificial sequence
  Extension Primer
acgcgactctctgaaaatataatct

SEQ ID NO: 9579 - DNA, 25 bp, Artificial sequence
  Extension Primer
aagttgaattagtactgaaaaaaat

SEQ ID NO: 9580 - DNA, 25 bp, Artificial sequence
  Extension Primer
agatcttttactgccgagttattta

SEQ ID NO: 9581 - DNA, 25 bp, Artificial sequence
  Extension Primer
ccattggatattcaatgtgaaacaa

SEQ ID NO: 9582 - DNA, 25 bp, Artificial sequence
  Extension Primer
tttctagaagcattaacacgactgt

SEQ ID NO: 9583 - DNA, 25 bp, Artificial sequence
  Extension Primer
gcagttaatatcattgccaaaaaaa

SEQ ID NO: 9584 - DNA, 25 bp, Artificial sequence
  Extension Primer
ccctccaaatagatttcctggagat

SEQ ID NO: 9585 - DNA, 25 bp, Artificial sequence
  Extension Primer
tttcctttcttctctcacacatcat

SEQ ID NO: 9586 - DNA, 25 bp, Artificial sequence
  Extension Primer
ttcatggaccatcctgacctcgcct

SEQ ID NO: 9587 - DNA, 25 bp, Artificial sequence
  Extension Primer
ttattgaaataaaatacgtataaga

SEQ ID NO: 9588 - DNA, 25 bp, Artificial sequence
  Extension Primer
attgggcaggatacttgtagacaac

SEQ ID NO: 9589 - DNA, 25 bp, Artificial sequence
  Extension Primer
cacaccacccggcaagtgagtytca

SEQ ID NO: 9590 - DNA, 25 bp, Artificial sequence
  Extension Primer
tgaggcaaggaaaatgtggaccagg

SEQ ID NO: 9591 - DNA, 25 bp, Artificial sequence
  Extension Primer
attaaaaaatttcttctacataatc

SEQ ID NO: 9592 - DNA, 25 bp, Artificial sequence
  Extension Primer
aaatcatctagggtggagtgggaaa

SEQ ID NO: 9593 - DNA, 25 bp, Artificial sequence
  Extension Primer
cctgaaatctgcattgacttatatt

SEQ ID NO: 9594 - DNA, 25 bp, Artificial sequence
  Extension Primer
tcaggatactccagtgtccagcata

SEQ ID NO: 9595 - DNA, 25 bp, Artificial sequence
  Extension Primer
gacctgttaccagtatcgcagagaa

SEQ ID NO: 9596 - DNA, 25 bp, Artificial sequence
  Extension Primer
aacaatcagtgttttgggctgtgat

SEQ ID NO: 9597 - DNA, 25 bp, Artificial sequence
  Extension Primer
aactatacgttctagtgacaatggg

SEQ ID NO: 9598 - DNA, 25 bp, Artificial sequence
  Extension Primer
gtgaagacaagatttgagtgcagga

SEQ ID NO: 9599 - DNA, 25 bp, Artificial sequence
  Extension Primer
atggtcatgcttgtcatggcgttgt

SEQ ID NO: 9600 - DNA, 25 bp, Artificial sequence
  Extension Primer
tctgcagrtgggaggggtgctttta

SEQ ID NO: 9601 - DNA, 25 bp, Artificial sequence
  Extension Primer
ggctctcagctctactgcctgcaat

SEQ ID NO: 9602 - DNA, 25 bp, Artificial sequence
  Extension Primer
atgatgggagctaaacgcctgctaa

SEQ ID NO: 9603 - DNA, 25 bp, Artificial sequence
  Extension Primer
aattgaggtgcaatagggagagagg

SEQ ID NO: 9604 - DNA, 25 bp, Artificial sequence
  Extension Primer
tcggaatactcaagtaagtgaaggg

SEQ ID NO: 9605 - DNA, 25 bp, Artificial sequence
  Extension Primer
tcagaagccaatgcctccacttyca

SEQ ID NO: 9606 - DNA, 25 bp, Artificial sequence
  Extension Primer
agaacagttttgtggttgccaaagc

SEQ ID NO: 9607 - DNA, 25 bp, Artificial sequence
  Extension Primer
aatgcaatgtagatgagaattggga

SEQ ID NO: 9608 - DNA, 25 bp, Artificial sequence
  Extension Primer
ggaccatcagggaagtcccagcctt

SEQ ID NO: 9609 - DNA, 25 bp, Artificial sequence
  Extension Primer
ccgcayggattccaaggccaagtya

SEQ ID NO: 9610 - DNA, 25 bp, Artificial sequence
  Extension Primer
ccagggtgagacaggaatcaagtcc

SEQ ID NO: 9611 - DNA, 25 bp, Artificial sequence
  Extension Primer
aagtgggtgggggagatttcttaca

SEQ ID NO: 9612 - DNA, 25 bp, Artificial sequence
  Extension Primer
tcaggcctgtgaccacaggctcttk

SEQ ID NO: 9613 - DNA, 25 bp, Artificial sequence
  Extension Primer
ctttgatatacttgttgctgaagaa

SEQ ID NO: 9614 - DNA, 25 bp, Artificial sequence
  Extension Primer
tcaatggcagcacattttatctatg

SEQ ID NO: 9615 - DNA, 25 bp, Artificial sequence
  Extension Primer
aagagtaatatgagagcgtctacyc

SEQ ID NO: 9616 - DNA, 25 bp, Artificial sequence
  Extension Primer
aaaggctgttttcagccagtctggg

SEQ ID NO: 9617 - DNA, 25 bp, Artificial sequence
  Extension Primer
gtagtgggtaatggtggagaaaata

SEQ ID NO: 9618 - DNA, 25 bp, Artificial sequence
  Extension Primer
tttcctgaaatcattctagcaaact

SEQ ID NO: 9619 - DNA, 25 bp, Artificial sequence
  Extension Primer
ttgtagactgcaggttagctgtgtc

SEQ ID NO: 9620 - DNA, 22 bp, Artificial sequence
  Extension Primer
attctaaggtaatgtagacccc

SEQ ID NO: 9621 - DNA, 25 bp, Artificial sequence
  Extension Primer
ctttttcctgttcttcctgcctaca

SEQ ID NO: 9622 - DNA, 25 bp, Artificial sequence
  Extension Primer
actctcaaggactcctgttctcctc

SEQ ID NO: 9623 - DNA, 25 bp, Artificial sequence
  Extension Primer
ttcatgggaccactggacagctggc

SEQ ID NO: 9624 - DNA, 25 bp, Artificial sequence
  Extension Primer
cttaaagagacatctaactaatgct

SEQ ID NO: 9625 - DNA, 25 bp, Artificial sequence
  Extension Primer
acaaagagcagaagtaattatgatt

SEQ ID NO: 9626 - DNA, 25 bp, Artificial sequence
  Extension Primer
gttatattaaaaagtagaggcatta

SEQ ID NO: 9627 - DNA, 25 bp, Artificial sequence
  Extension Primer
gttcttccatgagatgcagtctctc

SEQ ID NO: 9628 - DNA, 25 bp, Artificial sequence
  Extension Primer
gtaagtaagttaagcctaattwtga

SEQ ID NO: 9629 - DNA, 25 bp, Artificial sequence
  Extension Primer
tcayatactacgtaagccgcttgtt

SEQ ID NO: 9630 - DNA, 25 bp, Artificial sequence
  Extension Primer
gatcttccctgatctgatttcacga

SEQ ID NO: 9631 - DNA, 25 bp, Artificial sequence
  Extension Primer
ggaagtggaagctgagggagattaa

SEQ ID NO: 9632 - DNA, 25 bp, Artificial sequence
  Extension Primer
tacaaagcagccctgtccattcttg

SEQ ID NO: 9633 - DNA, 25 bp, Artificial sequence
  Extension Primer
ccccacttgctgctaggttctgtcc

SEQ ID NO: 9634 - DNA, 25 bp, Artificial sequence
  Extension Primer
ttggcgaccctctcagggccatgag

SEQ ID NO: 9635 - DNA, 25 bp, Artificial sequence
  Extension Primer
tatgggatacatgccaaaactgatt

SEQ ID NO: 9636 - DNA, 25 bp, Artificial sequence
  Extension Primer
aatgagggatccggacaagagcgtg

SEQ ID NO: 9637 - DNA, 25 bp, Artificial sequence
  Extension Primer
tacagaaaagctaccttgggagtca

SEQ ID NO: 9638 - DNA, 25 bp, Artificial sequence
  Extension Primer
ctgctaaattataagaaatccccaa

SEQ ID NO: 9639 - DNA, 25 bp, Artificial sequence
  Extension Primer
acacctccaataragccccatcaag

SEQ ID NO: 9640 - DNA, 25 bp, Artificial sequence
  Extension Primer
ccactggcagaagccccatgasaac

SEQ ID NO: 9641 - DNA, 25 bp, Artificial sequence
  Extension Primer
atttcaaaatattgaggtagtctcc

SEQ ID NO: 9642 - DNA, 25 bp, Artificial sequence
  Extension Primer
ctttccctccacctgtgtgtatgac

SEQ ID NO: 9643 - DNA, 25 bp, Artificial sequence
  Extension Primer
gtgttcttccaaaatgaacatattc

SEQ ID NO: 9644 - DNA, 25 bp, Artificial sequence
  Extension Primer
agagcagactagggagaggacattt

SEQ ID NO: 9645 - DNA, 25 bp, Artificial sequence
  Extension Primer
actgtctataatgacaaaagattta

SEQ ID NO: 9646 - DNA, 25 bp, Artificial sequence
  Extension Primer
tccttcaacccatcttctattctgg

SEQ ID NO: 9647 - DNA, 25 bp, Artificial sequence
  Extension Primer
tgcttcctgccctaccctggctcct

SEQ ID NO: 9648 - DNA, 25 bp, Artificial sequence
  Extension Primer
caacctgtttgactttttagatttt

SEQ ID NO: 9649 - DNA, 25 bp, Artificial sequence
  Extension Primer
agggaacagtgatatgaagcagtta

SEQ ID NO: 9650 - DNA, 25 bp, Artificial sequence
  Extension Primer
ttgtgaggatgcagcaaatgacttg

SEQ ID NO: 9651 - DNA, 25 bp, Artificial sequence
  Extension Primer
ctcctcttaatgtcttttcatttct

SEQ ID NO: 9652 - DNA, 25 bp, Artificial sequence
  Extension Primer
gcctgcaggaaatgccccagctagt

SEQ ID NO: 9653 - DNA, 25 bp, Artificial sequence
  Extension Primer
gcctgttaaggccacgtctcctccg

SEQ ID NO: 9654 - DNA, 25 bp, Artificial sequence
  Extension Primer
taataacaacaacaaaaacagaagt

SEQ ID NO: 9655 - DNA, 25 bp, Artificial sequence
  Extension Primer
gttgcccaagggtgttttatatctt

SEQ ID NO: 9656 - DNA, 25 bp, Artificial sequence
  Extension Primer
aacccaagctagctatttcctatcc

SEQ ID NO: 9657 - DNA, 25 bp, Artificial sequence
  Extension Primer
gcacaaccctttcatgagcaaagca

SEQ ID NO: 9658 - DNA, 25 bp, Artificial sequence
  Extension Primer
gtgctcattgaggctgtcaggatgc

SEQ ID NO: 9659 - DNA, 25 bp, Artificial sequence
  Extension Primer
atatttcatctgtggacaaaactct

SEQ ID NO: 9660 - DNA, 25 bp, Artificial sequence
  Extension Primer
aagggtccaggttcaatccctggtc

SEQ ID NO: 9661 - DNA, 25 bp, Artificial sequence
  Extension Primer
cagccccttttgctaaaaaaaagag

SEQ ID NO: 9662 - DNA, 25 bp, Artificial sequence
  Extension Primer
taactaatgactgcagaaagctact

SEQ ID NO: 9663 - DNA, 25 bp, Artificial sequence
  Extension Primer
gaactaggctgagagtccaccacca

SEQ ID NO: 9664 - DNA, 25 bp, Artificial sequence
  Extension Primer
gcgggctgttgtaaaggaagctgct

SEQ ID NO: 9665 - DNA, 25 bp, Artificial sequence
  Extension Primer
attaatctctgcactggaattttag

SEQ ID NO: 9666 - DNA, 25 bp, Artificial sequence
  Extension Primer
gtagtaggaaagggtgatagaacaa

SEQ ID NO: 9667 - DNA, 25 bp, Artificial sequence
  Extension Primer
agagacacagtttgatattcagaga

SEQ ID NO: 9668 - DNA, 25 bp, Artificial sequence
  Extension Primer
cagccaaaggctgcattctctaaga

SEQ ID NO: 9669 - DNA, 25 bp, Artificial sequence
  Extension Primer
agaatctgaatatattcatcgaatc

SEQ ID NO: 9670 - DNA, 25 bp, Artificial sequence
  Extension Primer
cgcaccacccaaaccagccctaaac

SEQ ID NO: 9671 - DNA, 25 bp, Artificial sequence
  Extension Primer
cctctttattataaggtttggaaag

SEQ ID NO: 9672 - DNA, 25 bp, Artificial sequence
  Extension Primer
atccttgtgtccccagcacccagca

SEQ ID NO: 9673 - DNA, 25 bp, Artificial sequence
  Extension Primer
attgtttccattaatttcaacttgg

SEQ ID NO: 9674 - DNA, 25 bp, Artificial sequence
  Extension Primer
gattactacatggacttgtccctgc

SEQ ID NO: 9675 - DNA, 25 bp, Artificial sequence
  Extension Primer
ttcccccaggaacttatattgtgac

SEQ ID NO: 9676 - DNA, 25 bp, Artificial sequence
  Extension Primer
agggtgagtcaaagcttttgtttct

SEQ ID NO: 9677 - DNA, 25 bp, Artificial sequence
  Extension Primer
gaatctccttctcaaactacatcat

SEQ ID NO: 9678 - DNA, 25 bp, Artificial sequence
  Extension Primer
acccctgttccctacagtrgaagca

SEQ ID NO: 9679 - DNA, 25 bp, Artificial sequence
  Extension Primer
agaatggatatgcggggaggtggga

SEQ ID NO: 9680 - DNA, 25 bp, Artificial sequence
  Extension Primer
gttaaaacaaacaaacaaaaattcc

SEQ ID NO: 9681 - DNA, 25 bp, Artificial sequence
  Extension Primer
gggagctactgataccaaggagaac

SEQ ID NO: 9682 - DNA, 25 bp, Artificial sequence
  Extension Primer
tttagttaggactctaagctatttt

SEQ ID NO: 9683 - DNA, 22 bp, Artificial sequence
  Extension Primer
ctggctgtaaagcagtgggtca

SEQ ID NO: 9684 - DNA, 25 bp, Artificial sequence
  Extension Primer
tgttaaggaacacagagactagtgt

SEQ ID NO: 9685 - DNA, 25 bp, Artificial sequence
  Extension Primer
tattcgattcagtagaaacagaatt

SEQ ID NO: 9686 - DNA, 25 bp, Artificial sequence
  Extension Primer
agcaggacaaagggagagaaaacaa

SEQ ID NO: 9687 - DNA, 25 bp, Artificial sequence
  Extension Primer
ggtgtggatggccgccttggagcag

SEQ ID NO: 9688 - DNA, 25 bp, Artificial sequence
  Extension Primer
cttgcatggcagctcaggacttgag

SEQ ID NO: 9689 - DNA, 25 bp, Artificial sequence
  Extension Primer
caggtagaaattcacaatggaaatt

SEQ ID NO: 9690 - DNA, 25 bp, Artificial sequence
  Extension Primer
cctcagcaccattaaagagaaatat

SEQ ID NO: 9691 - DNA, 25 bp, Artificial sequence
  Extension Primer
gattgaggagaactctcataccacc

SEQ ID NO: 9692 - DNA, 25 bp, Artificial sequence
  Extension Primer
gcaaatgtgttagtggagatcctga

SEQ ID NO: 9693 - DNA, 25 bp, Artificial sequence
  Extension Primer
aattacactgtctccatcccccaag

SEQ ID NO: 9694 - DNA, 25 bp, Artificial sequence
  Extension Primer
agttttaggtgtgttctgattgggg

SEQ ID NO: 9695 - DNA, 25 bp, Artificial sequence
  Extension Primer
agaaaatcctgctgtcccttacccc

SEQ ID NO: 9696 - DNA, 25 bp, Artificial sequence
  Extension Primer
aatataatttgaaacattctagttt

SEQ ID NO: 9697 - DNA, 25 bp, Artificial sequence
  Extension Primer
acagaaagatcaatagttcactcca

SEQ ID NO: 9698 - DNA, 25 bp, Artificial sequence
  Extension Primer
acacagagccaggggttaagctacc

SEQ ID NO: 9699 - DNA, 22 bp, Artificial sequence
  Extension Primer
tttttgcttttgccttaatgcc

SEQ ID NO: 9700 - DNA, 25 bp, Artificial sequence
  Extension Primer
gaacttcccaatttttatgtaatac

SEQ ID NO: 9701 - DNA, 25 bp, Artificial sequence
  Extension Primer
acacaggacactggagaacctggca

SEQ ID NO: 9702 - DNA, 25 bp, Artificial sequence
  Extension Primer
gtttatcaagtattttgttaagtat

SEQ ID NO: 9703 - DNA, 25 bp, Artificial sequence
  Extension Primer
aagttaaagaagttaaagtctttgt

SEQ ID NO: 9704 - DNA, 25 bp, Artificial sequence
  Extension Primer
tgaggataaaatgagacagtgatgt

SEQ ID NO: 9705 - DNA, 25 bp, Artificial sequence
  Extension Primer
attcaaatctctgtccttcaccagg

SEQ ID NO: 9706 - DNA, 25 bp, Artificial sequence
  Extension Primer
aatctccaggcctgaaaaacaaatc

SEQ ID NO: 9707 - DNA, 25 bp, Artificial sequence
  Extension Primer
ttcaacttttattttctcactaaca

SEQ ID NO: 9708 - DNA, 25 bp, Artificial sequence
  Extension Primer
cccatgttgactacttttacagaaa

SEQ ID NO: 9709 - DNA, 25 bp, Artificial sequence
  Extension Primer
taccttaggtcttatttccacccct

SEQ ID NO: 9710 - DNA, 25 bp, Artificial sequence
  Extension Primer
ttttttagtgctatcttaaagcagt

SEQ ID NO: 9711 - DNA, 25 bp, Artificial sequence
  Extension Primer
ccaggacactcattttggcctacag

SEQ ID NO: 9712 - DNA, 25 bp, Artificial sequence
  Extension Primer
ccccagctattgtgcatccggaagt

SEQ ID NO: 9713 - DNA, 25 bp, Artificial sequence
  Extension Primer
ctcaccacaaaccctagcagtacat

SEQ ID NO: 9714 - DNA, 25 bp, Artificial sequence
  Extension Primer
taagattgtttataaaccatgagaa

SEQ ID NO: 9715 - DNA, 25 bp, Artificial sequence
  Extension Primer
attccttccagattctgttattatt

SEQ ID NO: 9716 - DNA, 25 bp, Artificial sequence
  Extension Primer
atgtcaagtgctggagagccgtcac

SEQ ID NO: 9717 - DNA, 25 bp, Artificial sequence
  Extension Primer
aaaatgcctccgtgtttctcacact

SEQ ID NO: 9718 - DNA, 25 bp, Artificial sequence
  Extension Primer
ctcagaggcagaagaaggtttctag

SEQ ID NO: 9719 - DNA, 25 bp, Artificial sequence
  Extension Primer
gttgagggaacaggattatttatgc

SEQ ID NO: 9720 - DNA, 25 bp, Artificial sequence
  Extension Primer
taaagtgttaggttggtgagctgtc

SEQ ID NO: 9721 - DNA, 25 bp, Artificial sequence
  Extension Primer
agtgccacagggggacctgcttgcc

SEQ ID NO: 9722 - DNA, 25 bp, Artificial sequence
  Extension Primer
taaagcaataccaaacattttatct

SEQ ID NO: 9723 - DNA, 25 bp, Artificial sequence
  Extension Primer
gatgaagaaggattcctaagggctt

SEQ ID NO: 9724 - DNA, 25 bp, Artificial sequence
  Extension Primer
gaatcctcctgcagtacagtagagc

SEQ ID NO: 9725 - DNA, 25 bp, Artificial sequence
  Extension Primer
ttcttaaaagcatttctaaaaattg

SEQ ID NO: 9726 - DNA, 25 bp, Artificial sequence
  Extension Primer
tcttaattatcttgactttccattt

SEQ ID NO: 9727 - DNA, 25 bp, Artificial sequence
  Extension Primer
tacttctttggaaagcccatgtttt

SEQ ID NO: 9728 - DNA, 25 bp, Artificial sequence
  Extension Primer
cctcattctccatgaagcaagatgt

SEQ ID NO: 9729 - DNA, 25 bp, Artificial sequence
  Extension Primer
aggtttggtatgtggtatgaggaga

SEQ ID NO: 9730 - DNA, 25 bp, Artificial sequence
  Extension Primer
agggagtcatgagacataggaagta

SEQ ID NO: 9731 - DNA, 25 bp, Artificial sequence
  Extension Primer
tattttcagagaaaaattgtgctgc

SEQ ID NO: 9732 - DNA, 22 bp, Artificial sequence
  Extension Primer
gccacaccagatcgaggccacc

SEQ ID NO: 9733 - DNA, 25 bp, Artificial sequence
  Extension Primer
tagtaaacaaatcatttgaaattca

SEQ ID NO: 9734 - DNA, 25 bp, Artificial sequence
  Extension Primer
tcactgagagtatggatgacatgct

SEQ ID NO: 9735 - DNA, 25 bp, Artificial sequence
  Extension Primer
aacaaccttatactaggtacaatgt

SEQ ID NO: 9736 - DNA, 25 bp, Artificial sequence
  Extension Primer
gaaatacagatgaaaagtagaaggt

SEQ ID NO: 9737 - DNA, 24 bp, Artificial sequence
  Reverse Primer
acttttgtccctcagcatactact

SEQ ID NO: 9738 - DNA, 22 bp, Artificial sequence
  Reverse Primer
ttacagtagcaggtggaaaaac

SEQ ID NO: 9739 - DNA, 26 bp, Artificial sequence
  Reverse Primer
ttttatatctcttcccctgagtagtg

SEQ ID NO: 9740 - DNA, 26 bp, Artificial sequence
  Reverse Primer
aattaattagcatagaaagaggtcca

SEQ ID NO: 9741 - DNA, 23 bp, Artificial sequence
  Reverse Primer
tgtgaaaaaatgaaaatgacgtt

SEQ ID NO: 9742 - DNA, 24 bp, Artificial sequence
  Reverse Primer
attagaaaaaactgtcaccatcct

SEQ ID NO: 9743 - DNA, 22 bp, Artificial sequence
  Reverse Primer
atatttcaaggtgaggctgatg

SEQ ID NO: 9744 - DNA, 18 bp, Artificial sequence
  Reverse Primer
agcagggaaggcagtgaa

SEQ ID NO: 9745 - DNA, 22 bp, Artificial sequence
  Reverse Primer
tatctgctttcagagatttccc

SEQ ID NO: 9746 - DNA, 18 bp, Artificial sequence
  Reverse Primer
caaggccaatcgatggaa

SEQ ID NO: 9747 - DNA, 18 bp, Artificial sequence
  Reverse Primer
aacatgtccaagtggccg

SEQ ID NO: 9748 - DNA, 24 bp, Artificial sequence
  Reverse Primer
aagaaaaacaaacaraagagcaag

SEQ ID NO: 9749 - DNA, 18 bp, Artificial sequence
  Reverse Primer
cctgagaccgcactccac

SEQ ID NO: 9750 - DNA, 21 bp, Artificial sequence
  Reverse Primer
aaatccctgataatggtctcc

SEQ ID NO: 9751 - DNA, 24 bp, Artificial sequence
  Reverse Primer
aaaaaatcaaaggggagatacttg

SEQ ID NO: 9752 - DNA, 19 bp, Artificial sequence
  Reverse Primer
actgccatcacacccattt

SEQ ID NO: 9753 - DNA, 21 bp, Artificial sequence
  Reverse Primer
agaattattcagggctttgga

SEQ ID NO: 9754 - DNA, 21 bp, Artificial sequence
  Reverse Primer
tccacccaagaactagaatgg

SEQ ID NO: 9755 - DNA, 22 bp, Artificial sequence
  Reverse Primer
ttatccctctggtggacaataa

SEQ ID NO: 9756 - DNA, 19 bp, Artificial sequence
  Reverse Primer
tttggacaagctccttcca

SEQ ID NO: 9757 - DNA, 18 bp, Artificial sequence
  Reverse Primer
tgcagcctccaactcgcc

SEQ ID NO: 9758 - DNA, 18 bp, Artificial sequence
  Reverse Primer
atgtaagtgcccacggag

SEQ ID NO: 9759 - DNA, 19 bp, Artificial sequence
  Reverse Primer
tgtaggacttggtggcaga

SEQ ID NO: 9760 - DNA, 27 bp, Artificial sequence
  Reverse Primer
tggagtagaacttgttttttgtacata

SEQ ID NO: 9761 - DNA, 26 bp, Artificial sequence
  Reverse Primer
taattttatacaggwcacttgcctta

SEQ ID NO: 9762 - DNA, 21 bp, Artificial sequence
  Reverse Primer
aacccttggtcatctagccta

SEQ ID NO: 9763 - DNA, 19 bp, Artificial sequence
  Reverse Primer
gcacgagcacataaatgca

SEQ ID NO: 9764 - DNA, 21 bp, Artificial sequence
  Reverse Primer
tttgtgtcagttccgattctt

SEQ ID NO: 9765 - DNA, 25 bp, Artificial sequence
  Reverse Primer
tagaggatttgagtgagaatgaaaa

SEQ ID NO: 9766 - DNA, 24 bp, Artificial sequence
  Reverse Primer
tttatgtgtctgtgtgtatgtatg

SEQ ID NO: 9767 - DNA, 23 bp, Artificial sequence
  Reverse Primer
taaaaactcagactggcttcaga

SEQ ID NO: 9768 - DNA, 26 bp, Artificial sequence
  Reverse Primer
aatatttccagtttgaagtttttcac

SEQ ID NO: 9769 - DNA, 21 bp, Artificial sequence
  Reverse Primer
aaaagaaaggggaaaaggaga

SEQ ID NO: 9770 - DNA, 21 bp, Artificial sequence
  Reverse Primer
ccactactgtcaaggatcagc

SEQ ID NO: 9771 - DNA, 28 bp, Artificial sequence
  Reverse Primer
agattatcttggcctacaataattaaaa

SEQ ID NO: 9772 - DNA, 18 bp, Artificial sequence
  Reverse Primer
actcagccctggaccgtc

SEQ ID NO: 9773 - DNA, 23 bp, Artificial sequence
  Reverse Primer
aagaatggaaacacaaatctctg

SEQ ID NO: 9774 - DNA, 18 bp, Artificial sequence
  Reverse Primer
tgtgagggggtctgcagt

SEQ ID NO: 9775 - DNA, 20 bp, Artificial sequence
  Reverse Primer
aaatcctgctgcagagaagc

SEQ ID NO: 9776 - DNA, 20 bp, Artificial sequence
  Reverse Primer
tggcctcttatggtttgagt

SEQ ID NO: 9777 - DNA, 21 bp, Artificial sequence
  Reverse Primer
taatgctttctctgctccacc

SEQ ID NO: 9778 - DNA, 23 bp, Artificial sequence
  Reverse Primer
aaataaaggtcaggaaacaggaa

SEQ ID NO: 9779 - DNA, 22 bp, Artificial sequence
  Reverse Primer
atatctggagagcggtagaagc

SEQ ID NO: 9780 - DNA, 28 bp, Artificial sequence
  Reverse Primer
ttgaataaagaacatacaaacatacaca

SEQ ID NO: 9781 - DNA, 22 bp, Artificial sequence
  Reverse Primer
agaatcaggagtcatggaactg

SEQ ID NO: 9782 - DNA, 18 bp, Artificial sequence
  Reverse Primer
taccgggacagggcactt

SEQ ID NO: 9783 - DNA, 22 bp, Artificial sequence
  Reverse Primer
attgtcaattttggctctacca

SEQ ID NO: 9784 - DNA, 24 bp, Artificial sequence
  Reverse Primer
aatttgaaggagaagaaagtcaaa

SEQ ID NO: 9785 - DNA, 25 bp, Artificial sequence
  Reverse Primer
aaagagttagattgattgcctagag

SEQ ID NO: 9786 - DNA, 22 bp, Artificial sequence
  Reverse Primer
gaatgtcattggactctgaatg

SEQ ID NO: 9787 - DNA, 22 bp, Artificial sequence
  Reverse Primer
tcagcttctggcaaatataatg

SEQ ID NO: 9788 - DNA, 27 bp, Artificial sequence
  Reverse Primer
taaagtaaaatgtctttractctgcaa

SEQ ID NO: 9789 - DNA, 28 bp, Artificial sequence
  Reverse Primer
agctgagatatagaagaacttcaaaaat

SEQ ID NO: 9790 - DNA, 21 bp, Artificial sequence
  Reverse Primer
tatgaaaggaaggggaatgtt

SEQ ID NO: 9791 - DNA, 22 bp, Artificial sequence
  Reverse Primer
taactattcacccattcatgca

SEQ ID NO: 9792 - DNA, 21 bp, Artificial sequence
  Reverse Primer
agttcagccttgttcttctgg

SEQ ID NO: 9793 - DNA, 20 bp, Artificial sequence
  Reverse Primer
tgatttacccaaccaacctc

SEQ ID NO: 9794 - DNA, 22 bp, Artificial sequence
  Reverse Primer
ttaaatgtcaagcaggcctatt

SEQ ID NO: 9795 - DNA, 19 bp, Artificial sequence
  Reverse Primer
atctgtgtgtgcaggcatg

SEQ ID NO: 9796 - DNA, 24 bp, Artificial sequence
  Reverse Primer
aacattttcaaatcaaataagctg

SEQ ID NO: 9797 - DNA, 24 bp, Artificial sequence
  Reverse Primer
agtacctcaattcctcagtggtac

SEQ ID NO: 9798 - DNA, 19 bp, Artificial sequence
  Reverse Primer
ttttcctgaactccaggct

SEQ ID NO: 9799 - DNA, 23 bp, Artificial sequence
  Reverse Primer
aatcctgaggaacasaagacttc

SEQ ID NO: 9800 - DNA, 20 bp, Artificial sequence
  Reverse Primer
catctccaactagccactgg

SEQ ID NO: 9801 - DNA, 18 bp, Artificial sequence
  Reverse Primer
tcgtcatcactgggacac

SEQ ID NO: 9802 - DNA, 26 bp, Artificial sequence
  Reverse Primer
aataagaagtcattaatggaaatgct

SEQ ID NO: 9803 - DNA, 30 bp, Artificial sequence
  Reverse Primer
tataatgtgatttataagaagtttaggaga

SEQ ID NO: 9804 - DNA, 24 bp, Artificial sequence
  Reverse Primer
ttgtctcataatacccacagctag

SEQ ID NO: 9805 - DNA, 27 bp, Artificial sequence
  Reverse Primer
tttcctatattttaagtacttggaggc

SEQ ID NO: 9806 - DNA, 23 bp, Artificial sequence
  Reverse Primer
attttgcagatattcatccctct

SEQ ID NO: 9807 - DNA, 21 bp, Artificial sequence
  Reverse Primer
tctggcataggaaagttctca

SEQ ID NO: 9808 - DNA, 21 bp, Artificial sequence
  Reverse Primer
aaaagaatggacagaccacac

SEQ ID NO: 9809 - DNA, 26 bp, Artificial sequence
  Reverse Primer
atagttcaaatctcacaggagaactc

SEQ ID NO: 9810 - DNA, 20 bp, Artificial sequence
  Reverse Primer
ttctcctgcagctcatctct

SEQ ID NO: 9811 - DNA, 26 bp, Artificial sequence
  Reverse Primer
tcacataaatatttgtgaattatgcc

SEQ ID NO: 9812 - DNA, 24 bp, Artificial sequence
  Reverse Primer
attttacaatcaggaaaaccatgt

SEQ ID NO: 9813 - DNA, 28 bp, Artificial sequence
  Reverse Primer
tgtgtacagttgtgtaagttgtacagtc

SEQ ID NO: 9814 - DNA, 19 bp, Artificial sequence
  Reverse Primer
cacagsctgacacagaacc

SEQ ID NO: 9815 - DNA, 26 bp, Artificial sequence
  Reverse Primer
caattctaagatttttgatctttgtg

SEQ ID NO: 9816 - DNA, 27 bp, Artificial sequence
  Reverse Primer
agataaatgtatttttccttatcatgg

SEQ ID NO: 9817 - DNA, 23 bp, Artificial sequence
  Reverse Primer
cttatgcaagtttacggagaagg

SEQ ID NO: 9818 - DNA, 20 bp, Artificial sequence
  Reverse Primer
tttcttygggaaactccttg

SEQ ID NO: 9819 - DNA, 23 bp, Artificial sequence
  Reverse Primer
ctccattctaaacaaccacaaat

SEQ ID NO: 9820 - DNA, 22 bp, Artificial sequence
  Reverse Primer
ttaatgattcaaacagtgacgc

SEQ ID NO: 9821 - DNA, 22 bp, Artificial sequence
  Reverse Primer
tttgcaacagaaaagtgaccta

SEQ ID NO: 9822 - DNA, 18 bp, Artificial sequence
  Reverse Primer
accggggatgtccctcac

SEQ ID NO: 9823 - DNA, 22 bp, Artificial sequence
  Reverse Primer
tttatagtcagccccattctgt

SEQ ID NO: 9824 - DNA, 23 bp, Artificial sequence
  Reverse Primer
ttagtttctgcaaaagctgtctg

SEQ ID NO: 9825 - DNA, 30 bp, Artificial sequence
  Reverse Primer
atagactgatatgtgtctaatatttttcaa

SEQ ID NO: 9826 - DNA, 21 bp, Artificial sequence
  Reverse Primer
aagatcttgtgacctcccttg

SEQ ID NO: 9827 - DNA, 22 bp, Artificial sequence
  Reverse Primer
catccactggtaaagtgcttct

SEQ ID NO: 9828 - DNA, 27 bp, Artificial sequence
  Reverse Primer
ttaataactttrcatatttgtgactgc

SEQ ID NO: 9829 - DNA, 24 bp, Artificial sequence
  Reverse Primer
aatttgccatctgatacatatgaa

SEQ ID NO: 9830 - DNA, 21 bp, Artificial sequence
  Reverse Primer
tgtgactgaataagtgggagg

SEQ ID NO: 9831 - DNA, 22 bp, Artificial sequence
  Reverse Primer
atattctggtagaggctggatg

SEQ ID NO: 9832 - DNA, 29 bp, Artificial sequence
  Reverse Primer
ataaagaagagagcttttatctgaatagc

SEQ ID NO: 9833 - DNA, 19 bp, Artificial sequence
  Reverse Primer
tggctgtgtccaaacaatg

SEQ ID NO: 9834 - DNA, 22 bp, Artificial sequence
  Reverse Primer
attacaatccaaggtaacaggc

SEQ ID NO: 9835 - DNA, 21 bp, Artificial sequence
  Reverse Primer
tggttagacttcayagggcag

SEQ ID NO: 9836 - DNA, 19 bp, Artificial sequence
  Reverse Primer
agagcttcagccaatctgg

SEQ ID NO: 9837 - DNA, 23 bp, Artificial sequence
  Reverse Primer
tagaaacttacgacaattggctt

SEQ ID NO: 9838 - DNA, 18 bp, Artificial sequence
  Reverse Primer
tgggctgcaagtacagga

SEQ ID NO: 9839 - DNA, 20 bp, Artificial sequence
  Reverse Primer
tctacgtggagacagaggca

SEQ ID NO: 9840 - DNA, 18 bp, Artificial sequence
  Reverse Primer
aaactccacccaggcctc

SEQ ID NO: 9841 - DNA, 20 bp, Artificial sequence
  Reverse Primer
tttccagaaacttggctttg

SEQ ID NO: 9842 - DNA, 21 bp, Artificial sequence
  Reverse Primer
agtttctagatggggctcctc

SEQ ID NO: 9843 - DNA, 21 bp, Artificial sequence
  Reverse Primer
ttttcctagctccatctctgg

SEQ ID NO: 9844 - DNA, 21 bp, Artificial sequence
  Reverse Primer
agtctctgtcctcaaacccag

SEQ ID NO: 9845 - DNA, 25 bp, Artificial sequence
  Reverse Primer
taagataccatctttcttacggatg

SEQ ID NO: 9846 - DNA, 27 bp, Artificial sequence
  Reverse Primer
actcccaattctctctctctaaactag

SEQ ID NO: 9847 - DNA, 24 bp, Artificial sequence
  Reverse Primer
aaatgtttcctttttgattcaact

SEQ ID NO: 9848 - DNA, 19 bp, Artificial sequence
  Reverse Primer
accctcagcagtacaaccc

SEQ ID NO: 9849 - DNA, 23 bp, Artificial sequence
  Reverse Primer
ataaaacaaaaaacccctgaaga

SEQ ID NO: 9850 - DNA, 18 bp, Artificial sequence
  Reverse Primer
attttgaggctgtggagg

SEQ ID NO: 9851 - DNA, 30 bp, Artificial sequence
  Reverse Primer
attctaattttatactactgtcatcttttc

SEQ ID NO: 9852 - DNA, 28 bp, Artificial sequence
  Reverse Primer
atctttgtagctcttttctatttttgtg

SEQ ID NO: 9853 - DNA, 27 bp, Artificial sequence
  Reverse Primer
aaatatgcaagatatccataaaagaga

SEQ ID NO: 9854 - DNA, 22 bp, Artificial sequence
  Reverse Primer
actgtgatcagtactccttccc

SEQ ID NO: 9855 - DNA, 25 bp, Artificial sequence
  Reverse Primer
aacttgaatatgttagcatagtgcc

SEQ ID NO: 9856 - DNA, 24 bp, Artificial sequence
  Reverse Primer
ggcaaatagttcagagaaaaattc

SEQ ID NO: 9857 - DNA, 27 bp, Artificial sequence
  Reverse Primer
aaaagttaatgtttatatgccatgtct

SEQ ID NO: 9858 - DNA, 23 bp, Artificial sequence
  Reverse Primer
cagagaaatcagtaagaatgcca

SEQ ID NO: 9859 - DNA, 24 bp, Artificial sequence
  Reverse Primer
ttcactagaaccaaaatgttgtcc

SEQ ID NO: 9860 - DNA, 30 bp, Artificial sequence
  Reverse Primer
gttaatgcagtctctctaatgktatttatt

SEQ ID NO: 9861 - DNA, 24 bp, Artificial sequence
  Reverse Primer
aagtcaaaactgcaaaatacacct

SEQ ID NO: 9862 - DNA, 19 bp, Artificial sequence
  Reverse Primer
ttatctgcaggagacacgc

SEQ ID NO: 9863 - DNA, 27 bp, Artificial sequence
  Reverse Primer
aaawaaacaaacaaaactaccactaca

SEQ ID NO: 9864 - DNA, 27 bp, Artificial sequence
  Reverse Primer
taaatcgttagactccttttattttcc

SEQ ID NO: 9865 - DNA, 26 bp, Artificial sequence
  Reverse Primer
atttacttaaaagcctcttcctagtg

SEQ ID NO: 9866 - DNA, 30 bp, Artificial sequence
  Reverse Primer
atttcatctttttatctcttctaatgacta

SEQ ID NO: 9867 - DNA, 27 bp, Artificial sequence
  Reverse Primer
accactacaaggaatgtgaaattatat

SEQ ID NO: 9868 - DNA, 28 bp, Artificial sequence
  Reverse Primer
aatttctcaactataaaggttggtagaa

SEQ ID NO: 9869 - DNA, 26 bp, Artificial sequence
  Reverse Primer
tacatagagtatgtggtacaccaggt

SEQ ID NO: 9870 - DNA, 26 bp, Artificial sequence
  Reverse Primer
attagagtcatcttggaaaagaaaca

SEQ ID NO: 9871 - DNA, 24 bp, Artificial sequence
  Reverse Primer
ttacaacctcagcaattcttattg

SEQ ID NO: 9872 - DNA, 30 bp, Artificial sequence
  Reverse Primer
tatctatatcacagtttgagtaacattata

SEQ ID NO: 9873 - DNA, 23 bp, Artificial sequence
  Reverse Primer
accagataccatcagatcagaac

SEQ ID NO: 9874 - DNA, 28 bp, Artificial sequence
  Reverse Primer
atgatacacacctcaagtaaaataacaa

SEQ ID NO: 9875 - DNA, 23 bp, Artificial sequence
  Reverse Primer
ttctgttttctcaaaccaatttg

SEQ ID NO: 9876 - DNA, 30 bp, Artificial sequence
  Reverse Primer
ccagagatatgtgtaaaaatttgattatac

SEQ ID NO: 9877 - DNA, 30 bp, Artificial sequence
  Reverse Primer
atgttatctccatttattttcttgtagtaa

SEQ ID NO: 9878 - DNA, 27 bp, Artificial sequence
  Reverse Primer
tcaataaagatatattgcaagttgtgt

SEQ ID NO: 9879 - DNA, 24 bp, Artificial sequence
  Reverse Primer
tacccagacttgtagcacataaca

SEQ ID NO: 9880 - DNA, 27 bp, Artificial sequence
  Reverse Primer
tagcactgagttttctttaaatgttct

SEQ ID NO: 9881 - DNA, 26 bp, Artificial sequence
  Reverse Primer
agtctatagaacgttattatggcaac

SEQ ID NO: 9882 - DNA, 27 bp, Artificial sequence
  Reverse Primer
atttatgtgcaatgacttacaatttac

SEQ ID NO: 9883 - DNA, 30 bp, Artificial sequence
  Reverse Primer
taagtatgtactgtgtctctactatgtacc

SEQ ID NO: 9884 - DNA, 20 bp, Artificial sequence
  Reverse Primer
aaaaccagggttgaggaaat

SEQ ID NO: 9885 - DNA, 22 bp, Artificial sequence
  Reverse Primer
tctgaactctctctaaccctcc

SEQ ID NO: 9886 - DNA, 18 bp, Artificial sequence
  Reverse Primer
ataccagcttctcccccc

SEQ ID NO: 9887 - DNA, 19 bp, Artificial sequence
  Reverse Primer
aacacaaaccagccctacc

SEQ ID NO: 9888 - DNA, 23 bp, Artificial sequence
  Reverse Primer
ttgtgtgttacagaacagtggaa

SEQ ID NO: 9889 - DNA, 21 bp, Artificial sequence
  Reverse Primer
ataagaagtaccacgggtccc

SEQ ID NO: 9890 - DNA, 24 bp, Artificial sequence
  Reverse Primer
aaatgtccttttattctcagcaat

SEQ ID NO: 9891 - DNA, 28 bp, Artificial sequence
  Reverse Primer
agaagtaaagtcattctgtttaaatcaa

SEQ ID NO: 9892 - DNA, 25 bp, Artificial sequence
  Reverse Primer
atgcagaactttaaaaacaatgagt

SEQ ID NO: 9893 - DNA, 21 bp, Artificial sequence
  Reverse Primer
acaaggtctgcgatactctca

SEQ ID NO: 9894 - DNA, 27 bp, Artificial sequence
  Reverse Primer
atttataaccrtgacatttgttgttac

SEQ ID NO: 9895 - DNA, 24 bp, Artificial sequence
  Reverse Primer
tttttgcagaaattagctgatagc

SEQ ID NO: 9896 - DNA, 20 bp, Artificial sequence
  Reverse Primer
atgaaaacccaacacaatgg

SEQ ID NO: 9897 - DNA, 26 bp, Artificial sequence
  Reverse Primer
aaactgaaaagaaagttattgcatct

SEQ ID NO: 9898 - DNA, 23 bp, Artificial sequence
  Reverse Primer
aaactctggaaaagtaaaacccc

SEQ ID NO: 9899 - DNA, 21 bp, Artificial sequence
  Reverse Primer
aatatctgcccaggttcctaa

SEQ ID NO: 9900 - DNA, 19 bp, Artificial sequence
  Reverse Primer
aatggaattggcttttaag

SEQ ID NO: 9901 - DNA, 21 bp, Artificial sequence
  Reverse Primer
tttcaacttgaatgttctgcc

SEQ ID NO: 9902 - DNA, 24 bp, Artificial sequence
  Reverse Primer
taatggtaatttctggacctcact

SEQ ID NO: 9903 - DNA, 18 bp, Artificial sequence
  Reverse Primer
tgccgattgctttggata

SEQ ID NO: 9904 - DNA, 24 bp, Artificial sequence
  Reverse Primer
aaattaaactcgaatggatgttca

SEQ ID NO: 9905 - DNA, 28 bp, Artificial sequence
  Reverse Primer
tgtaaatattttgacagtagcctatgtg

SEQ ID NO: 9906 - DNA, 25 bp, Artificial sequence
  Reverse Primer
ataattggaaggatgtctttctttt

SEQ ID NO: 9907 - DNA, 27 bp, Artificial sequence
  Reverse Primer
taaattcaactgtaaggtgttttttct

SEQ ID NO: 9908 - DNA, 24 bp, Artificial sequence
  Reverse Primer
attgcagctaaggaatttaaagtg

SEQ ID NO: 9909 - DNA, 30 bp, Artificial sequence
  Reverse Primer
ctgggaaactacattcttaaaataaatatc

SEQ ID NO: 9910 - DNA, 25 bp, Artificial sequence
  Reverse Primer
ttataaagtatcacaaactgggtgg

SEQ ID NO: 9911 - DNA, 24 bp, Artificial sequence
  Reverse Primer
gaagaactcagaagctaggaaatg

SEQ ID NO: 9912 - DNA, 20 bp, Artificial sequence
  Reverse Primer
ttggtaccatgtcaggtttg

SEQ ID NO: 9913 - DNA, 18 bp, Artificial sequence
  Reverse Primer
ttccgggaaactgcgctg

SEQ ID NO: 9914 - DNA, 19 bp, Artificial sequence
  Reverse Primer
cagtccagcactgaaccag

SEQ ID NO: 9915 - DNA, 23 bp, Artificial sequence
  Reverse Primer
aaagttctgggcttcttctaaag

SEQ ID NO: 9916 - DNA, 26 bp, Artificial sequence
  Reverse Primer
gaattctcagtctttaccttatttgc

SEQ ID NO: 9917 - DNA, 21 bp, Artificial sequence
  Reverse Primer
aaactgcagcacattgaattt

SEQ ID NO: 9918 - DNA, 24 bp, Artificial sequence
  Reverse Primer
ataattacaggctgggagaagtag

SEQ ID NO: 9919 - DNA, 18 bp, Artificial sequence
  Reverse Primer
aaccatgtgccatcccat

SEQ ID NO: 9920 - DNA, 18 bp, Artificial sequence
  Reverse Primer
actgtagtttcccccgct

SEQ ID NO: 9921 - DNA, 24 bp, Artificial sequence
  Reverse Primer
aagagatacaggtaagtgacccag

SEQ ID NO: 9922 - DNA, 28 bp, Artificial sequence
  Reverse Primer
aattcagtcatattaacatttttaggtg

SEQ ID NO: 9923 - DNA, 23 bp, Artificial sequence
  Reverse Primer
tttcagtcagagaagacaggttg

SEQ ID NO: 9924 - DNA, 28 bp, Artificial sequence
  Reverse Primer
aaattttaagtgtatgtgaaaataagcc

SEQ ID NO: 9925 - DNA, 22 bp, Artificial sequence
  Reverse Primer
atttctcaattgaaagtgcagg

SEQ ID NO: 9926 - DNA, 26 bp, Artificial sequence
  Reverse Primer
atttttctagtttgaatatccctgaa

SEQ ID NO: 9927 - DNA, 20 bp, Artificial sequence
  Reverse Primer
attggagcaaagacagagca

SEQ ID NO: 9928 - DNA, 26 bp, Artificial sequence
  Reverse Primer
aactatttatatcctccagaatgcat

SEQ ID NO: 9929 - DNA, 18 bp, Artificial sequence
  Reverse Primer
accccacattgcaggaaa

SEQ ID NO: 9930 - DNA, 19 bp, Artificial sequence
  Reverse Primer
tgcatgtaaaacctggcac

SEQ ID NO: 9931 - DNA, 24 bp, Artificial sequence
  Reverse Primer
ttaaaaagcaaatattcaccattg

SEQ ID NO: 9932 - DNA, 25 bp, Artificial sequence
  Reverse Primer
tttacagatgtgtggtatgtgtatg

SEQ ID NO: 9933 - DNA, 22 bp, Artificial sequence
  Reverse Primer
atttcatgggactyaaaccact

SEQ ID NO: 9934 - DNA, 25 bp, Artificial sequence
  Reverse Primer
tgcagtttccaatttaactacctaa

SEQ ID NO: 9935 - DNA, 18 bp, Artificial sequence
  Reverse Primer
rttctttcccaycccctt

SEQ ID NO: 9936 - DNA, 28 bp, Artificial sequence
  Reverse Primer
caaaatatattgactttcattaacttcc

SEQ ID NO: 9937 - DNA, 28 bp, Artificial sequence
  Reverse Primer
aataaatttatgtgtgcaaagtgttaag

SEQ ID NO: 9938 - DNA, 28 bp, Artificial sequence
  Reverse Primer
tttgtacattatatatgccacaaagatt

SEQ ID NO: 9939 - DNA, 28 bp, Artificial sequence
  Reverse Primer
acagtattcaggttatttcctttttaaa

SEQ ID NO: 9940 - DNA, 22 bp, Artificial sequence
  Reverse Primer
tatatagttttggcttttccgg

SEQ ID NO: 9941 - DNA, 30 bp, Artificial sequence
  Reverse Primer
cacttactgattttagattaattctttacc

SEQ ID NO: 9942 - DNA, 19 bp, Artificial sequence
  Reverse Primer
ttatgctgccttagtgcca

SEQ ID NO: 9943 - DNA, 30 bp, Artificial sequence
  Reverse Primer
ttttaaagtcttttatgtggtagtagagat

SEQ ID NO: 9944 - DNA, 24 bp, Artificial sequence
  Reverse Primer
taatctgacaaggaatcaaggttc

SEQ ID NO: 9945 - DNA, 21 bp, Artificial sequence
  Reverse Primer
acacatcatcagtcagcacag

SEQ ID NO: 9946 - DNA, 21 bp, Artificial sequence
  Reverse Primer
atgaccgatgattcagtcaag

SEQ ID NO: 9947 - DNA, 22 bp, Artificial sequence
  Reverse Primer
aaaaaggaaactaaccagtgcc

SEQ ID NO: 9948 - DNA, 24 bp, Artificial sequence
  Reverse Primer
tgccgttattaacgtttttaaact

SEQ ID NO: 9949 - DNA, 20 bp, Artificial sequence
  Reverse Primer
tgggagaatgtcttttggaa

SEQ ID NO: 9950 - DNA, 25 bp, Artificial sequence
  Reverse Primer
atgttcattcattcctttctctatc

SEQ ID NO: 9951 - DNA, 22 bp, Artificial sequence
  Reverse Primer
gtatggctgccagtttaagaat

SEQ ID NO: 9952 - DNA, 27 bp, Artificial sequence
  Reverse Primer
atcaatgatatttttgttggtcttact

SEQ ID NO: 9953 - DNA, 23 bp, Artificial sequence
  Reverse Primer
tttggaacagtgagttttatcga

SEQ ID NO: 9954 - DNA, 21 bp, Artificial sequence
  Reverse Primer
ttcactttgttcacatgcaga

SEQ ID NO: 9955 - DNA, 19 bp, Artificial sequence
  Reverse Primer
agggtgaagcagggtaaca

SEQ ID NO: 9956 - DNA, 23 bp, Artificial sequence
  Reverse Primer
tgaaaagaatctacgttttggag

SEQ ID NO: 9957 - DNA, 21 bp, Artificial sequence
  Reverse Primer
aaaatgccaagtcctaaccac

SEQ ID NO: 9958 - DNA, 24 bp, Artificial sequence
  Reverse Primer
aattttatttgcagtattttgcca

SEQ ID NO: 9959 - DNA, 24 bp, Artificial sequence
  Reverse Primer
ttgctgggagaattaaataaaatt

SEQ ID NO: 9960 - DNA, 23 bp, Artificial sequence
  Reverse Primer
tagtcagaatcacagttgagggt

SEQ ID NO: 9961 - DNA, 30 bp, Artificial sequence
  Reverse Primer
gattgttttttatcctaatatatacatacc

SEQ ID NO: 9962 - DNA, 22 bp, Artificial sequence
  Reverse Primer
gtggggaagacagaaaataaac

SEQ ID NO: 9963 - DNA, 24 bp, Artificial sequence
  Reverse Primer
ttttttcagcttttgtatttcctc

SEQ ID NO: 9964 - DNA, 22 bp, Artificial sequence
  Reverse Primer
aagcacattattttccaccatc

SEQ ID NO: 9965 - DNA, 22 bp, Artificial sequence
  Reverse Primer
tgacattttttgtaagccatga

SEQ ID NO: 9966 - DNA, 18 bp, Artificial sequence
  Reverse Primer
agccctgcgcctyttcct

SEQ ID NO: 9967 - DNA, 19 bp, Artificial sequence
  Reverse Primer
aggcaccagcagggcagat

SEQ ID NO: 9968 - DNA, 21 bp, Artificial sequence
  Reverse Primer
gaaaggcaccaagtcataaca

SEQ ID NO: 9969 - DNA, 21 bp, Artificial sequence
  Reverse Primer
atctgtatgtcaacacgcagg

SEQ ID NO: 9970 - DNA, 21 bp, Artificial sequence
  Reverse Primer
aagcagaggagagagtccttc

SEQ ID NO: 9971 - DNA, 21 bp, Artificial sequence
  Reverse Primer
aaaattaaaaaacaaacgccc

SEQ ID NO: 9972 - DNA, 24 bp, Artificial sequence
  Reverse Primer
gtgttataactatggtggtgacgt

SEQ ID NO: 9973 - DNA, 19 bp, Artificial sequence
  Reverse Primer
ttagttccctggctccaca

SEQ ID NO: 9974 - DNA, 23 bp, Artificial sequence
  Reverse Primer
aacactcactgtgrttttgttga

SEQ ID NO: 9975 - DNA, 19 bp, Artificial sequence
  Reverse Primer
cacccattaccttcagcac

SEQ ID NO: 9976 - DNA, 21 bp, Artificial sequence
  Reverse Primer
agtacaactaggctggctgct

SEQ ID NO: 9977 - DNA, 25 bp, Artificial sequence
  Reverse Primer
aagttaggtcgctgtgtaagtagaa

SEQ ID NO: 9978 - DNA, 30 bp, Artificial sequence
  Reverse Primer
atttatttcacacttacctaatcttcttta

SEQ ID NO: 9979 - DNA, 24 bp, Artificial sequence
  Reverse Primer
aatagatgtcttttccgactcaaa

SEQ ID NO: 9980 - DNA, 23 bp, Artificial sequence
  Reverse Primer
tttttgctgctctgtattttctg

SEQ ID NO: 9981 - DNA, 22 bp, Artificial sequence
  Reverse Primer
tttactggtacacagacccctt

SEQ ID NO: 9982 - DNA, 25 bp, Artificial sequence
  Reverse Primer
caactacctgacagtttttaaagga

SEQ ID NO: 9983 - DNA, 25 bp, Artificial sequence
  Reverse Primer
ttttctgaacagtaagccrtaagta

SEQ ID NO: 9984 - DNA, 22 bp, Artificial sequence
  Reverse Primer
aatgagaatgatgaacgctctg

SEQ ID NO: 9985 - DNA, 20 bp, Artificial sequence
  Reverse Primer
aaaatctgcatggaacaagg

SEQ ID NO: 9986 - DNA, 30 bp, Artificial sequence
  Reverse Primer
atgagagacactgttataattaaatggtat

SEQ ID NO: 9987 - DNA, 22 bp, Artificial sequence
  Reverse Primer
atgtgatgctgattctgtgaag

SEQ ID NO: 9988 - DNA, 19 bp, Artificial sequence
  Reverse Primer
atgcctggcactycttttc

SEQ ID NO: 9989 - DNA, 28 bp, Artificial sequence
  Reverse Primer
agtttcatatttttcttctcagtctctg

SEQ ID NO: 9990 - DNA, 27 bp, Artificial sequence
  Reverse Primer
aatagtctctggagatgatatttcttg

SEQ ID NO: 9991 - DNA, 27 bp, Artificial sequence
  Reverse Primer
tagcagaataggttcatcaagtaattt

SEQ ID NO: 9992 - DNA, 27 bp, Artificial sequence
  Reverse Primer
aattaaagaaatgttgagaagagaatg

SEQ ID NO: 9993 - DNA, 27 bp, Artificial sequence
  Reverse Primer
aacaaaaataatacaacagtcacaaag

SEQ ID NO: 9994 - DNA, 28 bp, Artificial sequence
  Reverse Primer
atattggttatgttaataaatgtggtga

SEQ ID NO: 9995 - DNA, 23 bp, Artificial sequence
  Reverse Primer
ttctaaaacagggatgayagtcc

SEQ ID NO: 9996 - DNA, 25 bp, Artificial sequence
  Reverse Primer
aaaatcttaagagaaaaacccaaag

SEQ ID NO: 9997 - DNA, 24 bp, Artificial sequence
  Reverse Primer
gatgaagacagtagctatcctggt

SEQ ID NO: 9998 - DNA, 30 bp, Artificial sequence
  Reverse Primer
tgtaacagtctcttagagatgatttaaaac

SEQ ID NO: 9999 - DNA, 27 bp, Artificial sequence
  Reverse Primer
aatartttggaatatgaactgtcagtc

SEQ ID NO: 10000 - DNA, 24 bp, Artificial sequence
  Reverse Primer
aaaaatccattaaagccagaaata

SEQ ID NO: 10001 - DNA, 24 bp, Artificial sequence
  Reverse Primer
ttcttttgctgtgttaactgaaaa

SEQ ID NO: 10002 - DNA, 27 bp, Artificial sequence
  Reverse Primer
tgatcaatatgaagtcattgtacttgt

SEQ ID NO: 10003 - DNA, 26 bp, Artificial sequence
  Reverse Primer
ttgaaagaggttttgtatctttcttt

SEQ ID NO: 10004 - DNA, 26 bp, Artificial sequence
  Reverse Primer
aaagctccaggttatttattaactca

SEQ ID NO: 10005 - DNA, 25 bp, Artificial sequence
  Reverse Primer
aaaaacctatttaagttcccaaaga

SEQ ID NO: 10006 - DNA, 21 bp, Artificial sequence
  Reverse Primer
actttcctgtagacggaaggg

SEQ ID NO: 10007 - DNA, 25 bp, Artificial sequence
  Reverse Primer
tatttagacatgtcaaagatggatg

SEQ ID NO: 10008 - DNA, 26 bp, Artificial sequence
  Reverse Primer
aaaaagcaacagtaatccatttaaac

SEQ ID NO: 10009 - DNA, 30 bp, Artificial sequence
  Reverse Primer
atatattagactgtaatgttcagctttagg

SEQ ID NO: 10010 - DNA, 22 bp, Artificial sequence
  Reverse Primer
aaatgcgaatggtaaatacctg

SEQ ID NO: 10011 - DNA, 26 bp, Artificial sequence
  Reverse Primer
aaattttcttacgacacagatctttt

SEQ ID NO: 10012 - DNA, 21 bp, Artificial sequence
  Reverse Primer
ataaggtcagcaacaaggaca

SEQ ID NO: 10013 - DNA, 27 bp, Artificial sequence
  Reverse Primer
ccataccatgaatgtttayacaaatat

SEQ ID NO: 10014 - DNA, 22 bp, Artificial sequence
  Reverse Primer
atcttgtaggacattgggtgag

SEQ ID NO: 10015 - DNA, 22 bp, Artificial sequence
  Reverse Primer
atagagaacatcaccaccacca

SEQ ID NO: 10016 - DNA, 23 bp, Artificial sequence
  Reverse Primer
ctatgatggaggatagtgctcat

SEQ ID NO: 10017 - DNA, 18 bp, Artificial sequence
  Reverse Primer
agctccaactgggaggcc

SEQ ID NO: 10018 - DNA, 24 bp, Artificial sequence
  Reverse Primer
aaatgtggttggaaaaaagtttat

SEQ ID NO: 10019 - DNA, 24 bp, Artificial sequence
  Reverse Primer
aaaacttcttaatgttctccagcc

SEQ ID NO: 10020 - DNA, 22 bp, Artificial sequence
  Reverse Primer
acagagcaattttgacctgagt

SEQ ID NO: 10021 - DNA, 28 bp, Artificial sequence
  Reverse Primer
ggagacatgattttatttaattatctga

SEQ ID NO: 10022 - DNA, 24 bp, Artificial sequence
  Reverse Primer
gcaatgtacatttgctctactgat

SEQ ID NO: 10023 - DNA, 28 bp, Artificial sequence
  Reverse Primer
aatattttgtgtgaagacatttatcact

SEQ ID NO: 10024 - DNA, 24 bp, Artificial sequence
  Reverse Primer
aaaatttgttttccttcgattagc

SEQ ID NO: 10025 - DNA, 18 bp, Artificial sequence
  Reverse Primer
tcactgggacaaaggcct

SEQ ID NO: 10026 - DNA, 25 bp, Artificial sequence
  Reverse Primer
atactgacttgtgtgaggactctct

SEQ ID NO: 10027 - DNA, 23 bp, Artificial sequence
  Reverse Primer
gtaggatctcaccaagtgtcaga

SEQ ID NO: 10028 - DNA, 21 bp, Artificial sequence
  Reverse Primer
acttgcctctgagcagactct

SEQ ID NO: 10029 - DNA, 19 bp, Artificial sequence
  Reverse Primer
aagtcagaatgttcggggc

SEQ ID NO: 10030 - DNA, 18 bp, Artificial sequence
  Reverse Primer
tttctggcatgatgtgca

SEQ ID NO: 10031 - DNA, 21 bp, Artificial sequence
  Reverse Primer
aacaaggaaggagtctggagc

SEQ ID NO: 10032 - DNA, 21 bp, Artificial sequence
  Reverse Primer
taggacatggtgtgatgttgc

SEQ ID NO: 10033 - DNA, 19 bp, Artificial sequence
  Reverse Primer
ttcctgcwtcagctcacag

SEQ ID NO: 10034 - DNA, 19 bp, Artificial sequence
  Reverse Primer
tcagacaattggacaccga

SEQ ID NO: 10035 - DNA, 21 bp, Artificial sequence
  Reverse Primer
tctaggctcttgggtttcagt

SEQ ID NO: 10036 - DNA, 24 bp, Artificial sequence
  Reverse Primer
atctaacaaaaggcttcacaagtc

SEQ ID NO: 10037 - DNA, 22 bp, Artificial sequence
  Reverse Primer
ttactcagttgtgctttgctga

SEQ ID NO: 10038 - DNA, 25 bp, Artificial sequence
  Reverse Primer
ttgttaaagtggaagaggttatgtg

SEQ ID NO: 10039 - DNA, 22 bp, Artificial sequence
  Reverse Primer
aagtttccagaatcctagcaca

SEQ ID NO: 10040 - DNA, 26 bp, Artificial sequence
  Reverse Primer
ttattttttcccccatatattagttg

SEQ ID NO: 10041 - DNA, 28 bp, Artificial sequence
  Reverse Primer
gaaaaaatggttaaaaactataggttga

SEQ ID NO: 10042 - DNA, 23 bp, Artificial sequence
  Reverse Primer
aaagtatgacaagaaaaacacgc

SEQ ID NO: 10043 - DNA, 24 bp, Artificial sequence
  Reverse Primer
aatgaattatttcaggaaatggaa

SEQ ID NO: 10044 - DNA, 25 bp, Artificial sequence
  Reverse Primer
atagtgacaaacccatcatactcat

SEQ ID NO: 10045 - DNA, 27 bp, Artificial sequence
  Reverse Primer
ttaaatagcatgttttgtaaaaagagg

SEQ ID NO: 10046 - DNA, 24 bp, Artificial sequence
  Reverse Primer
aagaattggataaacaaaaccaag

SEQ ID NO: 10047 - DNA, 26 bp, Artificial sequence
  Reverse Primer
ctgaatgaacatcagtatgaaaaatg

SEQ ID NO: 10048 - DNA, 25 bp, Artificial sequence
  Reverse Primer
aagtctgtgacaaagaattactgtg

SEQ ID NO: 10049 - DNA, 28 bp, Artificial sequence
  Reverse Primer
acacatatttactttttgttttgttctg

SEQ ID NO: 10050 - DNA, 19 bp, Artificial sequence
  Reverse Primer
ttttctctggtttcaggcc

SEQ ID NO: 10051 - DNA, 25 bp, Artificial sequence
  Reverse Primer
ataaagaaccaaagcagaaaagatc

SEQ ID NO: 10052 - DNA, 28 bp, Artificial sequence
  Reverse Primer
tacctcactttataaaataaatacagcc

SEQ ID NO: 10053 - DNA, 24 bp, Artificial sequence
  Reverse Primer
caaagaccacatatcctatgattc

SEQ ID NO: 10054 - DNA, 22 bp, Artificial sequence
  Reverse Primer
aacatgaaaataagcccttgag

SEQ ID NO: 10055 - DNA, 23 bp, Artificial sequence
  Reverse Primer
ttcacagtgtaccttcactctcc

SEQ ID NO: 10056 - DNA, 26 bp, Artificial sequence
  Reverse Primer
taaagagcttgctttttaagtttttg

SEQ ID NO: 10057 - DNA, 22 bp, Artificial sequence
  Reverse Primer
aatgcattatttattcgcacct

SEQ ID NO: 10058 - DNA, 21 bp, Artificial sequence
  Reverse Primer
tttggaacagtctggaatctg

SEQ ID NO: 10059 - DNA, 27 bp, Artificial sequence
  Reverse Primer
attcccaacagttaatttatattctga

SEQ ID NO: 10060 - DNA, 23 bp, Artificial sequence
  Reverse Primer
atatggttaagtgggtttcttgc

SEQ ID NO: 10061 - DNA, 30 bp, Artificial sequence
  Reverse Primer
gttttatatttatctgtattcagttcagtt

SEQ ID NO: 10062 - DNA, 24 bp, Artificial sequence
  Reverse Primer
agatataactgaagccaggtacca

SEQ ID NO: 10063 - DNA, 26 bp, Artificial sequence
  Reverse Primer
aaaacaaagcaacctgtattttaact

SEQ ID NO: 10064 - DNA, 26 bp, Artificial sequence
  Reverse Primer
tacaagggaatagtgtgtacaagaaa

SEQ ID NO: 10065 - DNA, 29 bp, Artificial sequence
  Reverse Primer
agtgtagaagatacagattagtaacatcg

SEQ ID NO: 10066 - DNA, 24 bp, Artificial sequence
  Reverse Primer
atacacaatgcarcacagtaagag

SEQ ID NO: 10067 - DNA, 26 bp, Artificial sequence
  Reverse Primer
tgctaaaagaaagattaagtcctttt

SEQ ID NO: 10068 - DNA, 26 bp, Artificial sequence
  Reverse Primer
tctttcagtcactgttttctaatgtt

SEQ ID NO: 10069 - DNA, 19 bp, Artificial sequence
  Reverse Primer
ctctcagaaggagccaccc

SEQ ID NO: 10070 - DNA, 18 bp, Artificial sequence
  Reverse Primer
aaggagaggcggatcaga

SEQ ID NO: 10071 - DNA, 22 bp, Artificial sequence
  Reverse Primer
ttcctgaatggatttactctgc

SEQ ID NO: 10072 - DNA, 22 bp, Artificial sequence
  Reverse Primer
tctccyggctatagtgagaaaa

SEQ ID NO: 10073 - DNA, 21 bp, Artificial sequence
  Reverse Primer
aaaagccagtacaaaggtcct

SEQ ID NO: 10074 - DNA, 20 bp, Artificial sequence
  Reverse Primer
actgtgagcatgtctgtgca

SEQ ID NO: 10075 - DNA, 20 bp, Artificial sequence
  Reverse Primer
aaacagtggggagagacaga

SEQ ID NO: 10076 - DNA, 21 bp, Artificial sequence
  Reverse Primer
atggatcccaaggactaagtg

SEQ ID NO: 10077 - DNA, 25 bp, Artificial sequence
  Reverse Primer
aatagtatgacctgagaaagacgtc

SEQ ID NO: 10078 - DNA, 18 bp, Artificial sequence
  Reverse Primer
agcccttttgcatggtcc

SEQ ID NO: 10079 - DNA, 18 bp, Artificial sequence
  Reverse Primer
ggcccaagaacttcagcg

SEQ ID NO: 10080 - DNA, 21 bp, Artificial sequence
  Reverse Primer
aaatgatgatgcatgatgtcc

SEQ ID NO: 10081 - DNA, 21 bp, Artificial sequence
  Reverse Primer
aaagacgatgtgtatggtcgg

SEQ ID NO: 10082 - DNA, 25 bp, Artificial sequence
  Reverse Primer
cactagcactgccttaatatacctc

SEQ ID NO: 10083 - DNA, 28 bp, Artificial sequence
  Reverse Primer
cagattaattatattttgaaagctgaga

SEQ ID NO: 10084 - DNA, 24 bp, Artificial sequence
  Reverse Primer
cataaaaataaaatacattccccc

SEQ ID NO: 10085 - DNA, 26 bp, Artificial sequence
  Reverse Primer
tagaggagtgtgaactttaacaacag

SEQ ID NO: 10086 - DNA, 18 bp, Artificial sequence
  Reverse Primer
ctcccaaccagtcccgtg

SEQ ID NO: 10087 - DNA, 24 bp, Artificial sequence
  Reverse Primer
taaaaaattcagaaaattcagtgg

SEQ ID NO: 10088 - DNA, 22 bp, Artificial sequence
  Reverse Primer
tttaggaccaaaaatagctggg

SEQ ID NO: 10089 - DNA, 20 bp, Artificial sequence
  Reverse Primer
ccccattgactgtagcactc

SEQ ID NO: 10090 - DNA, 21 bp, Artificial sequence
  Reverse Primer
aaaaggcttcttgaggaaatc

SEQ ID NO: 10091 - DNA, 21 bp, Artificial sequence
  Reverse Primer
taggycctgtgttgttgttgt

SEQ ID NO: 10092 - DNA, 24 bp, Artificial sequence
  Reverse Primer
ttagagatgtgaacaagacaaacg

SEQ ID NO: 10093 - DNA, 21 bp, Artificial sequence
  Reverse Primer
ttcctttgaaagaagaatgca

SEQ ID NO: 10094 - DNA, 25 bp, Artificial sequence
  Reverse Primer
tcactgatcctatgagatagaggaa

SEQ ID NO: 10095 - DNA, 30 bp, Artificial sequence
  Reverse Primer
tattactaacacwctagttttcaattttct

SEQ ID NO: 10096 - DNA, 26 bp, Artificial sequence
  Reverse Primer
ttgaagtcatctgatttttatcatgt

SEQ ID NO: 10097 - DNA, 20 bp, Artificial sequence
  Reverse Primer
ctctttccctccctgtcttt

SEQ ID NO: 10098 - DNA, 25 bp, Artificial sequence
  Reverse Primer
ttaagtgcacagttcaaaartgtta

SEQ ID NO: 10099 - DNA, 25 bp, Artificial sequence
  Reverse Primer
tatatcatggccagttaaagttcat

SEQ ID NO: 10100 - DNA, 30 bp, Artificial sequence
  Reverse Primer
tttttacatataaatctgctatctcctcta

SEQ ID NO: 10101 - DNA, 20 bp, Artificial sequence
  Reverse Primer
agtgtgaaggatatgtgggc

SEQ ID NO: 10102 - DNA, 25 bp, Artificial sequence
  Reverse Primer
aatgttagctcattttatttgccta

SEQ ID NO: 10103 - DNA, 22 bp, Artificial sequence
  Reverse Primer
aaggaattttcagtgaagacgc

SEQ ID NO: 10104 - DNA, 22 bp, Artificial sequence
  Reverse Primer
cactgtgctgtaggcagataac

SEQ ID NO: 10105 - DNA, 26 bp, Artificial sequence
  Reverse Primer
atactaacgtaggtctttcatcgaat

SEQ ID NO: 10106 - DNA, 30 bp, Artificial sequence
  Reverse Primer
aagatatcttagaagtttacttacttcatc

SEQ ID NO: 10107 - DNA, 21 bp, Artificial sequence
  Reverse Primer
agttgtataatcagaaccgcg

SEQ ID NO: 10108 - DNA, 21 bp, Artificial sequence
  Reverse Primer
tgtgagtctttgaacacttgg

SEQ ID NO: 10109 - DNA, 27 bp, Artificial sequence
  Reverse Primer
atagagcaggattttcatctctattaa

SEQ ID NO: 10110 - DNA, 30 bp, Artificial sequence
  Reverse Primer
cttacctaatcttattcactaaaatttcaa

SEQ ID NO: 10111 - DNA, 27 bp, Artificial sequence
  Reverse Primer
tattgttaacatttaatagaaagcctg

SEQ ID NO: 10112 - DNA, 20 bp, Artificial sequence
  Reverse Primer
tttcatttccatcaacgagc

SEQ ID NO: 10113 - DNA, 21 bp, Artificial sequence
  Reverse Primer
aatgggagctttgttgaaatt

SEQ ID NO: 10114 - DNA, 30 bp, Artificial sequence
  Reverse Primer
attttttactctacttctttccataaagag

SEQ ID NO: 10115 - DNA, 22 bp, Artificial sequence
  Reverse Primer
tggagccacactttttagattt

SEQ ID NO: 10116 - DNA, 27 bp, Artificial sequence
  Reverse Primer
tataaaacagaaaatgactaaaatcgg

SEQ ID NO: 10117 - DNA, 28 bp, Artificial sequence
  Reverse Primer
ttaaaatatttatacactgagttcccct

SEQ ID NO: 10118 - DNA, 29 bp, Artificial sequence
  Reverse Primer
attactaaatgtgactatttgttcagctt

SEQ ID NO: 10119 - DNA, 23 bp, Artificial sequence
  Reverse Primer
tttaagagtcaacacacaggtgg

SEQ ID NO: 10120 - DNA, 23 bp, Artificial sequence
  Reverse Primer
tcaagaaagcttaaacaaatgga

SEQ ID NO: 10121 - DNA, 30 bp, Artificial sequence
  Reverse Primer
aaactatacccttaaattagcttttattac

SEQ ID NO: 10122 - DNA, 23 bp, Artificial sequence
  Reverse Primer
ttaagatactgaaggctgctgac

SEQ ID NO: 10123 - DNA, 18 bp, Artificial sequence
  Reverse Primer
ggcctrcttggtctgagc

SEQ ID NO: 10124 - DNA, 25 bp, Artificial sequence
  Reverse Primer
tagatctgcaggaagagattcttta

SEQ ID NO: 10125 - DNA, 22 bp, Artificial sequence
  Reverse Primer
ttaaggaatacccaagcaaaaa

SEQ ID NO: 10126 - DNA, 24 bp, Artificial sequence
  Reverse Primer
aaaatttttactttagcagcgtga

SEQ ID NO: 10127 - DNA, 18 bp, Artificial sequence
  Reverse Primer
accagcgtgggggactct

SEQ ID NO: 10128 - DNA, 27 bp, Artificial sequence
  Reverse Primer
ttcactttatagcactgttaaagtttc

SEQ ID NO: 10129 - DNA, 19 bp, Artificial sequence
  Reverse Primer
tgccgtctttccccagcat

SEQ ID NO: 10130 - DNA, 18 bp, Artificial sequence
  Reverse Primer
tgatcaatcccctccccg

SEQ ID NO: 10131 - DNA, 21 bp, Artificial sequence
  Reverse Primer
gctctccgaataaggtcgtat

SEQ ID NO: 10132 - DNA, 21 bp, Artificial sequence
  Reverse Primer
tcgtcatcctgatggtgtatg

SEQ ID NO: 10133 - DNA, 21 bp, Artificial sequence
  Reverse Primer
caacatgagaactgttcgttg

SEQ ID NO: 10134 - DNA, 30 bp, Artificial sequence
  Reverse Primer
attgtcaagaatagtttcagtagaataatg

SEQ ID NO: 10135 - DNA, 18 bp, Artificial sequence
  Reverse Primer
agacctgggctcggatcc

SEQ ID NO: 10136 - DNA, 20 bp, Artificial sequence
  Reverse Primer
ttatctgaacagcaagcagg

SEQ ID NO: 10137 - DNA, 26 bp, Artificial sequence
  Reverse Primer
aaagatgagtcaaacactcatacatg

SEQ ID NO: 10138 - DNA, 23 bp, Artificial sequence
  Reverse Primer
caaatccagatgaaggtaaatcc

SEQ ID NO: 10139 - DNA, 28 bp, Artificial sequence
  Reverse Primer
ttcttgttctttcattttttaactctac

SEQ ID NO: 10140 - DNA, 25 bp, Artificial sequence
  Reverse Primer
tttttagtacaagcccttttttctc

SEQ ID NO: 10141 - DNA, 22 bp, Artificial sequence
  Reverse Primer
ataaagatgtttcagtgcatgc

SEQ ID NO: 10142 - DNA, 20 bp, Artificial sequence
  Reverse Primer
tttgtttgtcttggtccagg

SEQ ID NO: 10143 - DNA, 27 bp, Artificial sequence
  Reverse Primer
tttataactttttcggttagtcactgt

SEQ ID NO: 10144 - DNA, 29 bp, Artificial sequence
  Reverse Primer
gctttacatttaataaataagtactgcca

SEQ ID NO: 10145 - DNA, 27 bp, Artificial sequence
  Reverse Primer
gcttttatctgtttgagtttaaaaatg

SEQ ID NO: 10146 - DNA, 29 bp, Artificial sequence
  Reverse Primer
ttcttaatctttactggttttaatcagag

SEQ ID NO: 10147 - DNA, 30 bp, Artificial sequence
  Reverse Primer
aattatagtccataaaatatgacatgatag

SEQ ID NO: 10148 - DNA, 23 bp, Artificial sequence
  Reverse Primer
aagaatggatacacatgctttct

SEQ ID NO: 10149 - DNA, 18 bp, Artificial sequence
  Reverse Primer
atgcatgacaagcccagg

SEQ ID NO: 10150 - DNA, 23 bp, Artificial sequence
  Reverse Primer
aatacggtccatttacagtctcc

SEQ ID NO: 10151 - DNA, 26 bp, Artificial sequence
  Reverse Primer
ttgatgttcttacatctgaatatttg

SEQ ID NO: 10152 - DNA, 27 bp, Artificial sequence
  Reverse Primer
aaaagtaaggtccctttattatcctaa

SEQ ID NO: 10153 - DNA, 24 bp, Artificial sequence
  Reverse Primer
cagtcttggacaccatttatactg

SEQ ID NO: 10154 - DNA, 19 bp, Artificial sequence
  Reverse Primer
catggcacatattcgtgtg

SEQ ID NO: 10155 - DNA, 26 bp, Artificial sequence
  Reverse Primer
atgtcttgtattctttcaactttcag

SEQ ID NO: 10156 - DNA, 22 bp, Artificial sequence
  Reverse Primer
agtccacttggaggtaatgagg

SEQ ID NO: 10157 - DNA, 21 bp, Artificial sequence
  Reverse Primer
tctggaaacttgagctaagca

SEQ ID NO: 10158 - DNA, 23 bp, Artificial sequence
  Reverse Primer
ttccctggaatattcttttttca

SEQ ID NO: 10159 - DNA, 26 bp, Artificial sequence
  Reverse Primer
taattatgaatatgtctggrcatctg

SEQ ID NO: 10160 - DNA, 24 bp, Artificial sequence
  Reverse Primer
aggcattggagttataagcttaag

SEQ ID NO: 10161 - DNA, 23 bp, Artificial sequence
  Reverse Primer
attgaatgtaggaagaaacaggg

SEQ ID NO: 10162 - DNA, 26 bp, Artificial sequence
  Reverse Primer
aaggtttgtcaaatgttttaaacttc

SEQ ID NO: 10163 - DNA, 24 bp, Artificial sequence
  Reverse Primer
accaaatttgtcctcagatatgtg

SEQ ID NO: 10164 - DNA, 23 bp, Artificial sequence
  Reverse Primer
ttacttttcttccccctactgtg

SEQ ID NO: 10165 - DNA, 20 bp, Artificial sequence
  Reverse Primer
aaatttagctgttctggggg

SEQ ID NO: 10166 - DNA, 21 bp, Artificial sequence
  Reverse Primer
aagagttggtcagaacttgca

SEQ ID NO: 10167 - DNA, 18 bp, Artificial sequence
  Reverse Primer
cgggccagcaacacccat

SEQ ID NO: 10168 - DNA, 19 bp, Artificial sequence
  Reverse Primer
agagactgactgaggggga

SEQ ID NO: 10169 - DNA, 25 bp, Artificial sequence
  Reverse Primer
tttttatttctgacagacaagagga

SEQ ID NO: 10170 - DNA, 19 bp, Artificial sequence
  Reverse Primer
gcagcattycatgyaaacc

SEQ ID NO: 10171 - DNA, 21 bp, Artificial sequence
  Reverse Primer
ccattacttccagatcagcaa

SEQ ID NO: 10172 - DNA, 23 bp, Artificial sequence
  Reverse Primer
aattagaaacgtaggacatggct

SEQ ID NO: 10173 - DNA, 24 bp, Artificial sequence
  Reverse Primer
ttgccttaactcaagctatttagc

SEQ ID NO: 10174 - DNA, 18 bp, Artificial sequence
  Reverse Primer
gcccggttcaagtgaagt

SEQ ID NO: 10175 - DNA, 21 bp, Artificial sequence
  Reverse Primer
atgttttccaagttccctgtt

SEQ ID NO: 10176 - DNA, 26 bp, Artificial sequence
  Reverse Primer
tttttaattaggatgatattctggtg

SEQ ID NO: 10177 - DNA, 19 bp, Artificial sequence
  Reverse Primer
ctggacccctgtytgtctg

SEQ ID NO: 10178 - DNA, 18 bp, Artificial sequence
  Reverse Primer
acccgtttcgtcagctcc

SEQ ID NO: 10179 - DNA, 21 bp, Artificial sequence
  Reverse Primer
cctacccccaacacataaaac

SEQ ID NO: 10180 - DNA, 22 bp, Artificial sequence
  Reverse Primer
atttgcacatgagacaatgaaa

SEQ ID NO: 10181 - DNA, 30 bp, Artificial sequence
  Reverse Primer
aaataatatatctataatcactcttttggt

SEQ ID NO: 10182 - DNA, 18 bp, Artificial sequence
  Reverse Primer
tttcaggccacttgttgc

SEQ ID NO: 10183 - DNA, 21 bp, Artificial sequence
  Reverse Primer
atatcacattccgtaaagggc

SEQ ID NO: 10184 - DNA, 25 bp, Artificial sequence
  Reverse Primer
aaatcttggttagttttgaacatgt

SEQ ID NO: 10185 - DNA, 29 bp, Artificial sequence
  Reverse Primer
gtaaattatttaaaacacatgctgtagtg

SEQ ID NO: 10186 - DNA, 23 bp, Artificial sequence
  Reverse Primer
agacacacaactgttcaaatgtg

SEQ ID NO: 10187 - DNA, 25 bp, Artificial sequence
  Reverse Primer
ttgtactctgaaagtcaagtctgaa

SEQ ID NO: 10188 - DNA, 29 bp, Artificial sequence
  Reverse Primer
taaacaaataytgttaaatctgaaagtgc

SEQ ID NO: 10189 - DNA, 18 bp, Artificial sequence
  Reverse Primer
tgttgcctcaatttggtg

SEQ ID NO: 10190 - DNA, 24 bp, Artificial sequence
  Reverse Primer
attttggtaattcagtgacacagc

SEQ ID NO: 10191 - DNA, 23 bp, Artificial sequence
  Reverse Primer
cttattttctcttttccaaaggg

SEQ ID NO: 10192 - DNA, 29 bp, Artificial sequence
  Reverse Primer
aaacatctagaaacttgattatcttgttg

SEQ ID NO: 10193 - DNA, 24 bp, Artificial sequence
  Reverse Primer
agcctaakgttacatttggagtct

SEQ ID NO: 10194 - DNA, 28 bp, Artificial sequence
  Reverse Primer
ccatttatataaagttcaaaacaaacac

SEQ ID NO: 10195 - DNA, 21 bp, Artificial sequence
  Reverse Primer
tcattaggccagacataaagg

SEQ ID NO: 10196 - DNA, 27 bp, Artificial sequence
  Reverse Primer
taaatagactaaaaagcagagctaagc

SEQ ID NO: 10197 - DNA, 28 bp, Artificial sequence
  Reverse Primer
aattagctcaaaaacatagacataaatg

SEQ ID NO: 10198 - DNA, 24 bp, Artificial sequence
  Reverse Primer
aattgtgttaacctgtaaagatgg

SEQ ID NO: 10199 - DNA, 19 bp, Artificial sequence
  Reverse Primer
aactattgcccacacccac

SEQ ID NO: 10200 - DNA, 26 bp, Artificial sequence
  Reverse Primer
tgagatagttccttgaaacttgtcta

SEQ ID NO: 10201 - DNA, 23 bp, Artificial sequence
  Reverse Primer
agttgcttccttatcattttcca

SEQ ID NO: 10202 - DNA, 27 bp, Artificial sequence
  Reverse Primer
tttagaatttctctgtttctgtgagtt

SEQ ID NO: 10203 - DNA, 26 bp, Artificial sequence
  Reverse Primer
aaaagaagatacagagagctgatacc

SEQ ID NO: 10204 - DNA, 20 bp, Artificial sequence
  Reverse Primer
tgtgctccttctctgttcac

SEQ ID NO: 10205 - DNA, 29 bp, Artificial sequence
  Reverse Primer
atttaggaattaagattgactctgtaaga

SEQ ID NO: 10206 - DNA, 27 bp, Artificial sequence
  Reverse Primer
taatgatgttttgtgactaaaagtgaa

SEQ ID NO: 10207 - DNA, 26 bp, Artificial sequence
  Reverse Primer
aagagaggtagggaagataaaaaatg

SEQ ID NO: 10208 - DNA, 24 bp, Artificial sequence
  Reverse Primer
aattgggattcttctagtttgtgt

SEQ ID NO: 10209 - DNA, 26 bp, Artificial sequence
  Reverse Primer
cagtttttagaaaatttgctttaagg

SEQ ID NO: 10210 - DNA, 22 bp, Artificial sequence
  Reverse Primer
aaatacctgcttcccactgtaa

SEQ ID NO: 10211 - DNA, 28 bp, Artificial sequence
  Reverse Primer
taaatgaattatcacactcatttattcc

SEQ ID NO: 10212 - DNA, 25 bp, Artificial sequence
  Reverse Primer
aaaattacagtgaaacatctgcttt

SEQ ID NO: 10213 - DNA, 24 bp, Artificial sequence
  Reverse Primer
atcattggttagatccaagttttt

SEQ ID NO: 10214 - DNA, 23 bp, Artificial sequence
  Reverse Primer
gggaatcatcttaagttttccac

SEQ ID NO: 10215 - DNA, 22 bp, Artificial sequence
  Reverse Primer
tttaggagcacttctgtcaagc

SEQ ID NO: 10216 - DNA, 23 bp, Artificial sequence
  Reverse Primer
attggtaagaggaacaggaaaaa

SEQ ID NO: 10217 - DNA, 24 bp, Artificial sequence
  Reverse Primer
agagtctcattatgctggacattc

SEQ ID NO: 10218 - DNA, 20 bp, Artificial sequence
  Reverse Primer
tttctgaggaagcactttgg

SEQ ID NO: 10219 - DNA, 21 bp, Artificial sequence
  Reverse Primer
ccacttccctccatgtaattt

SEQ ID NO: 10220 - DNA, 26 bp, Artificial sequence
  Reverse Primer
ttatctgggctatacagtaggatttt

SEQ ID NO: 10221 - DNA, 26 bp, Artificial sequence
  Reverse Primer
ttagattagaaggatgaagaggagtc

SEQ ID NO: 10222 - DNA, 27 bp, Artificial sequence
  Reverse Primer
aaaagaagatctaacaatttctgtctg

SEQ ID NO: 10223 - DNA, 24 bp, Artificial sequence
  Reverse Primer
aaaacttaggaattgcaaaaaatg

SEQ ID NO: 10224 - DNA, 30 bp, Artificial sequence
  Reverse Primer
aaagaactatattttgcagtatcttattgc

SEQ ID NO: 10225 - DNA, 23 bp, Artificial sequence
  Reverse Primer
caaatcatctttttcttttggag

SEQ ID NO: 10226 - DNA, 27 bp, Artificial sequence
  Reverse Primer
ttatctagggtttaggatctgtttttt

SEQ ID NO: 10227 - DNA, 28 bp, Artificial sequence
  Reverse Primer
aaatgactcagtctttaaacatctttta

SEQ ID NO: 10228 - DNA, 28 bp, Artificial sequence
  Reverse Primer
gcaattaagaaaaatattagagtcaatg

SEQ ID NO: 10229 - DNA, 28 bp, Artificial sequence
  Reverse Primer
tataatttttgactgcatagtgagtttt

SEQ ID NO: 10230 - DNA, 23 bp, Artificial sequence
  Reverse Primer
tgtcccaataaaactgcatttat

SEQ ID NO: 10231 - DNA, 29 bp, Artificial sequence
  Reverse Primer
gcaataactggtaaagaatagataacatt

SEQ ID NO: 10232 - DNA, 25 bp, Artificial sequence
  Reverse Primer
tatttgtcttctacaaccacaaagc

SEQ ID NO: 10233 - DNA, 27 bp, Artificial sequence
  Reverse Primer
aaaaaactaacagaacactgaaaatca

SEQ ID NO: 10234 - DNA, 30 bp, Artificial sequence
  Reverse Primer
atgttcagtaataagatcaacttagtctct

SEQ ID NO: 10235 - DNA, 22 bp, Artificial sequence
  Reverse Primer
attagaaacagtggcaccaatg

SEQ ID NO: 10236 - DNA, 19 bp, Artificial sequence
  Reverse Primer
tgagtcaggggtcactgtt

SEQ ID NO: 10237 - DNA, 20 bp, Artificial sequence
  Reverse Primer
aagaatcccggatcctaagg

SEQ ID NO: 10238 - DNA, 18 bp, Artificial sequence
  Reverse Primer
cattggaaacagtgcccc

SEQ ID NO: 10239 - DNA, 25 bp, Artificial sequence
  Reverse Primer
aaaatgcatcacatactgaaactct

SEQ ID NO: 10240 - DNA, 22 bp, Artificial sequence
  Reverse Primer
tcacgagagtcaggtcttacct

SEQ ID NO: 10241 - DNA, 18 bp, Artificial sequence
  Reverse Primer
agccaaggtagccgagtt

SEQ ID NO: 10242 - DNA, 21 bp, Artificial sequence
  Reverse Primer
atttgtaaaatgggaacccag

SEQ ID NO: 10243 - DNA, 27 bp, Artificial sequence
  Reverse Primer
aagaactaagtcatttagtgaagctcc

SEQ ID NO: 10244 - DNA, 20 bp, Artificial sequence
  Reverse Primer
aaggactcaaaggtccagct

SEQ ID NO: 10245 - DNA, 23 bp, Artificial sequence
  Reverse Primer
ataattacattacagcgtggacc

SEQ ID NO: 10246 - DNA, 19 bp, Artificial sequence
  Reverse Primer
atgatgcagagcggtcttc

SEQ ID NO: 10247 - DNA, 25 bp, Artificial sequence
  Reverse Primer
atgtactcagcaagtccctaattta

SEQ ID NO: 10248 - DNA, 28 bp, Artificial sequence
  Reverse Primer
tttcttaaatactcttagcctctcactc

SEQ ID NO: 10249 - DNA, 21 bp, Artificial sequence
  Reverse Primer
atgactgcagaaggaaaacag

SEQ ID NO: 10250 - DNA, 21 bp, Artificial sequence
  Reverse Primer
tggtggtctaggatgagctaa

SEQ ID NO: 10251 - DNA, 19 bp, Artificial sequence
  Reverse Primer
aaccatactccagcccaga

SEQ ID NO: 10252 - DNA, 18 bp, Artificial sequence
  Reverse Primer
tttgtatgcatcccaggg

SEQ ID NO: 10253 - DNA, 19 bp, Artificial sequence
  Reverse Primer
gccccttcccattctctat

SEQ ID NO: 10254 - DNA, 27 bp, Artificial sequence
  Reverse Primer
tagagtctcygttacatggagattagt

SEQ ID NO: 10255 - DNA, 24 bp, Artificial sequence
  Reverse Primer
aacatatgtttcagaaggaagctc

SEQ ID NO: 10256 - DNA, 23 bp, Artificial sequence
  Reverse Primer
taatccttctgggaactgagtct

SEQ ID NO: 10257 - DNA, 30 bp, Artificial sequence
  Reverse Primer
atgtatatgtagatctgtatgtatatatgg

SEQ ID NO: 10258 - DNA, 23 bp, Artificial sequence
  Reverse Primer
taaaaggggaaaataaaagcaca

SEQ ID NO: 10259 - DNA, 28 bp, Artificial sequence
  Reverse Primer
tagagttgcctsttattcttgattatac

SEQ ID NO: 10260 - DNA, 30 bp, Artificial sequence
  Reverse Primer
tatctaaaacaatctgtgttstagttagaa

SEQ ID NO: 10261 - DNA, 23 bp, Artificial sequence
  Reverse Primer
ttcataggtcagcagataaaggc

SEQ ID NO: 10262 - DNA, 26 bp, Artificial sequence
  Reverse Primer
atttaagaggtgatctaaaagtggaa

SEQ ID NO: 10263 - DNA, 28 bp, Artificial sequence
  Reverse Primer
aattagatgttttctccttcsttctata

SEQ ID NO: 10264 - DNA, 27 bp, Artificial sequence
  Reverse Primer
ttaaaatgctattgagttacaatgagc

SEQ ID NO: 10265 - DNA, 29 bp, Artificial sequence
  Reverse Primer
aattattattctgttattggtaaggagag

SEQ ID NO: 10266 - DNA, 22 bp, Artificial sequence
  Reverse Primer
atggcagacaaccacttatact

SEQ ID NO: 10267 - DNA, 24 bp, Artificial sequence
  Reverse Primer
acttatttcctcagatgtgattgc

SEQ ID NO: 10268 - DNA, 23 bp, Artificial sequence
  Reverse Primer
ttctgtgttcaaagatgttcttg

SEQ ID NO: 10269 - DNA, 28 bp, Artificial sequence
  Reverse Primer
taaatttcattcataatctgtaaacctg

SEQ ID NO: 10270 - DNA, 25 bp, Artificial sequence
  Reverse Primer
atctaaatgaattctgagtttccaa

SEQ ID NO: 10271 - DNA, 27 bp, Artificial sequence
  Reverse Primer
attaattttttcagcaaatgtgtagtc

SEQ ID NO: 10272 - DNA, 22 bp, Artificial sequence
  Reverse Primer
attttcttcatgaggggaactc

SEQ ID NO: 10273 - DNA, 21 bp, Artificial sequence
  Reverse Primer
atggtctgtatccacctcctg

SEQ ID NO: 10274 - DNA, 28 bp, Artificial sequence
  Reverse Primer
atgtayttacagcctaaatctrtcaact

SEQ ID NO: 10275 - DNA, 26 bp, Artificial sequence
  Reverse Primer
aaatgcagactttagtagttcttcca

SEQ ID NO: 10276 - DNA, 30 bp, Artificial sequence
  Reverse Primer
aaaaatatagattctctaacaacatactcc

SEQ ID NO: 10277 - DNA, 28 bp, Artificial sequence
  Reverse Primer
ttaataggaattgccattagtaaaatag

SEQ ID NO: 10278 - DNA, 30 bp, Artificial sequence
  Reverse Primer
gctacagtatggttagtaaagaactatata

SEQ ID NO: 10279 - DNA, 24 bp, Artificial sequence
  Reverse Primer
tttatcatatagcaatggacaagg

SEQ ID NO: 10280 - DNA, 28 bp, Artificial sequence
  Reverse Primer
acattacaaaattattaccacaatcaag

SEQ ID NO: 10281 - DNA, 25 bp, Artificial sequence
  Reverse Primer
cctttatgtttttccaataggtacg

SEQ ID NO: 10282 - DNA, 20 bp, Artificial sequence
  Reverse Primer
gccgttaagcgtacagtctc

SEQ ID NO: 10283 - DNA, 22 bp, Artificial sequence
  Reverse Primer
aaatatgtcaaaagtgctgacc

SEQ ID NO: 10284 - DNA, 23 bp, Artificial sequence
  Reverse Primer
agctaatccattgacttgtctgt

SEQ ID NO: 10285 - DNA, 28 bp, Artificial sequence
  Reverse Primer
tgtgctgaaagtacatatataaaagtcc

SEQ ID NO: 10286 - DNA, 27 bp, Artificial sequence
  Reverse Primer
aaaaatttacagtgtcctttgagtaag

SEQ ID NO: 10287 - DNA, 30 bp, Artificial sequence
  Reverse Primer
gaacatgtttattctactttaatttctctg

SEQ ID NO: 10288 - DNA, 23 bp, Artificial sequence
  Reverse Primer
aatgtttaaaaatttccagtggg

SEQ ID NO: 10289 - DNA, 23 bp, Artificial sequence
  Reverse Primer
aagggcactttctgagttagatg

SEQ ID NO: 10290 - DNA, 27 bp, Artificial sequence
  Reverse Primer
gaatccaattcttacatagagtatgca

SEQ ID NO: 10291 - DNA, 29 bp, Artificial sequence
  Reverse Primer
aatacaccaactgataaagtttttagaag

SEQ ID NO: 10292 - DNA, 24 bp, Artificial sequence
  Reverse Primer
tggtaaaactaagttgctaatgca

SEQ ID NO: 10293 - DNA, 26 bp, Artificial sequence
  Reverse Primer
ttttactaaacgcactaacacagtct

SEQ ID NO: 10294 - DNA, 28 bp, Artificial sequence
  Reverse Primer
tattgtaagttaaacagaagtccaattc

SEQ ID NO: 10295 - DNA, 23 bp, Artificial sequence
  Reverse Primer
aggaaattgttagcaaggaaaaa

SEQ ID NO: 10296 - DNA, 24 bp, Artificial sequence
  Reverse Primer
tgccatcatatatgaaatgaattg

SEQ ID NO: 10297 - DNA, 18 bp, Artificial sequence
  Reverse Primer
atcagtggtcccaacggg

SEQ ID NO: 10298 - DNA, 20 bp, Artificial sequence
  Reverse Primer
tgtcgttaaccactgatgcc

SEQ ID NO: 10299 - DNA, 27 bp, Artificial sequence
  Reverse Primer
aaagttctaactctcacttatcaacca

SEQ ID NO: 10300 - DNA, 25 bp, Artificial sequence
  Reverse Primer
tctgaacattaggacaaaacctaga

SEQ ID NO: 10301 - DNA, 22 bp, Artificial sequence
  Reverse Primer
aatggttcaagctgtcttctgt

SEQ ID NO: 10302 - DNA, 19 bp, Artificial sequence
  Reverse Primer
acaaacaccacccttcctc

SEQ ID NO: 10303 - DNA, 19 bp, Artificial sequence
  Reverse Primer
atttgcaagaaggagcacc

SEQ ID NO: 10304 - DNA, 19 bp, Artificial sequence
  Reverse Primer
gttcccacctaggaccctc

SEQ ID NO: 10305 - DNA, 18 bp, Artificial sequence
  Reverse Primer
cttgcttggctttccctg

SEQ ID NO: 10306 - DNA, 19 bp, Artificial sequence
  Reverse Primer
ttcacacagatccactgcc

SEQ ID NO: 10307 - DNA, 20 bp, Artificial sequence
  Reverse Primer
aggtgggtaagaagtcggag

SEQ ID NO: 10308 - DNA, 22 bp, Artificial sequence
  Reverse Primer
atgatgtatttgcaccaagtca

SEQ ID NO: 10309 - DNA, 18 bp, Artificial sequence
  Reverse Primer
agggaggagaaggtgagg

SEQ ID NO: 10310 - DNA, 25 bp, Artificial sequence
  Reverse Primer
ttctaagaagtgtggtagacatcca

SEQ ID NO: 10311 - DNA, 18 bp, Artificial sequence
  Reverse Primer
ggaggggatcatgcagct

SEQ ID NO: 10312 - DNA, 22 bp, Artificial sequence
  Reverse Primer
atacttccaccagagtcctgtg

SEQ ID NO: 10313 - DNA, 18 bp, Artificial sequence
  Reverse Primer
ttgcttttagccccagtg

SEQ ID NO: 10314 - DNA, 20 bp, Artificial sequence
  Reverse Primer
atttgttttccagggcactt

SEQ ID NO: 10315 - DNA, 24 bp, Artificial sequence
  Reverse Primer
aagacagataattgaaatgtacgc

SEQ ID NO: 10316 - DNA, 18 bp, Artificial sequence
  Reverse Primer
gcccttttcgtgactcca

SEQ ID NO: 10317 - DNA, 19 bp, Artificial sequence
  Reverse Primer
agacgacgagagtctgcac

SEQ ID NO: 10318 - DNA, 30 bp, Artificial sequence
  Reverse Primer
ctgatgtcagtcattaaatttagtatacaa

SEQ ID NO: 10319 - DNA, 21 bp, Artificial sequence
  Reverse Primer
agatcccatggctacataggt

SEQ ID NO: 10320 - DNA, 26 bp, Artificial sequence
  Reverse Primer
tcattaaaccatctcacatattcact

SEQ ID NO: 10321 - DNA, 22 bp, Artificial sequence
  Reverse Primer
tttctgctgtcatcactcagag

SEQ ID NO: 10322 - DNA, 23 bp, Artificial sequence
  Reverse Primer
aatggtcatagtcattttgcaat

SEQ ID NO: 10323 - DNA, 23 bp, Artificial sequence
  Reverse Primer
tgttgatccattcagatgtgtaa

SEQ ID NO: 10324 - DNA, 28 bp, Artificial sequence
  Reverse Primer
agttttataatgcaaaaatcagtattcc

SEQ ID NO: 10325 - DNA, 28 bp, Artificial sequence
  Reverse Primer
taattttatattccactttgtaacttgc

SEQ ID NO: 10326 - DNA, 27 bp, Artificial sequence
  Reverse Primer
aatattgtgtacttaagctgagagttg

SEQ ID NO: 10327 - DNA, 30 bp, Artificial sequence
  Reverse Primer
aatataggactcagaaaataacagttaata

SEQ ID NO: 10328 - DNA, 30 bp, Artificial sequence
  Reverse Primer
tagagactgaattgattttaaataagtata

SEQ ID NO: 10329 - DNA, 24 bp, Artificial sequence
  Reverse Primer
tttactggaagttctggtgaaatt

SEQ ID NO: 10330 - DNA, 28 bp, Artificial sequence
  Reverse Primer
cagcaaataattctcttatcatctctag

SEQ ID NO: 10331 - DNA, 26 bp, Artificial sequence
  Reverse Primer
ttaaaagactgtatctcagtccttgc

SEQ ID NO: 10332 - DNA, 30 bp, Artificial sequence
  Reverse Primer
agtattttaacatttgaatttactcttcta

SEQ ID NO: 10333 - DNA, 21 bp, Artificial sequence
  Reverse Primer
ttgaatgtttgctaaacgtcc

SEQ ID NO: 10334 - DNA, 30 bp, Artificial sequence
  Reverse Primer
attgtttttatagacacctaactattaccc

SEQ ID NO: 10335 - DNA, 27 bp, Artificial sequence
  Reverse Primer
ttttcgtctaaaacattaaattagacc

SEQ ID NO: 10336 - DNA, 23 bp, Artificial sequence
  Reverse Primer
atgtgaagagagaaaccagtcag

SEQ ID NO: 10337 - DNA, 24 bp, Artificial sequence
  Reverse Primer
taaatgaactttccagaggattgt

SEQ ID NO: 10338 - DNA, 27 bp, Artificial sequence
  Reverse Primer
aaaatttccagtaaaacttagtctgag

SEQ ID NO: 10339 - DNA, 20 bp, Artificial sequence
  Reverse Primer
attccagaatgtgacttgcc

SEQ ID NO: 10340 - DNA, 24 bp, Artificial sequence
  Reverse Primer
ccacaaactttcaattgytttaaa

SEQ ID NO: 10341 - DNA, 22 bp, Artificial sequence
  Reverse Primer
tttgacagttgccagatatcag

SEQ ID NO: 10342 - DNA, 25 bp, Artificial sequence
  Reverse Primer
aaagacttttaaaatggttcacatc

SEQ ID NO: 10343 - DNA, 25 bp, Artificial sequence
  Reverse Primer
attttacagcaaattatccactcaa

SEQ ID NO: 10344 - DNA, 26 bp, Artificial sequence
  Reverse Primer
tttcttcaactatctagaaaatggtg

SEQ ID NO: 10345 - DNA, 24 bp, Artificial sequence
  Reverse Primer
ttttgttttgctactaaaaccctt

SEQ ID NO: 10346 - DNA, 24 bp, Artificial sequence
  Reverse Primer
taaagggagttttacctttcactt

SEQ ID NO: 10347 - DNA, 23 bp, Artificial sequence
  Reverse Primer
taaagtcttcagcaaatgaacag

SEQ ID NO: 10348 - DNA, 25 bp, Artificial sequence
  Reverse Primer
arcatctaagagttgaagatggaga

SEQ ID NO: 10349 - DNA, 30 bp, Artificial sequence
  Reverse Primer
aaaccctaaataagagtcagtaaaatagat

SEQ ID NO: 10350 - DNA, 26 bp, Artificial sequence
  Reverse Primer
tcaaaactttaattctgagtttttgc

SEQ ID NO: 10351 - DNA, 28 bp, Artificial sequence
  Reverse Primer
aattgatacaaattgaagtctctttctt

SEQ ID NO: 10352 - DNA, 22 bp, Artificial sequence
  Reverse Primer
tgctcacttctcattgtctgtg

SEQ ID NO: 10353 - DNA, 29 bp, Artificial sequence
  Reverse Primer
ataggattcttgactaaaaatatctgact

SEQ ID NO: 10354 - DNA, 23 bp, Artificial sequence
  Reverse Primer
gttgtcacagagatgctcttttt

SEQ ID NO: 10355 - DNA, 22 bp, Artificial sequence
  Reverse Primer
tagtcagagaagaacaggcaac

SEQ ID NO: 10356 - DNA, 22 bp, Artificial sequence
  Reverse Primer
aaattggacttacaaacacgct

SEQ ID NO: 10357 - DNA, 21 bp, Artificial sequence
  Reverse Primer
ccaagcagcttgttaaactgt

SEQ ID NO: 10358 - DNA, 28 bp, Artificial sequence
  Reverse Primer
tttacctgacaagagaactaaacttaag

SEQ ID NO: 10359 - DNA, 20 bp, Artificial sequence
  Reverse Primer
attgcgagaattcttagggc

SEQ ID NO: 10360 - DNA, 29 bp, Artificial sequence
  Reverse Primer
ttattttctagttctgcttacagatctct

SEQ ID NO: 10361 - DNA, 28 bp, Artificial sequence
  Reverse Primer
aatattttctttcactttcttaccctat

SEQ ID NO: 10362 - DNA, 26 bp, Artificial sequence
  Reverse Primer
gagaggaaggagtctgtagtaaaagc

SEQ ID NO: 10363 - DNA, 27 bp, Artificial sequence
  Reverse Primer
ttaaaatgaaacactattcaaaggttg

SEQ ID NO: 10364 - DNA, 23 bp, Artificial sequence
  Reverse Primer
atagaaaaaggcagggatgtaaa

SEQ ID NO: 10365 - DNA, 19 bp, Artificial sequence
  Reverse Primer
tgaatgggatggagtcttg

SEQ ID NO: 10366 - DNA, 20 bp, Artificial sequence
  Reverse Primer
aaaacaagagggtccacaac

SEQ ID NO: 10367 - DNA, 24 bp, Artificial sequence
  Reverse Primer
cattcatgctccaagatatattcc

SEQ ID NO: 10368 - DNA, 23 bp, Artificial sequence
  Reverse Primer
agaatcacattttggatgaaaga

SEQ ID NO: 10369 - DNA, 20 bp, Artificial sequence
  Reverse Primer
tcattgctaatggtgatggg

SEQ ID NO: 10370 - DNA, 21 bp, Artificial sequence
  Reverse Primer
ttccaattgttaaaggcttgc

SEQ ID NO: 10371 - DNA, 19 bp, Artificial sequence
  Reverse Primer
agacacaggaaatgcaggc

SEQ ID NO: 10372 - DNA, 20 bp, Artificial sequence
  Reverse Primer
agaggatattcctaggcccc

SEQ ID NO: 10373 - DNA, 24 bp, Artificial sequence
  Reverse Primer
ttgacaagggagtaaaacttaggt

SEQ ID NO: 10374 - DNA, 20 bp, Artificial sequence
  Reverse Primer
ttttaaggaggtctgggtcc

SEQ ID NO: 10375 - DNA, 18 bp, Artificial sequence
  Reverse Primer
ttccaggactgttgccca

SEQ ID NO: 10376 - DNA, 18 bp, Artificial sequence
  Reverse Primer
agcggcaccaaaagctgg

SEQ ID NO: 10377 - DNA, 19 bp, Artificial sequence
  Reverse Primer
attttgcaggatgtggtcg

SEQ ID NO: 10378 - DNA, 26 bp, Artificial sequence
  Reverse Primer
acaagggacacagtacataaaagata

SEQ ID NO: 10379 - DNA, 21 bp, Artificial sequence
  Reverse Primer
atccctaaagtatgccaaggc

SEQ ID NO: 10380 - DNA, 26 bp, Artificial sequence
  Reverse Primer
taactttttggattgtgctgtagtat

SEQ ID NO: 10381 - DNA, 18 bp, Artificial sequence
  Reverse Primer
cgacatccccaccacacc

SEQ ID NO: 10382 - DNA, 21 bp, Artificial sequence
  Reverse Primer
ataggagcaggcattgtctct

SEQ ID NO: 10383 - DNA, 22 bp, Artificial sequence
  Reverse Primer
aacagtgacttttggcttagca

SEQ ID NO: 10384 - DNA, 24 bp, Artificial sequence
  Reverse Primer
aattatcccaagtaatctccatgg

SEQ ID NO: 10385 - DNA, 23 bp, Artificial sequence
  Reverse Primer
tgggcagttgttttattttttaa

SEQ ID NO: 10386 - DNA, 23 bp, Artificial sequence
  Reverse Primer
aaccagcatttttcctctctagt

SEQ ID NO: 10387 - DNA, 26 bp, Artificial sequence
  Reverse Primer
tttttgccatatcacttacagataac

SEQ ID NO: 10388 - DNA, 22 bp, Artificial sequence
  Reverse Primer
tgtgctcctaacatgagttttg

SEQ ID NO: 10389 - DNA, 20 bp, Artificial sequence
  Reverse Primer
acagatggacctttcatccc

SEQ ID NO: 10390 - DNA, 26 bp, Artificial sequence
  Reverse Primer
aaaatttctatgattttcctctgtct

SEQ ID NO: 10391 - DNA, 20 bp, Artificial sequence
  Reverse Primer
ttggcaatgtttaccctttg

SEQ ID NO: 10392 - DNA, 26 bp, Artificial sequence
  Reverse Primer
cccaattttgttgctatatttaaact

SEQ ID NO: 10393 - DNA, 29 bp, Artificial sequence
  Reverse Primer
aaaatcactctataaattcttctttctcc

SEQ ID NO: 10394 - DNA, 24 bp, Artificial sequence
  Reverse Primer
acaaggtgagttatcaagtgtgtg

SEQ ID NO: 10395 - DNA, 27 bp, Artificial sequence
  Reverse Primer
ttattttgtttatgggtttaatctgtg

SEQ ID NO: 10396 - DNA, 28 bp, Artificial sequence
  Reverse Primer
tacgtgttttgttttttatatacaacct

SEQ ID NO: 10397 - DNA, 20 bp, Artificial sequence
  Reverse Primer
actgcaggttacttgccttc

SEQ ID NO: 10398 - DNA, 24 bp, Artificial sequence
  Reverse Primer
taaaatccctcaagaattgctatt

SEQ ID NO: 10399 - DNA, 22 bp, Artificial sequence
  Reverse Primer
aaaccaattatctgctctctgc

SEQ ID NO: 10400 - DNA, 27 bp, Artificial sequence
  Reverse Primer
camtattgtaaatcaagtatggttcaa

SEQ ID NO: 10401 - DNA, 26 bp, Artificial sequence
  Reverse Primer
tttatgtagcatttgaatcatctacc

SEQ ID NO: 10402 - DNA, 25 bp, Artificial sequence
  Reverse Primer
ataaagtccccttagtgacaaaaga

SEQ ID NO: 10403 - DNA, 25 bp, Artificial sequence
  Reverse Primer
attaagatcaacattttatggtccc

SEQ ID NO: 10404 - DNA, 22 bp, Artificial sequence
  Reverse Primer
atatcagcatccatcaattggt

SEQ ID NO: 10405 - DNA, 30 bp, Artificial sequence
  Reverse Primer
tgaactgaggtaattattagttctgtattt

SEQ ID NO: 10406 - DNA, 21 bp, Artificial sequence
  Reverse Primer
actggctaagtagatgctgca

SEQ ID NO: 10407 - DNA, 23 bp, Artificial sequence
  Reverse Primer
agatctcttgggagtggtagaac

SEQ ID NO: 10408 - DNA, 29 bp, Artificial sequence
  Reverse Primer
tgaaaatgaaagagagctaatatgtacta

SEQ ID NO: 10409 - DNA, 30 bp, Artificial sequence
  Reverse Primer
atttcagtactctactgttatatattgtta

SEQ ID NO: 10410 - DNA, 27 bp, Artificial sequence
  Reverse Primer
gaagatttgcaactagttaaagtagca

SEQ ID NO: 10411 - DNA, 26 bp, Artificial sequence
  Reverse Primer
taaatggagtcctagatcttgaaact

SEQ ID NO: 10412 - DNA, 21 bp, Artificial sequence
  Reverse Primer
aaacttcttccttccacctcc

SEQ ID NO: 10413 - DNA, 24 bp, Artificial sequence
  Reverse Primer
aagggttaggtgattttaaggttc

SEQ ID NO: 10414 - DNA, 24 bp, Artificial sequence
  Reverse Primer
tttctcttgtgcttaatcttgtcg

SEQ ID NO: 10415 - DNA, 21 bp, Artificial sequence
  Reverse Primer
tttcctctgcctttactgtcc

SEQ ID NO: 10416 - DNA, 18 bp, Artificial sequence
  Reverse Primer
cctgacctgacacgtggg

SEQ ID NO: 10417 - DNA, 18 bp, Artificial sequence
  Reverse Primer
ttcaacccacctctgggc

SEQ ID NO: 10418 - DNA, 22 bp, Artificial sequence
  Reverse Primer
taacactcaygtatgtgccacc

SEQ ID NO: 10419 - DNA, 20 bp, Artificial sequence
  Reverse Primer
ttgccatgatgttctctgag

SEQ ID NO: 10420 - DNA, 21 bp, Artificial sequence
  Reverse Primer
actagatcccacygtgaggag

SEQ ID NO: 10421 - DNA, 23 bp, Artificial sequence
  Reverse Primer
atttgcaagtaattaaaggcacg

SEQ ID NO: 10422 - DNA, 22 bp, Artificial sequence
  Reverse Primer
atgacaaaactgaccctgagag

SEQ ID NO: 10423 - DNA, 22 bp, Artificial sequence
  Reverse Primer
tgttcagtcagtaactcatgcc

SEQ ID NO: 10424 - DNA, 18 bp, Artificial sequence
  Reverse Primer
ccartgaaggcgaacagc

SEQ ID NO: 10425 - DNA, 21 bp, Artificial sequence
  Reverse Primer
tatgtggttgtgtcctcgagt

SEQ ID NO: 10426 - DNA, 21 bp, Artificial sequence
  Reverse Primer
atgacagaaggaggactggat

SEQ ID NO: 10427 - DNA, 22 bp, Artificial sequence
  Reverse Primer
agaactctgtcttgccttttga

SEQ ID NO: 10428 - DNA, 25 bp, Artificial sequence
  Reverse Primer
atctttgggaataactctcacattt

SEQ ID NO: 10429 - DNA, 23 bp, Artificial sequence
  Reverse Primer
ttgtttttgaaatgagaaagcat

SEQ ID NO: 10430 - DNA, 21 bp, Artificial sequence
  Reverse Primer
tggttcttgttgcagtcatct

SEQ ID NO: 10431 - DNA, 24 bp, Artificial sequence
  Reverse Primer
caaaatgtttgactgagttttttg

SEQ ID NO: 10432 - DNA, 26 bp, Artificial sequence
  Reverse Primer
tttcaatgaatttgctatcttacttg

SEQ ID NO: 10433 - DNA, 25 bp, Artificial sequence
  Reverse Primer
aataatatgtggatttctttgggtt

SEQ ID NO: 10434 - DNA, 27 bp, Artificial sequence
  Reverse Primer
tgttagtataattgtggacaaaagatg

SEQ ID NO: 10435 - DNA, 26 bp, Artificial sequence
  Reverse Primer
agatttcagaacaagggtaaaaatta

SEQ ID NO: 10436 - DNA, 23 bp, Artificial sequence
  Reverse Primer
taccggtcacatcataagaaaag

SEQ ID NO: 10437 - DNA, 28 bp, Artificial sequence
  Reverse Primer
tttagatgtctaaactggtagtgcttaa

SEQ ID NO: 10438 - DNA, 23 bp, Artificial sequence
  Reverse Primer
tctctagaatgaggacggtaaca

SEQ ID NO: 10439 - DNA, 27 bp, Artificial sequence
  Reverse Primer
ttttaaattgatgtcatgattcagtag

SEQ ID NO: 10440 - DNA, 22 bp, Artificial sequence
  Reverse Primer
aggcacttgtagacacttaccc

SEQ ID NO: 10441 - DNA, 25 bp, Artificial sequence
  Reverse Primer
acataaatgccctttacttacaagg

SEQ ID NO: 10442 - DNA, 21 bp, Artificial sequence
  Reverse Primer
aggggtagtgaggatcaaaga

SEQ ID NO: 10443 - DNA, 24 bp, Artificial sequence
  Reverse Primer
ttacattcatttctcaaattccac

SEQ ID NO: 10444 - DNA, 20 bp, Artificial sequence
  Reverse Primer
taattgccccctagttcagg

SEQ ID NO: 10445 - DNA, 25 bp, Artificial sequence
  Reverse Primer
aaacattaaaaaggacatgaatgag

SEQ ID NO: 10446 - DNA, 20 bp, Artificial sequence
  Reverse Primer
tgactgccacatccctactt

SEQ ID NO: 10447 - DNA, 23 bp, Artificial sequence
  Reverse Primer
aaataagaaaaggcaatggaaag

SEQ ID NO: 10448 - DNA, 24 bp, Artificial sequence
  Reverse Primer
tcaaactctgcattttaacaaaac

SEQ ID NO: 10449 - DNA, 21 bp, Artificial sequence
  Reverse Primer
aaagggctatgatacagtgcc

SEQ ID NO: 10450 - DNA, 19 bp, Artificial sequence
  Reverse Primer
tttttcagtagggtgggca

SEQ ID NO: 10451 - DNA, 22 bp, Artificial sequence
  Reverse Primer
ataggattgtcatgaggattgg

SEQ ID NO: 10452 - DNA, 29 bp, Artificial sequence
  Reverse Primer
taaaaatagtatcaatactcctttctcca

SEQ ID NO: 10453 - DNA, 24 bp, Artificial sequence
  Reverse Primer
tttttgtgccattaaacttgtaca

SEQ ID NO: 10454 - DNA, 23 bp, Artificial sequence
  Reverse Primer
actcagcatccagagtctacaaa

SEQ ID NO: 10455 - DNA, 19 bp, Artificial sequence
  Reverse Primer
acggtcatttccaggtctt

SEQ ID NO: 10456 - DNA, 24 bp, Artificial sequence
  Reverse Primer
cagtgaattttggcacttataaaa

SEQ ID NO: 10457 - DNA, 24 bp, Artificial sequence
  Reverse Primer
tgtttaatgtgtgccatttagttc

SEQ ID NO: 10458 - DNA, 27 bp, Artificial sequence
  Reverse Primer
taaagtctatgagaattgtttcagctt

SEQ ID NO: 10459 - DNA, 18 bp, Artificial sequence
  Reverse Primer
aggcaggtggaattttcc

SEQ ID NO: 10460 - DNA, 30 bp, Artificial sequence
  Reverse Primer
tgtaacatctatatgtataacatcttaagc

SEQ ID NO: 10461 - DNA, 26 bp, Artificial sequence
  Reverse Primer
tgataataaatcagaatctgaaccac

SEQ ID NO: 10462 - DNA, 25 bp, Artificial sequence
  Reverse Primer
attttgttgtactatattggttggc

SEQ ID NO: 10463 - DNA, 26 bp, Artificial sequence
  Reverse Primer
atgttatcagtgtgcaaattaaaatg

SEQ ID NO: 10464 - DNA, 25 bp, Artificial sequence
  Reverse Primer
tctttagtcctctttagcctgtttc

SEQ ID NO: 10465 - DNA, 20 bp, Artificial sequence
  Reverse Primer
atgaagagatgggtctgtcc

SEQ ID NO: 10466 - DNA, 28 bp, Artificial sequence
  Reverse Primer
aggaatgacaaattaagtaaagaattgt

SEQ ID NO: 10467 - DNA, 25 bp, Artificial sequence
  Reverse Primer
gctaaataagccaggaacataaatt

SEQ ID NO: 10468 - DNA, 21 bp, Artificial sequence
  Reverse Primer
agaaacaaccccaattttctg

SEQ ID NO: 10469 - DNA, 24 bp, Artificial sequence
  Reverse Primer
ttacacattctccccttaaagaag

SEQ ID NO: 10470 - DNA, 24 bp, Artificial sequence
  Reverse Primer
atcaggagagagaagaacagatca

SEQ ID NO: 10471 - DNA, 26 bp, Artificial sequence
  Reverse Primer
atttatcagctccagatagctagaaa

SEQ ID NO: 10472 - DNA, 24 bp, Artificial sequence
  Reverse Primer
tcttttagaaccaagttccattct

SEQ ID NO: 10473 - DNA, 28 bp, Artificial sequence
  Reverse Primer
aaattatctggttaaaatctaaaactgg

SEQ ID NO: 10474 - DNA, 20 bp, Artificial sequence
  Reverse Primer
ttccgcatttgagaataatg

SEQ ID NO: 10475 - DNA, 18 bp, Artificial sequence
  Reverse Primer
aggatggcgggaggtgat

SEQ ID NO: 10476 - DNA, 21 bp, Artificial sequence
  Reverse Primer
agctgtgtacagtctttccca

SEQ ID NO: 10477 - DNA, 22 bp, Artificial sequence
  Reverse Primer
ttccaaacagtgttgtttctcc

SEQ ID NO: 10478 - DNA, 19 bp, Artificial sequence
  Reverse Primer
gcagcctgtgcacttagag

SEQ ID NO: 10479 - DNA, 19 bp, Artificial sequence
  Reverse Primer
tcaggcatctcctcctctg

SEQ ID NO: 10480 - DNA, 18 bp, Artificial sequence
  Reverse Primer
ccagaaacagggcacatg

SEQ ID NO: 10481 - DNA, 19 bp, Artificial sequence
  Reverse Primer
aaattggggctttagggag

SEQ ID NO: 10482 - DNA, 21 bp, Artificial sequence
  Reverse Primer
tagagtagcaggtgcatgagg

SEQ ID NO: 10483 - DNA, 18 bp, Artificial sequence
  Reverse Primer
aatgtggccggaatttgg

SEQ ID NO: 10484 - DNA, 19 bp, Artificial sequence
  Reverse Primer
ctgcaacttgcactgagtc

SEQ ID NO: 10485 - DNA, 19 bp, Artificial sequence
  Reverse Primer
tccttggtagatggcatgc

SEQ ID NO: 10486 - DNA, 26 bp, Artificial sequence
  Reverse Primer
taaagcttsttaacttggtcctatct

SEQ ID NO: 10487 - DNA, 26 bp, Artificial sequence
  Reverse Primer
atttcctttattgcttctaatggtag

SEQ ID NO: 10488 - DNA, 25 bp, Artificial sequence
  Reverse Primer
tctttactaatatcatggatgcctg

SEQ ID NO: 10489 - DNA, 23 bp, Artificial sequence
  Reverse Primer
aaagattggcagaactgtaagtc

SEQ ID NO: 10490 - DNA, 24 bp, Artificial sequence
  Reverse Primer
cacatttcaaaatagaacatttgc

SEQ ID NO: 10491 - DNA, 21 bp, Artificial sequence
  Reverse Primer
agctccaaagcttacttcctg

SEQ ID NO: 10492 - DNA, 24 bp, Artificial sequence
  Reverse Primer
agcattttgcaaatattacctatg

SEQ ID NO: 10493 - DNA, 26 bp, Artificial sequence
  Reverse Primer
aaaaaaagctgcataatagataacgt

SEQ ID NO: 10494 - DNA, 28 bp, Artificial sequence
  Reverse Primer
acaaaaaccaattatcttaacattatcc

SEQ ID NO: 10495 - DNA, 30 bp, Artificial sequence
  Reverse Primer
ctcattatgagctctaacagattttaatat

SEQ ID NO: 10496 - DNA, 23 bp, Artificial sequence
  Reverse Primer
tatgggtcttctggttcagtact

SEQ ID NO: 10497 - DNA, 22 bp, Artificial sequence
  Reverse Primer
gctctctcactagaagggaagc

SEQ ID NO: 10498 - DNA, 30 bp, Artificial sequence
  Reverse Primer
tttactagacttaagagatgaattcagtac

SEQ ID NO: 10499 - DNA, 26 bp, Artificial sequence
  Reverse Primer
tgaagagtctagcgagtacttcatat

SEQ ID NO: 10500 - DNA, 23 bp, Artificial sequence
  Reverse Primer
ttataaaacacacttccctcctc

SEQ ID NO: 10501 - DNA, 27 bp, Artificial sequence
  Reverse Primer
agagagaaagatagaaataccaacagg

SEQ ID NO: 10502 - DNA, 28 bp, Artificial sequence
  Reverse Primer
aggttcttggttattagaagttattttg

SEQ ID NO: 10503 - DNA, 19 bp, Artificial sequence
  Reverse Primer
tgctacgaaacaacacgct

SEQ ID NO: 10504 - DNA, 30 bp, Artificial sequence
  Reverse Primer
ttaattctctgacttatatgaacattctct

SEQ ID NO: 10505 - DNA, 25 bp, Artificial sequence
  Reverse Primer
tattaacgaatatcatcctcacgat

SEQ ID NO: 10506 - DNA, 24 bp, Artificial sequence
  Reverse Primer
actaagccaggagatttcctctat

SEQ ID NO: 10507 - DNA, 27 bp, Artificial sequence
  Reverse Primer
agtgggaccaaactattatagagtacg

SEQ ID NO: 10508 - DNA, 26 bp, Artificial sequence
  Reverse Primer
aataacagagtcaactacattgctga

SEQ ID NO: 10509 - DNA, 25 bp, Artificial sequence
  Reverse Primer
taatataactgttcctcctgcatgt

SEQ ID NO: 10510 - DNA, 21 bp, Artificial sequence
  Reverse Primer
tctatttgagggcatacaagc

SEQ ID NO: 10511 - DNA, 24 bp, Artificial sequence
  Reverse Primer
aaaaactcaccctgaaactttaga

SEQ ID NO: 10512 - DNA, 30 bp, Artificial sequence
  Reverse Primer
ccagatatctttctactatagagttctact

SEQ ID NO: 10513 - DNA, 25 bp, Artificial sequence
  Reverse Primer
agarctctatttgtcttcaccttga

SEQ ID NO: 10514 - DNA, 20 bp, Artificial sequence
  Reverse Primer
tggttttcagcaaatgttgg

SEQ ID NO: 10515 - DNA, 26 bp, Artificial sequence
  Reverse Primer
tcttattaatgtgattcagtgactcc

SEQ ID NO: 10516 - DNA, 23 bp, Artificial sequence
  Reverse Primer
aaattaaagttmtttgtgtggcc

SEQ ID NO: 10517 - DNA, 27 bp, Artificial sequence
  Reverse Primer
aatttattaccagcttaagttgaacag

SEQ ID NO: 10518 - DNA, 27 bp, Artificial sequence
  Reverse Primer
aaaagttttagttttcctaactttgct

SEQ ID NO: 10519 - DNA, 26 bp, Artificial sequence
  Reverse Primer
ttaatggcagaaatcaatatagctag

SEQ ID NO: 10520 - DNA, 23 bp, Artificial sequence
  Reverse Primer
ccaatgcatctttttcaataagt

SEQ ID NO: 10521 - DNA, 24 bp, Artificial sequence
  Reverse Primer
atgaaattaaaagccagtaaatgg

SEQ ID NO: 10522 - DNA, 21 bp, Artificial sequence
  Reverse Primer
gcctcagtcattcattcatca

SEQ ID NO: 10523 - DNA, 19 bp, Artificial sequence
  Reverse Primer
ctgtaggagggaccatgtg

SEQ ID NO: 10524 - DNA, 21 bp, Artificial sequence
  Reverse Primer
agaacacagtaaaagsaacgc

SEQ ID NO: 10525 - DNA, 26 bp, Artificial sequence
  Reverse Primer
gcttctaatcatgacaattatcactt

SEQ ID NO: 10526 - DNA, 19 bp, Artificial sequence
  Reverse Primer
atttggtgctgcatggtta

SEQ ID NO: 10527 - DNA, 25 bp, Artificial sequence
  Reverse Primer
cctacagtcagttgactttaaagga

SEQ ID NO: 10528 - DNA, 18 bp, Artificial sequence
  Reverse Primer
tgaggccgaacacgctct

SEQ ID NO: 10529 - DNA, 18 bp, Artificial sequence
  Reverse Primer
actgcagagagaaggggg

SEQ ID NO: 10530 - DNA, 28 bp, Artificial sequence
  Reverse Primer
agatttgagttcttttatttcctctcta

SEQ ID NO: 10531 - DNA, 21 bp, Artificial sequence
  Reverse Primer
atgtattcagagatgggcagg

SEQ ID NO: 10532 - DNA, 18 bp, Artificial sequence
  Reverse Primer
aagagcagtcccacccca

SEQ ID NO: 10533 - DNA, 26 bp, Artificial sequence
  Reverse Primer
tttccaattatgttaaactcttcagg

SEQ ID NO: 10534 - DNA, 21 bp, Artificial sequence
  Reverse Primer
agtttccccaaatgtaaagct

SEQ ID NO: 10535 - DNA, 23 bp, Artificial sequence
  Reverse Primer
aaacaattcactgctattcctgg

SEQ ID NO: 10536 - DNA, 19 bp, Artificial sequence
  Reverse Primer
aatgataacccaaggccaa

SEQ ID NO: 10537 - DNA, 19 bp, Artificial sequence
  Reverse Primer
ggtgatggtgctgttgtgt

SEQ ID NO: 10538 - DNA, 21 bp, Artificial sequence
  Reverse Primer
taaccagggtgggattagaat

SEQ ID NO: 10539 - DNA, 26 bp, Artificial sequence
  Reverse Primer
agacatttaaataataaaagctgtgc

SEQ ID NO: 10540 - DNA, 18 bp, Artificial sequence
  Reverse Primer
acagctctttcaccgcag

SEQ ID NO: 10541 - DNA, 28 bp, Artificial sequence
  Reverse Primer
tataaatgaaccatttagaaattaaggc

SEQ ID NO: 10542 - DNA, 19 bp, Artificial sequence
  Reverse Primer
tcggcatactttctctgca

SEQ ID NO: 10543 - DNA, 25 bp, Artificial sequence
  Reverse Primer
ttattccacccaacttatttattga

SEQ ID NO: 10544 - DNA, 22 bp, Artificial sequence
  Reverse Primer
ttaytgggtcataagccaattc

SEQ ID NO: 10545 - DNA, 19 bp, Artificial sequence
  Reverse Primer
tttttgtgartgccccttt

SEQ ID NO: 10546 - DNA, 23 bp, Artificial sequence
  Reverse Primer
tagtgtttggttgtgttagcttg

SEQ ID NO: 10547 - DNA, 27 bp, Artificial sequence
  Reverse Primer
aacaacagtggtcattgaaatataatt

SEQ ID NO: 10548 - DNA, 22 bp, Artificial sequence
  Reverse Primer
tttatgctgcaaatagagctca

SEQ ID NO: 10549 - DNA, 26 bp, Artificial sequence
  Reverse Primer
tgtggagtgaaaataaagatgttaat

SEQ ID NO: 10550 - DNA, 20 bp, Artificial sequence
  Reverse Primer
tatgaaatctggggcagttc

SEQ ID NO: 10551 - DNA, 25 bp, Artificial sequence
  Reverse Primer
aatgctcaatttccagttattaatc

SEQ ID NO: 10552 - DNA, 18 bp, Artificial sequence
  Reverse Primer
taatgggcggtccttgaa

SEQ ID NO: 10553 - DNA, 27 bp, Artificial sequence
  Reverse Primer
gcaagggtttaaaatattgtataattg

SEQ ID NO: 10554 - DNA, 18 bp, Artificial sequence
  Reverse Primer
tgctggggcaagatcagt

SEQ ID NO: 10555 - DNA, 19 bp, Artificial sequence
  Reverse Primer
tgttctgtgctcctttgca

SEQ ID NO: 10556 - DNA, 23 bp, Artificial sequence
  Reverse Primer
agaaaagtctggagccttagtga

SEQ ID NO: 10557 - DNA, 25 bp, Artificial sequence
  Reverse Primer
aaacggtaatggctaaataaactct

SEQ ID NO: 10558 - DNA, 26 bp, Artificial sequence
  Reverse Primer
aaacaattcaacagtatttctcagac

SEQ ID NO: 10559 - DNA, 24 bp, Artificial sequence
  Reverse Primer
aaatcacagtctggtaggtgactc

SEQ ID NO: 10560 - DNA, 28 bp, Artificial sequence
  Reverse Primer
agcactttataatgaatcttttatgtcc

SEQ ID NO: 10561 - DNA, 23 bp, Artificial sequence
  Reverse Primer
agtaggctcttagtttgcagctc

SEQ ID NO: 10562 - DNA, 24 bp, Artificial sequence
  Reverse Primer
tttcacwtcacctttattggaatt

SEQ ID NO: 10563 - DNA, 23 bp, Artificial sequence
  Reverse Primer
aaatacctcttttttctcctccc

SEQ ID NO: 10564 - DNA, 26 bp, Artificial sequence
  Reverse Primer
aaatgagaagtcaactctaatgaacg

SEQ ID NO: 10565 - DNA, 22 bp, Artificial sequence
  Reverse Primer
gtctccattttgggaaaaaatc

SEQ ID NO: 10566 - DNA, 23 bp, Artificial sequence
  Reverse Primer
ttgtttcatttaaagaacccaga

SEQ ID NO: 10567 - DNA, 25 bp, Artificial sequence
  Reverse Primer
taatagccaaaagtttcctaaatgg

SEQ ID NO: 10568 - DNA, 26 bp, Artificial sequence
  Reverse Primer
tatcaggcataagaatgaattgatag

SEQ ID NO: 10569 - DNA, 30 bp, Artificial sequence
  Reverse Primer
ttaatgaaactgacataagtgayttactct

SEQ ID NO: 10570 - DNA, 21 bp, Artificial sequence
  Reverse Primer
aaatgcagaaagaaggtgatg

SEQ ID NO: 10571 - DNA, 24 bp, Artificial sequence
  Reverse Primer
taatgaattgtgtctttccaaagc

SEQ ID NO: 10572 - DNA, 30 bp, Artificial sequence
  Reverse Primer
cctgttctaagtacttyacatgtattaaat

SEQ ID NO: 10573 - DNA, 29 bp, Artificial sequence
  Reverse Primer
aagattatatagacaatctcttttccaac

SEQ ID NO: 10574 - DNA, 23 bp, Artificial sequence
  Reverse Primer
agtgaacaggtagtaagtcccca

SEQ ID NO: 10575 - DNA, 20 bp, Artificial sequence
  Reverse Primer
atatgctgtgtgctttgggt

SEQ ID NO: 10576 - DNA, 22 bp, Artificial sequence
  Reverse Primer
ttgagcagttattctggtctgg

SEQ ID NO: 10577 - DNA, 22 bp, Artificial sequence
  Reverse Primer
attgatttcagggttcacagtg

SEQ ID NO: 10578 - DNA, 25 bp, Artificial sequence
  Reverse Primer
ataatcacctttcttttgtttctca

SEQ ID NO: 10579 - DNA, 27 bp, Artificial sequence
  Reverse Primer
attgtaaggaatacaacaggaagtact

SEQ ID NO: 10580 - DNA, 28 bp, Artificial sequence
  Reverse Primer
taaatttatattgggattttgtacagtc

SEQ ID NO: 10581 - DNA, 26 bp, Artificial sequence
  Reverse Primer
aaacagttctttttcaaactttcagt

SEQ ID NO: 10582 - DNA, 18 bp, Artificial sequence
  Reverse Primer
accactcttcctccgcgt

SEQ ID NO: 10583 - DNA, 18 bp, Artificial sequence
  Reverse Primer
gacgggcgtggaatccag

SEQ ID NO: 10584 - DNA, 18 bp, Artificial sequence
  Reverse Primer
tttcacccctttctccgt

SEQ ID NO: 10585 - DNA, 27 bp, Artificial sequence
  Reverse Primer
aataagtaaaacttaatccttcttgcc

SEQ ID NO: 10586 - DNA, 23 bp, Artificial sequence
  Reverse Primer
agtgtgcaaataaaaccaagttg

SEQ ID NO: 10587 - DNA, 30 bp, Artificial sequence
  Reverse Primer
gagtattattcaactcttattaaacaatca

SEQ ID NO: 10588 - DNA, 21 bp, Artificial sequence
  Reverse Primer
aatttcaccagctcacaggtt

SEQ ID NO: 10589 - DNA, 22 bp, Artificial sequence
  Reverse Primer
attagaagtgtccagttggcat

SEQ ID NO: 10590 - DNA, 23 bp, Artificial sequence
  Reverse Primer
tgatccattcttctggtacattc

SEQ ID NO: 10591 - DNA, 28 bp, Artificial sequence
  Reverse Primer
tcagtatccttaactaataacagatgca

SEQ ID NO: 10592 - DNA, 22 bp, Artificial sequence
  Reverse Primer
tttctgggaaacataggagaaa

SEQ ID NO: 10593 - DNA, 21 bp, Artificial sequence
  Reverse Primer
ttgttctagcaaagttgggtg

SEQ ID NO: 10594 - DNA, 18 bp, Artificial sequence
  Reverse Primer
tgagaggcccacacatct

SEQ ID NO: 10595 - DNA, 24 bp, Artificial sequence
  Reverse Primer
atgatcatactaagggacgtcaat

SEQ ID NO: 10596 - DNA, 29 bp, Artificial sequence
  Reverse Primer
atctttttacaacttagtggaattactga

SEQ ID NO: 10597 - DNA, 24 bp, Artificial sequence
  Reverse Primer
tttatactcttttctactgccgac

SEQ ID NO: 10598 - DNA, 25 bp, Artificial sequence
  Reverse Primer
caccaaggtgacaaatagtaaattc

SEQ ID NO: 10599 - DNA, 25 bp, Artificial sequence
  Reverse Primer
ttgaaatcaaytatttggaaaactc

SEQ ID NO: 10600 - DNA, 24 bp, Artificial sequence
  Reverse Primer
tcttgaaaatagaaactctgcaca

SEQ ID NO: 10601 - DNA, 30 bp, Artificial sequence
  Reverse Primer
aaattatacctatacaaaccttctaaagag

SEQ ID NO: 10602 - DNA, 27 bp, Artificial sequence
  Reverse Primer
ttgtctgtatctttctaatttttttcc

SEQ ID NO: 10603 - DNA, 28 bp, Artificial sequence
  Reverse Primer
ttctttctcatacagatcattacagaat

SEQ ID NO: 10604 - DNA, 18 bp, Artificial sequence
  Reverse Primer
gaccaggagcacgtgatt

SEQ ID NO: 10605 - DNA, 27 bp, Artificial sequence
  Reverse Primer
tagaagtgttctggtaatctattgtga

SEQ ID NO: 10606 - DNA, 27 bp, Artificial sequence
  Reverse Primer
aaatcttgatcataaacttcttggtta

SEQ ID NO: 10607 - DNA, 22 bp, Artificial sequence
  Reverse Primer
acagaaagacaggatgttcagc

SEQ ID NO: 10608 - DNA, 22 bp, Artificial sequence
  Reverse Primer
acaggacagtcacattcaattc

SEQ ID NO: 10609 - DNA, 30 bp, Artificial sequence
  Reverse Primer
agattaatactcagatttaatgagttttgg

SEQ ID NO: 10610 - DNA, 24 bp, Artificial sequence
  Reverse Primer
tcatgcaaaacccattttataata

SEQ ID NO: 10611 - DNA, 27 bp, Artificial sequence
  Reverse Primer
ttgactttgcaagattaatagagattt

SEQ ID NO: 10612 - DNA, 19 bp, Artificial sequence
  Reverse Primer
aagagccacctttcagctt

SEQ ID NO: 10613 - DNA, 23 bp, Artificial sequence
  Reverse Primer
tcagtggtagctgtcttctgtag

SEQ ID NO: 10614 - DNA, 30 bp, Artificial sequence
  Reverse Primer
ttaattctaagtagtaacagtaaaactttg

SEQ ID NO: 10615 - DNA, 26 bp, Artificial sequence
  Reverse Primer
cagagcttcacagagtgttaaaatat

SEQ ID NO: 10616 - DNA, 18 bp, Artificial sequence
  Reverse Primer
tcacggcctccacaccca

SEQ ID NO: 10617 - DNA, 22 bp, Artificial sequence
  Reverse Primer
aatgattcagaaggtatcctgg

SEQ ID NO: 10618 - DNA, 21 bp, Artificial sequence
  Reverse Primer
aaatgatgaattgatgctggg

SEQ ID NO: 10619 - DNA, 18 bp, Artificial sequence
  Reverse Primer
ttccggctgatgtcaaac

SEQ ID NO: 10620 - DNA, 22 bp, Artificial sequence
  Reverse Primer
ttatcaagagacactccctgct

SEQ ID NO: 10621 - DNA, 24 bp, Artificial sequence
  Reverse Primer
atatatgatctagccatggacaca

SEQ ID NO: 10622 - DNA, 18 bp, Artificial sequence
  Reverse Primer
acaccctctctcsgtcct

SEQ ID NO: 10623 - DNA, 18 bp, Artificial sequence
  Reverse Primer
tggacttccttggtggtc

SEQ ID NO: 10624 - DNA, 22 bp, Artificial sequence
  Reverse Primer
acctacagggctgttctgtcta

SEQ ID NO: 10625 - DNA, 28 bp, Artificial sequence
  Reverse Primer
aaataagtataatagctctctgggttca

SEQ ID NO: 10626 - DNA, 22 bp, Artificial sequence
  Reverse Primer
cctataaatggagaccacaggt

SEQ ID NO: 10627 - DNA, 28 bp, Artificial sequence
  Reverse Primer
tatggtagaactagaaatttaaagggtt

SEQ ID NO: 10628 - DNA, 30 bp, Artificial sequence
  Reverse Primer
taaaagttaagattactgtcctagagtatt

SEQ ID NO: 10629 - DNA, 26 bp, Artificial sequence
  Reverse Primer
tcccataaaagcataagttaaaaatc

SEQ ID NO: 10630 - DNA, 20 bp, Artificial sequence
  Reverse Primer
tatgctccttcctgcagtgt

SEQ ID NO: 10631 - DNA, 23 bp, Artificial sequence
  Reverse Primer
acatcatacacgctcacatagtc

SEQ ID NO: 10632 - DNA, 30 bp, Artificial sequence
  Reverse Primer
ttattaatacttaagtggttgttcttttct

SEQ ID NO: 10633 - DNA, 25 bp, Artificial sequence
  Reverse Primer
ataatgtcaacaagcatcactctct

SEQ ID NO: 10634 - DNA, 21 bp, Artificial sequence
  Reverse Primer
aatctaacaagcgacccagtt

SEQ ID NO: 10635 - DNA, 26 bp, Artificial sequence
  Reverse Primer
ttctttcctcaatagagctagagaac

SEQ ID NO: 10636 - DNA, 20 bp, Artificial sequence
  Reverse Primer
tactccacagaggccttttc

SEQ ID NO: 10637 - DNA, 27 bp, Artificial sequence
  Reverse Primer
gccataatatgaattgataaaataagg

SEQ ID NO: 10638 - DNA, 20 bp, Artificial sequence
  Reverse Primer
ttccacaagtcacacagctg

SEQ ID NO: 10639 - DNA, 27 bp, Artificial sequence
  Reverse Primer
tacgttttcttctaggagttttacagt

SEQ ID NO: 10640 - DNA, 26 bp, Artificial sequence
  Reverse Primer
gatgagtgaaagtaatcattgaaaga

SEQ ID NO: 10641 - DNA, 28 bp, Artificial sequence
  Reverse Primer
tatttttaaagatagatatggccttgtc

SEQ ID NO: 10642 - DNA, 18 bp, Artificial sequence
  Reverse Primer
tgaccctattggcaaccc

SEQ ID NO: 10643 - DNA, 28 bp, Artificial sequence
  Reverse Primer
aaacaaatacataccttatttgaattgg

SEQ ID NO: 10644 - DNA, 28 bp, Artificial sequence
  Reverse Primer
taaataactctgtgttcaaatttttgtc

SEQ ID NO: 10645 - DNA, 27 bp, Artificial sequence
  Reverse Primer
aatcctcctaacatgtaaaaagatttt

SEQ ID NO: 10646 - DNA, 24 bp, Artificial sequence
  Reverse Primer
taaagaacaagtaatgagagcagc

SEQ ID NO: 10647 - DNA, 26 bp, Artificial sequence
  Reverse Primer
agccatgctaaaatttattgttaact

SEQ ID NO: 10648 - DNA, 22 bp, Artificial sequence
  Reverse Primer
aatcgtgctttagggaaatagc

SEQ ID NO: 10649 - DNA, 22 bp, Artificial sequence
  Reverse Primer
tagattttaggatgggtggtga

SEQ ID NO: 10650 - DNA, 28 bp, Artificial sequence
  Reverse Primer
tatattaatagttgttcatttcaaacgc

SEQ ID NO: 10651 - DNA, 22 bp, Artificial sequence
  Reverse Primer
tgggttgttcaagaagaaaagt

SEQ ID NO: 10652 - DNA, 28 bp, Artificial sequence
  Reverse Primer
tttcgatcacatttatttctcttaatac

SEQ ID NO: 10653 - DNA, 28 bp, Artificial sequence
  Reverse Primer
acttcaacagtaacaaagatttgtaaga

SEQ ID NO: 10654 - DNA, 24 bp, Artificial sequence
  Reverse Primer
aaagatattcatggtgggttatct

SEQ ID NO: 10655 - DNA, 27 bp, Artificial sequence
  Reverse Primer
aaacttcttatgaatttctttgagaca

SEQ ID NO: 10656 - DNA, 22 bp, Artificial sequence
  Reverse Primer
tccagttggcttttatttctct

SEQ ID NO: 10657 - DNA, 22 bp, Artificial sequence
  Reverse Primer
tcctcagaactcttagggacaa

SEQ ID NO: 10658 - DNA, 27 bp, Artificial sequence
  Reverse Primer
tcatatcctaagtcctttttcatttag

SEQ ID NO: 10659 - DNA, 21 bp, Artificial sequence
  Reverse Primer
tgtttgcttcttctcaaagcc

SEQ ID NO: 10660 - DNA, 27 bp, Artificial sequence
  Reverse Primer
taaggattttctgactacatgtttttt

SEQ ID NO: 10661 - DNA, 21 bp, Artificial sequence
  Reverse Primer
cctgttttacttgctgcagtc

SEQ ID NO: 10662 - DNA, 23 bp, Artificial sequence
  Reverse Primer
ttcagatcaacagcatttcctac

SEQ ID NO: 10663 - DNA, 20 bp, Artificial sequence
  Reverse Primer
tttaaagccactgcaagagg

SEQ ID NO: 10664 - DNA, 18 bp, Artificial sequence
  Reverse Primer
ttttcctgagcggaagag

SEQ ID NO: 10665 - DNA, 18 bp, Artificial sequence
  Reverse Primer
aggatcaaggggtgcttc

SEQ ID NO: 10666 - DNA, 23 bp, Artificial sequence
  Reverse Primer
ttaactcagtgtgaccaatgtga

SEQ ID NO: 10667 - DNA, 24 bp, Artificial sequence
  Reverse Primer
acctacagttactatgcctcgaat

SEQ ID NO: 10668 - DNA, 20 bp, Artificial sequence
  Reverse Primer
agggtttcccagcactattg

SEQ ID NO: 10669 - DNA, 18 bp, Artificial sequence
  Reverse Primer
gacccaggttccacccat

SEQ ID NO: 10670 - DNA, 24 bp, Artificial sequence
  Reverse Primer
aaaatggactctagtcactggaag

SEQ ID NO: 10671 - DNA, 25 bp, Artificial sequence
  Reverse Primer
ttctaactttgtattttagggcagt

SEQ ID NO: 10672 - DNA, 22 bp, Artificial sequence
  Reverse Primer
atacccaagtttgaatcccatt

SEQ ID NO: 10673 - DNA, 23 bp, Artificial sequence
  Reverse Primer
ttgttcaatgtcacctycaatat

SEQ ID NO: 10674 - DNA, 30 bp, Artificial sequence
  Reverse Primer
taaartgacaytcttaagagaacataatag

SEQ ID NO: 10675 - DNA, 25 bp, Artificial sequence
  Reverse Primer
ttttgttggaagaaaacttaaatcc

SEQ ID NO: 10676 - DNA, 21 bp, Artificial sequence
  Reverse Primer
atgatgcacttttatccaacc

SEQ ID NO: 10677 - DNA, 26 bp, Artificial sequence
  Reverse Primer
tggtttgttatgttatattcttgagg

SEQ ID NO: 10678 - DNA, 25 bp, Artificial sequence
  Reverse Primer
tttccttaccttatgtaccttgttg

SEQ ID NO: 10679 - DNA, 26 bp, Artificial sequence
  Reverse Primer
tttatctccaagttaacaaaagtttg

SEQ ID NO: 10680 - DNA, 28 bp, Artificial sequence
  Reverse Primer
ttattcatacttttaagatgatccttcc

SEQ ID NO: 10681 - DNA, 19 bp, Artificial sequence
  Reverse Primer
aaagatgcatttccggagt

SEQ ID NO: 10682 - DNA, 25 bp, Artificial sequence
  Reverse Primer
rcatgagatactttctcrgaaaatg

SEQ ID NO: 10683 - DNA, 22 bp, Artificial sequence
  Reverse Primer
atacttaaggaaaccttcacaa

SEQ ID NO: 10684 - DNA, 18 bp, Artificial sequence
  Reverse Primer
aagaaccgcgcttcggaa

SEQ ID NO: 10685 - DNA, 27 bp, Artificial sequence
  Reverse Primer
ataaattattgggaatgagaatatgag

SEQ ID NO: 10686 - DNA, 25 bp, Artificial sequence
  Reverse Primer
tagacatcctcttctctcagatagc

SEQ ID NO: 10687 - DNA, 25 bp, Artificial sequence
  Reverse Primer
taataggtaccgtggtttttatgaa

SEQ ID NO: 10688 - DNA, 24 bp, Artificial sequence
  Reverse Primer
tttcttacctatctttgtgtgggt

SEQ ID NO: 10689 - DNA, 26 bp, Artificial sequence
  Reverse Primer
tattttactctttttctcctgaaagg

SEQ ID NO: 10690 - DNA, 20 bp, Artificial sequence
  Reverse Primer
tttgaaataccctgcttccc

SEQ ID NO: 10691 - DNA, 19 bp, Artificial sequence
  Reverse Primer
agaatgccaagctctgagg

SEQ ID NO: 10692 - DNA, 22 bp, Artificial sequence
  Reverse Primer
ctggaagtcagaggtgagctag

SEQ ID NO: 10693 - DNA, 20 bp, Artificial sequence
  Reverse Primer
aacaagtgtgggccacttaa

SEQ ID NO: 10694 - DNA, 20 bp, Artificial sequence
  Reverse Primer
ttcttggcatctgtaccctc

SEQ ID NO: 10695 - DNA, 18 bp, Artificial sequence
  Reverse Primer
atccacaggccaagggct

SEQ ID NO: 10696 - DNA, 21 bp, Artificial sequence
  Reverse Primer
attgttagggaatcctcggta

SEQ ID NO: 10697 - DNA, 22 bp, Artificial sequence
  Reverse Primer
tagacacagtgggtgataccac

SEQ ID NO: 10698 - DNA, 24 bp, Artificial sequence
  Reverse Primer
aaaatagcagataaatggattgca

SEQ ID NO: 10699 - DNA, 21 bp, Artificial sequence
  Reverse Primer
aggaggcagctagttcttgaa

SEQ ID NO: 10700 - DNA, 21 bp, Artificial sequence
  Reverse Primer
agggttcccaaggtagaagtc

SEQ ID NO: 10701 - DNA, 18 bp, Artificial sequence
  Reverse Primer
caagtctgctgggctccc

SEQ ID NO: 10702 - DNA, 28 bp, Artificial sequence
  Reverse Primer
atacgtgaatagtttaaagtcatttctg

SEQ ID NO: 10703 - DNA, 21 bp, Artificial sequence
  Reverse Primer
attgaaactgtggggagaaaa

SEQ ID NO: 10704 - DNA, 27 bp, Artificial sequence
  Reverse Primer
tccttaactgatttctaaataaagcaa

SEQ ID NO: 10705 - DNA, 21 bp, Artificial sequence
  Reverse Primer
ccctttatacacaggcacaca

SEQ ID NO: 10706 - DNA, 30 bp, Artificial sequence
  Reverse Primer
ttacaccaagtataactgtgatttattact

SEQ ID NO: 10707 - DNA, 28 bp, Artificial sequence
  Reverse Primer
tataacttgttgtggaatgataaaaaac

SEQ ID NO: 10708 - DNA, 25 bp, Artificial sequence
  Reverse Primer
gctaccttctcgattttattcattt

SEQ ID NO: 10709 - DNA, 25 bp, Artificial sequence
  Reverse Primer
aagagggaaaggagatagtgttatg

SEQ ID NO: 10710 - DNA, 30 bp, Artificial sequence
  Reverse Primer
tcaattacatgattagagaatagtgaataa

SEQ ID NO: 10711 - DNA, 25 bp, Artificial sequence
  Reverse Primer
taagtacaatttcccatatttccaa

SEQ ID NO: 10712 - DNA, 22 bp, Artificial sequence
  Reverse Primer
aaacccacagttcctgttttaa

SEQ ID NO: 10713 - DNA, 19 bp, Artificial sequence
  Reverse Primer
aactctccaagattgccca

SEQ ID NO: 10714 - DNA, 18 bp, Artificial sequence
  Reverse Primer
aagatcccgacgctcaga

SEQ ID NO: 10715 - DNA, 21 bp, Artificial sequence
  Reverse Primer
ggttagtcccagctctctcag

SEQ ID NO: 10716 - DNA, 28 bp, Artificial sequence
  Reverse Primer
aagaagaaagaaattgtgagttagtgta

SEQ ID NO: 10717 - DNA, 23 bp, Artificial sequence
  Reverse Primer
taggtggactgtctctttgaaat

SEQ ID NO: 10718 - DNA, 18 bp, Artificial sequence
  Reverse Primer
atcaggcacagggaatga

SEQ ID NO: 10719 - DNA, 20 bp, Artificial sequence
  Reverse Primer
gcagcagcagaaccataagt

SEQ ID NO: 10720 - DNA, 21 bp, Artificial sequence
  Reverse Primer
tgccttatccgtttagcttct

SEQ ID NO: 10721 - DNA, 20 bp, Artificial sequence
  Reverse Primer
tatgggatgtagttccctgc

SEQ ID NO: 10722 - DNA, 19 bp, Artificial sequence
  Reverse Primer
aacaacctggggtaccatc

SEQ ID NO: 10723 - DNA, 25 bp, Artificial sequence
  Reverse Primer
atctgctatcagctacgtagtcact

SEQ ID NO: 10724 - DNA, 22 bp, Artificial sequence
  Reverse Primer
aactagatgcaaagcctcaaga

SEQ ID NO: 10725 - DNA, 24 bp, Artificial sequence
  Reverse Primer
aggcctatggatcttaagttgtaa

SEQ ID NO: 10726 - DNA, 22 bp, Artificial sequence
  Reverse Primer
acaaggtggtatcagcctttta

SEQ ID NO: 10727 - DNA, 24 bp, Artificial sequence
  Reverse Primer
attaacattgttctgttccaatgc

SEQ ID NO: 10728 - DNA, 21 bp, Artificial sequence
  Reverse Primer
acagagcctcagctacctcat

SEQ ID NO: 10729 - DNA, 22 bp, Artificial sequence
  Reverse Primer
aaatgaaatagttttgctgcct

SEQ ID NO: 10730 - DNA, 19 bp, Artificial sequence
  Reverse Primer
tggatgtacagagctgggc

SEQ ID NO: 10731 - DNA, 24 bp, Artificial sequence
  Reverse Primer
taatgcaaatgtgatcttgttagc

SEQ ID NO: 10732 - DNA, 30 bp, Artificial sequence
  Reverse Primer
taatgatgagatatctgtataaatactcct

SEQ ID NO: 10733 - DNA, 22 bp, Artificial sequence
  Reverse Primer
tgaatggtacttcaactgcaca

SEQ ID NO: 10734 - DNA, 20 bp, Artificial sequence
  Reverse Primer
tcaagatgcttcaccatgat

SEQ ID NO: 10735 - DNA, 22 bp, Artificial sequence
  Reverse Primer
tatttagtgggtaaagccagga

SEQ ID NO: 10736 - DNA, 22 bp, Artificial sequence
  Reverse Primer
actggtgatgcactgtcatatg

SEQ ID NO: 10737 - DNA, 23 bp, Artificial sequence
  Reverse Primer
tttatggaagtcatttttgttcc

SEQ ID NO: 10738 - DNA, 21 bp, Artificial sequence
  Reverse Primer
acagtttgggattgtttcctt

SEQ ID NO: 10739 - DNA, 18 bp, Artificial sequence
  Reverse Primer
agtgaggcagaattcccc

SEQ ID NO: 10740 - DNA, 21 bp, Artificial sequence
  Reverse Primer
taagggaccactttgcttctt

SEQ ID NO: 10741 - DNA, 21 bp, Artificial sequence
  Reverse Primer
actagacaggcttcctggacc

SEQ ID NO: 10742 - DNA, 20 bp, Artificial sequence
  Reverse Primer
ttaaatcacatcctccacgg

SEQ ID NO: 10743 - DNA, 23 bp, Artificial sequence
  Reverse Primer
atagatctataggctggtcctgg

SEQ ID NO: 10744 - DNA, 30 bp, Artificial sequence
  Reverse Primer
tctagaagttctttaatatctctgagtttc

SEQ ID NO: 10745 - DNA, 23 bp, Artificial sequence
  Reverse Primer
tcagaagaataatgcaagaatcc

SEQ ID NO: 10746 - DNA, 20 bp, Artificial sequence
  Reverse Primer
cccttgtcactgatcttgct

SEQ ID NO: 10747 - DNA, 21 bp, Artificial sequence
  Reverse Primer
ttactagtgttgagggctggg

SEQ ID NO: 10748 - DNA, 20 bp, Artificial sequence
  Reverse Primer
atgtttatgcccatctccag

SEQ ID NO: 10749 - DNA, 21 bp, Artificial sequence
  Reverse Primer
atttaacaaaccaagggcaaa

SEQ ID NO: 10750 - DNA, 19 bp, Artificial sequence
  Reverse Primer
ttctgttcctgagggaagc

SEQ ID NO: 10751 - DNA, 18 bp, Artificial sequence
  Reverse Primer
agcccttctggttggggc

SEQ ID NO: 10752 - DNA, 18 bp, Artificial sequence
  Reverse Primer
tagtgctcccacgcctgc

SEQ ID NO: 10753 - DNA, 22 bp, Artificial sequence
  Reverse Primer
gatttaattctggtctgcgaac

SEQ ID NO: 10754 - DNA, 24 bp, Artificial sequence
  Reverse Primer
atctccctgaaatgtgtaacagtc

SEQ ID NO: 10755 - DNA, 22 bp, Artificial sequence
  Reverse Primer
aggactttagtccttggtggtc

SEQ ID NO: 10756 - DNA, 21 bp, Artificial sequence
  Reverse Primer
taaatccaagactggggagac

SEQ ID NO: 10757 - DNA, 24 bp, Artificial sequence
  Reverse Primer
atcaataatctcatcagtaggctg

SEQ ID NO: 10758 - DNA, 27 bp, Artificial sequence
  Reverse Primer
tacatgtgtaatgcctgtatctacttg

SEQ ID NO: 10759 - DNA, 18 bp, Artificial sequence
  Reverse Primer
aagctccctccccaacca

SEQ ID NO: 10760 - DNA, 20 bp, Artificial sequence
  Reverse Primer
atgggcagaaaagactgtca

SEQ ID NO: 10761 - DNA, 21 bp, Artificial sequence
  Reverse Primer
aatgtggctaaaacgtgtcac

SEQ ID NO: 10762 - DNA, 22 bp, Artificial sequence
  Reverse Primer
agtgaattcatgttgatgcaga

SEQ ID NO: 10763 - DNA, 21 bp, Artificial sequence
  Reverse Primer
aattaaccatctcaaatccgg

SEQ ID NO: 10764 - DNA, 20 bp, Artificial sequence
  Reverse Primer
ttttctgtgcctgtgtctcg

SEQ ID NO: 10765 - DNA, 20 bp, Artificial sequence
  Reverse Primer
tatttcctatttcccccgtt

SEQ ID NO: 10766 - DNA, 18 bp, Artificial sequence
  Reverse Primer
acctccygggctctatgg

SEQ ID NO: 10767 - DNA, 21 bp, Artificial sequence
  Reverse Primer
agaagcattgcactttgagag

SEQ ID NO: 10768 - DNA, 23 bp, Artificial sequence
  Reverse Primer
taaaagtacagaytcctgggatg

SEQ ID NO: 10769 - DNA, 19 bp, Artificial sequence
  Reverse Primer
cgtgaaaattttgtgaggc

SEQ ID NO: 10770 - DNA, 21 bp, Artificial sequence
  Reverse Primer
tttgagagaggttgagtgctg

SEQ ID NO: 10771 - DNA, 22 bp, Artificial sequence
  Reverse Primer
tatgcctgagagagagatttgc

SEQ ID NO: 10772 - DNA, 27 bp, Artificial sequence
  Reverse Primer
cttatgtcgtgtacagtaagtacatcc

SEQ ID NO: 10773 - DNA, 18 bp, Artificial sequence
  Reverse Primer
atcaccgcctcagtggat

SEQ ID NO: 10774 - DNA, 19 bp, Artificial sequence
  Reverse Primer
attcgcttgagctggtagc

SEQ ID NO: 10775 - DNA, 21 bp, Artificial sequence
  Reverse Primer
ctgaaggacacagtcaggaac

SEQ ID NO: 10776 - DNA, 20 bp, Artificial sequence
  Reverse Primer
cagaagtcagcaaaagcaca

SEQ ID NO: 10777 - DNA, 20 bp, Artificial sequence
  Reverse Primer
ctcttacccgctgctaacat

SEQ ID NO: 10778 - DNA, 26 bp, Artificial sequence
  Reverse Primer
aaatcctcagaatttgtttggtatat

SEQ ID NO: 10779 - DNA, 25 bp, Artificial sequence
  Reverse Primer
ttatgtagaccaaaaaaatcacctg

SEQ ID NO: 10780 - DNA, 21 bp, Artificial sequence
  Reverse Primer
ttccccaaattcacacaataa

SEQ ID NO: 10781 - DNA, 19 bp, Artificial sequence
  Reverse Primer
aaccgtgcaatggaaaact

SEQ ID NO: 10782 - DNA, 20 bp, Artificial sequence
  Reverse Primer
tgtcattgattgtggctgat

SEQ ID NO: 10783 - DNA, 19 bp, Artificial sequence
  Reverse Primer
aaaaataaccccaccctcc

SEQ ID NO: 10784 - DNA, 27 bp, Artificial sequence
  Reverse Primer
atagcaagagtaaytgcattttaaaca

SEQ ID NO: 10785 - DNA, 23 bp, Artificial sequence
  Reverse Primer
attcactagcttgatgtctctgg

SEQ ID NO: 10786 - DNA, 22 bp, Artificial sequence
  Reverse Primer
aaaatgggacaatgagactgaa

SEQ ID NO: 10787 - DNA, 27 bp, Artificial sequence
  Reverse Primer
actattctcctttasagtaaaatccct

SEQ ID NO: 10788 - DNA, 25 bp, Artificial sequence
  Reverse Primer
taatacatctttagcagtgtgtcca

SEQ ID NO: 10789 - DNA, 30 bp, Artificial sequence
  Reverse Primer
tttatagatctagacctacagataaaaccc

SEQ ID NO: 10790 - DNA, 20 bp, Artificial sequence
  Reverse Primer
tcataaaactgatggtggcg

SEQ ID NO: 10791 - DNA, 25 bp, Artificial sequence
  Reverse Primer
ttgattgttgtgttaggatatttcc

SEQ ID NO: 10792 - DNA, 18 bp, Artificial sequence
  Reverse Primer
ataggcccaatgactggc

SEQ ID NO: 10793 - DNA, 25 bp, Artificial sequence
  Reverse Primer
ttatcaggtggctaataaatcagtc

SEQ ID NO: 10794 - DNA, 22 bp, Artificial sequence
  Reverse Primer
aaaatcacaacaatctccaagg

SEQ ID NO: 10795 - DNA, 25 bp, Artificial sequence
  Reverse Primer
aatgttagctcattttatttgccta

SEQ ID NO: 10796 - DNA, 22 bp, Artificial sequence
  Reverse Primer
ttttttctgcagactgaatttc

SEQ ID NO: 10797 - DNA, 24 bp, Artificial sequence
  Reverse Primer
aatagctttcactttctgagcact

SEQ ID NO: 10798 - DNA, 27 bp, Artificial sequence
  Reverse Primer
ataaaatatttcctagaacctgacaca

SEQ ID NO: 10799 - DNA, 19 bp, Artificial sequence
  Reverse Primer
tatcttcccaaatgctccc

SEQ ID NO: 10800 - DNA, 24 bp, Artificial sequence
  Reverse Primer
gtgtccagtgaaatacagttgatt

SEQ ID NO: 10801 - DNA, 22 bp, Artificial sequence
  Reverse Primer
tgatagctgttctgtgcatgtt

SEQ ID NO: 10802 - DNA, 23 bp, Artificial sequence
  Reverse Primer
ttactttctctgtgctgggatag

SEQ ID NO: 10803 - DNA, 19 bp, Artificial sequence
  Reverse Primer
ccaacttctcctgcagctc

SEQ ID NO: 10804 - DNA, 20 bp, Artificial sequence
  Reverse Primer
taggacctatgggtggaatg

SEQ ID NO: 10805 - DNA, 28 bp, Artificial sequence
  Reverse Primer
ttgtaatgtttaagcataccattatttc

SEQ ID NO: 10806 - DNA, 21 bp, Artificial sequence
  Reverse Primer
tcctaggaaataggaccatgg

SEQ ID NO: 10807 - DNA, 25 bp, Artificial sequence
  Reverse Primer
attatgaaaagcagtcaattcaaga

SEQ ID NO: 10808 - DNA, 23 bp, Artificial sequence
  Reverse Primer
accagttcttttttaagagccag

SEQ ID NO: 10809 - DNA, 22 bp, Artificial sequence
  Reverse Primer
atgtcccaacaaacaacagatt

SEQ ID NO: 10810 - DNA, 22 bp, Artificial sequence
  Reverse Primer
tgtatgtgcttcttctttccac

SEQ ID NO: 10811 - DNA, 26 bp, Artificial sequence
  Reverse Primer
aaaatattgtttcttttatctgcagg

SEQ ID NO: 10812 - DNA, 24 bp, Artificial sequence
  Reverse Primer
actttgataccctcaagatatgct

SEQ ID NO: 10813 - DNA, 20 bp, Artificial sequence
  Reverse Primer
agaaaaccagggttgaggaa

SEQ ID NO: 10814 - DNA, 30 bp, Artificial sequence
  Reverse Primer
tctatacaaagtgaaatttatgtactgtta

SEQ ID NO: 10815 - DNA, 30 bp, Artificial sequence
  Reverse Primer
tgtaaagtggaactataacaattaagaaag

SEQ ID NO: 10816 - DNA, 22 bp, Artificial sequence
  Reverse Primer
cataatgttttccaaagaatgc

SEQ ID NO: 10817 - DNA, 26 bp, Artificial sequence
  Reverse Primer
ttaaaatctacaagagactccaaagc

SEQ ID NO: 10818 - DNA, 20 bp, Artificial sequence
  Reverse Primer
atgaaatgacagcgggtacc

SEQ ID NO: 10819 - DNA, 23 bp, Artificial sequence
  Reverse Primer
aattatggattagacactggcag

SEQ ID NO: 10820 - DNA, 21 bp, Artificial sequence
  Reverse Primer
tttctttgagtttcagggagc

SEQ ID NO: 10821 - DNA, 23 bp, Artificial sequence
  Reverse Primer
gccatttcatttatccaatatga

SEQ ID NO: 10822 - DNA, 26 bp, Artificial sequence
  Reverse Primer
taaacttaagtgtctccagactcctt

SEQ ID NO: 10823 - DNA, 22 bp, Artificial sequence
  Reverse Primer
tcaagtctccttacagtccaca

SEQ ID NO: 10824 - DNA, 19 bp, Artificial sequence
  Reverse Primer
aaaaatcagtggctagggc

SEQ ID NO: 10825 - DNA, 24 bp, Artificial sequence
  Reverse Primer
ctgcagctcctttaaaatctaaaa

SEQ ID NO: 10826 - DNA, 23 bp, Artificial sequence
  Reverse Primer
ttgaaaaatcgaacaggatttta

SEQ ID NO: 10827 - DNA, 23 bp, Artificial sequence
  Reverse Primer
ttaaggaacaaaaatggaaaacc

SEQ ID NO: 10828 - DNA, 26 bp, Artificial sequence
  Reverse Primer
tctctttatatttctcccatgtgatt

SEQ ID NO: 10829 - DNA, 21 bp, Artificial sequence
  Reverse Primer
agaacaccctggtatgttgtg

SEQ ID NO: 10830 - DNA, 30 bp, Artificial sequence
  Reverse Primer
gtagtaaatctccatattgttaatgtaaaa

SEQ ID NO: 10831 - DNA, 26 bp, Artificial sequence
  Reverse Primer
tatcactggtccaaagtaacacttaa

SEQ ID NO: 10832 - DNA, 27 bp, Artificial sequence
  Reverse Primer
gaagttttcaaagtagtgttgcttatg

SEQ ID NO: 10833 - DNA, 21 bp, Artificial sequence
  Reverse Primer
ttagcaaggctstctgttcaa

SEQ ID NO: 10834 - DNA, 23 bp, Artificial sequence
  Reverse Primer
aaactcactgaatcaaaygattg

SEQ ID NO: 10835 - DNA, 23 bp, Artificial sequence
  Reverse Primer
aaagtcttaaaccctgtcctgaa

SEQ ID NO: 10836 - DNA, 25 bp, Artificial sequence
  Reverse Primer
tttggaaatatggaagatacaagaa

SEQ ID NO: 10837 - DNA, 24 bp, Artificial sequence
  Reverse Primer
tttttgctagttatccatgtgacc

SEQ ID NO: 10838 - DNA, 27 bp, Artificial sequence
  Reverse Primer
araaaatatattaggccctaccttatg

SEQ ID NO: 10839 - DNA, 21 bp, Artificial sequence
  Reverse Primer
taagtgatccacgtttccaaa

SEQ ID NO: 10840 - DNA, 23 bp, Artificial sequence
  Reverse Primer
attaaacctcttggtttcaggag

SEQ ID NO: 10841 - DNA, 29 bp, Artificial sequence
  Reverse Primer
acaataaattactagtaagaacygctttg

SEQ ID NO: 10842 - DNA, 18 bp, Artificial sequence
  Reverse Primer
gattgcagtgcaggagca

SEQ ID NO: 10843 - DNA, 23 bp, Artificial sequence
  Reverse Primer
atgttttctttttcattctccct

SEQ ID NO: 10844 - DNA, 27 bp, Artificial sequence
  Reverse Primer
ttaaagagctaaatggaatctgtttat

SEQ ID NO: 10845 - DNA, 26 bp, Artificial sequence
  Reverse Primer
attgaatcattgcatcatataatcac

SEQ ID NO: 10846 - DNA, 29 bp, Artificial sequence
  Reverse Primer
ctgttaatgtaatttcttatgtagaatgg

SEQ ID NO: 10847 - DNA, 30 bp, Artificial sequence
  Reverse Primer
tatatgtagagacacaagtaaggtactagc

SEQ ID NO: 10848 - DNA, 27 bp, Artificial sequence
  Reverse Primer
ttacttgaaccttagatcttgagtcat

SEQ ID NO: 10849 - DNA, 24 bp, Artificial sequence
  Reverse Primer
gattttatagggattactgcagga

SEQ ID NO: 10850 - DNA, 28 bp, Artificial sequence
  Reverse Primer
gagatatattgaagacattatagcagga

SEQ ID NO: 10851 - DNA, 18 bp, Artificial sequence
  Reverse Primer
atgcccctaaaamccctc

SEQ ID NO: 10852 - DNA, 20 bp, Artificial sequence
  Reverse Primer
tggattctactgaagaggcg

SEQ ID NO: 10853 - DNA, 18 bp, Artificial sequence
  Reverse Primer
gctccgcctrgaaggtac

SEQ ID NO: 10854 - DNA, 20 bp, Artificial sequence
  Reverse Primer
attccacacagccatcaagt

SEQ ID NO: 10855 - DNA, 28 bp, Artificial sequence
  Reverse Primer
aaaaatgctatcagagaagaaaaactat

SEQ ID NO: 10856 - DNA, 28 bp, Artificial sequence
  Reverse Primer
tatcactaaaggagacttaacaactgac

SEQ ID NO: 10857 - DNA, 27 bp, Artificial sequence
  Reverse Primer
gtacaacttttgatcattttgagtctt

SEQ ID NO: 10858 - DNA, 22 bp, Artificial sequence
  Reverse Primer
acccctatcagctaatttcacc

SEQ ID NO: 10859 - DNA, 23 bp, Artificial sequence
  Reverse Primer
catctttttgcagaaattagctg

SEQ ID NO: 10860 - DNA, 22 bp, Artificial sequence
  Reverse Primer
aaattcaccaggttctaatggg

SEQ ID NO: 10861 - DNA, 30 bp, Artificial sequence
  Reverse Primer
tactcagactttacattttataactatcct

SEQ ID NO: 10862 - DNA, 20 bp, Artificial sequence
  Reverse Primer
tatacctgtgactgcccacg

SEQ ID NO: 10863 - DNA, 19 bp, Artificial sequence
  Reverse Primer
tttctgcccagytcacagt

SEQ ID NO: 10864 - DNA, 23 bp, Artificial sequence
  Reverse Primer
atactcgaacaaggaaggagtct

SEQ ID NO: 10865 - DNA, 18 bp, Artificial sequence
  Reverse Primer
aaggcaatgcctgcacct

SEQ ID NO: 10866 - DNA, 24 bp, Artificial sequence
  Reverse Primer
tccacaagttcartagctgtttaa

SEQ ID NO: 10867 - DNA, 19 bp, Artificial sequence
  Reverse Primer
agacgtgaccttctgctgc

SEQ ID NO: 10868 - DNA, 18 bp, Artificial sequence
  Reverse Primer
tctgcctgctgcactgcc

SEQ ID NO: 10869 - DNA, 19 bp, Artificial sequence
  Reverse Primer
aacctgtgggagttgaggg

SEQ ID NO: 10870 - DNA, 25 bp, Artificial sequence
  Reverse Primer
ttacaaagtctggatcacataggtc

SEQ ID NO: 10871 - DNA, 21 bp, Artificial sequence
  Reverse Primer
ggagcacttaagaggaaccag

SEQ ID NO: 10872 - DNA, 18 bp, Artificial sequence
  Reverse Primer
agatgagtcctccctgcc

SEQ ID NO: 10873 - DNA, 22 bp, Artificial sequence
  Reverse Primer
tgaaatattagatcattcccgg

SEQ ID NO: 10874 - DNA, 26 bp, Artificial sequence
  Reverse Primer
atcttctgataaaggtaagctggtaa

SEQ ID NO: 10875 - DNA, 23 bp, Artificial sequence
  Reverse Primer
atgtatgagctgtcactcttggt

SEQ ID NO: 10876 - DNA, 25 bp, Artificial sequence
  Reverse Primer
aaatgacaagccattatctgagtag

SEQ ID NO: 10877 - DNA, 26 bp, Artificial sequence
  Reverse Primer
tctctcaggcattcttaagtaaagtc

SEQ ID NO: 10878 - DNA, 18 bp, Artificial sequence
  Reverse Primer
aaggaggggtttctcccg

SEQ ID NO: 10879 - DNA, 18 bp, Artificial sequence
  Reverse Primer
agtcacccacccagctct

SEQ ID NO: 10880 - DNA, 26 bp, Artificial sequence
  Reverse Primer
aaatactagaggtatcatcagtcccc

SEQ ID NO: 10881 - DNA, 18 bp, Artificial sequence
  Reverse Primer
agggtcccagtccaggtc

SEQ ID NO: 10882 - DNA, 22 bp, Artificial sequence
  Reverse Primer
aaacctcttgtgaaaggttgag

SEQ ID NO: 10883 - DNA, 25 bp, Artificial sequence
  Reverse Primer
rgtctgagaatgagrgatgaaatag

SEQ ID NO: 10884 - DNA, 23 bp, Artificial sequence
  Reverse Primer
tacttttacagatgccaaggaca

SEQ ID NO: 10885 - DNA, 23 bp, Artificial sequence
  Reverse Primer
catccaataacaaccagcttaag

SEQ ID NO: 10886 - DNA, 18 bp, Artificial sequence
  Reverse Primer
aatcaaggtccagcaagg

SEQ ID NO: 10887 - DNA, 28 bp, Artificial sequence
  Reverse Primer
attaataatgacagsaacagtctcttta

SEQ ID NO: 10888 - DNA, 24 bp, Artificial sequence
  Reverse Primer
tggtttactggaaatgtttcttct

SEQ ID NO: 10889 - DNA, 20 bp, Artificial sequence
  Reverse Primer
tagcattttatgccaggtgc

SEQ ID NO: 10890 - DNA, 23 bp, Artificial sequence
  Reverse Primer
agtcttcaaggagaaaggtaggg

SEQ ID NO: 10891 - DNA, 24 bp, Artificial sequence
  Reverse Primer
tacaatttcatggtggtatctcag

SEQ ID NO: 10892 - DNA, 20 bp, Artificial sequence
  Reverse Primer
agtctcagtggagggtctgc

SEQ ID NO: 10893 - DNA, 29 bp, Artificial sequence
  Reverse Primer
tacttcttattaaaagttatgagaggtgg

SEQ ID NO: 10894 - DNA, 21 bp, Artificial sequence
  Reverse Primer
aaaatgaatccctgaactgga

SEQ ID NO: 10895 - DNA, 23 bp, Artificial sequence
  Reverse Primer
cagataatatttgctccaggaga

SEQ ID NO: 10896 - DNA, 22 bp, Artificial sequence
  Reverse Primer
actatgccctttccctctttat

SEQ ID NO: 10897 - DNA, 22 bp, Artificial sequence
  Reverse Primer
tgtcactcattaaaaacttggc

SEQ ID NO: 10898 - DNA, 19 bp, Artificial sequence
  Reverse Primer
cagagtcagagcacctgga

SEQ ID NO: 10899 - DNA, 23 bp, Artificial sequence
  Reverse Primer
ttttgttgaagggatctctaacc

SEQ ID NO: 10900 - DNA, 22 bp, Artificial sequence
  Reverse Primer
aaagtgaaacaaacgagtgtgc

SEQ ID NO: 10901 - DNA, 26 bp, Artificial sequence
  Reverse Primer
ttattgttgtcattgttgttttagtc

SEQ ID NO: 10902 - DNA, 20 bp, Artificial sequence
  Reverse Primer
gaaggtaaagcacagctgct

SEQ ID NO: 10903 - DNA, 22 bp, Artificial sequence
  Reverse Primer
tttcttccayctccatttcttg

SEQ ID NO: 10904 - DNA, 20 bp, Artificial sequence
  Reverse Primer
aattgaggagatggagctgc

SEQ ID NO: 10905 - DNA, 18 bp, Artificial sequence
  Reverse Primer
tctgatacccgctcagcc

SEQ ID NO: 10906 - DNA, 18 bp, Artificial sequence
  Reverse Primer
aagtctgcctgggtcttg

SEQ ID NO: 10907 - DNA, 22 bp, Artificial sequence
  Reverse Primer
tataggtatgactccctgctgc

SEQ ID NO: 10908 - DNA, 20 bp, Artificial sequence
  Reverse Primer
tactgccctggttctgtgtt

SEQ ID NO: 10909 - DNA, 20 bp, Artificial sequence
  Reverse Primer
attgttctgggttctagggg

SEQ ID NO: 10910 - DNA, 22 bp, Artificial sequence
  Reverse Primer
gaatccagatttttgtctctgg

SEQ ID NO: 10911 - DNA, 30 bp, Artificial sequence
  Reverse Primer
tttactctaacagrttcataacagtaaatc

SEQ ID NO: 10912 - DNA, 26 bp, Artificial sequence
  Reverse Primer
ctcattaataagggaaaattttgagt

SEQ ID NO: 10913 - DNA, 23 bp, Artificial sequence
  Reverse Primer
ratttgaggaaagagatgaggtg

SEQ ID NO: 10914 - DNA, 22 bp, Artificial sequence
  Reverse Primer
aaatcccgacaatgttcatatc

SEQ ID NO: 10915 - DNA, 27 bp, Artificial sequence
  Reverse Primer
ttcagttctttctgtgaagttctattt

SEQ ID NO: 10916 - DNA, 26 bp, Artificial sequence
  Reverse Primer
aattactcaggaattctactggtagc

SEQ ID NO: 10917 - DNA, 23 bp, Artificial sequence
  Reverse Primer
tccagaacatatttcagaggaaa

SEQ ID NO: 10918 - DNA, 30 bp, Artificial sequence
  Reverse Primer
actacaaactacatatgtgtactgtaccaa

SEQ ID NO: 10919 - DNA, 22 bp, Artificial sequence
  Reverse Primer
ttgttaggatatggaaatgcct

SEQ ID NO: 10920 - DNA, 26 bp, Artificial sequence
  Reverse Primer
aatgggattatttattcattgtgtct

SEQ ID NO: 10921 - DNA, 25 bp, Artificial sequence
  Reverse Primer
aaggttgaaaaggaactttagactc

SEQ ID NO: 10922 - DNA, 29 bp, Artificial sequence
  Reverse Primer
acttacctaatcttctttagtccttaagc

SEQ ID NO: 10923 - DNA, 19 bp, Artificial sequence
  Reverse Primer
aattagcccttccatctgg

SEQ ID NO: 10924 - DNA, 30 bp, Artificial sequence
  Reverse Primer
tagtctgtatatttctaacatttatgtcca

SEQ ID NO: 10925 - DNA, 19 bp, Artificial sequence
  Reverse Primer
tcacctggagatttgctca

SEQ ID NO: 10926 - DNA, 19 bp, Artificial sequence
  Reverse Primer
tcytctgtggtcctcctca

SEQ ID NO: 10927 - DNA, 21 bp, Artificial sequence
  Reverse Primer
tacgacagggacagactttga

SEQ ID NO: 10928 - DNA, 22 bp, Artificial sequence
  Reverse Primer
tatttttggccactggataatg

SEQ ID NO: 10929 - DNA, 21 bp, Artificial sequence
  Reverse Primer
tatcagtttggtccaggtgtt

SEQ ID NO: 10930 - DNA, 19 bp, Artificial sequence
  Reverse Primer
aggggaatttctgacctgg

SEQ ID NO: 10931 - DNA, 18 bp, Artificial sequence
  Reverse Primer
ccccatccccgcacttac

SEQ ID NO: 10932 - DNA, 30 bp, Artificial sequence
  Reverse Primer
tgtattaataccctctactagctttgtatc

SEQ ID NO: 10933 - DNA, 21 bp, Artificial sequence
  Reverse Primer
atacgcaaagaggcttaggag

SEQ ID NO: 10934 - DNA, 18 bp, Artificial sequence
  Reverse Primer
aaaatgtgccccatttcc

SEQ ID NO: 10935 - DNA, 27 bp, Artificial sequence
  Reverse Primer
cctaaaggctaataaactttctgtttt

SEQ ID NO: 10936 - DNA, 24 bp, Artificial sequence
  Reverse Primer
tcttcatctgaaatcacatgtttg

SEQ ID NO: 10937 - DNA, 21 bp, Artificial sequence
  Reverse Primer
tattttctccaaagggagctg

SEQ ID NO: 10938 - DNA, 27 bp, Artificial sequence
  Reverse Primer
aaatgattagtaggaaaagaaaagagg

SEQ ID NO: 10939 - DNA, 28 bp, Artificial sequence
  Reverse Primer
atgtctgacataatacacacatacacac

SEQ ID NO: 10940 - DNA, 18 bp, Artificial sequence
  Reverse Primer
tgagcccacgctctacag

SEQ ID NO: 10941 - DNA, 30 bp, Artificial sequence
  Reverse Primer
gtaatatattgacaaaatgtccagtttatg

SEQ ID NO: 10942 - DNA, 21 bp, Artificial sequence
  Reverse Primer
tgcattcactggaatatttgg

SEQ ID NO: 10943 - DNA, 30 bp, Artificial sequence
  Reverse Primer
tagtttaccttattttactatgaacaccat

SEQ ID NO: 10944 - DNA, 23 bp, Artificial sequence
  Reverse Primer
ataaaatgaagctgataatggcc

SEQ ID NO: 10945 - DNA, 23 bp, Artificial sequence
  Reverse Primer
acatcaaatcatcttttcagtgg

SEQ ID NO: 10946 - DNA, 29 bp, Artificial sequence
  Reverse Primer
acaaaggtcctatatattagttacaatgc

SEQ ID NO: 10947 - DNA, 26 bp, Artificial sequence
  Reverse Primer
attttcacactgacttctctgtgtat

SEQ ID NO: 10948 - DNA, 28 bp, Artificial sequence
  Reverse Primer
ttctattccactctaggttacaagttta

SEQ ID NO: 10949 - DNA, 23 bp, Artificial sequence
  Reverse Primer
taaacagcagtgacaacaaagta

SEQ ID NO: 10950 - DNA, 23 bp, Artificial sequence
  Reverse Primer
tgaacagctaatgcacaagtaag

SEQ ID NO: 10951 - DNA, 19 bp, Artificial sequence
  Reverse Primer
atggctcacaaacagcaaa

SEQ ID NO: 10952 - DNA, 25 bp, Artificial sequence
  Reverse Primer
tcawctactcaaaccctactcaaat

SEQ ID NO: 10953 - DNA, 29 bp, Artificial sequence
  Reverse Primer
tatattcaaataagcttaacggagtagag

SEQ ID NO: 10954 - DNA, 19 bp, Artificial sequence
  Reverse Primer
ttaggactgtgcagagggg

SEQ ID NO: 10955 - DNA, 22 bp, Artificial sequence
  Reverse Primer
aataacarccaagaaacccaaa

SEQ ID NO: 10956 - DNA, 24 bp, Artificial sequence
  Reverse Primer
tgaaagtatgcagtatcctgatgt

SEQ ID NO: 10957 - DNA, 18 bp, Artificial sequence
  Reverse Primer
acggaaggcttcctggag

SEQ ID NO: 10958 - DNA, 21 bp, Artificial sequence
  Reverse Primer
agagttgctagggaaagctca

SEQ ID NO: 10959 - DNA, 24 bp, Artificial sequence
  Reverse Primer
ctattaccggctactaaccacact

SEQ ID NO: 10960 - DNA, 19 bp, Artificial sequence
  Reverse Primer
tggtcgtcttacttcgcag

SEQ ID NO: 10961 - DNA, 21 bp, Artificial sequence
  Reverse Primer
ctggactactgcaaaaggatg

SEQ ID NO: 10962 - DNA, 22 bp, Artificial sequence
  Reverse Primer
akaggaagaaagagatgccaaa

SEQ ID NO: 10963 - DNA, 25 bp, Artificial sequence
  Reverse Primer
atttttgcttactcaaattaccatg

SEQ ID NO: 10964 - DNA, 26 bp, Artificial sequence
  Reverse Primer
tgatatttcactggagttatttcaat

SEQ ID NO: 10965 - DNA, 25 bp, Artificial sequence
  Reverse Primer
aaacagtaattgaaatcatgatgct

SEQ ID NO: 10966 - DNA, 24 bp, Artificial sequence
  Reverse Primer
aatcttgtgttccctttattcact

SEQ ID NO: 10967 - DNA, 26 bp, Artificial sequence
  Reverse Primer
agaacagacttcataaaaggtgaatt

SEQ ID NO: 10968 - DNA, 20 bp, Artificial sequence
  Reverse Primer
atcagatggcagaggagacg

SEQ ID NO: 10969 - DNA, 18 bp, Artificial sequence
  Reverse Primer
aaggtccaatcatggcct

SEQ ID NO: 10970 - DNA, 29 bp, Artificial sequence
  Reverse Primer
attttaaaacttaytgctgtctagattcc

SEQ ID NO: 10971 - DNA, 26 bp, Artificial sequence
  Reverse Primer
atatgaaactgtctgcatgactctag

SEQ ID NO: 10972 - DNA, 19 bp, Artificial sequence
  Reverse Primer
agatggtgcttcttggctg

SEQ ID NO: 10973 - DNA, 20 bp, Artificial sequence
  Reverse Primer
ttagaggccagaaccaaagc

SEQ ID NO: 10974 - DNA, 21 bp, Artificial sequence
  Reverse Primer
aaacggtgacacataatggag

SEQ ID NO: 10975 - DNA, 28 bp, Artificial sequence
  Reverse Primer
tctattaaaactctagggtcatgattac

SEQ ID NO: 10976 - DNA, 29 bp, Artificial sequence
  Reverse Primer
atgacctatttttactatmatgagcataa

SEQ ID NO: 10977 - DNA, 23 bp, Artificial sequence
  Reverse Primer
aaaataaagccgagaaatcaaac

SEQ ID NO: 10978 - DNA, 29 bp, Artificial sequence
  Reverse Primer
ggaataataagtttatttagataatggcc

SEQ ID NO: 10979 - DNA, 30 bp, Artificial sequence
  Reverse Primer
tgatctcagtaatactaacagaaatagtaa

SEQ ID NO: 10980 - DNA, 30 bp, Artificial sequence
  Reverse Primer
aatattgattttgtaacactgattacagtc

SEQ ID NO: 10981 - DNA, 29 bp, Artificial sequence
  Reverse Primer
attaagaatctgaaatacacagttttctg

SEQ ID NO: 10982 - DNA, 25 bp, Artificial sequence
  Reverse Primer
aacaaacacacagttttataatgca

SEQ ID NO: 10983 - DNA, 27 bp, Artificial sequence
  Reverse Primer
gttacaagtgctttttgttttattttg

SEQ ID NO: 10984 - DNA, 25 bp, Artificial sequence
  Reverse Primer
ttgctgaaataacttcctaacattg

SEQ ID NO: 10985 - DNA, 20 bp, Artificial sequence
  Reverse Primer
agcccacctatgtaatgcag

SEQ ID NO: 10986 - DNA, 24 bp, Artificial sequence
  Reverse Primer
aatttcacagttacgttaaggagg

SEQ ID NO: 10987 - DNA, 21 bp, Artificial sequence
  Reverse Primer
ttttatgagactgtggccctt

SEQ ID NO: 10988 - DNA, 26 bp, Artificial sequence
  Reverse Primer
aataacacaagagctagaagaggaag

SEQ ID NO: 10989 - DNA, 25 bp, Artificial sequence
  Reverse Primer
agtgaaagtattatgacctcaccaa

SEQ ID NO: 10990 - DNA, 30 bp, Artificial sequence
  Reverse Primer
aatgtatctactgtgtggatctaaagttac

SEQ ID NO: 10991 - DNA, 18 bp, Artificial sequence
  Reverse Primer
tgcaaccacaagctccag

SEQ ID NO: 10992 - DNA, 21 bp, Artificial sequence
  Reverse Primer
ggaagaatgtagcatggacct

SEQ ID NO: 10993 - DNA, 19 bp, Artificial sequence
  Reverse Primer
agtcgactgaggtgtgtgc

SEQ ID NO: 10994 - DNA, 18 bp, Artificial sequence
  Reverse Primer
ttgtgcgatgtgatggag

SEQ ID NO: 10995 - DNA, 18 bp, Artificial sequence
  Reverse Primer
aactcccagccaagctga

SEQ ID NO: 10996 - DNA, 18 bp, Artificial sequence
  Reverse Primer
tctccttcagccctggga

SEQ ID NO: 10997 - DNA, 23 bp, Artificial sequence
  Reverse Primer
atactaccaaactcaagcaacca

SEQ ID NO: 10998 - DNA, 18 bp, Artificial sequence
  Reverse Primer
agctgcggagtgagtgcc

SEQ ID NO: 10999 - DNA, 25 bp, Artificial sequence
  Reverse Primer
gctaaataagccaggaacataaatt

SEQ ID NO: 11000 - DNA, 25 bp, Artificial sequence
  Reverse Primer
aagtcacctagtttttcttcctagg

SEQ ID NO: 11001 - DNA, 18 bp, Artificial sequence
  Reverse Primer
aggagaaggaccaagcca

SEQ ID NO: 11002 - DNA, 18 bp, Artificial sequence
  Reverse Primer
ctgcagagtccaaccagc

SEQ ID NO: 11003 - DNA, 23 bp, Artificial sequence
  Reverse Primer
atggtttattggatagcrtaacg

SEQ ID NO: 11004 - DNA, 23 bp, Artificial sequence
  Reverse Primer
ttagttatacgtggtcccatgac

SEQ ID NO: 11005 - DNA, 22 bp, Artificial sequence
  Reverse Primer
tttaatcttgctggtagggaag

SEQ ID NO: 11006 - DNA, 21 bp, Artificial sequence
  Reverse Primer
ttgctaatttccattgaccaa

SEQ ID NO: 11007 - DNA, 21 bp, Artificial sequence
  Reverse Primer
attctcacctgtggaatagcc

SEQ ID NO: 11008 - DNA, 19 bp, Artificial sequence
  Reverse Primer
tgagggacacaagaatgga

SEQ ID NO: 11009 - DNA, 20 bp, Artificial sequence
  Reverse Primer
tagactctttcgaatgggca

SEQ ID NO: 11010 - DNA, 28 bp, Artificial sequence
  Reverse Primer
atgatttgtaattaaacatttgtctgtg

SEQ ID NO: 11011 - DNA, 24 bp, Artificial sequence
  Reverse Primer
aaactaaggcctagatgtgttcag

SEQ ID NO: 11012 - DNA, 23 bp, Artificial sequence
  Reverse Primer
aaaatcctctcacagtgtgtctg

SEQ ID NO: 11013 - DNA, 19 bp, Artificial sequence
  Reverse Primer
tattttcccccacttgctt

SEQ ID NO: 11014 - DNA, 18 bp, Artificial sequence
  Reverse Primer
agcctgagcttggcggct

SEQ ID NO: 11015 - DNA, 19 bp, Artificial sequence
  Reverse Primer
tacagttggtggggtcaca

SEQ ID NO: 11016 - DNA, 18 bp, Artificial sequence
  Reverse Primer
tcagttgcccccctgggt

SEQ ID NO: 11017 - DNA, 18 bp, Artificial sequence
  Reverse Primer
aagagatgatgctccggg

SEQ ID NO: 11018 - DNA, 19 bp, Artificial sequence
  Reverse Primer
tccacccctccaacttaac

SEQ ID NO: 11019 - DNA, 18 bp, Artificial sequence
  Reverse Primer
attgccatcctttgcagc

SEQ ID NO: 11020 - DNA, 21 bp, Artificial sequence
  Reverse Primer
ctcaataattatggccagtgg

SEQ ID NO: 11021 - DNA, 21 bp, Artificial sequence
  Reverse Primer
tgraatgtcaaggtgatgacc

SEQ ID NO: 11022 - DNA, 24 bp, Artificial sequence
  Reverse Primer
atttttcctgctgagttacaaaga

SEQ ID NO: 11023 - DNA, 24 bp, Artificial sequence
  Reverse Primer
agagaggaaggaaagactctcttg

SEQ ID NO: 11024 - DNA, 23 bp, Artificial sequence
  Reverse Primer
atcaaatgcacttgtgtttatcc

SEQ ID NO: 11025 - DNA, 18 bp, Artificial sequence
  Reverse Primer
cccacgggtcttcaggat

SEQ ID NO: 11026 - DNA, 24 bp, Artificial sequence
  Reverse Primer
atgtacagtgaatgtagcatcacc

SEQ ID NO: 11027 - DNA, 21 bp, Artificial sequence
  Reverse Primer
aatctgattggttcgaactgg

SEQ ID NO: 11028 - DNA, 30 bp, Artificial sequence
  Reverse Primer
atatagtaaaccctacaaaacaatatgata

SEQ ID NO: 11029 - DNA, 23 bp, Artificial sequence
  Reverse Primer
taaacaaacattgtgttctttgc

SEQ ID NO: 11030 - DNA, 30 bp, Artificial sequence
  Reverse Primer
ttatttaagagtagataaatctaaacatga

SEQ ID NO: 11031 - DNA, 28 bp, Artificial sequence
  Reverse Primer
aatttatgagggtatctgtagaaagaat

SEQ ID NO: 11032 - DNA, 18 bp, Artificial sequence
  Reverse Primer
tggcctggactatgctgc

SEQ ID NO: 11033 - DNA, 18 bp, Artificial sequence
  Reverse Primer
ttccattgttgtctgccc

SEQ ID NO: 11034 - DNA, 20 bp, Artificial sequence
  Reverse Primer
caaaagtcttgggcaaatga

SEQ ID NO: 11035 - DNA, 23 bp, Artificial sequence
  Reverse Primer
ataaagtgagattcagcaacagc

SEQ ID NO: 11036 - DNA, 30 bp, Artificial sequence
  Reverse Primer
aagtagataaatatttaggcacactgagta

SEQ ID NO: 11037 - DNA, 21 bp, Artificial sequence
  Reverse Primer
ttggggattatttacrcaagg

SEQ ID NO: 11038 - DNA, 27 bp, Artificial sequence
  Reverse Primer
ttaaaaataagtacatggaagcaattc

SEQ ID NO: 11039 - DNA, 28 bp, Artificial sequence
  Reverse Primer
aaaatattagcatctraggaaatattcc

SEQ ID NO: 11040 - DNA, 26 bp, Artificial sequence
  Reverse Primer
ttttaatcaacaggatatatgcacat

SEQ ID NO: 11041 - DNA, 28 bp, Artificial sequence
  Reverse Primer
aagtttttctctaatactgacataaggg

SEQ ID NO: 11042 - DNA, 20 bp, Artificial sequence
  Reverse Primer
tgcatgaataaaagcccaat

SEQ ID NO: 11043 - DNA, 21 bp, Artificial sequence
  Reverse Primer
acaagcttgcaactttacctg

SEQ ID NO: 11044 - DNA, 26 bp, Artificial sequence
  Reverse Primer
tataatttcttcttgctatctccaag

SEQ ID NO: 11045 - DNA, 24 bp, Artificial sequence
  Reverse Primer
ctctagacagtgaaagtgcacagt

SEQ ID NO: 11046 - DNA, 29 bp, Artificial sequence
  Reverse Primer
ttactttatcttctaaaatgaaagaggag

SEQ ID NO: 11047 - DNA, 23 bp, Artificial sequence
  Reverse Primer
acaagaatccaaagacactttga

SEQ ID NO: 11048 - DNA, 26 bp, Artificial sequence
  Reverse Primer
agagatttctgttcagaatctaccta

SEQ ID NO: 11049 - DNA, 28 bp, Artificial sequence
  Reverse Primer
gacttcatgaaactaaaaattaaagttg

SEQ ID NO: 11050 - DNA, 24 bp, Artificial sequence
  Reverse Primer
gggtaagtgaaaggagaaaatatc

SEQ ID NO: 11051 - DNA, 22 bp, Artificial sequence
  Reverse Primer
tggaaaccttctgcttcattat

SEQ ID NO: 11052 - DNA, 22 bp, Artificial sequence
  Reverse Primer
attttcccacagcaaaattagg

SEQ ID NO: 11053 - DNA, 21 bp, Artificial sequence
  Reverse Primer
tttgctatttctgagatgccc

SEQ ID NO: 11054 - DNA, 28 bp, Artificial sequence
  Reverse Primer
attttatgtttttctacctgttacacct

SEQ ID NO: 11055 - DNA, 18 bp, Artificial sequence
  Reverse Primer
actgtcccagggaaagga

SEQ ID NO: 11056 - DNA, 22 bp, Artificial sequence
  Reverse Primer
gtcactgatttctgagtcatgc

SEQ ID NO: 11057 - DNA, 20 bp, Artificial sequence
  Reverse Primer
ctgaagggactaaatctgtg

SEQ ID NO: 11058 - DNA, 28 bp, Artificial sequence
  Reverse Primer
taaagtgagaaaataaaagaggataagg

SEQ ID NO: 11059 - DNA, 26 bp, Artificial sequence
  Reverse Primer
ttctctgtaaacttgaaataaacagc

SEQ ID NO: 11060 - DNA, 23 bp, Artificial sequence
  Reverse Primer
acaggttcttactttgacgtcct

SEQ ID NO: 11061 - DNA, 18 bp, Artificial sequence
  Reverse Primer
cagcctgaggaccaaggc

SEQ ID NO: 11062 - DNA, 19 bp, Artificial sequence
  Reverse Primer
acagagatgtggaggagcg

SEQ ID NO: 11063 - DNA, 21 bp, Artificial sequence
  Reverse Primer
aagacttgggtgagaaggaaa

SEQ ID NO: 11064 - DNA, 28 bp, Artificial sequence
  Reverse Primer
agttacaatcaggtgatatttatattcg

SEQ ID NO: 11065 - DNA, 18 bp, Artificial sequence
  Reverse Primer
acatgtgaacagccccac

SEQ ID NO: 11066 - DNA, 22 bp, Artificial sequence
  Reverse Primer
tatgcatttgacagatgctttc

SEQ ID NO: 11067 - DNA, 19 bp, Artificial sequence
  Reverse Primer
ttcctcgttctcatccacg

SEQ ID NO: 11068 - DNA, 19 bp, Artificial sequence
  Reverse Primer
aatgaggggcaaacactgt

SEQ ID NO: 11069 - DNA, 18 bp, Artificial sequence
  Reverse Primer
agagagggtaaggggcca

SEQ ID NO: 11070 - DNA, 18 bp, Artificial sequence
  Reverse Primer
aggamatctgtgcaggcg

SEQ ID NO: 11071 - DNA, 24 bp, Artificial sequence
  Reverse Primer
taagcgaattactttttacttggc

SEQ ID NO: 11072 - DNA, 21 bp, Artificial sequence
  Reverse Primer
tttggatgtccatgttttctg

SEQ ID NO: 11073 - DNA, 29 bp, Artificial sequence
  Reverse Primer
actcagctatactccagtacaaaataatt

SEQ ID NO: 11074 - DNA, 21 bp, Artificial sequence
  Reverse Primer
tttacatcagacggttgtgag

SEQ ID NO: 11075 - DNA, 23 bp, Artificial sequence
  Reverse Primer
ccatgaaactagaaccagtgaat

SEQ ID NO: 11076 - DNA, 25 bp, Artificial sequence
  Reverse Primer
ctccattcagtctgtttagatatgc

SEQ ID NO: 11077 - DNA, 26 bp, Artificial sequence
  Reverse Primer
tataaatgacaaaaagctgaatgttc

SEQ ID NO: 11078 - DNA, 21 bp, Artificial sequence
  Reverse Primer
gagtcttcttgacccaggaat

SEQ ID NO: 11079 - DNA, 22 bp, Artificial sequence
  Reverse Primer
cgttagagtctggcagattttg

SEQ ID NO: 11080 - DNA, 26 bp, Artificial sequence
  Reverse Primer
ttttcttctcagtaacactcaaagtg

SEQ ID NO: 11081 - DNA, 22 bp, Artificial sequence
  Reverse Primer
aattccttctatttggacagca

SEQ ID NO: 11082 - DNA, 28 bp, Artificial sequence
  Reverse Primer
gaagattcctaagttatttgtcaaaact

SEQ ID NO: 11083 - DNA, 21 bp, Artificial sequence
  Reverse Primer
taaagcttagggccttgtttg

SEQ ID NO: 11084 - DNA, 29 bp, Artificial sequence
  Reverse Primer
aaattagtataatatgttccctgaagaag

SEQ ID NO: 11085 - DNA, 26 bp, Artificial sequence
  Reverse Primer
ttcttaccaagtaggtgaacatacag

SEQ ID NO: 11086 - DNA, 27 bp, Artificial sequence
  Reverse Primer
ataaagtacagcttcaaagaaaaacaa

SEQ ID NO: 11087 - DNA, 27 bp, Artificial sequence
  Reverse Primer
agtggttaaaaaatataggttcaaaca

SEQ ID NO: 11088 - DNA, 23 bp, Artificial sequence
  Reverse Primer
ttctacacaaggagaacagaagc

SEQ ID NO: 11089 - DNA, 28 bp, Artificial sequence
  Reverse Primer
atttatccaggtctaaaagaaataaagc

SEQ ID NO: 11090 - DNA, 25 bp, Artificial sequence
  Reverse Primer
ttgagagtgagcttcttaggaatag

SEQ ID NO: 11091 - DNA, 18 bp, Artificial sequence
  Reverse Primer
aacacaagccctgagcac

SEQ ID NO: 11092 - DNA, 26 bp, Artificial sequence
  Reverse Primer
ccttacattaacataaagcaaacaga

SEQ ID NO: 11093 - DNA, 20 bp, Artificial sequence
  Reverse Primer
tgtgcaaattcctcaacagc

SEQ ID NO: 11094 - DNA, 21 bp, Artificial sequence
  Reverse Primer
acagactgtctgctgtccatc

SEQ ID NO: 11095 - DNA, 18 bp, Artificial sequence
  Reverse Primer
gagagttgcagagccagg

SEQ ID NO: 11096 - DNA, 19 bp, Artificial sequence
  Reverse Primer
atcacacatgggtcaagcc

SEQ ID NO: 11097 - DNA, 21 bp, Artificial sequence
  Reverse Primer
attgcaatatttggcaatcag

SEQ ID NO: 11098 - DNA, 18 bp, Artificial sequence
  Reverse Primer
accctccgttcagcgcag

SEQ ID NO: 11099 - DNA, 25 bp, Artificial sequence
  Reverse Primer
tttagagcctataatgttttcaggc

SEQ ID NO: 11100 - DNA, 19 bp, Artificial sequence
  Reverse Primer
gacctgagggtggtctgag

SEQ ID NO: 11101 - DNA, 19 bp, Artificial sequence
  Reverse Primer
agccctgtcctaatgatgc

SEQ ID NO: 11102 - DNA, 21 bp, Artificial sequence
  Reverse Primer
accagtgaccatggtgctata

SEQ ID NO: 11103 - DNA, 25 bp, Artificial sequence
  Reverse Primer
tgctttctcttttttgactaatttg

SEQ ID NO: 11104 - DNA, 24 bp, Artificial sequence
  Reverse Primer
agttccttggtacgtcaaagtact

SEQ ID NO: 11105 - DNA, 25 bp, Artificial sequence
  Reverse Primer
atcagtaatttgtggctctagatga

SEQ ID NO: 11106 - DNA, 21 bp, Artificial sequence
  Reverse Primer
aaatatctgggcatcctacga

SEQ ID NO: 11107 - DNA, 30 bp, Artificial sequence
  Reverse Primer
gatatgactgagtgactaacattttctact

SEQ ID NO: 11108 - DNA, 30 bp, Artificial sequence
  Reverse Primer
tgtagtacactaaattttacagctttttag

SEQ ID NO: 11109 - DNA, 19 bp, Artificial sequence
  Reverse Primer
aaaaaccttcccaaatccc

SEQ ID NO: 11110 - DNA, 18 bp, Artificial sequence
  Reverse Primer
ttttggaggtggggtctg

SEQ ID NO: 11111 - DNA, 18 bp, Artificial sequence
  Reverse Primer
ttgggggacgctggcttc

SEQ ID NO: 11112 - DNA, 18 bp, Artificial sequence
  Reverse Primer
gcaggacgaggtcccaca

SEQ ID NO: 11113 - DNA, 23 bp, Artificial sequence
  Reverse Primer
ataattcatggatctttgaagcg

SEQ ID NO: 11114 - DNA, 20 bp, Artificial sequence
  Reverse Primer
aggatggagttggtgtcagg

SEQ ID NO: 11115 - DNA, 21 bp, Artificial sequence
  Reverse Primer
ttcgtgtctctttcctcttca

SEQ ID NO: 11116 - DNA, 28 bp, Artificial sequence
  Reverse Primer
ttgaataaagaacatacaaacatacaca

SEQ ID NO: 11117 - DNA, 28 bp, Artificial sequence
  Reverse Primer
attgatttatttttagacttsgtttagc

SEQ ID NO: 11118 - DNA, 26 bp, Artificial sequence
  Reverse Primer
tcacaaaaactaaatatctttcacgt

SEQ ID NO: 11119 - DNA, 18 bp, Artificial sequence
  Reverse Primer
tcaggcgggagcaaccag

SEQ ID NO: 11120 - DNA, 21 bp, Artificial sequence
  Reverse Primer
aacagcttgtccttccatagg

SEQ ID NO: 11121 - DNA, 19 bp, Artificial sequence
  Reverse Primer
tgccagtgagygtaaatgc

SEQ ID NO: 11122 - DNA, 22 bp, Artificial sequence
  Reverse Primer
ataatcagcaaactcctcctca

SEQ ID NO: 11123 - DNA, 20 bp, Artificial sequence
  Reverse Primer
agtgtatggcatctggaggt

SEQ ID NO: 11124 - DNA, 21 bp, Artificial sequence
  Reverse Primer
atctagcgctctacagcacac

SEQ ID NO: 11125 - DNA, 28 bp, Artificial sequence
  Reverse Primer
aaaatatcattggtagtttgataggaat

SEQ ID NO: 11126 - DNA, 21 bp, Artificial sequence
  Reverse Primer
ttgctactggtttttcagtcc

SEQ ID NO: 11127 - DNA, 25 bp, Artificial sequence
  Reverse Primer
attagatagactttcccaccatctt

SEQ ID NO: 11128 - DNA, 22 bp, Artificial sequence
  Reverse Primer
actgagcggctaatattgtcac

SEQ ID NO: 11129 - DNA, 22 bp, Artificial sequence
  Reverse Primer
aaatacgtaatcagcacttggc

SEQ ID NO: 11130 - DNA, 22 bp, Artificial sequence
  Reverse Primer
agagtgagcatgatccttcatt

SEQ ID NO: 11131 - DNA, 20 bp, Artificial sequence
  Reverse Primer
tttctcccaggagtgaaacc

SEQ ID NO: 11132 - DNA, 26 bp, Artificial sequence
  Reverse Primer
tgtgtgtttttagatttaaagcactt

SEQ ID NO: 11133 - DNA, 20 bp, Artificial sequence
  Reverse Primer
tttcccgagaaagctacaaa

SEQ ID NO: 11134 - DNA, 18 bp, Artificial sequence
  Reverse Primer
aatagtggtggggtccca

SEQ ID NO: 11135 - DNA, 18 bp, Artificial sequence
  Reverse Primer
gagtgcgctcgcagtgtg

SEQ ID NO: 11136 - DNA, 20 bp, Artificial sequence
  Reverse Primer
aagatgcaacacgaggaaga

SEQ ID NO: 11137 - DNA, 18 bp, Artificial sequence
  Reverse Primer
ttcccttgaaaatgggca

SEQ ID NO: 11138 - DNA, 18 bp, Artificial sequence
  Reverse Primer
ctcactaggggccgtagg

SEQ ID NO: 11139 - DNA, 18 bp, Artificial sequence
  Reverse Primer
tccaatgggcctggtaga

SEQ ID NO: 11140 - DNA, 29 bp, Artificial sequence
  Reverse Primer
tagaaacagattacagaggttagacctag

SEQ ID NO: 11141 - DNA, 20 bp, Artificial sequence
  Reverse Primer
attcatctttgcatcctcca

SEQ ID NO: 11142 - DNA, 20 bp, Artificial sequence
  Reverse Primer
cggacactcttcaggagaga

SEQ ID NO: 11143 - DNA, 19 bp, Artificial sequence
  Reverse Primer
aaagagacaggaggggagc

SEQ ID NO: 11144 - DNA, 19 bp, Artificial sequence
  Reverse Primer
ccatagtcagggaccgtct

SEQ ID NO: 11145 - DNA, 20 bp, Artificial sequence
  Reverse Primer
tgagaggcaggtctgtcact

SEQ ID NO: 11146 - DNA, 23 bp, Artificial sequence
  Reverse Primer
tttttctctaaattgtggaccct

SEQ ID NO: 11147 - DNA, 18 bp, Artificial sequence
  Reverse Primer
cccagaatctgtctgggg

SEQ ID NO: 11148 - DNA, 18 bp, Artificial sequence
  Reverse Primer
tctggggagcacatagga

SEQ ID NO: 11149 - DNA, 24 bp, Artificial sequence
  Reverse Primer
aaaagacaaaacaaacctgagaaa

SEQ ID NO: 11150 - DNA, 18 bp, Artificial sequence
  Reverse Primer
atcatccaagccaccaag

SEQ ID NO: 11151 - DNA, 21 bp, Artificial sequence
  Reverse Primer
ttcctaccctcagtctccaga

SEQ ID NO: 11152 - DNA, 22 bp, Artificial sequence
  Reverse Primer
ataatagcaacakcrgtcacga

SEQ ID NO: 11153 - DNA, 24 bp, Artificial sequence
  Reverse Primer
attagacggtttctgttctgtttg

SEQ ID NO: 11154 - DNA, 22 bp, Artificial sequence
  Reverse Primer
aaaagaaaaagtggaggacacc

SEQ ID NO: 11155 - DNA, 26 bp, Artificial sequence
  Reverse Primer
ggctacagtttaaaatctatcaaagc

SEQ ID NO: 11156 - DNA, 18 bp, Artificial sequence
  Reverse Primer
tggcgttgggactcatga

SEQ ID NO: 11157 - DNA, 18 bp, Artificial sequence
  Reverse Primer
tgcaagcctgaccctccc

SEQ ID NO: 11158 - DNA, 18 bp, Artificial sequence
  Reverse Primer
aacattgcaaatcctcgc

SEQ ID NO: 11159 - DNA, 24 bp, Artificial sequence
  Reverse Primer
aaacatgaaacatttctaccttcc

SEQ ID NO: 11160 - DNA, 25 bp, Artificial sequence
  Reverse Primer
agagtcttcctttcagctaagaaaa

SEQ ID NO: 11161 - DNA, 21 bp, Artificial sequence
  Reverse Primer
tttagagagcctcttctgcag

SEQ ID NO: 11162 - DNA, 21 bp, Artificial sequence
  Reverse Primer
cctgcagtcagctctactcag

SEQ ID NO: 11163 - DNA, 23 bp, Artificial sequence
  Reverse Primer
ctgaatgagagagcaytcacttt

SEQ ID NO: 11164 - DNA, 22 bp, Artificial sequence
  Reverse Primer
atttaagaaaacaggaggtggc

SEQ ID NO: 11165 - DNA, 25 bp, Artificial sequence
  Reverse Primer
aggctcttcyaatattttctttgtt

SEQ ID NO: 11166 - DNA, 24 bp, Artificial sequence
  Reverse Primer
tctataaaaagttttcccttccaa

SEQ ID NO: 11167 - DNA, 26 bp, Artificial sequence
  Reverse Primer
ttgtgcagtcaatttattttagtgtc

SEQ ID NO: 11168 - DNA, 20 bp, Artificial sequence
  Reverse Primer
cttcagcttctcccttcatc

SEQ ID NO: 11169 - DNA, 18 bp, Artificial sequence
  Reverse Primer
caggggtctgatttggga

SEQ ID NO: 11170 - DNA, 24 bp, Artificial sequence
  Reverse Primer
aataggagactgaagccatattcc

SEQ ID NO: 11171 - DNA, 27 bp, Artificial sequence
  Reverse Primer
atagaacatacttttttcccctaagtg

SEQ ID NO: 11172 - DNA, 27 bp, Artificial sequence
  Reverse Primer
attagcatttaattgtatgccatatct

SEQ ID NO: 11173 - DNA, 19 bp, Artificial sequence
  Reverse Primer
ccgacccctaacatcagtg

SEQ ID NO: 11174 - DNA, 21 bp, Artificial sequence
  Reverse Primer
tggagaaataaacattcctgg

SEQ ID NO: 11175 - DNA, 29 bp, Artificial sequence
  Reverse Primer
tatttaatatgagatcatcagctttactg

SEQ ID NO: 11176 - DNA, 24 bp, Artificial sequence
  Reverse Primer
tatggaatgaaaaacacaatcaca

SEQ ID NO: 11177 - DNA, 25 bp, Artificial sequence
  Reverse Primer
attgaacatatggcacttatttctg

SEQ ID NO: 11178 - DNA, 19 bp, Artificial sequence
  Reverse Primer
aagagaattcccactgggg

SEQ ID NO: 11179 - DNA, 21 bp, Artificial sequence
  Reverse Primer
atagatcaggtttgcccaaga

SEQ ID NO: 11180 - DNA, 21 bp, Artificial sequence
  Reverse Primer
ttggagacatcttgtccagac

SEQ ID NO: 11181 - DNA, 25 bp, Artificial sequence
  Reverse Primer
caggatatgaattttttttaaaggc

SEQ ID NO: 11182 - DNA, 19 bp, Artificial sequence
  Reverse Primer
acacttggagatggcacaa

SEQ ID NO: 11183 - DNA, 30 bp, Artificial sequence
  Reverse Primer
cactctaactatttttaggtatacactgca

SEQ ID NO: 11184 - DNA, 21 bp, Artificial sequence
  Reverse Primer
atacaggcatggcgtattttt

SEQ ID NO: 11185 - DNA, 24 bp, Artificial sequence
  Reverse Primer
ttctaaaaatccattcatctgtca

SEQ ID NO: 11186 - DNA, 19 bp, Artificial sequence
  Reverse Primer
agcatttttatgccgtgtg

SEQ ID NO: 11187 - DNA, 19 bp, Artificial sequence
  Reverse Primer
tatcrtgcatsgaacctgg

SEQ ID NO: 11188 - DNA, 24 bp, Artificial sequence
  Reverse Primer
cttgtttactcccagtttttgatc

SEQ ID NO: 11189 - DNA, 26 bp, Artificial sequence
  Reverse Primer
tttgttattaatcaaaatcttgaccc

SEQ ID NO: 11190 - DNA, 23 bp, Artificial sequence
  Reverse Primer
ataatcacattctcccaatgttg

SEQ ID NO: 11191 - DNA, 24 bp, Artificial sequence
  Reverse Primer
agatgaacttaagcagaatggatc

SEQ ID NO: 11192 - DNA, 23 bp, Artificial sequence
  Reverse Primer
taaaactctgaccgtgtttctcc

SEQ ID NO: 11193 - DNA, 29 bp, Artificial sequence
  Reverse Primer
tgtaatagtctgagttctgagtaaatcaa

SEQ ID NO: 11194 - DNA, 25 bp, Artificial sequence
  Reverse Primer
taagattctccttcttggactcttc

SEQ ID NO: 11195 - DNA, 20 bp, Artificial sequence
  Reverse Primer
catctttgggttcctgtcaa

SEQ ID NO: 11196 - DNA, 18 bp, Artificial sequence
  Reverse Primer
ttttgtgctcccgaagcc

SEQ ID NO: 11197 - DNA, 20 bp, Artificial sequence
  Reverse Primer
tatgtttctgggctggaatc

SEQ ID NO: 11198 - DNA, 29 bp, Artificial sequence
  Reverse Primer
atcgaaaactcagtagttatatctctttg

SEQ ID NO: 11199 - DNA, 30 bp, Artificial sequence
  Reverse Primer
agagaatattacctgtataacatagctctt

SEQ ID NO: 11200 - DNA, 28 bp, Artificial sequence
  Reverse Primer
ataaaagagcaacttagattttcatttc

SEQ ID NO: 11201 - DNA, 24 bp, Artificial sequence
  Reverse Primer
aaacactagctgtgaactgaaaaa

SEQ ID NO: 11202 - DNA, 23 bp, Artificial sequence
  Reverse Primer
taattgttcaatcctattcccac

SEQ ID NO: 11203 - DNA, 26 bp, Artificial sequence
  Reverse Primer
aaagttcattactttgttacttctgg

SEQ ID NO: 11204 - DNA, 24 bp, Artificial sequence
  Reverse Primer
aaagattaagaccaggaagatcaa

SEQ ID NO: 11205 - DNA, 30 bp, Artificial sequence; identical to SEQ ID NO: 10061
  Reverse Primer

SEQ ID NO: 11206 - DNA, 29 bp, Artificial sequence
  Reverse Primer
agcttaaagctcacataataatgaaatag

SEQ ID NO: 11207 - DNA, 30 bp, Artificial sequence
  Reverse Primer
attagtataaatcataaatagaattcctgg

SEQ ID NO: 11208 - DNA, 28 bp, Artificial sequence
  Reverse Primer
taactttacctaggctattttactttgc

SEQ ID NO: 11209 - DNA, 21 bp, Artificial sequence
  Reverse Primer
tgctttgtccagatgaaaaga

SEQ ID NO: 11210 - DNA, 26 bp, Artificial sequence
  Reverse Primer
gtataaaagaatcttcaagttttggg

SEQ ID NO: 11211 - DNA, 22 bp, Artificial sequence
  Reverse Primer
tcttacctgaaaatatcccttt

SEQ ID NO: 11212 - DNA, 22 bp, Artificial sequence
  Reverse Primer
tcacagaagtgagatacctgca

SEQ ID NO: 11213 - DNA, 21 bp, Artificial sequence
  Reverse Primer
ataacccttgccacctcttat

SEQ ID NO: 11214 - DNA, 22 bp, Artificial sequence
  Reverse Primer
agtttccacatctgtcaaatgg

SEQ ID NO: 11215 - DNA, 23 bp, Artificial sequence
  Reverse Primer
ttattgatagacacgcactgcta

SEQ ID NO: 11216 - DNA, 26 bp, Artificial sequence
  Reverse Primer
ttctttgcaagtaacagacaaaatat

SEQ ID NO: 11217 - DNA, 24 bp, Artificial sequence
  Reverse Primer
tgtttaatgtgtgccatttagttc

SEQ ID NO: 11218 - DNA, 23 bp, Artificial sequence
  Reverse Primer
ccactcagttgcttaagctagaa

SEQ ID NO: 11219 - DNA, 21 bp, Artificial sequence
  Reverse Primer
atggatctgcttttgatgtca

SEQ ID NO: 11220 - DNA, 24 bp, Artificial sequence
  Reverse Primer
tgttaggattattcaccatattgc

SEQ ID NO: 11221 - DNA, 30 bp, Artificial sequence
  Reverse Primer
tacaagtggataggtatactatgttaagag

SEQ ID NO: 11222 - DNA, 26 bp, Artificial sequence
  Reverse Primer
agaataaagagctccaaatatggtac

SEQ ID NO: 11223 - DNA, 26 bp, Artificial sequence
  Reverse Primer
actttgcactgagastttttattttt

SEQ ID NO: 11224 - DNA, 30 bp, Artificial sequence
  Reverse Primer
ctaaaacatagctcattcttatgtaaaata

SEQ ID NO: 11225 - DNA, 27 bp, Artificial sequence
  Reverse Primer
ttgtacattagacatcatccttgtaga

SEQ ID NO: 11226 - DNA, 24 bp, Artificial sequence
  Reverse Primer
ttcaaaactcaacatgatctgact

SEQ ID NO: 11227 - DNA, 20 bp, Artificial sequence
  Reverse Primer
tgtttgggacttttccatga

SEQ ID NO: 11228 - DNA, 21 bp, Artificial sequence
  Reverse Primer
attaaaaggcaattaggcagc

SEQ ID NO: 11229 - DNA, 28 bp, Artificial sequence
  Reverse Primer
aaatgaattgatactagaaatatttggg

SEQ ID NO: 11230 - DNA, 22 bp, Artificial sequence
  Reverse Primer
actttgttcctggtggtgtatc

SEQ ID NO: 11231 - DNA, 18 bp, Artificial sequence
  Reverse Primer
tgaaattgctgtggccat

SEQ ID NO: 11232 - DNA, 20 bp, Artificial sequence
  Reverse Primer
atataggatttgaacggcgg

SEQ ID NO: 11233 - DNA, 23 bp, Artificial sequence
  Reverse Primer
ttctaagcagtgcagattacagc

SEQ ID NO: 11234 - DNA, 19 bp, Artificial sequence
  Reverse Primer
aaacttctctgcaccctgc

SEQ ID NO: 11235 - DNA, 18 bp, Artificial sequence
  Reverse Primer
ttaaccactggaccgcca

SEQ ID NO: 11236 - DNA, 20 bp, Artificial sequence
  Reverse Primer
agacaggtccacagttcctg

SEQ ID NO: 11237 - DNA, 18 bp, Artificial sequence
  Reverse Primer
agccgcctccaggacaag

SEQ ID NO: 11238 - DNA, 24 bp, Artificial sequence
  Reverse Primer
tacaggtgaaaacagaagagttga

SEQ ID NO: 11239 - DNA, 27 bp, Artificial sequence
  Reverse Primer
atgtgtgcctactattttatatcttgc

SEQ ID NO: 11240 - DNA, 20 bp, Artificial sequence
  Reverse Primer
tttcatggtaacacagtgcc

SEQ ID NO: 11241 - DNA, 27 bp, Artificial sequence
  Reverse Primer
aaaatccagattactttagctttgttt

SEQ ID NO: 11242 - DNA, 21 bp, Artificial sequence
  Reverse Primer
aggagttctgtctccggtaaa

SEQ ID NO: 11243 - DNA, 26 bp, Artificial sequence
  Reverse Primer
ttcctacttagatcaggaaaacaact

SEQ ID NO: 11244 - DNA, 30 bp, Artificial sequence
  Reverse Primer
agagattttaatgtctatagtatgtgcata

SEQ ID NO: 11245 - DNA, 25 bp, Artificial sequence
  Reverse Primer
atttcagaaatatcaccaaagatga

SEQ ID NO: 11246 - DNA, 25 bp, Artificial sequence
  Reverse Primer
gaagatatgttgacactcaatgagg

SEQ ID NO: 11247 - DNA, 30 bp, Artificial sequence
  Reverse Primer
atgttatataaggatctaatgtttcaaacc

SEQ ID NO: 11248 - DNA, 30 bp, Artificial sequence
  Reverse Primer
gtaattatctataactactttcacttcata

SEQ ID NO: 11249 - DNA, 26 bp, Artificial sequence
  Reverse Primer
tttatgatacttcctcattayccaaa

SEQ ID NO: 11250 - DNA, 26 bp, Artificial sequence
  Reverse Primer
aaactattgctgaaaatgtatgtgaa

SEQ ID NO: 11251 - DNA, 19 bp, Artificial sequence
  Reverse Primer
gcagagctggagcttcatc

SEQ ID NO: 11252 - DNA, 25 bp, Artificial sequence
  Reverse Primer
attaccactttccctttaaacctta

SEQ ID NO: 11253 - DNA, 21 bp, Artificial sequence
  Reverse Primer
tttcacaagcaacaggaaaag

SEQ ID NO: 11254 - DNA, 28 bp, Artificial sequence
  Reverse Primer
attttaaaaatagtgaaacttgaactgc

SEQ ID NO: 11255 - DNA, 27 bp, Artificial sequence
  Reverse Primer
aattgttttttctttaactcagttcac

SEQ ID NO: 11256 - DNA, 24 bp, Artificial sequence
  Reverse Primer
agagggggaaaaaaawattactct

SEQ ID NO: 11257 - DNA, 20 bp, Artificial sequence
  Reverse Primer
ggcctttgagttttgagtgg

SEQ ID NO: 11258 - DNA, 25 bp, Artificial sequence
  Reverse Primer
acctcccaactaaaaccttaattta

SEQ ID NO: 11259 - DNA, 27 bp, Artificial sequence
  Reverse Primer
aatcaaagatagtttatgaggacaatg

SEQ ID NO: 11260 - DNA, 30 bp, Artificial sequence
  Reverse Primer
ttagtaccaagtattctctttataatgtca

SEQ ID NO: 11261 - DNA, 27 bp, Artificial sequence
  Reverse Primer
acacttattctttgtaaagytttcctc

SEQ ID NO: 11262 - DNA, 22 bp, Artificial sequence
  Reverse Primer
aagtattgcatggcataacttg

SEQ ID NO: 11263 - DNA, 21 bp, Artificial sequence
  Reverse Primer
aaatgtggctgaaaacctttc

SEQ ID NO: 11264 - DNA, 22 bp, Artificial sequence
  Reverse Primer
aaactattgtcttctcacccca

SEQ ID NO: 11265 - DNA, 26 bp, Artificial sequence
  Reverse Primer
agtttgagtacttaagcyagagcagt

SEQ ID NO: 11266 - DNA, 26 bp, Artificial sequence
  Reverse Primer
aaatgtatccagaaaatatgaattcc

SEQ ID NO: 11267 - DNA, 20 bp, Artificial sequence
  Reverse Primer
tattgaccttttcctctgcg

SEQ ID NO: 11268 - DNA, 20 bp, Artificial sequence
  Reverse Primer
tgcttctttgtatgcctggt

SEQ ID NO: 11269 - DNA, 28 bp, Artificial sequence
  Reverse Primer
aattatatggagaaatttagagtgtttg

SEQ ID NO: 11270 - DNA, 27 bp, Artificial sequence
  Reverse Primer
acttttccaataagagcttaaaaagtt

SEQ ID NO: 11271 - DNA, 22 bp, Artificial sequence
  Reverse Primer
tggttcatgagaaagtaagggt

SEQ ID NO: 11272 - DNA, 23 bp, Artificial sequence
  Reverse Primer
aacatgcctttgaaattctgtag

SEQ ID NO: 11273 - DNA, 30 bp, Artificial sequence
  Reverse Primer
ttatttcataattatgttccctaaactagg

SEQ ID NO: 11274 - DNA, 20 bp, Artificial sequence
  Reverse Primer
agctgcctatatttgctgca

SEQ ID NO: 11275 - DNA, 24 bp, Artificial sequence
  Reverse Primer
tacttaaacatctgcaaacacgtc

SEQ ID NO: 11276 - DNA, 26 bp, Artificial sequence
  Reverse Primer
tttgaataattactctcatttcctca

SEQ ID NO: 11277 - DNA, 24 bp, Artificial sequence
  Reverse Primer
tcycaagtcatgaataagtaacca

SEQ ID NO: 11278 - DNA, 27 bp, Artificial sequence
  Reverse Primer
ttagaaatgtccagttgactagttttt

SEQ ID NO: 11279 - DNA, 26 bp, Artificial sequence
  Reverse Primer
cagagcattactaagtgtcagatttt

SEQ ID NO: 11280 - DNA, 30 bp, Artificial sequence
  Reverse Primer
atgtaattaaatcttaggtatgtctttctc

SEQ ID NO: 11281 - DNA, 23 bp, Artificial sequence
  Reverse Primer
tgtgaggccagatatttgttatt

SEQ ID NO: 11282 - DNA, 22 bp, Artificial sequence
  Reverse Primer
tccaaagagtcatattcatgca

SEQ ID NO: 11283 - DNA, 22 bp, Artificial sequence
  Reverse Primer
acaagcttctctttagcaagca

SEQ ID NO: 11284 - DNA, 26 bp, Artificial sequence
  Reverse Primer
ttatttttagggatacatgtcttgac

SEQ ID NO: 11285 - DNA, 27 bp, Artificial sequence
  Reverse Primer
acagtcaatatcttgagaggataaaat

SEQ ID NO: 11286 - DNA, 27 bp, Artificial sequence
  Reverse Primer
accctgttcatattaattgattgtaga

SEQ ID NO: 11287 - DNA, 30 bp, Artificial sequence
  Reverse Primer
ctaaatacagatcaactatttttgataaca

SEQ ID NO: 11288 - DNA, 27 bp, Artificial sequence
  Reverse Primer
aaatacatggctactacttgaaaaaca

SEQ ID NO: 11289 - DNA, 23 bp, Artificial sequence
  Reverse Primer
tagctggtttctatctccacatc

SEQ ID NO: 11290 - DNA, 23 bp, Artificial sequence
  Reverse Primer
ttrttaaatgcttgcccttagtt

SEQ ID NO: 11291 - DNA, 24 bp, Artificial sequence
  Reverse Primer
ggaagtcaaactgggtataacaag

SEQ ID NO: 11292 - DNA, 30 bp, Artificial sequence
  Reverse Primer
atataaatacatatcttatgactttttcct

SEQ ID NO: 11293 - DNA, 22 bp, Artificial sequence
  Reverse Primer
aaagtgttctccccatcctact

SEQ ID NO: 11294 - DNA, 18 bp, Artificial sequence
  Reverse Primer
ttagtgaggacgggtgga

SEQ ID NO: 11295 - DNA, 20 bp, Artificial sequence
  Reverse Primer
accgaaaaaaatggtccagt

SEQ ID NO: 11296 - DNA, 22 bp, Artificial sequence
  Reverse Primer
actcagaagtccatcatccaaa

SEQ ID NO: 11297 - DNA, 20 bp, Artificial sequence
  Reverse Primer
ttgtctcccactgctttgtt

SEQ ID NO: 11298 - DNA, 19 bp, Artificial sequence
  Reverse Primer
aatctctgagccctcagcc

SEQ ID NO: 11299 - DNA, 21 bp, Artificial sequence
  Reverse Primer
agagctgagccttcaagatca

SEQ ID NO: 11300 - DNA, 19 bp, Artificial sequence
  Reverse Primer
aacttgcacggaccaaaat

SEQ ID NO: 11301 - DNA, 23 bp, Artificial sequence
  Reverse Primer
atctttaaaacgatgcaacaaca

SEQ ID NO: 11302 - DNA, 19 bp, Artificial sequence
  Reverse Primer
cccctcttccagtgtctcc

SEQ ID NO: 11303 - DNA, 20 bp, Artificial sequence
  Reverse Primer
tgttacctgcacagctagcc

SEQ ID NO: 11304 - DNA, 27 bp, Artificial sequence
  Reverse Primer
tactgtttttgaggatcaaagtatttt

SEQ ID NO: 11305 - DNA, 26 bp, Artificial sequence
  Reverse Primer
actctaatcagagtatcatctaggcc

SEQ ID NO: 11306 - DNA, 23 bp, Artificial sequence
  Reverse Primer
ggtgtcaatatacatgatgcatg

SEQ ID NO: 11307 - DNA, 27 bp, Artificial sequence
  Reverse Primer
agtattacctttttttaaacaaccaca

SEQ ID NO: 11308 - DNA, 25 bp, Artificial sequence
  Reverse Primer
tatttctgytgttgattgtaaatgg

SEQ ID NO: 11309 - DNA, 26 bp, Artificial sequence
  Reverse Primer
gaagtaaaatgtttgtaaatgttgca

SEQ ID NO: 11310 - DNA, 24 bp, Artificial sequence
  Reverse Primer
tgagaaccactttttttctctttg

SEQ ID NO: 11311 - DNA, 21 bp, Artificial sequence
  Reverse Primer
atcgaaaaccattcatttgtg

SEQ ID NO: 11312 - DNA, 24 bp, Artificial sequence
  Reverse Primer
aaactacatgggtgacagaaatct

SEQ ID NO: 11313 - DNA, 18 bp, Artificial sequence
  Reverse Primer
ataccaaaaccccgtgtg

SEQ ID NO: 11314 - DNA, 24 bp, Artificial sequence
  Reverse Primer
aatattatcaccaacaaaaagcac

SEQ ID NO: 11315 - DNA, 23 bp, Artificial sequence
  Reverse Primer
ttctgtgtgttttattgcaaacg

SEQ ID NO: 11316 - DNA, 18 bp, Artificial sequence
  Reverse Primer
caccccccagaatgaatc

SEQ ID NO: 11317 - DNA, 23 bp, Artificial sequence
  Reverse Primer
atcccaaatcttttgtagaagga

SEQ ID NO: 11318 - DNA, 21 bp, Artificial sequence
  Reverse Primer
atatggcctgcttgagagttg

SEQ ID NO: 11319 - DNA, 21 bp, Artificial sequence
  Reverse Primer
aaaacagtgcagccacttatg

SEQ ID NO: 11320 - DNA, 26 bp, Artificial sequence
  Reverse Primer
agagcttctctttgttctgatctaga

SEQ ID NO: 11321 - DNA, 23 bp, Artificial sequence
  Reverse Primer
tactraaaacacttcccttgacc

SEQ ID NO: 11322 - DNA, 22 bp, Artificial sequence
  Reverse Primer
tagccaatctttgataactggg

SEQ ID NO: 11323 - DNA, 18 bp, Artificial sequence
  Reverse Primer
cgagccgtgtgckccttt

SEQ ID NO: 11324 - DNA, 25 bp, Artificial sequence
  Reverse Primer
aatgaggcacatgtagaatagagaa

SEQ ID NO: 11325 - DNA, 18 bp, Artificial sequence
  Reverse Primer
aatggtattgggggccat

SEQ ID NO: 11326 - DNA, 19 bp, Artificial sequence
  Reverse Primer
ttactgattgggcaacagg

SEQ ID NO: 11327 - DNA, 24 bp, Artificial sequence
  Reverse Primer
aacaggatagctttcttggaatac

SEQ ID NO: 11328 - DNA, 18 bp, Artificial sequence
  Reverse Primer
agscagggaaggtgagtg

SEQ ID NO: 11329 - DNA, 30 bp, Artificial sequence
  Reverse Primer
tgagatattttaagaacaactaagtcagat

SEQ ID NO: 11330 - DNA, 24 bp, Artificial sequence
  Reverse Primer
aaagcatataattccagctgtttg

SEQ ID NO: 11331 - DNA, 19 bp, Artificial sequence
  Reverse Primer
atcaggcccatctgaaaca

SEQ ID NO: 11332 - DNA, 26 bp, Artificial sequence
  Reverse Primer
ctcatactgttcctattggtatctca

SEQ ID NO: 11333 - DNA, 18 bp, Artificial sequence
  Reverse Primer
tcttgagtccagccaccc

SEQ ID NO: 11334 - DNA, 22 bp, Artificial sequence
  Reverse Primer
tcttcagagacatttccatcct

SEQ ID NO: 11335 - DNA, 24 bp, Artificial sequence
  Reverse Primer
ttaaatccaacagctaaagacctc

SEQ ID NO: 11336 - DNA, 24 bp, Artificial sequence
  Reverse Primer
aattctagttggartcrtggtttc

SEQ ID NO: 11337 - DNA, 18 bp, Artificial sequence
  Reverse Primer
aggggatgtccacgagag

SEQ ID NO: 11338 - DNA, 19 bp, Artificial sequence
  Reverse Primer
tgatgaacctctcaggcag

SEQ ID NO: 11339 - DNA, 23 bp, Artificial sequence
  Reverse Primer
attagcatgaggcctagatttgt

SEQ ID NO: 11340 - DNA, 29 bp, Artificial sequence
  Reverse Primer
tgaaamtcatacttgaattttaactaagg

SEQ ID NO: 11341 - DNA, 28 bp, Artificial sequence
  Reverse Primer
agaaaaaaatcaatacaacatacacatg

SEQ ID NO: 11342 - DNA, 29 bp, Artificial sequence
  Reverse Primer
agattatatatacaaacctgatgtcacag

SEQ ID NO: 11343 - DNA, 27 bp, Artificial sequence
  Reverse Primer
accttcctaattagttctataacctgc

SEQ ID NO: 11344 - DNA, 28 bp, Artificial sequence
  Reverse Primer
tttatgtttatattcctaaacctatgcc

SEQ ID NO: 11345 - DNA, 28 bp, Artificial sequence
  Reverse Primer
tgagcaaagttaaacagttatttaaaca

SEQ ID NO: 11346 - DNA, 30 bp, Artificial sequence
  Reverse Primer
aataatctctaaatgtattgttacattcct

SEQ ID NO: 11347 - DNA, 18 bp, Artificial sequence
  Reverse Primer
cccagaagcatgccaagt

SEQ ID NO: 11348 - DNA, 24 bp, Artificial sequence
  Reverse Primer
tctattacaacagggaagggatag

SEQ ID NO: 11349 - DNA, 26 bp, Artificial sequence
  Reverse Primer
aaatcatmactcttttgaaatatgcc

SEQ ID NO: 11350 - DNA, 24 bp, Artificial sequence
  Reverse Primer
ttagcaattgagcaaattaacctt

SEQ ID NO: 11351 - DNA, 30 bp, Artificial sequence
  Reverse Primer
taaaatattatctacattcttgtatcagct

SEQ ID NO: 11352 - DNA, 21 bp, Artificial sequence
  Reverse Primer
tatttcatgacccctaaaggc

SEQ ID NO: 11353 - DNA, 25 bp, Artificial sequence
  Reverse Primer
tttccatactgtttactctgacctc

SEQ ID NO: 11354 - DNA, 24 bp, Artificial sequence
  Reverse Primer
tttaaaaagatttttctcaggagg

SEQ ID NO: 11355 - DNA, 22 bp, Artificial sequence
  Reverse Primer
ttatgctgcaaatagagctcag

SEQ ID NO: 11356 - DNA, 27 bp, Artificial sequence
  Reverse Primer
ataatattgtctctggaaaaattgcta

SEQ ID NO: 11357 - DNA, 24 bp, Artificial sequence
  Reverse Primer
aaatggaatttcctaatgtgtagc

SEQ ID NO: 11358 - DNA, 27 bp, Artificial sequence
  Reverse Primer
tatataggtgacaactgatagcaacaa

SEQ ID NO: 11359 - DNA, 28 bp, Artificial sequence
  Reverse Primer
tttagkattgactggtttgatgtatagt

SEQ ID NO: 11360 - DNA, 23 bp, Artificial sequence
  Reverse Primer
ataaagattttcccaaatggaaa

SEQ ID NO: 11361 - DNA, 29 bp, Artificial sequence
  Reverse Primer
aaactgtctactacaggtttaaaaaattc

SEQ ID NO: 11362 - DNA, 25 bp, Artificial sequence
  Reverse Primer
aatcaggttacatagaagttttgca

SEQ ID NO: 11363 - DNA, 19 bp, Artificial sequence
  Reverse Primer
aaagaaatcactgggctgg

SEQ ID NO: 11364 - DNA, 23 bp, Artificial sequence
  Reverse Primer
aaaactagaagcaacgaatgaga

SEQ ID NO: 11365 - DNA, 28 bp, Artificial sequence
  Reverse Primer
ttggtccatgaatatttgtttatatatg

SEQ ID NO: 11366 - DNA, 21 bp, Artificial sequence
  Reverse Primer
ttggtctgaaggcagagacta

SEQ ID NO: 11367 - DNA, 28 bp, Artificial sequence
  Reverse Primer
atatatgtcaattctagtctcccagttc

SEQ ID NO: 11368 - DNA, 28 bp, Artificial sequence
  Reverse Primer
ttttaaagaatatatagctattttgggc

SEQ ID NO: 11369 - DNA, 25 bp, Artificial sequence
  Reverse Primer
tatttcttcaactacagaaacccat

SEQ ID NO: 11370 - DNA, 26 bp, Artificial sequence
  Reverse Primer
tctcatgaacttaatttttttctgtg

SEQ ID NO: 11371 - DNA, 20 bp, Artificial sequence
  Reverse Primer
aagggaagagggttttgcta

SEQ ID NO: 11372 - DNA, 23 bp, Artificial sequence
  Reverse Primer
taaaattccataagctacatggc

SEQ ID NO: 11373 - DNA, 21 bp, Artificial sequence
  Reverse Primer
atgacccctctctaaaagctc

SEQ ID NO: 11374 - DNA, 20 bp, Artificial sequence
  Reverse Primer
accaccagaaactcgaacag

SEQ ID NO: 11375 - DNA, 20 bp, Artificial sequence
  Reverse Primer
ttgtacccactgaacccatg

SEQ ID NO: 11376 - DNA, 21 bp, Artificial sequence
  Reverse Primer
agcaacaagcacttacttcca

SEQ ID NO: 11377 - DNA, 20 bp, Artificial sequence
  Reverse Primer
tctgtccctcctaacagctg

SEQ ID NO: 11378 - DNA, 18 bp, Artificial sequence
  Reverse Primer
tgtgaccccctcgctgag

SEQ ID NO: 11379 - DNA, 23 bp, Artificial sequence
  Reverse Primer
ttctttcacctttacaaccatcc

SEQ ID NO: 11380 - DNA, 21 bp, Artificial sequence
  Reverse Primer
tatgagtgactgcctcaggtg

SEQ ID NO: 11381 - DNA, 20 bp, Artificial sequence
  Reverse Primer
cagactgcaaggtaatccca

SEQ ID NO: 11382 - DNA, 22 bp, Artificial sequence
  Reverse Primer
aaattcactctgcaggtctttc

SEQ ID NO: 11383 - DNA, 29 bp, Artificial sequence
  Reverse Primer
ataaacttgggtttataatatacactgct

SEQ ID NO: 11384 - DNA, 18 bp, Artificial sequence
  Reverse Primer
acctgccacagacaaggc

SEQ ID NO: 11385 - DNA, 22 bp, Artificial sequence
  Reverse Primer
aaagattattgagcaccaatgg

SEQ ID NO: 11386 - DNA, 25 bp, Artificial sequence
  Reverse Primer
atttgttcagtatcctttgagagag

SEQ ID NO: 11387 - DNA, 22 bp, Artificial sequence
  Reverse Primer
accatgaaggtaatggtcagaa

SEQ ID NO: 11388 - DNA, 18 bp, Artificial sequence
  Reverse Primer
taagactgggtgggggaa

SEQ ID NO: 11389 - DNA, 24 bp, Artificial sequence
  Reverse Primer
attttagtgttgaatggaatgctt

SEQ ID NO: 11390 - DNA, 18 bp, Artificial sequence
  Reverse Primer
ttgggaaggacagcgaag

SEQ ID NO: 11391 - DNA, 24 bp, Artificial sequence
  Reverse Primer
tttcctcacctgtaaaagaaaatg

SEQ ID NO: 11392 - DNA, 21 bp, Artificial sequence
  Reverse Primer
actagagaaaagcccrcagag

SEQ ID NO: 11393 - DNA, 29 bp, Artificial sequence
  Reverse Primer
tattgtagttaagacacaaaaccaataca

SEQ ID NO: 11394 - DNA, 28 bp, Artificial sequence
  Reverse Primer
tgtaattatgtcataaagcaatraactc

SEQ ID NO: 11395 - DNA, 27 bp, Artificial sequence
  Reverse Primer
taattgaacaacatactatgtagcagg

SEQ ID NO: 11396 - DNA, 23 bp, Artificial sequence
  Reverse Primer
aaccaataccaggaraagctaga

SEQ ID NO: 11397 - DNA, 29 bp, Artificial sequence
  Reverse Primer
ttgaggtggtaataaatatctacttatgg

SEQ ID NO: 11398 - DNA, 30 bp, Artificial sequence
  Reverse Primer
tatataaaatgagacagatgataactgtgt

SEQ ID NO: 11399 - DNA, 27 bp, Artificial sequence
  Reverse Primer
ttacttagmctttcccaaagttaaatt

SEQ ID NO: 11400 - DNA, 28 bp, Artificial sequence
  Reverse Primer
ttttcatacccagtaaaactgatattac

SEQ ID NO: 11401 - DNA, 20 bp, Artificial sequence
  Reverse Primer
tcaggattcaaccctctgag

SEQ ID NO: 11402 - DNA, 20 bp, Artificial sequence
  Reverse Primer
agatttgggtgcatcatctg

SEQ ID NO: 11403 - DNA, 26 bp, Artificial sequence
  Reverse Primer
agcctacagattagaaaggaaaaatt

SEQ ID NO: 11404 - DNA, 21 bp, Artificial sequence
  Reverse Primer
caaacattacttgccctcatt

SEQ ID NO: 11405 - DNA, 29 bp, Artificial sequence
  Reverse Primer
ttatacatactagaaatatcctgacaggg

SEQ ID NO: 11406 - DNA, 23 bp, Artificial sequence
  Reverse Primer
aaaatcttggatgactctgtttg

SEQ ID NO: 11407 - DNA, 30 bp, Artificial sequence
  Reverse Primer
atattaagcagtaatatgacttaagggtag

SEQ ID NO: 11408 - DNA, 26 bp, Artificial sequence
  Reverse Primer
ataaagtgactgtttaccatgaagac

SEQ ID NO: 11409 - DNA, 25 bp, Artificial sequence
  Reverse Primer
taaatctaaaaactaatgcagaccc

SEQ ID NO: 11410 - DNA, 29 bp, Artificial sequence
  Reverse Primer
aagaatctactgagcacatagaatatgta

SEQ ID NO: 11411 - DNA, 20 bp, Artificial sequence
  Reverse Primer
tttttgctggaggacaaagt

SEQ ID NO: 11412 - DNA, 27 bp, Artificial sequence
  Reverse Primer
gatattgtcttttgacatcctcttatg

SEQ ID NO: 11413 - DNA, 29 bp, Artificial sequence
  Reverse Primer
atttctagatctctattctcaaaacttca

SEQ ID NO: 11414 - DNA, 30 bp, Artificial sequence
  Reverse Primer
gttaaactactgaggtattttataatctta

SEQ ID NO: 11415 - DNA, 23 bp, Artificial sequence
  Reverse Primer
attgttacttcactttggctgag

SEQ ID NO: 11416 - DNA, 22 bp, Artificial sequence
  Reverse Primer
gttctgagtctcggagtctgac

SEQ ID NO: 11417 - DNA, 24 bp, Artificial sequence
  Reverse Primer
ttaactctgaattttcctcagtgg

SEQ ID NO: 11418 - DNA, 23 bp, Artificial sequence
  Reverse Primer
tcacactaagcagagattccact

SEQ ID NO: 11419 - DNA, 23 bp, Artificial sequence
  Reverse Primer
aaaaatatcttgaaaataccccc

SEQ ID NO: 11420 - DNA, 22 bp, Artificial sequence
  Reverse Primer
tgtgtctgttcagaatcattcc

SEQ ID NO: 11421 - DNA, 21 bp, Artificial sequence
  Reverse Primer
acagttcctagcacacaatgg

SEQ ID NO: 11422 - DNA, 18 bp, Artificial sequence
  Reverse Primer
tggcctggtaggaagtgg

SEQ ID NO: 11423 - DNA, 18 bp, Artificial sequence
  Reverse Primer
aagtcccagctccggctc

SEQ ID NO: 11424 - DNA, 18 bp, Artificial sequence
  Reverse Primer
aagaccaggccaggccac

SEQ ID NO: 11425 - DNA, 20 bp, Artificial sequence
  Reverse Primer
agcccaaacatgaagtaggc

SEQ ID NO: 11426 - DNA, 20 bp, Artificial sequence
  Reverse Primer
aggagggtgcctctttacag

SEQ ID NO: 11427 - DNA, 20 bp, Artificial sequence
  Reverse Primer
aggccaagaacagtcagttg

SEQ ID NO: 11428 - DNA, 27 bp, Artificial sequence
  Reverse Primer
attaactaacttaagcctcagtttcct

SEQ ID NO: 11429 - DNA, 19 bp, Artificial sequence
  Reverse Primer
tacctctctgccacacctg

SEQ ID NO: 11430 - DNA, 22 bp, Artificial sequence
  Reverse Primer
aacagaaagtttcagagtgggg

SEQ ID NO: 11431 - DNA, 23 bp, Artificial sequence
  Reverse Primer
tcctgtctcttttatctggaagg

SEQ ID NO: 11432 - DNA, 21 bp, Artificial sequence
  Reverse Primer
tttaccatgaccctctcctct

SEQ ID NO: 11433 - DNA, 25 bp, Artificial sequence
  Reverse Primer
aactgaactagaaaacaaacaaacg

SEQ ID NO: 11434 - DNA, 24 bp, Artificial sequence
  Reverse Primer
agactctgtagtcagaagcatcac

SEQ ID NO: 11435 - DNA, 23 bp, Artificial sequence
  Reverse Primer
aaggctggagtgagaagttagac

SEQ ID NO: 11436 - DNA, 21 bp, Artificial sequence
  Reverse Primer
ttctagccctggactacctca

SEQ ID NO: 11437 - DNA, 18 bp, Artificial sequence
  Reverse Primer
acagccaagcaggaggct

SEQ ID NO: 11438 - DNA, 22 bp, Artificial sequence
  Reverse Primer
tactaaaaagccagaaccctgg

SEQ ID NO: 11439 - DNA, 24 bp, Artificial sequence
  Reverse Primer
agataccaaaggaggactaaacac

SEQ ID NO: 11440 - DNA, 27 bp, Artificial sequence
  Reverse Primer
tttcatctcctagctatgactctaaac

SEQ ID NO: 11441 - DNA, 28 bp, Artificial sequence
  Reverse Primer
ttagcatataataggcacagatcatatt

SEQ ID NO: 11442 - DNA, 26 bp, Artificial sequence
  Reverse Primer
tgaaaaatgaagaaaacaagttagtg

SEQ ID NO: 11443 - DNA, 24 bp, Artificial sequence
  Reverse Primer
tttctagaagcaacttatccctca

SEQ ID NO: 11444 - DNA, 21 bp, Artificial sequence
  Reverse Primer
atttttccttcaatcctgtgg

SEQ ID NO: 11445 - DNA, 20 bp, Artificial sequence
  Reverse Primer
taccactagtgccatgtggg

SEQ ID NO: 11446 - DNA, 23 bp, Artificial sequence
  Reverse Primer
aaaagattatctccatattgggg

SEQ ID NO: 11447 - DNA, 26 bp, Artificial sequence
  Reverse Primer
ctcggtataagattgttaagtacctg

SEQ ID NO: 11448 - DNA, 18 bp, Artificial sequence
  Reverse Primer
agttgtgtgtgttgcggg

SEQ ID NO: 11449 - DNA, 25 bp, Artificial sequence
  Reverse Primer
tttgggacttagttcacttagaatg

SEQ ID NO: 11450 - DNA, 20 bp, Artificial sequence
  Reverse Primer
tagtgcagcaagaactgacg

SEQ ID NO: 11451 - DNA, 29 bp, Artificial sequence
  Reverse Primer
attgaatgagtctgttaagtagtgtagtg

SEQ ID NO: 11452 - DNA, 20 bp, Artificial sequence
  Reverse Primer
aggcaactagatcccacatg

SEQ ID NO: 11453 - DNA, 23 bp, Artificial sequence
  Reverse Primer
ccacaaaataacacattatccca

SEQ ID NO: 11454 - DNA, 20 bp, Artificial sequence
  Reverse Primer
acaacatctcctatggcctg

SEQ ID NO: 11455 - DNA, 18 bp, Artificial sequence
  Reverse Primer
ttgttcagaaagcgccag

SEQ ID NO: 11456 - DNA, 23 bp, Artificial sequence
  Reverse Primer
tctcaaacttgagcttcagaatc

SEQ ID NO: 11457 - DNA, 22 bp, Artificial sequence
  Reverse Primer
taggctttcactcaatatcccc

SEQ ID NO: 11458 - DNA, 21 bp, Artificial sequence
  Reverse Primer
gctcttctctcgttttgaacc

SEQ ID NO: 11459 - DNA, 22 bp, Artificial sequence
  Reverse Primer
tagtgggactgagaaggacaga

SEQ ID NO: 11460 - DNA, 23 bp, Artificial sequence
  Reverse Primer
ttctttcttgacctcacatctca

SEQ ID NO: 11461 - DNA, 28 bp, Artificial sequence
  Reverse Primer
taccgaattagacagagttatagacctt

SEQ ID NO: 11462 - DNA, 20 bp, Artificial sequence
  Reverse Primer
aaatggagacagaagggagc

SEQ ID NO: 11463 - DNA, 29 bp, Artificial sequence
  Reverse Primer
aataaaaatagactcacagagaacaaatg

SEQ ID NO: 11464 - DNA, 18 bp, Artificial sequence
  Reverse Primer
tggtccaggtgaagcagg

SEQ ID NO: 11465 - DNA, 26 bp, Artificial sequence
  Reverse Primer
aaaaagtgactttaagtttgtccatc

SEQ ID NO: 11466 - DNA, 24 bp, Artificial sequence
  Reverse Primer
ttctctgcatcttaatactcctcc

SEQ ID NO: 11467 - DNA, 23 bp, Artificial sequence
  Reverse Primer
taataataaacaagcccacgtga

SEQ ID NO: 11468 - DNA, 19 bp, Artificial sequence
  Reverse Primer
tgggacactgtcttcaggg

SEQ ID NO: 11469 - DNA, 20 bp, Artificial sequence
  Reverse Primer
tcttaatcccctctcccaca

SEQ ID NO: 11470 - DNA, 25 bp, Artificial sequence
  Reverse Primer
tttacttaagtaggtggtarcaggc

SEQ ID NO: 11471 - DNA, 19 bp, Artificial sequence
  Reverse Primer
cgtctaatgcacagcagtg

SEQ ID NO: 11472 - DNA, 20 bp, Artificial sequence
  Reverse Primer
aacagccaagaccaacaaaa

SEQ ID NO: 11473 - DNA, 20 bp, Artificial sequence
  Reverse Primer
cacccaagaagtccactcag

SEQ ID NO: 11474 - DNA, 19 bp, Artificial sequence
  Reverse Primer
tttttcgaagcccagatca

SEQ ID NO: 11475 - DNA, 20 bp, Artificial sequence
  Reverse Primer
gctgtgacaactcttgagcc

SEQ ID NO: 11476 - DNA, 23 bp, Artificial sequence
  Reverse Primer
tttaggctcttacattcccctaa

SEQ ID NO: 11477 - DNA, 23 bp, Artificial sequence
  Reverse Primer
ttttgctgtagtttcctatttgg

SEQ ID NO: 11478 - DNA, 22 bp, Artificial sequence
  Reverse Primer
ttcttaacacacaatgtgctgg

SEQ ID NO: 11479 - DNA, 24 bp, Artificial sequence
  Reverse Primer
attgtgtagaatttgggagtagga

SEQ ID NO: 11480 - DNA, 18 bp, Artificial sequence
  Reverse Primer
cattaacaggggacgggg

SEQ ID NO: 11481 - DNA, 20 bp, Artificial sequence
  Reverse Primer
aagacgatcacacagcacaa

SEQ ID NO: 11482 - DNA, 27 bp, Artificial sequence
  Reverse Primer
ttcctctaggaaaagttgaatattagg

SEQ ID NO: 11483 - DNA, 22 bp, Artificial sequence
  Reverse Primer
atatagcagttttcagggaggg

SEQ ID NO: 11484 - DNA, 22 bp, Artificial sequence
  Reverse Primer
ttgactgctttaatcttgctgg

SEQ ID NO: 11485 - DNA, 28 bp, Artificial sequence
  Reverse Primer
attctctcagaatgaacctttagttaat

SEQ ID NO: 11486 - DNA, 25 bp, Artificial sequence
  Reverse Primer
cttagaccactgattctcaaacttg

SEQ ID NO: 11487 - DNA, 25 bp, Artificial sequence
  Reverse Primer
cgtattagttctgtggctttattca

SEQ ID NO: 11488 - DNA, 18 bp, Artificial sequence
  Reverse Primer
acgagaaccagccgggtg

SEQ ID NO: 11489 - DNA, 25 bp, Artificial sequence
  Reverse Primer
taagaaagatctaggatgagcacag

SEQ ID NO: 11490 - DNA, 19 bp, Artificial sequence
  Reverse Primer
aaagacacagtgggggagg

SEQ ID NO: 11491 - DNA, 23 bp, Artificial sequence
  Reverse Primer
agagaataagagcagtagcaggg

SEQ ID NO: 11492 - DNA, 23 bp, Artificial sequence
  Reverse Primer
aaaagaagaagcagcaacagata

SEQ ID NO: 11493 - DNA, 26 bp, Artificial sequence
  Reverse Primer
accaacttactcttttctaaagcatc

SEQ ID NO: 11494 - DNA, 28 bp, Artificial sequence
  Reverse Primer
aagtaggataaagaaaaagtagaatccc

SEQ ID NO: 11495 - DNA, 27 bp, Artificial sequence
  Reverse Primer
aattaaaatgaaatttctaaccagagg

SEQ ID NO: 11496 - DNA, 26 bp, Artificial sequence
  Reverse Primer
aataaatagaagagcctcactgatca

SEQ ID NO: 11497 - DNA, 30 bp, Artificial sequence
  Reverse Primer
attaactaaactaagtactcaagtccaaaa

SEQ ID NO: 11498 - DNA, 18 bp, Artificial sequence
  Reverse Primer
tatttctggcgcagggtt

SEQ ID NO: 11499 - DNA, 25 bp, Artificial sequence
  Reverse Primer
gcttcctttactacattaaaatggc

SEQ ID NO: 11500 - DNA, 21 bp, Artificial sequence
  Reverse Primer
gatttcagtccttgtggacaa

SEQ ID NO: 11501 - DNA, 25 bp, Artificial sequence
  Reverse Primer
ttacttcttggattctaaaccttga

SEQ ID NO: 11502 - DNA, 22 bp, Artificial sequence
  Reverse Primer
atcgtctgcctttaaattttgg

SEQ ID NO: 11503 - DNA, 23 bp, Artificial sequence
  Reverse Primer
aaatgtacaggaggtaaggaggt

SEQ ID NO: 11504 - DNA, 24 bp, Artificial sequence
  Reverse Primer
ttgacagtctagattacaaaggca

SEQ ID NO: 11505 - DNA, 29 bp, Artificial sequence
  Reverse Primer
tttgacttttgtatctaatttctagaagg

SEQ ID NO: 11506 - DNA, 22 bp, Artificial sequence
  Reverse Primer
ttcacttgtctccctgatgtac

SEQ ID NO: 11507 - DNA, 29 bp, Artificial sequence
  Reverse Primer
gtaactactaccatacaccaaagtgataa

SEQ ID NO: 11508 - DNA, 26 bp, Artificial sequence
  Reverse Primer
aaactgaatacctagagactcacaag

SEQ ID NO: 11509 - DNA, 21 bp, Artificial sequence
  Reverse Primer
aaactgattgcaccgtagaaa

SEQ ID NO: 11510 - DNA, 30 bp, Artificial sequence
  Reverse Primer
cttttgagtaaagtgagttattttatwtct

SEQ ID NO: 11511 - DNA, 26 bp, Artificial sequence
  Reverse Primer
aaaaaaagacatgctgtactatttca

SEQ ID NO: 11512 - DNA, 26 bp, Artificial sequence
  Reverse Primer
yttctgataaatgagaaaatgtctgt

SEQ ID NO: 11513 - DNA, 28 bp, Artificial sequence
  Reverse Primer
tttatcaacataccctaactgtagtcat

SEQ ID NO: 11514 - DNA, 20 bp, Artificial sequence
  Reverse Primer
aatttgcatcatttgtccct

SEQ ID NO: 11515 - DNA, 20 bp, Artificial sequence
  Reverse Primer
aatggggagagttgaggaac

SEQ ID NO: 11516 - DNA, 20 bp, Artificial sequence
  Reverse Primer
caatcragttgtgtgtcgct

SEQ ID NO: 11517 - DNA, 28 bp, Artificial sequence
  Reverse Primer
aataaaaaataacctggatactctgttt

SEQ ID NO: 11518 - DNA, 19 bp, Artificial sequence
  Reverse Primer
atgcaaatgaccaaacctg

SEQ ID NO: 11519 - DNA, 24 bp, Artificial sequence
  Reverse Primer
ttgttctcgacgatagtaatttcc

SEQ ID NO: 11520 - DNA, 24 bp, Artificial sequence
  Reverse Primer
aaattcccaaaatactcttcaaca

SEQ ID NO: 11521 - DNA, 27 bp, Artificial sequence
  Reverse Primer
ataaaacccacttgtttagacagtaga

SEQ ID NO: 11522 - DNA, 22 bp, Artificial sequence
  Reverse Primer
ttttaaatcctaagccaaatcg

SEQ ID NO: 11523 - DNA, 20 bp, Artificial sequence
  Reverse Primer
tgctttctccatatggttcc

SEQ ID NO: 11524 - DNA, 25 bp, Artificial sequence
  Reverse Primer
aaaaaacaaaatttaccttctcagc

SEQ ID NO: 11525 - DNA, 21 bp, Artificial sequence
  Reverse Primer
aaggcaggaagcatagtgttt

SEQ ID NO: 11526 - DNA, 28 bp, Artificial sequence
  Reverse Primer
tgtattcttagccaaatgaaattaatag

SEQ ID NO: 11527 - DNA, 22 bp, Artificial sequence
  Reverse Primer
ctgtgggttgttaaagttcatg

SEQ ID NO: 11528 - DNA, 24 bp, Artificial sequence
  Reverse Primer
gagcttggtgagtttgctattatt

SEQ ID NO: 11529 - DNA, 19 bp, Artificial sequence
  Reverse Primer
aaaaaggtgatgcccaaga

SEQ ID NO: 11530 - DNA, 22 bp, Artificial sequence
  Reverse Primer
acaaacgtctgtctatcccact

SEQ ID NO: 11531 - DNA, 24 bp, Artificial sequence
  Reverse Primer
aaggcaactcatttaaaacttcaa

SEQ ID NO: 11532 - DNA, 18 bp, Artificial sequence
  Reverse Primer
tggtatgctcacgggcag

SEQ ID NO: 11533 - DNA, 23 bp, Artificial sequence
  Reverse Primer
ttcctccgtatttcrtctatcac

SEQ ID NO: 11534 - DNA, 30 bp, Artificial sequence
  Reverse Primer
attatgtaactggtattgtataggtgtctt

SEQ ID NO: 11535 - DNA, 27 bp, Artificial sequence
  Reverse Primer
ttatatgaacccagatttctatgaaac

SEQ ID NO: 11536 - DNA, 24 bp, Artificial sequence
  Reverse Primer
tttaagcaaagttgagtaacaccc

SEQ ID NO: 11537 - DNA, 26 bp, Artificial sequence
  Reverse Primer
tgtaatcagcaatttaattgtaacct

SEQ ID NO: 11538 - DNA, 20 bp, Artificial sequence
  Reverse Primer
acatttcatcccaagcagag

SEQ ID NO: 11539 - DNA, 20 bp, Artificial sequence
  Reverse Primer
tgaattcatgagrgggtgtg

SEQ ID NO: 11540 - DNA, 21 bp, Artificial sequence
  Reverse Primer
atgaagaaggaggctgttttg

SEQ ID NO: 11541 - DNA, 21 bp, Artificial sequence
  Reverse Primer
aggaccagtcaacaggatagc

SEQ ID NO: 11542 - DNA, 18 bp, Artificial sequence
  Reverse Primer
tgttcttcaccagctccc

SEQ ID NO: 11543 - DNA, 27 bp, Artificial sequence
  Reverse Primer
ttagtagcttgacttatagaatgaccc

SEQ ID NO: 11544 - DNA, 26 bp, Artificial sequence
  Reverse Primer
aagtttcatgtgttatcttgttgaag

SEQ ID NO: 11545 - DNA, 22 bp, Artificial sequence
  Reverse Primer
ttgcagtctgggaactatctct

SEQ ID NO: 11546 - DNA, 24 bp, Artificial sequence
  Reverse Primer
aaatttaagggagaaaaaaactgc

SEQ ID NO: 11547 - DNA, 24 bp, Artificial sequence
  Reverse Primer
acctcctatgaactaagagctgag

SEQ ID NO: 11548 - DNA, 18 bp, Artificial sequence
  Reverse Primer
aaccgcatgaggaacttg

SEQ ID NO: 11549 - DNA, 18 bp, Artificial sequence
  Reverse Primer
tggatcccttgagggctg

SEQ ID NO: 11550 - DNA, 19 bp, Artificial sequence
  Reverse Primer
cactgaccactgatggtgc

SEQ ID NO: 11551 - DNA, 21 bp, Artificial sequence
  Reverse Primer
ttatgtggtgtcccatcttcc

SEQ ID NO: 11552 - DNA, 21 bp, Artificial sequence
  Reverse Primer
tttcgacacttttgtgagatg

SEQ ID NO: 11553 - DNA, 24 bp, Artificial sequence
  Reverse Primer
ataattctcaggtgaattgaggaa

SEQ ID NO: 11554 - DNA, 19 bp, Artificial sequence
  Reverse Primer
tcgctctcctccacttctg

SEQ ID NO: 11555 - DNA, 28 bp, Artificial sequence
  Reverse Primer
ataattcacactgtttaacaactggtac

SEQ ID NO: 11556 - DNA, 23 bp, Artificial sequence
  Reverse Primer
aaagcataatgctaaatacccac

SEQ ID NO: 11557 - DNA, 20 bp, Artificial sequence
  Reverse Primer
agatggaagcccatattcca

SEQ ID NO: 11558 - DNA, 22 bp, Artificial sequence
  Reverse Primer
tttgagtagcaggattctcagg

SEQ ID NO: 11559 - DNA, 23 bp, Artificial sequence
  Reverse Primer
aagagtctgctgtatacaacccc

SEQ ID NO: 11560 - DNA, 20 bp, Artificial sequence
  Reverse Primer
atgtgtgtgcatttctgctg

SEQ ID NO: 11561 - DNA, 20 bp, Artificial sequence
  Reverse Primer
actgggcatatgtctgtggt

SEQ ID NO: 11562 - DNA, 18 bp, Artificial sequence
  Reverse Primer
ttcctgctgcagggctcc

SEQ ID NO: 11563 - DNA, 22 bp, Artificial sequence
  Reverse Primer
aatgaatgctggaattatcacc

SEQ ID NO: 11564 - DNA, 27 bp, Artificial sequence
  Reverse Primer
taaaaaagataaatcatggaaataccc

SEQ ID NO: 11565 - DNA, 20 bp, Artificial sequence
  Reverse Primer
aaaggcagctagtgttgctg

SEQ ID NO: 11566 - DNA, 28 bp, Artificial sequence
  Reverse Primer
atcactattaacatgtaaggttcagaga

SEQ ID NO: 11567 - DNA, 25 bp, Artificial sequence
  Reverse Primer
tttttcaggttataaaatagatggg

SEQ ID NO: 11568 - DNA, 18 bp, Artificial sequence
  Reverse Primer
accaccaccactcgcatg

SEQ ID NO: 11569 - DNA, 25 bp, Artificial sequence
  Reverse Primer
actgataattctcaggtgaattgag

SEQ ID NO: 11570 - DNA, 23 bp, Artificial sequence
  Reverse Primer
ttttttctgagaagacaaagtgg

SEQ ID NO: 11571 - DNA, 20 bp, Artificial sequence
  Reverse Primer
aagtgagcagggaaagtgaa

SEQ ID NO: 11572 - DNA, 20 bp, Artificial sequence
  Reverse Primer
aattcagaaggacgagtgcg

SEQ ID NO: 11573 - DNA, 28 bp, Artificial sequence
  Reverse Primer
taaaaggcaataattatcttcaatacac

SEQ ID NO: 11574 - DNA, 18 bp, Artificial sequence
  Reverse Primer
cctggcacaaactggctg

SEQ ID NO: 11575 - DNA, 19 bp, Artificial sequence
  Reverse Primer
attgcctctgtgacgatga

SEQ ID NO: 11576 - DNA, 22 bp, Artificial sequence
  Reverse Primer
aagcctgttaagcagaactttg

SEQ ID NO: 11577 - DNA, 18 bp, Artificial sequence
  Reverse Primer
cgctcctctcggttcctt

SEQ ID NO: 11578 - DNA, 30 bp, Artificial sequence
  Reverse Primer
agtttaaactgtattggttattaatgtgta

SEQ ID NO: 11579 - DNA, 23 bp, Artificial sequence
  Reverse Primer
aaagatgcaaggactaccaactc

SEQ ID NO: 11580 - DNA, 19 bp, Artificial sequence
  Reverse Primer
gtgctgaggggaaagaaga

SEQ ID NO: 11581 - DNA, 23 bp, Artificial sequence
  Reverse Primer
actcgcttaaggtcacagagtac

SEQ ID NO: 11582 - DNA, 18 bp, Artificial sequence
  Reverse Primer
catgggcaggaagccacc

SEQ ID NO: 11583 - DNA, 20 bp, Artificial sequence
  Reverse Primer
crgatcttgtgcttcacctt

SEQ ID NO: 11584 - DNA, 25 bp, Artificial sequence
  Reverse Primer
aatcaaagaagtgaaataaccttgc

SEQ ID NO: 11585 - DNA, 28 bp, Artificial sequence
  Reverse Primer
aataaaccacctcttaggaataaaatta

SEQ ID NO: 11586 - DNA, 18 bp, Artificial sequence
  Reverse Primer
ccagaaggcaccgtcaat

SEQ ID NO: 11587 - DNA, 24 bp, Artificial sequence
  Reverse Primer
tgaggtcagagtcagtcatactca

SEQ ID NO: 11588 - DNA, 22 bp, Artificial sequence
  Reverse Primer
aaggtgcttgttttatcacgtc

SEQ ID NO: 11589 - DNA, 18 bp, Artificial sequence
  Reverse Primer
tcctaaggcagggatgtg

SEQ ID NO: 11590 - DNA, 24 bp, Artificial sequence
  Reverse Primer
agtaaaaaggaagatcctgattca

SEQ ID NO: 11591 - DNA, 18 bp, Artificial sequence
  Reverse Primer
tacaggcaagcccaggac

SEQ ID NO: 11592 - DNA, 23 bp, Artificial sequence
  Reverse Primer
atggtattattcaatatgcccaa

SEQ ID NO: 11593 - DNA, 25 bp, Artificial sequence
  Reverse Primer
acataggtatactgatggctgattc

SEQ ID NO: 11594 - DNA, 28 bp, Artificial sequence
  Reverse Primer
agttctacaagagttttaccaattactg

SEQ ID NO: 11595 - DNA, 22 bp, Artificial sequence
  Reverse Primer
ttcccctgaagttatgattcac

SEQ ID NO: 11596 - DNA, 28 bp, Artificial sequence
  Reverse Primer
ttagatatgaaaaacgacagtgataatt

SEQ ID NO: 11597 - DNA, 23 bp, Artificial sequence
  Reverse Primer
ttatacaaagctgcctgtcaatt

SEQ ID NO: 11598 - DNA, 30 bp, Artificial sequence
  Reverse Primer
agttagtagtagtaaatctccatattgtta

SEQ ID NO: 11599 - DNA, 25 bp, Artificial sequence
  Reverse Primer
cagaaaaagattaatggaaacatca

SEQ ID NO: 11600 - DNA, 22 bp, Artificial sequence
  Reverse Primer
attcatggtattgtgcaacctc

SEQ ID NO: 11601 - DNA, 24 bp, Artificial sequence
  Reverse Primer
tattgggagtaagtttgttcttcc

SEQ ID NO: 11602 - DNA, 23 bp, Artificial sequence
  Reverse Primer
tcttttcagctcctagtgacaac

SEQ ID NO: 11603 - DNA, 30 bp, Artificial sequence
  Reverse Primer
tattaaatgagtctatatctcaggaactta

SEQ ID NO: 11604 - DNA, 23 bp, Artificial sequence
  Reverse Primer
aaaacgaagacccagtataggaa

SEQ ID NO: 11605 - DNA, 22 bp, Artificial sequence
  Reverse Primer
ccttttcacttacaactcggtc

SEQ ID NO: 11606 - DNA, 28 bp, Artificial sequence
  Reverse Primer
caactgtgttttataactctttctgaga

SEQ ID NO: 11607 - DNA, 27 bp, Artificial sequence
  Reverse Primer
cacaataggattttaatttcaatagga

SEQ ID NO: 11608 - DNA, 22 bp, Artificial sequence
  Reverse Primer
aatttcagtttgggatgatgaa

SEQ ID NO: 11609 - DNA, 25 bp, Artificial sequence
  Reverse Primer
actaagcaagttctgaaaccaatta

SEQ ID NO: 11610 - DNA, 30 bp, Artificial sequence
  Reverse Primer
ataagaagtaatatgtacaactctcagcag

SEQ ID NO: 11611 - DNA, 22 bp, Artificial sequence
  Reverse Primer
tatgtgtyagggtaggtgctct

SEQ ID NO: 11612 - DNA, 24 bp, Artificial sequence
  Reverse Primer
ttgacttttcacacctaatgatca

SEQ ID NO: 11613 - DNA, 26 bp, Artificial sequence
  Reverse Primer
aaacatagaaagaaaagttttccaag

SEQ ID NO: 11614 - DNA, 21 bp, Artificial sequence
  Reverse Primer
ggtgtgttacatccgaacaaa

SEQ ID NO: 11615 - DNA, 29 bp, Artificial sequence
  Reverse Primer
catyacatataatctatttttattgtggc

SEQ ID NO: 11616 - DNA, 27 bp, Artificial sequence
  Reverse Primer
tcacacacttcttcatatacttgagaa

SEQ ID NO: 11617 - DNA, 27 bp, Artificial sequence
  Reverse Primer
gggattgtatttataaaccattttctt

SEQ ID NO: 11618 - DNA, 23 bp, Artificial sequence
  Reverse Primer
taagctgtttgtgtgcactatgt

SEQ ID NO: 11619 - DNA, 28 bp, Artificial sequence
  Reverse Primer
taattttatttccacatttggtatactg

SEQ ID NO: 11620 - DNA, 30 bp, Artificial sequence
  Reverse Primer
taaataaggtctattcaaatctaataggta

SEQ ID NO: 11621 - DNA, 30 bp, Artificial sequence
  Reverse Primer
ttcttcatcagaatagagataataattaca

SEQ ID NO: 11622 - DNA, 26 bp, Artificial sequence
  Reverse Primer
tattcaatacttctgtctgagcaact

SEQ ID NO: 11623 - DNA, 18 bp, Artificial sequence
  Reverse Primer
tctcagtgattcggcagc

SEQ ID NO: 11624 - DNA, 25 bp, Artificial sequence
  Reverse Primer
agaaacaccatcaatgatatttttg

SEQ ID NO: 11625 - DNA, 19 bp, Artificial sequence
  Reverse Primer
actgggagggtaaggacag

SEQ ID NO: 11626 - DNA, 28 bp, Artificial sequence
  Reverse Primer
ttaggttgtactacaaagwaattcaggt

SEQ ID NO: 11627 - DNA, 25 bp, Artificial sequence
  Reverse Primer
aaaataaactccatgttgagatgtc

SEQ ID NO: 11628 - DNA, 21 bp, Artificial sequence
  Reverse Primer
tacacttcctttttgaccctg

SEQ ID NO: 11629 - DNA, 28 bp, Artificial sequence
  Reverse Primer
aagttcagtttgaggtactattacactg

SEQ ID NO: 11630 - DNA, 27 bp, Artificial sequence
  Reverse Primer
aactggtatatttaaccaaaatgaaga

SEQ ID NO: 11631 - DNA, 21 bp, Artificial sequence
  Reverse Primer
gtccctrtctgagtcctgtcc

SEQ ID NO: 11632 - DNA, 25 bp, Artificial sequence
  Reverse Primer
tagatcactttccctacacatcttt

SEQ ID NO: 11633 - DNA, 18 bp, Artificial sequence
  Reverse Primer
actggggctcagtggtca

SEQ ID NO: 11634 - DNA, 25 bp, Artificial sequence
  Reverse Primer
attakagatctgaacagctaatgca

SEQ ID NO: 11635 - DNA, 30 bp, Artificial sequence
  Reverse Primer
taagtagttagacagtttaagaagtgaaaa

SEQ ID NO: 11636 - DNA, 21 bp, Artificial sequence
  Reverse Primer
ttaatgaccagaagaaaggca

SEQ ID NO: 11637 - DNA, 22 bp, Artificial sequence
  Reverse Primer
ggtttcctggtgcatataaaag

SEQ ID NO: 11638 - DNA, 25 bp, Artificial sequence
  Reverse Primer
atattatctgacatatagccccctt

SEQ ID NO: 11639 - DNA, 30 bp, Artificial sequence
  Reverse Primer
catattcttttagagtatttttaggtttac

SEQ ID NO: 11640 - DNA, 28 bp, Artificial sequence
  Reverse Primer
ttaaatatcagacaaaattacattctgc

SEQ ID NO: 11641 - DNA, 26 bp, Artificial sequence
  Reverse Primer
ccatattacagatgaaaaaagttgag

SEQ ID NO: 11642 - DNA, 22 bp, Artificial sequence
  Reverse Primer
taagagcttggctgtacagagc

SEQ ID NO: 11643 - DNA, 27 bp, Artificial sequence
  Reverse Primer
aaagtagaataagatcatccacagttc

SEQ ID NO: 11644 - DNA, 19 bp, Artificial sequence
  Reverse Primer
gcttctgttgcagagcaca

SEQ ID NO: 11645 - DNA, 20 bp, Artificial sequence
  Reverse Primer
ttgaatgcatatccactggg

SEQ ID NO: 11646 - DNA, 22 bp, Artificial sequence
  Reverse Primer
taacccacaaaccctgtaagac

SEQ ID NO: 11647 - DNA, 24 bp, Artificial sequence
  Reverse Primer
tttaacaactggtacagcattgac

SEQ ID NO: 11648 - DNA, 18 bp, Artificial sequence
  Reverse Primer
tgccctgttgctctttgg

SEQ ID NO: 11649 - DNA, 23 bp, Artificial sequence
  Reverse Primer
agactctgaaggatgagtaaggg

SEQ ID NO: 11650 - DNA, 21 bp, Artificial sequence
  Reverse Primer
ttgttcatcccttgactgatc

SEQ ID NO: 11651 - DNA, 23 bp, Artificial sequence
  Reverse Primer
tatttctgcacttgggttagtcc

SEQ ID NO: 11652 - DNA, 25 bp, Artificial sequence
  Reverse Primer
ttttctccctttgttcttttctact

SEQ ID NO: 11653 - DNA, 18 bp, Artificial sequence
  Reverse Primer
taaacactggggagccga

SEQ ID NO: 11654 - DNA, 21 bp, Artificial sequence
  Reverse Primer
caatcagaggacactatgccc

SEQ ID NO: 11655 - DNA, 23 bp, Artificial sequence
  Reverse Primer
agcatcttcttagaagctttgga

SEQ ID NO: 11656 - DNA, 18 bp, Artificial sequence
  Reverse Primer
tggagmaayccccgctca

SEQ ID NO: 11657 - DNA, 22 bp, Artificial sequence
  Reverse Primer
agttcatrgggtcacaaagaca

SEQ ID NO: 11658 - DNA, 29 bp, Artificial sequence
  Reverse Primer
attattaaggttaagactgtaaggatgaa

SEQ ID NO: 11659 - DNA, 20 bp, Artificial sequence
  Reverse Primer
atcagattcacctgttgctg

SEQ ID NO: 11660 - DNA, 19 bp, Artificial sequence
  Reverse Primer
acttcagcctggcctaaca

SEQ ID NO: 11661 - DNA, 21 bp, Artificial sequence
  Reverse Primer
tgttctagcactcagttcgga

SEQ ID NO: 11662 - DNA, 22 bp, Artificial sequence
  Reverse Primer
taacaccagcatcattagctcc

SEQ ID NO: 11663 - DNA, 23 bp, Artificial sequence
  Reverse Primer
aaacttgaaatacttagggcagg

SEQ ID NO: 11664 - DNA, 21 bp, Artificial sequence
  Reverse Primer
gcaggcatatgctctgagtaa

SEQ ID NO: 11665 - DNA, 22 bp, Artificial sequence
  Reverse Primer
atacatctcatcatctggggat

SEQ ID NO: 11666 - DNA, 20 bp, Artificial sequence
  Reverse Primer
ttaactccacatcccacaca

SEQ ID NO: 11667 - DNA, 25 bp, Artificial sequence
  Reverse Primer
tccccatacataaatttaacatgat

SEQ ID NO: 11668 - DNA, 23 bp, Artificial sequence
  Reverse Primer
ctgatgctatggrctgaattatg

SEQ ID NO: 11669 - DNA, 21 bp, Artificial sequence
  Reverse Primer
tcagagagggtaaatggcttt

SEQ ID NO: 11670 - DNA, 18 bp, Artificial sequence
  Reverse Primer
gctgaaacagctggggtt

SEQ ID NO: 11671 - DNA, 21 bp, Artificial sequence
  Reverse Primer
ttactctgctgctatggcatc

SEQ ID NO: 11672 - DNA, 22 bp, Artificial sequence
  Reverse Primer
tccactcaggtagaccctaaag

SEQ ID NO: 11673 - DNA, 20 bp, Artificial sequence
  Reverse Primer
tggtccagctaatttcctcc

SEQ ID NO: 11674 - DNA, 20 bp, Artificial sequence
  Reverse Primer
attccaggtttggacattgg

SEQ ID NO: 11675 - DNA, 27 bp, Artificial sequence
  Reverse Primer
aagaatttattaggacaagaatggttc

SEQ ID NO: 11676 - DNA, 22 bp, Artificial sequence
  Reverse Primer
tttctcttgtcccttttcttcc

SEQ ID NO: 11677 - DNA, 22 bp, Artificial sequence
  Reverse Primer
taatccattaccaaggcctact

SEQ ID NO: 11678 - DNA, 22 bp, Artificial sequence
  Reverse Primer
aacttgacagtaaccgttcgtc

SEQ ID NO: 11679 - DNA, 22 bp, Artificial sequence
  Reverse Primer
atgagctgtgtgaccttatgtg

SEQ ID NO: 11680 - DNA, 23 bp, Artificial sequence
  Reverse Primer
aaaatcaaaccatgtaactccct

SEQ ID NO: 11681 - DNA, 27 bp, Artificial sequence
  Reverse Primer
ttattcatttagcaaacacttactgag

SEQ ID NO: 11682 - DNA, 19 bp, Artificial sequence
  Reverse Primer
tgtgggatgttaagtgccc

SEQ ID NO: 11683 - DNA, 19 bp, Artificial sequence
  Reverse Primer
tggcatgtggcagatttac

SEQ ID NO: 11684 - DNA, 18 bp, Artificial sequence
  Reverse Primer
ttcccaggcagccacagg

SEQ ID NO: 11685 - DNA, 18 bp, Artificial sequence
  Reverse Primer
tagttgcaacgagtgggg

SEQ ID NO: 11686 - DNA, 22 bp, Artificial sequence
  Reverse Primer
tgtttaagtgaatagcagggct

SEQ ID NO: 11687 - DNA, 24 bp, Artificial sequence
  Reverse Primer
taagttgtakccaactcttttgca

SEQ ID NO: 11688 - DNA, 21 bp, Artificial sequence
  Reverse Primer
tgaataataccagcagctcca

SEQ ID NO: 11689 - DNA, 22 bp, Artificial sequence
  Reverse Primer
cctgtgagacactcacatgttc

SEQ ID NO: 11690 - DNA, 20 bp, Artificial sequence
  Reverse Primer
aaacaccaaaatgttcaccg

SEQ ID NO: 11691 - DNA, 27 bp, Artificial sequence
  Reverse Primer
attaaaatggaatttcctaatgtgtag

SEQ ID NO: 11692 - DNA, 21 bp, Artificial sequence
  Reverse Primer
ttccaaaactacgctgaaaga

SEQ ID NO: 11693 - DNA, 25 bp, Artificial sequence
  Reverse Primer
ttctttcctttcttctaatgcttct

SEQ ID NO: 11694 - DNA, 24 bp, Artificial sequence
  Reverse Primer
tttcaaattggatctggaaataat

SEQ ID NO: 11695 - DNA, 24 bp, Artificial sequence
  Reverse Primer
taatgaaacgaaacaacacaaaac

SEQ ID NO: 11696 - DNA, 27 bp, Artificial sequence
  Reverse Primer
ttctttaagagaaatgtgaatacctca

SEQ ID NO: 11697 - DNA, 22 bp, Artificial sequence
  Reverse Primer
tttttctagctctttcaaggca

SEQ ID NO: 11698 - DNA, 29 bp, Artificial sequence
  Reverse Primer
atatcttaatagaagtttcttgtctgtgc

SEQ ID NO: 11699 - DNA, 18 bp, Artificial sequence
  Reverse Primer
ccctggctcccatgacag

SEQ ID NO: 11700 - DNA, 30 bp, Artificial sequence
  Reverse Primer
gtaatacatggctatacattttttaatgag

SEQ ID NO: 11701 - DNA, 26 bp, Artificial sequence
  Reverse Primer
aaatatcctttggtcttctctttacc

SEQ ID NO: 11702 - DNA, 25 bp, Artificial sequence
  Reverse Primer
ttaatgtatgcaggttgttaggatt

SEQ ID NO: 11703 - DNA, 22 bp, Artificial sequence
  Reverse Primer
cagagagagacacatgtaaggg

SEQ ID NO: 11704 - DNA, 28 bp, Artificial sequence
  Reverse Primer
agtgtcattgacctgaaaagactatata

SEQ ID NO: 11705 - DNA, 27 bp, Artificial sequence
  Reverse Primer
tacaacactgtattctttcctgttaca

SEQ ID NO: 11706 - DNA, 28 bp, Artificial sequence
  Reverse Primer
aaaaaaccttagtgattaattctcatgt

SEQ ID NO: 11707 - DNA, 29 bp, Artificial sequence
  Reverse Primer
agaatgatctttctaaaatgtagatctga

SEQ ID NO: 11708 - DNA, 27 bp, Artificial sequence
  Reverse Primer
atgtccatgtgaaagtatatcaaaatt

SEQ ID NO: 11709 - DNA, 21 bp, Artificial sequence
  Reverse Primer
ttttgaaatgggaaattgtgg

SEQ ID NO: 11710 - DNA, 23 bp, Artificial sequence
  Reverse Primer
tagtcatggttggattttcattc

SEQ ID NO: 11711 - DNA, 24 bp, Artificial sequence
  Reverse Primer
aaatggtgctattaccttaaccac

SEQ ID NO: 11712 - DNA, 18 bp, Artificial sequence
  Reverse Primer
tggggagaatyacaggca

SEQ ID NO: 11713 - DNA, 22 bp, Artificial sequence
  Reverse Primer
acaagatagaagcagaggctga

SEQ ID NO: 11714 - DNA, 25 bp, Artificial sequence
  Reverse Primer
taatatgtacaactctcagcagcat

SEQ ID NO: 11715 - DNA, 23 bp, Artificial sequence
  Reverse Primer
ttagactttctctttsctcgtgg

SEQ ID NO: 11716 - DNA, 29 bp, Artificial sequence
  Reverse Primer
gtatacatgtatcatttacctgttctctc

SEQ ID NO: 11717 - DNA, 26 bp, Artificial sequence
  Reverse Primer
gcattaattcagtgtttattgaatcc

SEQ ID NO: 11718 - DNA, 26 bp, Artificial sequence
  Reverse Primer
atatgctctgagtaagggaactagat

SEQ ID NO: 11719 - DNA, 23 bp, Artificial sequence
  Reverse Primer
gatcagcagataattatggagca

SEQ ID NO: 11720 - DNA, 25 bp, Artificial sequence
  Reverse Primer
attggtcttagaaatacttggacac

SEQ ID NO: 11721 - DNA, 28 bp, Artificial sequence
  Reverse Primer
ttctcttacattcttataactcactccc

SEQ ID NO: 11722 - DNA, 25 bp, Artificial sequence
  Reverse Primer
agcatttctgatctaattcaaaact

SEQ ID NO: 11723 - DNA, 22 bp, Artificial sequence
  Reverse Primer
actcctcagctcatcaggtaaa

SEQ ID NO: 11724 - DNA, 24 bp, Artificial sequence
  Reverse Primer
atttgggtagtcttgttctcattt

SEQ ID NO: 11725 - DNA, 24 bp, Artificial sequence
  Reverse Primer
aaggcaactcatttaaaacttcaa

SEQ ID NO: 11726 - DNA, 26 bp, Artificial sequence
  Reverse Primer
agtctcattctgtagaagtacaggtg

SEQ ID NO: 11727 - DNA, 27 bp, Artificial sequence
  Reverse Primer
tatcaaataatgctgacctactatcaa

SEQ ID NO: 11728 - DNA, 21 bp, Artificial sequence
  Reverse Primer
agtgtgagaggcactgactga

SEQ ID NO: 11729 - DNA, 24 bp, Artificial sequence
  Reverse Primer
agcratttatgcatatttgattca

SEQ ID NO: 11730 - DNA, 20 bp, Artificial sequence
  Reverse Primer
tttgttggtctatcctgggc

SEQ ID NO: 11731 - DNA, 28 bp, Artificial sequence
  Reverse Primer
tttaaaaaactcaaaaatgtagtgctac

SEQ ID NO: 11732 - DNA, 27 bp, Artificial sequence
  Reverse Primer
ttagaggaaaatattaaagacgtaacg

SEQ ID NO: 11733 - DNA, 24 bp, Artificial sequence
  Reverse Primer
attactccttaggatgtggtcaaa

SEQ ID NO: 11734 - DNA, 29 bp, Artificial sequence
  Reverse Primer
agtatttatttagcatttacaggaaagtg

SEQ ID NO: 11735 - DNA, 26 bp, Artificial sequence
  Reverse Primer
ataaggatccaagcaatcacttatat

SEQ ID NO: 11736 - DNA, 27 bp, Artificial sequence
  Reverse Primer
tagggaatgttctaatttcatttttac

SEQ ID NO: 11737 - DNA, 28 bp, Artificial sequence
  Reverse Primer
tgactaatttcttcataatgatttcttc

SEQ ID NO: 11738 - DNA, 21 bp, Artificial sequence
  Reverse Primer
atggaagcaacctaaataccc

SEQ ID NO: 11739 - DNA, 24 bp, Artificial sequence
  Reverse Primer
taaaaattrttttccctcaaagga

SEQ ID NO: 11740 - DNA, 20 bp, Artificial sequence
  Reverse Primer
attattgcttcygaatggca

SEQ ID NO: 11741 - DNA, 18 bp, Artificial sequence
  Reverse Primer
tgctgccaccctcctgca

SEQ ID NO: 11742 - DNA, 22 bp, Artificial sequence
  Reverse Primer
agatagaggtgactgcagagct

SEQ ID NO: 11743 - DNA, 19 bp, Artificial sequence
  Reverse Primer
ttggtgagaccacagatgc

SEQ ID NO: 11744 - DNA, 23 bp, Artificial sequence
  Reverse Primer
taagaagcttcgtctaatgcaca

SEQ ID NO: 11745 - DNA, 24 bp, Artificial sequence
  Reverse Primer
aaatatacctgaatcagctggact

SEQ ID NO: 11746 - DNA, 24 bp, Artificial sequence
  Reverse Primer
acttagcattacagaacccaatca

SEQ ID NO: 11747 - DNA, 19 bp, Artificial sequence
  Reverse Primer
tgaaggtgtacggatgcag

SEQ ID NO: 11748 - DNA, 20 bp, Artificial sequence
  Reverse Primer
ttcctactgctgctgctttc

SEQ ID NO: 11749 - DNA, 22 bp, Artificial sequence
  Reverse Primer
aaaagactgttttgaatggagg

SEQ ID NO: 11750 - DNA, 21 bp, Artificial sequence
  Reverse Primer
tttatgacaggccacagtttg

SEQ ID NO: 11751 - DNA, 20 bp, Artificial sequence
  Reverse Primer
ttaaagatcagcccacattg

SEQ ID NO: 11752 - DNA, 20 bp, Artificial sequence
  Reverse Primer
agtgaccaaaatgtgccttg

SEQ ID NO: 11753 - DNA, 19 bp, Artificial sequence
  Reverse Primer
aggacttyagcagcgatga

SEQ ID NO: 11754 - DNA, 21 bp, Artificial sequence
  Reverse Primer
tgacgtacactttgtccctgt

SEQ ID NO: 11755 - DNA, 22 bp, Artificial sequence
  Reverse Primer
atgtttggtctcaagtatccca

SEQ ID NO: 11756 - DNA, 22 bp, Artificial sequence
  Reverse Primer
atacaggggaggagataggttc

SEQ ID NO: 11757 - DNA, 20 bp, Artificial sequence
  Reverse Primer
acgagcattcctttctctca

SEQ ID NO: 11758 - DNA, 22 bp, Artificial sequence
  Reverse Primer
agttttgttccccctatcttgt

SEQ ID NO: 11759 - DNA, 21 bp, Artificial sequence
  Reverse Primer
tgccctgtgagttagagatcc

SEQ ID NO: 11760 - DNA, 18 bp, Artificial sequence
  Reverse Primer
aagaacagccctcgcttc

SEQ ID NO: 11761 - DNA, 18 bp, Artificial sequence
  Reverse Primer
gatttgaggagctgggct

SEQ ID NO: 11762 - DNA, 24 bp, Artificial sequence
  Reverse Primer
aggtaacagagtacaagcacacag

SEQ ID NO: 11763 - DNA, 18 bp, Artificial sequence
  Reverse Primer
tagagagcagccagcctg

SEQ ID NO: 11764 - DNA, 18 bp, Artificial sequence
  Reverse Primer
tttgcctggcaccaaaac

SEQ ID NO: 11765 - DNA, 21 bp, Artificial sequence
  Reverse Primer
atttatggcatccacgagtag

SEQ ID NO: 11766 - DNA, 22 bp, Artificial sequence
  Reverse Primer
ataggaggtcacgtgataccag

SEQ ID NO: 11767 - DNA, 18 bp, Artificial sequence
  Reverse Primer
ggcgattcccctactttg

SEQ ID NO: 11768 - DNA, 25 bp, Artificial sequence
  Reverse Primer
taataatgagactctcaggaaaggg

SEQ ID NO: 11769 - DNA, 24 bp, Artificial sequence
  Reverse Primer
aaaaaaagaagtgatctgagctct

SEQ ID NO: 11770 - DNA, 24 bp, Artificial sequence
  Reverse Primer
attttagtgttgaatggaatgctt

SEQ ID NO: 11771 - DNA, 21 bp, Artificial sequence
  Reverse Primer
aaaattctatgaagccagcag

SEQ ID NO: 11772 - DNA, 18 bp, Artificial sequence
  Reverse Primer
ccaagagcagacgacatg

SEQ ID NO: 11773 - DNA, 22 bp, Artificial sequence
  Reverse Primer
ttttcagataaggaaagggaag

SEQ ID NO: 11774 - DNA, 22 bp, Artificial sequence
  Reverse Primer
caaataaagctctcctgactcg

SEQ ID NO: 11775 - DNA, 20 bp, Artificial sequence
  Reverse Primer
aactgagccaaagggaaaac

SEQ ID NO: 11776 - DNA, 26 bp, Artificial sequence
  Reverse Primer
atttcattttatttattgactgcctc

SEQ ID NO: 11777 - DNA, 19 bp, Artificial sequence
  Reverse Primer
ttttctctgggaggtcagc

SEQ ID NO: 11778 - DNA, 20 bp, Artificial sequence
  Reverse Primer
tatcaaatcccaaagtccca

SEQ ID NO: 11779 - DNA, 18 bp, Artificial sequence
  Reverse Primer
tctgcccttcctccattc

SEQ ID NO: 11780 - DNA, 19 bp, Artificial sequence
  Reverse Primer
ccatagcygggaagaaatt

SEQ ID NO: 11781 - DNA, 23 bp, Artificial sequence
  Reverse Primer
ttagtgggagacatttttgtttc

SEQ ID NO: 11782 - DNA, 27 bp, Artificial sequence
  Reverse Primer
tgcctcagattacacatctaagtataa

SEQ ID NO: 11783 - DNA, 23 bp, Artificial sequence
  Reverse Primer
aattccttgaaatttccttttga

SEQ ID NO: 11784 - DNA, 28 bp, Artificial sequence
  Reverse Primer
agggaactctataaatatttgtgttttt

SEQ ID NO: 11785 - DNA, 25 bp, Artificial sequence
  Reverse Primer
aactatcttcaattgcttctcaatg

SEQ ID NO: 11786 - DNA, 25 bp, Artificial sequence
  Reverse Primer
aaataaaagaacaagatgaagcctc

SEQ ID NO: 11787 - DNA, 19 bp, Artificial sequence
  Reverse Primer
aaaaatcagtggctagggc

SEQ ID NO: 11788 - DNA, 28 bp, Artificial sequence
  Reverse Primer
agacatcacatagaagaaggattaaatt

SEQ ID NO: 11789 - DNA, 18 bp, Artificial sequence
  Reverse Primer
aaccacttcccctcctgc

SEQ ID NO: 11790 - DNA, 22 bp, Artificial sequence
  Reverse Primer
cgaagccataatttctgatttt

SEQ ID NO: 11791 - DNA, 30 bp, Artificial sequence
  Reverse Primer
gaatctttacatgttaacatactttttaac

SEQ ID NO: 11792 - DNA, 19 bp, Artificial sequence
  Reverse Primer
tggaagcagggcaaatatt

SEQ ID NO: 11793 - DNA, 24 bp, Artificial sequence
  Reverse Primer
actgcttctgtggtttttacttct

SEQ ID NO: 11794 - DNA, 24 bp, Artificial sequence
  Reverse Primer
tttactacattaaaatggccacct

SEQ ID NO: 11795 - DNA, 29 bp, Artificial sequence
  Reverse Primer
ttaactagttcagtaacatgacagattca

SEQ ID NO: 11796 - DNA, 22 bp, Artificial sequence
  Reverse Primer
atttgccaaaggagtatgaaga

SEQ ID NO: 11797 - DNA, 29 bp, Artificial sequence
  Reverse Primer
ttaactagttcagtaacatgacagattca

SEQ ID NO: 11798 - DNA, 30 bp, Artificial sequence
  Reverse Primer
cctactactatctatgtacaactggtttgt

SEQ ID NO: 11799 - DNA, 25 bp, Artificial sequence
  Reverse Primer
atttttcaaaaacctaaaacacagg

SEQ ID NO: 11800 - DNA, 26 bp, Artificial sequence
  Reverse Primer
atccctgatattctatttttttatgg

SEQ ID NO: 11801 - DNA, 25 bp, Artificial sequence
  Reverse Primer
tgggaataagtttggtgattataaa

SEQ ID NO: 11802 - DNA, 23 bp, Artificial sequence
  Reverse Primer
tctagaatcagccactgacattt

SEQ ID NO: 11803 - DNA, 25 bp, Artificial sequence
  Reverse Primer
attcttaaagttatgggccttctag

SEQ ID NO: 11804 - DNA, 20 bp, Artificial sequence
  Reverse Primer
atttcattaggcccttgagc

SEQ ID NO: 11805 - DNA, 30 bp, Artificial sequence
  Reverse Primer
tactttgatatttacaacatctacaactga

SEQ ID NO: 11806 - DNA, 19 bp, Artificial sequence
  Reverse Primer
tatgaacacaggggtgcat

SEQ ID NO: 11807 - DNA, 25 bp, Artificial sequence
  Reverse Primer
tgtaaagttcttcaawtttttcctc

SEQ ID NO: 11808 - DNA, 25 bp, Artificial sequence
  Reverse Primer
atataagtgctgttttgccttacaa

SEQ ID NO: 11809 - DNA, 25 bp, Artificial sequence
  Reverse Primer
taaagtgttgacaaaaactcctctg

SEQ ID NO: 11810 - DNA, 23 bp, Artificial sequence
  Reverse Primer
tataaaaccccggagattcttag

SEQ ID NO: 11811 - DNA, 25 bp, Artificial sequence
  Reverse Primer
tttaactaaaaggccaataatgacc

SEQ ID NO: 11812 - DNA, 21 bp, Artificial sequence
  Reverse Primer
tatgattgaggtggttccaag

SEQ ID NO: 11813 - DNA, 19 bp, Artificial sequence
  Reverse Primer
ttctgaagccagggagatt

SEQ ID NO: 11814 - DNA, 24 bp, Artificial sequence
  Reverse Primer
atagagggcaataaagtgactcag

SEQ ID NO: 11815 - DNA, 18 bp, Artificial sequence
  Reverse Primer
ccgataggaggtccgaca

SEQ ID NO: 11816 - DNA, 24 bp, Artificial sequence
  Reverse Primer
gatctgtgtgatgaactwagcatg

SEQ ID NO: 11817 - DNA, 19 bp, Artificial sequence
  Reverse Primer
atctgtccctctcgtccag

SEQ ID NO: 11818 - DNA, 27 bp, Artificial sequence
  Reverse Primer
ccgatctaaattttacagtataagcaa

SEQ ID NO: 11819 - DNA, 23 bp, Artificial sequence
  Reverse Primer
tggtgtcaggataagttggttat

SEQ ID NO: 11820 - DNA, 28 bp, Artificial sequence
  Reverse Primer
ttaaagcaatagttttctatctgtgttt

SEQ ID NO: 11821 - DNA, 24 bp, Artificial sequence
  Reverse Primer
tccaaatgataaaaagaatgtgtg

SEQ ID NO: 11822 - DNA, 24 bp, Artificial sequence
  Reverse Primer
acactgtatttgagaaaacatccg

SEQ ID NO: 11823 - DNA, 27 bp, Artificial sequence
  Reverse Primer
tttttctagattccacatataagcatt

SEQ ID NO: 11824 - DNA, 23 bp, Artificial sequence
  Reverse Primer
atgatgcactatttactgggtga

SEQ ID NO: 11825 - DNA, 18 bp, Artificial sequence
  Reverse Primer
ttggacaatccccaatca

SEQ ID NO: 11826 - DNA, 25 bp, Artificial sequence
  Reverse Primer
ttgttcaatatcttgaaactctggt

SEQ ID NO: 11827 - DNA, 27 bp, Artificial sequence
  Reverse Primer
aatttcctaagtactgagtgtggtaca

SEQ ID NO: 11828 - DNA, 22 bp, Artificial sequence
  Reverse Primer
aaaaataaatgcaaagcgattg

SEQ ID NO: 11829 - DNA, 22 bp, Artificial sequence
  Reverse Primer
aatcattctggttaatgtgcct

SEQ ID NO: 11830 - DNA, 30 bp, Artificial sequence; identical to SEQ ID NO: 11791
  Reverse Primer

SEQ ID NO: 11831 - DNA, 22 bp, Artificial sequence
  Reverse Primer
tatttcatggttctgttttggg

SEQ ID NO: 11832 - DNA, 20 bp, Artificial sequence
  Reverse Primer
tgcgtatttggtgaatcagt

SEQ ID NO: 11833 - DNA, 26 bp, Artificial sequence
  Reverse Primer
aatccatagatcaatcaaaggagtac

SEQ ID NO: 11834 - DNA, 26 bp, Artificial sequence
  Reverse Primer
taaagtgaaagtgttttgttgttgtt

SEQ ID NO: 11835 - DNA, 18 bp, Artificial sequence
  Reverse Primer
ttcctgagtgatgctgcc

SEQ ID NO: 11836 - DNA, 18 bp, Artificial sequence
  Reverse Primer
atgcgatygccttcccat

SEQ ID NO: 11837 - DNA, 18 bp, Artificial sequence
  Reverse Primer
attcctgggacgtggtga

SEQ ID NO: 11838 - DNA, 22 bp, Artificial sequence
  Reverse Primer
aaatcaaagagagatgacgctg

SEQ ID NO: 11839 - DNA, 26 bp, Artificial sequence
  Reverse Primer
agatagtaactactagccacctgtgg

SEQ ID NO: 11840 - DNA, 20 bp, Artificial sequence
  Reverse Primer
attctgatgctatggggatg

SEQ ID NO: 11841 - DNA, 30 bp, Artificial sequence
  Reverse Primer
atatacatattctttttcacattcttctcc

SEQ ID NO: 11842 - DNA, 22 bp, Artificial sequence
  Reverse Primer
ccttcatcacttttccctattg

SEQ ID NO: 11843 - DNA, 24 bp, Artificial sequence
  Reverse Primer
aataagcttgaaggaagaaacctt

SEQ ID NO: 11844 - DNA, 29 bp, Artificial sequence
  Reverse Primer
aaaataatcctctagaaaggatgactagt

SEQ ID NO: 11845 - DNA, 23 bp, Artificial sequence
  Reverse Primer
taggtatcagattacctggatgg

SEQ ID NO: 11846 - DNA, 18 bp, Artificial sequence
  Reverse Primer
agattggagagggcacgt

SEQ ID NO: 11847 - DNA, 28 bp, Artificial sequence
  Reverse Primer
ttctctttgttctgatctagagtacatg

SEQ ID NO: 11848 - DNA, 18 bp, Artificial sequence
  Reverse Primer
agcaagcctgccrtggtc

SEQ ID NO: 11849 - DNA, 23 bp, Artificial sequence
  Reverse Primer
atgaataaaaacctcatcttccc

SEQ ID NO: 11850 - DNA, 19 bp, Artificial sequence
  Reverse Primer
agggccttggaataaacct

SEQ ID NO: 11851 - DNA, 22 bp, Artificial sequence
  Reverse Primer
atccagtaagactccatgctcc

SEQ ID NO: 11852 - DNA, 20 bp, Artificial sequence
  Reverse Primer
taaggttttgaggttcacgg

SEQ ID NO: 11853 - DNA, 20 bp, Artificial sequence
  Reverse Primer
attccaggtttggacattgg

SEQ ID NO: 11854 - DNA, 21 bp, Artificial sequence
  Reverse Primer
aaatccatgacttctgcaaaa

SEQ ID NO: 11855 - DNA, 24 bp, Artificial sequence
  Reverse Primer
aaacaggaaacaaattctctaagc

SEQ ID NO: 11856 - DNA, 22 bp, Artificial sequence
  Reverse Primer
ttagagatcctgggaactaggg

SEQ ID NO: 11857 - DNA, 20 bp, Artificial sequence
  Reverse Primer
agtggtggctttcttttcag

SEQ ID NO: 11858 - DNA, 19 bp, Artificial sequence
  Reverse Primer
aacaacctggggtaccatc

SEQ ID NO: 11859 - DNA, 19 bp, Artificial sequence
  Reverse Primer
ttccagcactccacagaca

SEQ ID NO: 11860 - DNA, 19 bp, Artificial sequence
  Reverse Primer
atttgccaggctctctgtg

SEQ ID NO: 11861 - DNA, 28 bp, Artificial sequence
  Reverse Primer
agtatattcagaccttctctgtctgttt

SEQ ID NO: 11862 - DNA, 20 bp, Artificial sequence
  Reverse Primer
atgaagctctactgccatcc

SEQ ID NO: 11863 - DNA, 21 bp, Artificial sequence
  Reverse Primer
ttaagatccaacaaccacagg

SEQ ID NO: 11864 - DNA, 22 bp, Artificial sequence
  Reverse Primer
ttaggctttgaggaatctcttc

SEQ ID NO: 11865 - DNA, 18 bp, Artificial sequence
  Reverse Primer
ctgagctggcccttcatt

SEQ ID NO: 11866 - DNA, 25 bp, Artificial sequence
  Reverse Primer
ttctacaaatgtcccaaagattatg

SEQ ID NO: 11867 - DNA, 27 bp, Artificial sequence
  Reverse Primer
aacacagtaagtggtaaagaatactgc

SEQ ID NO: 11868 - DNA, 21 bp, Artificial sequence
  Reverse Primer
ttggaaaccattgtcattttg

SEQ ID NO: 11869 - DNA, 21 bp, Artificial sequence
  Reverse Primer
attcctgacctgaaggatgtc

SEQ ID NO: 11870 - DNA, 20 bp, Artificial sequence
  Reverse Primer
atcctagtcagcaggaagcc

SEQ ID NO: 11871 - DNA, 24 bp, Artificial sequence
  Reverse Primer
tagacatttcccagataaagacag

SEQ ID NO: 11872 - DNA, 29 bp, Artificial sequence
  Reverse Primer
aaataattcatagagaccttgtacttgag

SEQ ID NO: 11873 - DNA, 23 bp, Artificial sequence
  Reverse Primer
tgtgaactgagttgtttcacact

SEQ ID NO: 11874 - DNA, 19 bp, Artificial sequence
  Reverse Primer
tgagctgagtgagctgtgg

SEQ ID NO: 11875 - DNA, 23 bp, Artificial sequence
  Reverse Primer
ttaaatttagtcttttgggcaca

SEQ ID NO: 11876 - DNA, 29 bp, Artificial sequence
  Reverse Primer
aacattgactawtatarcactgagttctg

SEQ ID NO: 11877 - DNA, 26 bp, Artificial sequence
  Reverse Primer
tataccacgtcacatgtaatgtaaga

SEQ ID NO: 11878 - DNA, 19 bp, Artificial sequence
  Reverse Primer
catgtgccaaaacgaagac

SEQ ID NO: 11879 - DNA, 20 bp, Artificial sequence
  Reverse Primer
tcatctttgggttcctgtca

SEQ ID NO: 11880 - DNA, 25 bp, Artificial sequence
  Reverse Primer
atattttgcaagttgaatgtctagc

SEQ ID NO: 11881 - DNA, 28 bp, Artificial sequence
  Reverse Primer
ttagagatcatacccttttgactagatt

SEQ ID NO: 11882 - DNA, 25 bp, Artificial sequence
  Reverse Primer
agttatcttacctgaacaatggttg

SEQ ID NO: 11883 - DNA, 21 bp, Artificial sequence
  Reverse Primer
aactgtacacaagccacctga

SEQ ID NO: 11884 - DNA, 26 bp, Artificial sequence
  Reverse Primer
aagtaatggctgttctctcaaatatt

SEQ ID NO: 11885 - DNA, 22 bp, Artificial sequence
  Reverse Primer
aaaattttatgtggggacaatc

SEQ ID NO: 11886 - DNA, 27 bp, Artificial sequence
  Reverse Primer
tactaacagtcatttaaaaccacagtg

SEQ ID NO: 11887 - DNA, 27 bp, Artificial sequence
  Reverse Primer
acagagcaattacttttcaacttagaa

SEQ ID NO: 11888 - DNA, 18 bp, Artificial sequence
  Reverse Primer
cagctgagtttcccatgc

SEQ ID NO: 11889 - DNA, 22 bp, Artificial sequence
  Reverse Primer
ttcaaccacagaacctcttttt

SEQ ID NO: 11890 - DNA, 21 bp, Artificial sequence
  Reverse Primer
tttgtgatatgaaggcatgag

SEQ ID NO: 11891 - DNA, 23 bp, Artificial sequence
  Reverse Primer
agtataagggatttcttcaggga

SEQ ID NO: 11892 - DNA, 23 bp, Artificial sequence
  Reverse Primer
tagatggcaattgagaaatgatg

SEQ ID NO: 11893 - DNA, 22 bp, Artificial sequence
  Reverse Primer
aaaaatcctgcagtgaataacg

SEQ ID NO: 11894 - DNA, 25 bp, Artificial sequence
  Reverse Primer
gatccctgattttcaaagaatttat

SEQ ID NO: 11895 - DNA, 22 bp, Artificial sequence
  Reverse Primer
tcacttaatttgacaggaaggg

SEQ ID NO: 11896 - DNA, 24 bp, Artificial sequence
  Reverse Primer
aagaagaacagttccaaactcaaa

SEQ ID NO: 11897 - DNA, 22 bp, Artificial sequence
  Reverse Primer
attgactcctgacctttgatca

SEQ ID NO: 11898 - DNA, 21 bp, Artificial sequence
  Reverse Primer
agattagcacttgcgatgagc

SEQ ID NO: 11899 - DNA, 23 bp, Artificial sequence
  Reverse Primer
tcaaatatttcttccttttccca

SEQ ID NO: 11900 - DNA, 26 bp, Artificial sequence
  Reverse Primer
taaggcttacaaaagaaacagttaca

SEQ ID NO: 11901 - DNA, 20 bp, Artificial sequence
  Reverse Primer
agggagacactgcaaaagag

SEQ ID NO: 11902 - DNA, 21 bp, Artificial sequence
  Reverse Primer
ccaagtcttcactcccatgta

SEQ ID NO: 11903 - DNA, 22 bp, Artificial sequence
  Reverse Primer
tatagacgcagaggacaaaacc

SEQ ID NO: 11904 - DNA, 23 bp, Artificial sequence
  Reverse Primer
agacaaaggacagtttgtcactc

SEQ ID NO: 11905 - DNA, 20 bp, Artificial sequence
  Reverse Primer
tagacgtcggcattgtttct

SEQ ID NO: 11906 - DNA, 25 bp, Artificial sequence
  Reverse Primer
tttattgaccacattcagtttacaa

SEQ ID NO: 11907 - DNA, 24 bp, Artificial sequence
  Reverse Primer
atyggaaaattttgtttaggaaac

SEQ ID NO: 11908 - DNA, 27 bp, Artificial sequence
  Reverse Primer
acacttcaggctacaggtatgtataat

SEQ ID NO: 11909 - DNA, 26 bp, Artificial sequence
  Reverse Primer
gaagcytgaattgataatgaacatat

SEQ ID NO: 11910 - DNA, 22 bp, Artificial sequence
  Reverse Primer
ttctgtatccttgcaaatttcc

SEQ ID NO: 11911 - DNA, 26 bp, Artificial sequence
  Reverse Primer
aatttaagttttcatcctttttcacc

SEQ ID NO: 11912 - DNA, 26 bp, Artificial sequence
  Reverse Primer
tttcttattgggttttttctctaaag

SEQ ID NO: 11913 - DNA, 20 bp, Artificial sequence
  Reverse Primer
tagcctcaccacagtcacct

SEQ ID NO: 11914 - DNA, 18 bp, Artificial sequence
  Reverse Primer
tcactggcttattggggg

SEQ ID NO: 11915 - DNA, 30 bp, Artificial sequence
  Reverse Primer
cttataaactgtatattttatgaatgtggg

SEQ ID NO: 11916 - DNA, 29 bp, Artificial sequence
  Reverse Primer
aaacattttagtrtgtaataatgagaagc

SEQ ID NO: 11917 - DNA, 23 bp, Artificial sequence
  Reverse Primer
tcatcttttcctaaagggtgatt

SEQ ID NO: 11918 - DNA, 19 bp, Artificial sequence
  Reverse Primer
acgggagccctcctggaat

SEQ ID NO: 11919 - DNA, 29 bp, Artificial sequence
  Reverse Primer
acagtacgataaattatattgctcttgtt

SEQ ID NO: 11920 - DNA, 30 bp, Artificial sequence
  Reverse Primer
tcatctataaaatggaaataagcatagtac

SEQ ID NO: 11921 - DNA, 28 bp, Artificial sequence
  Reverse Primer
tttcaatctaaacagaaaagtgatgtat

SEQ ID NO: 11922 - DNA, 18 bp, Artificial sequence
  Reverse Primer
gagcttcgatgaggtcgg

SEQ ID NO: 11923 - DNA, 22 bp, Artificial sequence
  Reverse Primer
ttgttggtaattcctttggaac

SEQ ID NO: 11924 - DNA, 23 bp, Artificial sequence
  Reverse Primer
agtcatttttccaaaacacaacc

SEQ ID NO: 11925 - DNA, 20 bp, Artificial sequence
  Reverse Primer
cgtaagggttggacaaacaa

SEQ ID NO: 11926 - DNA, 24 bp, Artificial sequence
  Reverse Primer
atataatatacacctggggaacgg

SEQ ID NO: 11927 - DNA, 20 bp, Artificial sequence
  Reverse Primer
aacaaggtgactgcccatag

SEQ ID NO: 11928 - DNA, 30 bp, Artificial sequence
  Reverse Primer
atgtgagactaacacattataaatcaacta

SEQ ID NO: 11929 - DNA, 30 bp, Artificial sequence
  Reverse Primer
atagtgattttactctactcataaaatggt

SEQ ID NO: 11930 - DNA, 30 bp, Artificial sequence
  Reverse Primer
tgatagttctaatctgataataacgactaa

SEQ ID NO: 11931 - DNA, 29 bp, Artificial sequence
  Reverse Primer
tagtaggcctaaatataactacagttgtg

SEQ ID NO: 11932 - DNA, 25 bp, Artificial sequence
  Reverse Primer
ttcacactcttcatattcttcatca

SEQ ID NO: 11933 - DNA, 26 bp, Artificial sequence
  Reverse Primer
tcaaatatcatccatatctctaaagg

SEQ ID NO: 11934 - DNA, 22 bp, Artificial sequence
  Reverse Primer
cttgtcatacccatrtgtgtgc

SEQ ID NO: 11935 - DNA, 21 bp, Artificial sequence
  Reverse Primer
taaattgatgtgggaatccct

SEQ ID NO: 11936 - DNA, 25 bp, Artificial sequence
  Reverse Primer
caggatatgaattttttttaaaggc

SEQ ID NO: 11937 - DNA, 27 bp, Artificial sequence
  Reverse Primer
aactgatataaacaggtttaggaacaa

SEQ ID NO: 11938 - DNA, 19 bp, Artificial sequence
  Reverse Primer
tccatggaaactgcagacc

SEQ ID NO: 11939 - DNA, 18 bp, Artificial sequence
  Reverse Primer
aagccgactccaggccca

SEQ ID NO: 11940 - DNA, 30 bp, Artificial sequence
  Reverse Primer
gttttagaatgtctttctgtttactaaatt

SEQ ID NO: 11941 - DNA, 26 bp, Artificial sequence
  Reverse Primer
gccctgagtatatttttgaactaatt

SEQ ID NO: 11942 - DNA, 24 bp, Artificial sequence
  Reverse Primer
gggtttttcatcccatttatattt

SEQ ID NO: 11943 - DNA, 28 bp, Artificial sequence
  Reverse Primer
taattgtatgctttaaagttttgactgt

SEQ ID NO: 11944 - DNA, 25 bp, Artificial sequence
  Reverse Primer
aatgcacatttatttacacagcttt

SEQ ID NO: 11945 - DNA, 24 bp, Artificial sequence
  Reverse Primer
aaagttcttacatgaattccacct

SEQ ID NO: 11946 - DNA, 25 bp, Artificial sequence
  Reverse Primer
atcatccaatatttatgcctgatta

SEQ ID NO: 11947 - DNA, 28 bp, Artificial sequence
  Reverse Primer
taaaaaagaaaactatagcatcatatgg

SEQ ID NO: 11948 - DNA, 19 bp, Artificial sequence
  Reverse Primer
aaatggagacctcaggtgg

SEQ ID NO: 11949 - DNA, 30 bp, Artificial sequence
  Reverse Primer
atttattgtaatactgtgaagaaactgtgt

SEQ ID NO: 11950 - DNA, 27 bp, Artificial sequence
  Reverse Primer
tttattctctatgaagatggactgagt

SEQ ID NO: 11951 - DNA, 30 bp, Artificial sequence
  Reverse Primer
aatataagtatatgcaagaatagggttata

SEQ ID NO: 11952 - DNA, 30 bp, Artificial sequence
  Reverse Primer
tttatcttaactaaatcatagatacagtag

SEQ ID NO: 11953 - DNA, 20 bp, Artificial sequence
  Reverse Primer
agattcccttttgggttttc

SEQ ID NO: 11954 - DNA, 26 bp, Artificial sequence
  Reverse Primer
gataagcaaagtctggaaataaataa

SEQ ID NO: 11955 - DNA, 25 bp, Artificial sequence
  Reverse Primer
aaaacagaagcattgctattaatga

SEQ ID NO: 11956 - DNA, 23 bp, Artificial sequence
  Reverse Primer
taccttccactgcctacagttta

SEQ ID NO: 11957 - DNA, 23 bp, Artificial sequence
  Reverse Primer
aactgttcttcatcagagtcacc

SEQ ID NO: 11958 - DNA, 30 bp, Artificial sequence
  Reverse Primer
tatattaaagaactgtagaagatgttgttg

SEQ ID NO: 11959 - DNA, 18 bp, Artificial sequence
  Reverse Primer
agctggggcagaggcttc

SEQ ID NO: 11960 - DNA, 22 bp, Artificial sequence
  Reverse Primer
atttctgatatgggaacatgct

SEQ ID NO: 11961 - DNA, 29 bp, Artificial sequence
  Reverse Primer
gtcatattttgatagtttwtccaagtaaa

SEQ ID NO: 11962 - DNA, 22 bp, Artificial sequence
  Reverse Primer
cattgtgctttgttttctctga

SEQ ID NO: 11963 - DNA, 26 bp, Artificial sequence
  Reverse Primer
tttgttcccaaaatatataaatgagg

SEQ ID NO: 11964 - DNA, 18 bp, Artificial sequence
  Reverse Primer
atgctcttgctcccaagg

SEQ ID NO: 11965 - DNA, 20 bp, Artificial sequence
  Reverse Primer
tccactgcttacctctaggg

SEQ ID NO: 11966 - DNA, 28 bp, Artificial sequence
  Reverse Primer
aacatttgaatatcttaccttatatgca

SEQ ID NO: 11967 - DNA, 24 bp, Artificial sequence
  Reverse Primer
aaagagtcagagagcaaaatcaag

SEQ ID NO: 11968 - DNA, 26 bp, Artificial sequence
  Reverse Primer
taacctrmacttcagatgatatccaa

SEQ ID NO: 11969 - DNA, 19 bp, Artificial sequence
  Reverse Primer
caggttcccaagcatctct

SEQ ID NO: 11970 - DNA, 23 bp, Artificial sequence
  Reverse Primer
attctttaccattgagtcacctg

SEQ ID NO: 11971 - DNA, 24 bp, Artificial sequence
  Reverse Primer
agtgacaaagaacaggaaaagaaa

SEQ ID NO: 11972 - DNA, 26 bp, Artificial sequence
  Reverse Primer
ttgacataaatcttcatcygtatctc

SEQ ID NO: 11973 - DNA, 27 bp, Artificial sequence
  Reverse Primer
ttccttggagaattagtatctagctta

SEQ ID NO: 11974 - DNA, 25 bp, Artificial sequence
  Reverse Primer
ttacattcttataactcactcccca

SEQ ID NO: 11975 - DNA, 18 bp, Artificial sequence
  Reverse Primer
ggtaacagtgtggcccct

SEQ ID NO: 11976 - DNA, 25 bp, Artificial sequence
  Reverse Primer
tattcattttcactcttctcagctt

SEQ ID NO: 11977 - DNA, 19 bp, Artificial sequence
  Reverse Primer
acccayggagagcaatttc

SEQ ID NO: 11978 - DNA, 21 bp, Artificial sequence
  Reverse Primer
aaaaatgaaaatgcatggtcc

SEQ ID NO: 11979 - DNA, 30 bp, Artificial sequence
  Reverse Primer
tttaaaacacatgttacactcaagtactat

SEQ ID NO: 11980 - DNA, 24 bp, Artificial sequence
  Reverse Primer
tactcttttctcttctccacgagt

SEQ ID NO: 11981 - DNA, 20 bp, Artificial sequence
  Reverse Primer
ttacagtctgccacctgaca

SEQ ID NO: 11982 - DNA, 18 bp, Artificial sequence
  Reverse Primer
tggggtggcatctttgtc

SEQ ID NO: 11983 - DNA, 25 bp, Artificial sequence
  Reverse Primer
ataaactcacaccaggatttagaaa

SEQ ID NO: 11984 - DNA, 22 bp, Artificial sequence
  Reverse Primer
ttcacacaagatcaaccacttc

SEQ ID NO: 11985 - DNA, 23 bp, Artificial sequence
  Reverse Primer
agaagaaaattgtctcgagatgg

SEQ ID NO: 11986 - DNA, 24 bp, Artificial sequence
  Reverse Primer
ttctgaatttcggtctaaatttct

SEQ ID NO: 11987 - DNA, 28 bp, Artificial sequence
  Reverse Primer
atttgtttagaatgtaataaatcaaggg

SEQ ID NO: 11988 - DNA, 25 bp, Artificial sequence
  Reverse Primer
aagttgtcaagcattatcactacct

SEQ ID NO: 11989 - DNA, 30 bp, Artificial sequence
  Reverse Primer
gactcagttatacatatagatactttttca

SEQ ID NO: 11990 - DNA, 22 bp, Artificial sequence
  Reverse Primer
tagggccaccaaaaataaatta

SEQ ID NO: 11991 - DNA, 26 bp, Artificial sequence
  Reverse Primer
actatttctggtcatgcatttattaa

SEQ ID NO: 11992 - DNA, 23 bp, Artificial sequence
  Reverse Primer
atttaggatggtcatgatgtgtc

SEQ ID NO: 11993 - DNA, 23 bp, Artificial sequence
  Reverse Primer
taagactttgaagacaggcaaca

SEQ ID NO: 11994 - DNA, 22 bp, Artificial sequence
  Reverse Primer
agctgaacagaaacttccattc

SEQ ID NO: 11995 - DNA, 23 bp, Artificial sequence
  Reverse Primer
tctcacatacaaaatggcttgta

SEQ ID NO: 11996 - DNA, 29 bp, Artificial sequence
  Reverse Primer
aatctaccctaagactcttaaacatagtg

SEQ ID NO: 11997 - DNA, 27 bp, Artificial sequence
  Reverse Primer
ttagatcttggattagacacaattctt

SEQ ID NO: 11998 - DNA, 18 bp, Artificial sequence
  Reverse Primer
tgcctctagctgcttcca

SEQ ID NO: 11999 - DNA, 18 bp, Artificial sequence
  Reverse Primer
ggctgaggcaatagccaa

SEQ ID NO: 12000 - DNA, 26 bp, Artificial sequence
  Reverse Primer
tagcaatgtttttctytagttgaatg

SEQ ID NO: 12001 - DNA, 21 bp, Artificial sequence
  Reverse Primer
tttccttgaggatccagaaac

SEQ ID NO: 12002 - DNA, 21 bp, Artificial sequence
  Reverse Primer
aacatagtcactgcagcagct

SEQ ID NO: 12003 - DNA, 19 bp, Artificial sequence
  Reverse Primer
ctttggagcgattctgctt

SEQ ID NO: 12004 - DNA, 30 bp, Artificial sequence
  Reverse Primer
cagagtaccaaaactataactaaaatgaaa

SEQ ID NO: 12005 - DNA, 30 bp, Artificial sequence
  Reverse Primer
atgataaaggacagtatttaagaagaaata

SEQ ID NO: 12006 - DNA, 18 bp, Artificial sequence
  Reverse Primer
gaggggcagaaacggtaa

SEQ ID NO: 12007 - DNA, 23 bp, Artificial sequence
  Reverse Primer
acctggttaccagtccttcttag

SEQ ID NO: 12008 - DNA, 29 bp, Artificial sequence
  Reverse Primer
ttagtaaatctatttctagggatctagca

SEQ ID NO: 12009 - DNA, 25 bp, Artificial sequence
  Reverse Primer
tatatcaaacttgagtggttctcac

SEQ ID NO: 12010 - DNA, 18 bp, Artificial sequence
  Reverse Primer
tttgcagagtccatccca

SEQ ID NO: 12011 - DNA, 23 bp, Artificial sequence
  Reverse Primer
acttgcagagtctgattgagttt

SEQ ID NO: 12012 - DNA, 18 bp, Artificial sequence
  Reverse Primer
tcacatcgcctctccatc

SEQ ID NO: 12013 - DNA, 26 bp, Artificial sequence
  Reverse Primer
tgatatgtctattgataaycctcctt

SEQ ID NO: 12014 - DNA, 27 bp, Artificial sequence
  Reverse Primer
actgtgaaagtttatcatcttcagtct

SEQ ID NO: 12015 - DNA, 22 bp, Artificial sequence
  Reverse Primer
ttagaccttggtgagggtacag

SEQ ID NO: 12016 - DNA, 22 bp, Artificial sequence
  Reverse Primer
ttctataacctcacagttcggg

SEQ ID NO: 12017 - DNA, 19 bp, Artificial sequence
  Reverse Primer
tgaaggcatacggttagcc

SEQ ID NO: 12018 - DNA, 20 bp, Artificial sequence
  Reverse Primer
acaactcaagttcctgtccc

SEQ ID NO: 12019 - DNA, 23 bp, Artificial sequence
  Reverse Primer
atctcattgactttgtgttttgc

SEQ ID NO: 12020 - DNA, 26 bp, Artificial sequence
  Reverse Primer
tttaaaacctgtgcctaaataaagat

SEQ ID NO: 12021 - DNA, 29 bp, Artificial sequence
  Reverse Primer
ctgactttaactctagatgactttttttt

SEQ ID NO: 12022 - DNA, 26 bp, Artificial sequence
  Reverse Primer
aatatatctgattccacaggagaagt

SEQ ID NO: 12023 - DNA, 24 bp, Artificial sequence
  Reverse Primer
ttttagctatttttggcattcttt

SEQ ID NO: 12024 - DNA, 25 bp, Artificial sequence
  Reverse Primer
accctatgattcttcactaaaagga

SEQ ID NO: 12025 - DNA, 24 bp, Artificial sequence
  Reverse Primer
tggaataaatatcccatagcaact

SEQ ID NO: 12026 - DNA, 20 bp, Artificial sequence
  Reverse Primer
tacagactgctttggggttg

SEQ ID NO: 12027 - DNA, 25 bp, Artificial sequence
  Reverse Primer
tagagaaggaaataaaactttggct

SEQ ID NO: 12028 - DNA, 27 bp, Artificial sequence
  Reverse Primer
gtaaaattttctaaaggtttttgtgag

SEQ ID NO: 12029 - DNA, 24 bp, Artificial sequence
  Reverse Primer
caactgaaaaacaaagtttgatca

SEQ ID NO: 12030 - DNA, 27 bp, Artificial sequence
  Reverse Primer
tataattagagattcagactggagagc

SEQ ID NO: 12031 - DNA, 26 bp, Artificial sequence
  Reverse Primer
agatcccattaagtctaggagaattt

SEQ ID NO: 12032 - DNA, 21 bp, Artificial sequence
  Reverse Primer
aatatgtgcctttgagcctct

SEQ ID NO: 12033 - DNA, 20 bp, Artificial sequence
  Reverse Primer
agccttggactatgagacgc

SEQ ID NO: 12034 - DNA, 26 bp, Artificial sequence
  Reverse Primer
tttggtctctcttttctcttactctt

SEQ ID NO: 12035 - DNA, 18 bp, Artificial sequence
  Reverse Primer
tggggccattccctgctc

SEQ ID NO: 12036 - DNA, 23 bp, Artificial sequence
  Reverse Primer
aattctccaggcaagtctactag

SEQ ID NO: 12037 - DNA, 27 bp, Artificial sequence
  Reverse Primer
ccttatatttctgaaggtgacttctta

SEQ ID NO: 12038 - DNA, 22 bp, Artificial sequence
  Reverse Primer
tagcttttggaatcctatggaa

SEQ ID NO: 12039 - DNA, 18 bp, Artificial sequence
  Reverse Primer
accaccctacgaggccgt

SEQ ID NO: 12040 - DNA, 27 bp, Artificial sequence
  Reverse Primer
aaggatcatgtctactatcttcagttt

SEQ ID NO: 12041 - DNA, 18 bp, Artificial sequence
  Reverse Primer
atgccagggaggacggtc

SEQ ID NO: 12042 - DNA, 18 bp, Artificial sequence
  Reverse Primer
tgacatcaaccaggcatg

SEQ ID NO: 12043 - DNA, 28 bp, Artificial sequence
  Reverse Primer
ttagatgttagattagcatccaataaag

SEQ ID NO: 12044 - DNA, 18 bp, Artificial sequence
  Reverse Primer
aggactccacttttcccc

SEQ ID NO: 12045 - DNA, 24 bp, Artificial sequence
  Reverse Primer
tatggaaatctcagtagatgaagg

SEQ ID NO: 12046 - DNA, 22 bp, Artificial sequence
  Reverse Primer
tcagcaggcttctgtaagtctt

SEQ ID NO: 12047 - DNA, 23 bp, Artificial sequence
  Reverse Primer
aaaagaggagacagcttcatttt

SEQ ID NO: 12048 - DNA, 22 bp, Artificial sequence
  Reverse Primer
tcagagttcccatttttcaaat

SEQ ID NO: 12049 - DNA, 26 bp, Artificial sequence
  Reverse Primer
aggcattaatttatttaaactttccc

SEQ ID NO: 12050 - DNA, 24 bp, Artificial sequence
  Reverse Primer
ccctggttgtttaaatagaaaaaa

SEQ ID NO: 12051 - DNA, 28 bp, Artificial sequence
  Reverse Primer
ttactgagtcttatcaattttgttttca

SEQ ID NO: 12052 - DNA, 27 bp, Artificial sequence
  Reverse Primer
aattttaatgttgagttatttgctgtc

SEQ ID NO: 12053 - DNA, 21 bp, Artificial sequence
  Reverse Primer
ataaatggaatgagctgaggg

SEQ ID NO: 12054 - DNA, 18 bp, Artificial sequence
  Reverse Primer
agatagccagagccccgg

SEQ ID NO: 12055 - DNA, 22 bp, Artificial sequence
  Reverse Primer
tattgtttttcatggctgtctg

SEQ ID NO: 12056 - DNA, 20 bp, Artificial sequence
  Reverse Primer
tgactcagcagcctgtactc

SEQ ID NO: 12057 - DNA, 27 bp, Artificial sequence
  Reverse Primer
tatttcttcctctgtattaatatccca

SEQ ID NO: 12058 - DNA, 25 bp, Artificial sequence
  Reverse Primer
aaataaccaaataccaaacagacaa

SEQ ID NO: 12059 - DNA, 24 bp, Artificial sequence
  Reverse Primer
ayatttattcacttgtctcctccc

SEQ ID NO: 12060 - DNA, 18 bp, Artificial sequence
  Reverse Primer
aggggtcccctaacctca

SEQ ID NO: 12061 - DNA, 23 bp, Artificial sequence
  Reverse Primer
aaattttatggaagaggaagcat

SEQ ID NO: 12062 - DNA, 25 bp, Artificial sequence
  Reverse Primer
tgataataaaatctcacagcaagtc

SEQ ID NO: 12063 - DNA, 28 bp, Artificial sequence
  Reverse Primer
tttcagagtacaatagtttccactaaga

SEQ ID NO: 12064 - DNA, 23 bp, Artificial sequence
  Reverse Primer
taatgtccttgttttctttggtc

SEQ ID NO: 12065 - DNA, 23 bp, Artificial sequence
  Reverse Primer
taacacattcaacatggactttg

SEQ ID NO: 12066 - DNA, 28 bp, Artificial sequence
  Reverse Primer
aataagagatgtaatggttgtcactcta

SEQ ID NO: 12067 - DNA, 24 bp, Artificial sequence
  Reverse Primer
aagaagaggaaagcacttaagaca

SEQ ID NO: 12068 - DNA, 20 bp, Artificial sequence
  Reverse Primer
aacaaggtctctgtcccctt

SEQ ID NO: 12069 - DNA, 30 bp, Artificial sequence
  Reverse Primer
attcttaggttacttttttctattcaagtg

SEQ ID NO: 12070 - DNA, 24 bp, Artificial sequence
  Reverse Primer
atgttacaaagttgtagccagtga

SEQ ID NO: 12071 - DNA, 21 bp, Artificial sequence
  Reverse Primer
tatagttcacccgtgtggtga

SEQ ID NO: 12072 - DNA, 24 bp, Artificial sequence
  Reverse Primer
ctacatttttctctgtgttccctt

SEQ ID NO: 12073 - DNA, 18 bp, Artificial sequence
  Reverse Primer
tgggggtcttcatggtct

SEQ ID NO: 12074 - DNA, 21 bp, Artificial sequence
  Reverse Primer
aactaccaggaagttgggtgt

SEQ ID NO: 12075 - DNA, 25 bp, Artificial sequence
  Reverse Primer
atcactggaaaatctgataaattcc

SEQ ID NO: 12076 - DNA, 24 bp, Artificial sequence
  Reverse Primer
tgcctattgacaagacctatgtag

SEQ ID NO: 12077 - DNA, 21 bp, Artificial sequence
  Reverse Primer
aaagtcagagaagcagcaagc

SEQ ID NO: 12078 - DNA, 18 bp, Artificial sequence
  Reverse Primer
tcccggcctttctgcctt

SEQ ID NO: 12079 - DNA, 28 bp, Artificial sequence
  Reverse Primer
aagaaattaaggcagatctatacttttc

SEQ ID NO: 12080 - DNA, 24 bp, Artificial sequence
  Reverse Primer
aataattcaaggcctattttctcc

SEQ ID NO: 12081 - DNA, 30 bp, Artificial sequence
  Reverse Primer
taacatasagcacagtaagtagagatgtta

SEQ ID NO: 12082 - DNA, 24 bp, Artificial sequence
  Reverse Primer
tttttctgctcttttcttttcttg

SEQ ID NO: 12083 - DNA, 27 bp, Artificial sequence
  Reverse Primer
ttttcttttattctgtcctatttgaca

SEQ ID NO: 12084 - DNA, 24 bp, Artificial sequence
  Reverse Primer
acagcaagatgattcagttacaca

SEQ ID NO: 12085 - DNA, 23 bp, Artificial sequence
  Reverse Primer
tctgcttacatgtcttgttttgg

SEQ ID NO: 12086 - DNA, 24 bp, Artificial sequence
  Reverse Primer
aataaaaacaatgagatcatttgg

SEQ ID NO: 12087 - DNA, 21 bp, Artificial sequence
  Reverse Primer
agcttctgaggctgagacagt

SEQ ID NO: 12088 - DNA, 26 bp, Artificial sequence
  Reverse Primer
attcaagctacatactgaatttttca

SEQ ID NO: 12089 - DNA, 22 bp, Artificial sequence
  Reverse Primer
ttgctgagtataaccattgcaa

SEQ ID NO: 12090 - DNA, 20 bp, Artificial sequence
  Reverse Primer
gggattcagacaaagatttt

SEQ ID NO: 12091 - DNA, 27 bp, Artificial sequence
  Reverse Primer
tagattaattagcattcaaagtcaaca

SEQ ID NO: 12092 - DNA, 28 bp, Artificial sequence
  Reverse Primer
tctttgaaacagtattttgacaattatc

SEQ ID NO: 12093 - DNA, 28 bp, Artificial sequence
  Reverse Primer
aatagaaaatccagaaatatatccaagt

SEQ ID NO: 12094 - DNA, 26 bp, Artificial sequence
  Reverse Primer
aatttattttctatggctgagtaagc

SEQ ID NO: 12095 - DNA, 25 bp, Artificial sequence
  Reverse Primer
tatatttttatagcccccaatacac

SEQ ID NO: 12096 - DNA, 20 bp, Artificial sequence
  Reverse Primer
gctaacccataaggaaagcc

SEQ ID NO: 12097 - DNA, 30 bp, Artificial sequence
  Reverse Primer
atgtactctaagacattgttaattaaacag

SEQ ID NO: 12098 - DNA, 25 bp, Artificial sequence
  Reverse Primer
ttttctgtcttctgtagtccaattt

SEQ ID NO: 12099 - DNA, 27 bp, Artificial sequence
  Reverse Primer
aatcaattaagtttcgtagtctctcaa

SEQ ID NO: 12100 - DNA, 20 bp, Artificial sequence
  Reverse Primer
cctcaaacaacggaaagagc

SEQ ID NO: 12101 - DNA, 27 bp, Artificial sequence
  Reverse Primer
tagctcattttagagtattttgttctg

SEQ ID NO: 12102 - DNA, 29 bp, Artificial sequence
  Reverse Primer
acatcagtggtagtaaaataaatgtatgc

SEQ ID NO: 12103 - DNA, 24 bp, Artificial sequence
  Reverse Primer
taatctattgtgaatgatgctgct

SEQ ID NO: 12104 - DNA, 22 bp, Artificial sequence
  Reverse Primer
taaaccattagtaatgccccag

SEQ ID NO: 12105 - DNA, 18 bp, Artificial sequence
  Reverse Primer
tccctttcaggccaaatt

SEQ ID NO: 12106 - DNA, 30 bp, Artificial sequence
  Reverse Primer
ctatagtatacctaagtgaaaaccaataca

SEQ ID NO: 12107 - DNA, 23 bp, Artificial sequence
  Reverse Primer
ataatacaagagaaccccgagat

SEQ ID NO: 12108 - DNA, 30 bp, Artificial sequence
  Reverse Primer
caattactgttataaagatacagtgttaga

SEQ ID NO: 12109 - DNA, 19 bp, Artificial sequence
  Reverse Primer
tatctggagccatgtgagc

SEQ ID NO: 12110 - DNA, 26 bp, Artificial sequence
  Reverse Primer
aagagtacagaggtttgagttttctg

SEQ ID NO: 12111 - DNA, 20 bp, Artificial sequence
  Reverse Primer
taacttgccatggacactcc

SEQ ID NO: 12112 - DNA, 21 bp, Artificial sequence
  Reverse Primer
aatgttgttaacagtgcggtg

SEQ ID NO: 12113 - DNA, 21 bp, Artificial sequence
  Reverse Primer
tggaaaaaytgtcttccacaa

SEQ ID NO: 12114 - DNA, 30 bp, Artificial sequence
  Reverse Primer
atataataattgagggtatagtaattgctg

SEQ ID NO: 12115 - DNA, 25 bp, Artificial sequence
  Reverse Primer
attttccaaaatktcaaacagtatc

SEQ ID NO: 12116 - DNA, 23 bp, Artificial sequence
  Reverse Primer
taccaggtagtggagactcttgg

SEQ ID NO: 12117 - DNA, 19 bp, Artificial sequence
  Reverse Primer
tcaaggaagggaattgcat

SEQ ID NO: 12118 - DNA, 19 bp, Artificial sequence
  Reverse Primer
cccaaatttttgttcaccc

SEQ ID NO: 12119 - DNA, 18 bp, Artificial sequence
  Reverse Primer
agttcacatgcctggcaa

SEQ ID NO: 12120 - DNA, 21 bp, Artificial sequence
  Reverse Primer
aatcaggtgtacaggtgggtt

SEQ ID NO: 12121 - DNA, 18 bp, Artificial sequence
  Reverse Primer
ttcgtgggctcagccgta

SEQ ID NO: 12122 - DNA, 29 bp, Artificial sequence
  Reverse Primer
tttacgtgtatatctaaatccctttctac

SEQ ID NO: 12123 - DNA, 19 bp, Artificial sequence
  Reverse Primer
actcctgagcctccagagg

SEQ ID NO: 12124 - DNA, 23 bp, Artificial sequence
  Reverse Primer
tcttttctacttgagttgcagca

SEQ ID NO: 12125 - DNA, 24 bp, Artificial sequence
  Reverse Primer
tttcatctgtatttacagccactg

SEQ ID NO: 12126 - DNA, 22 bp, Artificial sequence
  Reverse Primer
agttcctatttgtatccccttg

SEQ ID NO: 12127 - DNA, 22 bp, Artificial sequence
  Reverse Primer
ctctagtctttggttggaaagg

SEQ ID NO: 12128 - DNA, 25 bp, Artificial sequence
  Reverse Primer
taaagtaaatcagaatttccaaacc

SEQ ID NO: 12129 - DNA, 20 bp, Artificial sequence
  Reverse Primer
atacaaccaccaaaaccctg

SEQ ID NO: 12130 - DNA, 21 bp, Artificial sequence
  Reverse Primer
tcataaagaatgcagccaaca

SEQ ID NO: 12131 - DNA, 22 bp, Artificial sequence
  Reverse Primer
crtttcctagtgtgattggtca

SEQ ID NO: 12132 - DNA, 23 bp, Artificial sequence
  Reverse Primer
aaaagtgcctcttgtcattacag

SEQ ID NO: 12133 - DNA, 18 bp, Artificial sequence
  Reverse Primer
accttccacctccctccg

SEQ ID NO: 12134 - DNA, 21 bp, Artificial sequence
  Reverse Primer
gcttactttccaagtagcccc

SEQ ID NO: 12135 - DNA, 19 bp, Artificial sequence
  Reverse Primer
tagggagcaatgaagcctc

SEQ ID NO: 12136 - DNA, 26 bp, Artificial sequence
  Reverse Primer
tcatactgctgaaatattctatggaa

SEQ ID NO: 12137 - DNA, 21 bp, Artificial sequence
  Reverse Primer
ttttggtggagtgtcaaagaa

SEQ ID NO: 12138 - DNA, 25 bp, Artificial sequence
  Reverse Primer
tatgtgttctggttgaagtttcata

SEQ ID NO: 12139 - DNA, 19 bp, Artificial sequence
  Reverse Primer
aaatgtccatttgtgccaa

SEQ ID NO: 12140 - DNA, 21 bp, Artificial sequence
  Reverse Primer
agatgtgacagaagtgggtga

SEQ ID NO: 12141 - DNA, 22 bp, Artificial sequence
  Reverse Primer
atgtgaaactaacacaatgccg

SEQ ID NO: 12142 - DNA, 30 bp, Artificial sequence
  Reverse Primer
ttaatagattaaggcctastataaactgac

SEQ ID NO: 12143 - DNA, 19 bp, Artificial sequence
  Reverse Primer
agtccttcagccatgcttt

SEQ ID NO: 12144 - DNA, 24 bp, Artificial sequence
  Reverse Primer
attttattgatcatttacctgccc

SEQ ID NO: 12145 - DNA, 29 bp, Artificial sequence
  Reverse Primer
cagaattagaggtatggaattaattagag

SEQ ID NO: 12146 - DNA, 21 bp, Artificial sequence
  Reverse Primer
cattttgctcacagagtctgg

SEQ ID NO: 12147 - DNA, 19 bp, Artificial sequence
  Reverse Primer
tctgtcttctgcccattga

SEQ ID NO: 12148 - DNA, 23 bp, Artificial sequence
  Reverse Primer
aagtcaggatagactgaagggat

SEQ ID NO: 12149 - DNA, 19 bp, Artificial sequence
  Reverse Primer
gccaaagctagagcacagg

SEQ ID NO: 12150 - DNA, 21 bp, Artificial sequence
  Reverse Primer
atattggttctgcccctactg

SEQ ID NO: 12151 - DNA, 25 bp, Artificial sequence
  Reverse Primer
attttccaaaatktcaaacagtatc

SEQ ID NO: 12152 - DNA, 24 bp, Artificial sequence
  Reverse Primer
tgacctttaatgaatgtgcaataa

SEQ ID NO: 12153 - DNA, 24 bp, Artificial sequence
  Reverse Primer
aattccaaactaatagaggggaaa

SEQ ID NO: 12154 - DNA, 30 bp, Artificial sequence
  Reverse Primer
ctttaggcatgatataatttagtcatattt

SEQ ID NO: 12155 - DNA, 26 bp, Artificial sequence
  Reverse Primer
tgtttattatcttcccaattgttatc

SEQ ID NO: 12156 - DNA, 24 bp, Artificial sequence
  Reverse Primer
gggttccatacattaagaagctaa

SEQ ID NO: 12157 - DNA, 23 bp, Artificial sequence
  Reverse Primer
ttccaaaagctgctaactttaag

SEQ ID NO: 12158 - DNA, 18 bp, Artificial sequence
  Reverse Primer
agtcacaggcggttttcc

SEQ ID NO: 12159 - DNA, 20 bp, Artificial sequence
  Reverse Primer
tgctctgctcctcttctgat

SEQ ID NO: 12160 - DNA, 19 bp, Artificial sequence
  Reverse Primer
aggtaaagcrctggcttca

SEQ ID NO: 12161 - DNA, 23 bp, Artificial sequence
  Reverse Primer
tgatttttacatttctttcccaa

SEQ ID NO: 12162 - DNA, 27 bp, Artificial sequence
  Reverse Primer
tattaaaatcagaatcacttcacactg

SEQ ID NO: 12163 - DNA, 18 bp, Artificial sequence
  Reverse Primer
tggacctgtgccactgcc

SEQ ID NO: 12164 - DNA, 28 bp, Artificial sequence
  Reverse Primer
aaattacatttgatttgatctgtaaagg

SEQ ID NO: 12165 - DNA, 27 bp, Artificial sequence
  Reverse Primer
aggactatatgtacagatgtggaaaga

SEQ ID NO: 12166 - DNA, 23 bp, Artificial sequence
  Reverse Primer
ttgaatcatctmraaaccatcca

SEQ ID NO: 12167 - DNA, 24 bp, Artificial sequence
  Reverse Primer
ttattctgtccacatcagatgaga

SEQ ID NO: 12168 - DNA, 25 bp, Artificial sequence
  Reverse Primer
tttcagtaactccttattctgtcca

SEQ ID NO: 12169 - DNA, 20 bp, Artificial sequence
  Reverse Primer
gaatgagctgagggagtttg

SEQ ID NO: 12170 - DNA, 22 bp, Artificial sequence
  Reverse Primer
gacaaagattcttgcctgatgt

SEQ ID NO: 12171 - DNA, 22 bp, Artificial sequence
  Reverse Primer
ttcagttgtcttcggaataagg

SEQ ID NO: 12172 - DNA, 23 bp, Artificial sequence
  Reverse Primer
tgttggacggaaataatcataag

SEQ ID NO: 12173 - DNA, 28 bp, Artificial sequence
  Reverse Primer
atagatttcacaattatactgcaaagaa

SEQ ID NO: 12174 - DNA, 25 bp, Artificial sequence
  Reverse Primer
aatctagcagtctcatttgctaatc

SEQ ID NO: 12175 - DNA, 19 bp, Artificial sequence
  Reverse Primer
agaatgacttgggttgcca

SEQ ID NO: 12176 - DNA, 19 bp, Artificial sequence
  Reverse Primer
ttaagaacgcgggctctac

SEQ ID NO: 12177 - DNA, 18 bp, Artificial sequence
  Reverse Primer
tggaaatcttgagaggcg

SEQ ID NO: 12178 - DNA, 18 bp, Artificial sequence
  Reverse Primer
gccgtctgacacgcaacc

SEQ ID NO: 12179 - DNA, 18 bp, Artificial sequence
  Reverse Primer
tgggcctgtgaatgagtc

SEQ ID NO: 12180 - DNA, 20 bp, Artificial sequence
  Reverse Primer
tttttaccagctgtgcaacc

SEQ ID NO: 12181 - DNA, 19 bp, Artificial sequence
  Reverse Primer
aactgtggcatttgggaag

SEQ ID NO: 12182 - DNA, 26 bp, Artificial sequence
  Reverse Primer
atttccttgtcagattttacttctca

SEQ ID NO: 12183 - DNA, 21 bp, Artificial sequence
  Reverse Primer
actccagttagagcttgtggg

SEQ ID NO: 12184 - DNA, 21 bp, Artificial sequence
  Reverse Primer
tcctgtrtattatgtcccttc

SEQ ID NO: 12185 - DNA, 22 bp, Artificial sequence
  Reverse Primer
atgttgtcttccctctgattcc

SEQ ID NO: 12186 - DNA, 24 bp, Artificial sequence
  Reverse Primer
tcctgttaaatatagccatcaagg

SEQ ID NO: 12187 - DNA, 30 bp, Artificial sequence
  Reverse Primer
tctaggacttttcctctttaactataactc

SEQ ID NO: 12188 - DNA, 25 bp, Artificial sequence
  Reverse Primer
ctttgctttgagatacaagtacaac

SEQ ID NO: 12189 - DNA, 29 bp, Artificial sequence
  Reverse Primer
gaatacatgtaaaataaagatcagctttc

SEQ ID NO: 12190 - DNA, 28 bp, Artificial sequence
  Reverse Primer
cagagaactgtataaaatcttaggacct

SEQ ID NO: 12191 - DNA, 26 bp, Artificial sequence
  Reverse Primer
atcaaatgaccagagttgacatatat

SEQ ID NO: 12192 - DNA, 22 bp, Artificial sequence
  Reverse Primer
atgaattcaagcacaaaaggtc

SEQ ID NO: 12193 - DNA, 21 bp, Artificial sequence
  Reverse Primer
agttcagaaaatggaaatggg

SEQ ID NO: 12194 - DNA, 21 bp, Artificial sequence
  Reverse Primer
tataaggcatatttgctgcca

SEQ ID NO: 12195 - DNA, 21 bp, Artificial sequence
  Reverse Primer
aaccaaggttatccaggaaca

SEQ ID NO: 12196 - DNA, 21 bp, Artificial sequence
  Reverse Primer
tcgagtttgggaagaagagat

SEQ ID NO: 12197 - DNA, 23 bp, Artificial sequence
  Reverse Primer
acgctagggtacatgatattcaa

SEQ ID NO: 12198 - DNA, 24 bp, Artificial sequence
  Reverse Primer
tatagcatgctttaactgctagga

SEQ ID NO: 12199 - DNA, 26 bp, Artificial sequence
  Reverse Primer
aagttctcaaactgcctaatagtttt

SEQ ID NO: 12200 - DNA, 30 bp, Artificial sequence
  Reverse Primer
atttattgagtactagttttcctaaccatc

SEQ ID NO: 12201 - DNA, 27 bp, Artificial sequence
  Reverse Primer
ttaaacagtcttacaggtacgttactc

SEQ ID NO: 12202 - DNA, 22 bp, Artificial sequence
  Reverse Primer
atctgttgaaatcattgtttgc

SEQ ID NO: 12203 - DNA, 23 bp, Artificial sequence
  Reverse Primer
aggtttatggatttcagaatttt

SEQ ID NO: 12204 - DNA, 24 bp, Artificial sequence
  Reverse Primer
aatagttggttgacaacattgtgt

SEQ ID NO: 12205 - DNA, 24 bp, Artificial sequence
  Reverse Primer
taaaacttggattgaattttctcc

SEQ ID NO: 12206 - DNA, 22 bp, Artificial sequence
  Reverse Primer
aaagaaggtctagagggcaaat

SEQ ID NO: 12207 - DNA, 28 bp, Artificial sequence
  Reverse Primer
attgtcttcatcattatgctacattact

SEQ ID NO: 12208 - DNA, 21 bp, Artificial sequence
  Reverse Primer
tttgctgctgtagtctcacct

SEQ ID NO: 12209 - DNA, 23 bp, Artificial sequence
  Reverse Primer
tggtgtctataagagcctgattc

SEQ ID NO: 12210 - DNA, 21 bp, Artificial sequence
  Reverse Primer
ttagataaagaggtggccagc

SEQ ID NO: 12211 - DNA, 24 bp, Artificial sequence
  Reverse Primer
ttgaatgtagaaaagcagaagagc

SEQ ID NO: 12212 - DNA, 28 bp, Artificial sequence
  Reverse Primer
ttaaaggattgaatcactgtctaaatag

SEQ ID NO: 12213 - DNA, 29 bp, Artificial sequence
  Reverse Primer
atataaagattctcactccaggttatcta

SEQ ID NO: 12214 - DNA, 22 bp, Artificial sequence
  Reverse Primer
atcctgccttgttattcagttg

SEQ ID NO: 12215 - DNA, 21 bp, Artificial sequence
  Reverse Primer
tttttttccaggctttcactc

SEQ ID NO: 12216 - DNA, 24 bp, Artificial sequence
  Reverse Primer
argaagatattsactgccctttat

SEQ ID NO: 12217 - DNA, 22 bp, Artificial sequence
  Reverse Primer
aagcatccacagaacctaaagc

SEQ ID NO: 12218 - DNA, 27 bp, Artificial sequence
  Reverse Primer
tcataaacttgttgttgtacagtcact

SEQ ID NO: 12219 - DNA, 21 bp, Artificial sequence
  Reverse Primer
tgaaggataggagaattggga

SEQ ID NO: 12220 - DNA, 19 bp, Artificial sequence
  Reverse Primer
acacggcaagcattctaca

SEQ ID NO: 12221 - DNA, 22 bp, Artificial sequence
  Reverse Primer
ttttactgtcatgtgatggacc

SEQ ID NO: 12222 - DNA, 21 bp, Artificial sequence
  Reverse Primer
ttttcttggaatcagaccctt

SEQ ID NO: 12223 - DNA, 20 bp, Artificial sequence
  Reverse Primer
atttactctggcatgggaca

SEQ ID NO: 12224 - DNA, 26 bp, Artificial sequence
  Reverse Primer
acagtgatttaagttcaattaagctg

SEQ ID NO: 12225 - DNA, 29 bp, Artificial sequence
  Reverse Primer
ataatgaatactagtgatatgggagaaac

SEQ ID NO: 12226 - DNA, 29 bp, Artificial sequence
  Reverse Primer
tacaaggtacaaagattaaactgrtaact

SEQ ID NO: 12227 - DNA, 25 bp, Artificial sequence
  Reverse Primer
caggaagctttatttatttactggg

SEQ ID NO: 12228 - DNA, 18 bp, Artificial sequence
  Reverse Primer
ccaggagctgggatgaac

SEQ ID NO: 12229 - DNA, 20 bp, Artificial sequence
  Reverse Primer
tgcaaggagggtgactttaa

SEQ ID NO: 12230 - DNA, 28 bp, Artificial sequence
  Reverse Primer
aatcaacaatcaaatatgaattaactcc

SEQ ID NO: 12231 - DNA, 27 bp, Artificial sequence
  Reverse Primer
ataataaaacccctttcattgagtatt

SEQ ID NO: 12232 - DNA, 23 bp, Artificial sequence
  Reverse Primer
ctggacacctctttttttcttct

SEQ ID NO: 12233 - DNA, 20 bp, Artificial sequence
  Reverse Primer
tagatgacaggagggtcagg

SEQ ID NO: 12234 - DNA, 26 bp, Artificial sequence
  Reverse Primer
gcactctatatggaatacttcattga

SEQ ID NO: 12235 - DNA, 29 bp, Artificial sequence
  Reverse Primer
catacactaattaaattataagtgccctc

SEQ ID NO: 12236 - DNA, 27 bp, Artificial sequence
  Reverse Primer
agatcttgtaacttaaagcagtagctc

SEQ ID NO: 12237 - DNA, 30 bp, Artificial sequence
  Reverse Primer
attcttactaatctcagaaagtaaagacta

SEQ ID NO: 12238 - DNA, 28 bp, Artificial sequence
  Reverse Primer
aaacagtaaaatgatattaaacacaggg

SEQ ID NO: 12239 - DNA, 20 bp, Artificial sequence
  Reverse Primer
tcatgcttttggtgtcattt

SEQ ID NO: 12240 - DNA, 23 bp, Artificial sequence
  Reverse Primer
aagatggagagtaccagaggact

SEQ ID NO: 12241 - DNA, 23 bp, Artificial sequence
  Reverse Primer
tggtagatctttaatgtccctcc

SEQ ID NO: 12242 - DNA, 18 bp, Artificial sequence
  Reverse Primer
ttgtgagttcgtgccatc

SEQ ID NO: 12243 - DNA, 24 bp, Artificial sequence
  Reverse Primer
taatacaattgtttctgcttgtgg

SEQ ID NO: 12244 - DNA, 22 bp, Artificial sequence
  Reverse Primer
aggctgtatgagtccaaatgac

SEQ ID NO: 12245 - DNA, 25 bp, Artificial sequence
  Reverse Primer
tttagccttctttcagatatcactt

SEQ ID NO: 12246 - DNA, 18 bp, Artificial sequence
  Reverse Primer
tagacggctcagactccg

SEQ ID NO: 12247 - DNA, 27 bp, Artificial sequence
  Reverse Primer
tgatgagagactattttgtcatgttaa

SEQ ID NO: 12248 - DNA, 21 bp, Artificial sequence
  Reverse Primer
atgtgcttaaaattggagggt

SEQ ID NO: 12249 - DNA, 27 bp, Artificial sequence
  Reverse Primer
aaaataaaactgaacctcaagatacaa

SEQ ID NO: 12250 - DNA, 21 bp, Artificial sequence
  Reverse Primer
aagtacaaacaggacctgcct

SEQ ID NO: 12251 - DNA, 26 bp, Artificial sequence
  Reverse Primer
gttctctgctgtaatattagatggtc

SEQ ID NO: 12252 - DNA, 24 bp, Artificial sequence
  Reverse Primer
gtcaagtaaagtcttcagggtgtt

SEQ ID NO: 12253 - DNA, 28 bp, Artificial sequence
  Reverse Primer
atctagcttatttttttctcataatgct

SEQ ID NO: 12254 - DNA, 30 bp, Artificial sequence
  Reverse Primer
aagaaaggtaagataggtattcataaaatc

SEQ ID NO: 12255 - DNA, 27 bp, Artificial sequence
  Reverse Primer
agtcaatattgtacagagagagaagct

SEQ ID NO: 12256 - DNA, 18 bp, Artificial sequence
  Reverse Primer
gcagcaggatgcaaacac

SEQ ID NO: 12257 - DNA, 19 bp, Artificial sequence
  Reverse Primer
tgactggcagcaggtttaa

SEQ ID NO: 12258 - DNA, 29 bp, Artificial sequence
  Reverse Primer
aaattatargtcccagtaaaattatgagt

SEQ ID NO: 12259 - DNA, 23 bp, Artificial sequence
  Reverse Primer
attgagtgcccattataataaat

SEQ ID NO: 12260 - DNA, 27 bp, Artificial sequence
  Reverse Primer
actttacatttggcatgactttatagt

SEQ ID NO: 12261 - DNA, 18 bp, Artificial sequence
  Reverse Primer
cccttggagctaccatcg

SEQ ID NO: 12262 - DNA, 30 bp, Artificial sequence
  Reverse Primer
tactctatgagcactctagttctagattca

SEQ ID NO: 12263 - DNA, 28 bp, Artificial sequence
  Reverse Primer
aaaccacagtattttttataacctaacc

SEQ ID NO: 12264 - DNA, 26 bp, Artificial sequence
  Reverse Primer
caaaaaaatgtatattaacagctgct

SEQ ID NO: 12265 - DNA, 23 bp, Artificial sequence
  Reverse Primer
ttcagattgagatctgtcacctt

SEQ ID NO: 12266 - DNA, 22 bp, Artificial sequence
  Reverse Primer
attcttgatctgcacaaggtct

SEQ ID NO: 12267 - DNA, 27 bp, Artificial sequence
  Reverse Primer
attggtaatatttagaaggtcagtgtc

SEQ ID NO: 12268 - DNA, 18 bp, Artificial sequence
  Reverse Primer
gacagctctgctcggtgg

SEQ ID NO: 12269 - DNA, 27 bp, Artificial sequence
  Reverse Primer
aaacttctgcaaattacaaaaatagtc

SEQ ID NO: 12270 - DNA, 24 bp, Artificial sequence
  Reverse Primer
attaaaaactgctgagtgtgtcac

SEQ ID NO: 12271 - DNA, 23 bp, Artificial sequence
  Reverse Primer
atggtgatgatcaaatgtcttca

SEQ ID NO: 12272 - DNA, 24 bp, Artificial sequence
  Reverse Primer
ttaaaatgctttgatttcagagag

SEQ ID NO: 12273 - DNA, 28 bp, Artificial sequence
  Reverse Primer
ttaaatttcttaccaaaaaaagtctctg

SEQ ID NO: 12274 - DNA, 18 bp, Artificial sequence
  Reverse Primer
caaacgtgcacacgggag

SEQ ID NO: 12275 - DNA, 30 bp, Artificial sequence
  Reverse Primer
tgagtaatattctatcgtrtatttgtacca

SEQ ID NO: 12276 - DNA, 22 bp, Artificial sequence
  Reverse Primer
ctgcgtatgtttcatgatgtct

SEQ ID NO: 12277 - DNA, 24 bp, Artificial sequence
  Reverse Primer
tttctataggacttgacaatgtgc

SEQ ID NO: 12278 - DNA, 21 bp, Artificial sequence
  Reverse Primer
tcctctctctagcacagtgcc

SEQ ID NO: 12279 - DNA, 22 bp, Artificial sequence
  Reverse Primer
tgttttctgagaccatctctcc

SEQ ID NO: 12280 - DNA, 27 bp, Artificial sequence
  Reverse Primer
tattcattttatcaactcttcaattcc

SEQ ID NO: 12281 - DNA, 26 bp, Artificial sequence
  Reverse Primer
atacacacacataaaagagagagaga

SEQ ID NO: 12282 - DNA, 24 bp, Artificial sequence
  Reverse Primer
aaatgatgaaatcagtgctcttct

SEQ ID NO: 12283 - DNA, 26 bp, Artificial sequence
  Reverse Primer
agcatagtgtgaagtaaygtaagtcc

SEQ ID NO: 12284 - DNA, 26 bp, Artificial sequence
  Reverse Primer
saaattgttaatttttaaagtccagc

SEQ ID NO: 12285 - DNA, 25 bp, Artificial sequence
  Reverse Primer
tttgcatctctactttcaattcttt

SEQ ID NO: 12286 - DNA, 27 bp, Artificial sequence
  Reverse Primer
ttttattactccttgagaacctaagaa

SEQ ID NO: 12287 - DNA, 23 bp, Artificial sequence
  Reverse Primer
attgctgattattttctccatgg

SEQ ID NO: 12288 - DNA, 30 bp, Artificial sequence
  Reverse Primer
atatactaacaaaagactaggttaaactct

SEQ ID NO: 12289 - DNA, 22 bp, Artificial sequence
  Reverse Primer
aggctcctctgttcataggatt

SEQ ID NO: 12290 - DNA, 19 bp, Artificial sequence
  Reverse Primer
gccaacatacatgaggcct

SEQ ID NO: 12291 - DNA, 24 bp, Artificial sequence
  Reverse Primer
tttactgcatctttgaaagaaagg

SEQ ID NO: 12292 - DNA, 19 bp, Artificial sequence
  Reverse Primer
acaaggccctttcaacctt

SEQ ID NO: 12293 - DNA, 26 bp, Artificial sequence
  Reverse Primer
tggaagttagctactgttatgtgaat

SEQ ID NO: 12294 - DNA, 29 bp, Artificial sequence
  Reverse Primer
taattacataaaacattaagcatagtccc

SEQ ID NO: 12295 - DNA, 25 bp, Artificial sequence
  Reverse Primer
aatgtctgagacagtaataaccacc

SEQ ID NO: 12296 - DNA, 18 bp, Artificial sequence
  Reverse Primer
tcctccctcaggcagaat

SEQ ID NO: 12297 - DNA, 21 bp, Artificial sequence
  Reverse Primer
tatgcagatcaaatggtggat

SEQ ID NO: 12298 - DNA, 30 bp, Artificial sequence
  Reverse Primer
ataaagtgaaactgttatcagctatctaaa

SEQ ID NO: 12299 - DNA, 27 bp, Artificial sequence
  Reverse Primer
atacaactcaaacacacacattcttac

SEQ ID NO: 12300 - DNA, 19 bp, Artificial sequence
  Reverse Primer
aattagcacaatgcatggc

SEQ ID NO: 12301 - DNA, 23 bp, Artificial sequence
  Reverse Primer
cttaatgttagagaaggatgcca

SEQ ID NO: 12302 - DNA, 23 bp, Artificial sequence
  Reverse Primer
aaaggtttaaacggcctttacta

SEQ ID NO: 12303 - DNA, 19 bp, Artificial sequence
  Reverse Primer
tggttcaacatgttccctg

SEQ ID NO: 12304 - DNA, 29 bp, Artificial sequence
  Reverse Primer
attggagtcatstctctagatatgataag

SEQ ID NO: 12305 - DNA, 23 bp, Artificial sequence
  Reverse Primer
catacaactcaggaagctcaaac

SEQ ID NO: 12306 - DNA, 22 bp, Artificial sequence
  Reverse Primer
acatacatctaacacccccact

SEQ ID NO: 12307 - DNA, 22 bp, Artificial sequence
  Reverse Primer
cctttagaacacgatcgaagat

SEQ ID NO: 12308 - DNA, 19 bp, Artificial sequence
  Reverse Primer
agggccttsattctcaacc

SEQ ID NO: 12309 - DNA, 22 bp, Artificial sequence
  Reverse Primer
tgctstagccggttagtcttat

SEQ ID NO: 12310 - DNA, 25 bp, Artificial sequence
  Reverse Primer
tgtttrtaagtaagttcacttgccc

SEQ ID NO: 12311 - DNA, 21 bp, Artificial sequence
  Reverse Primer
tttctccaggtatctcctgct

SEQ ID NO: 12312 - DNA, 18 bp, Artificial sequence
  Reverse Primer
gggaggggaaaagggcag

SEQ ID NO: 12313 - DNA, 25 bp, Artificial sequence
  Reverse Primer
ttgtttaatgttgaaaggaaagaac

SEQ ID NO: 12314 - DNA, 24 bp, Artificial sequence
  Reverse Primer
aaagttcttaacctttgcactgtg

SEQ ID NO: 12315 - DNA, 19 bp, Artificial sequence
  Reverse Primer
ctcttttgcccccttactg

SEQ ID NO: 12316 - DNA, 27 bp, Artificial sequence
  Reverse Primer
aaatctttcagtctaatcaragaactg

SEQ ID NO: 12317 - DNA, 23 bp, Artificial sequence
  Reverse Primer
ccaggaattgttcataytttcaa

SEQ ID NO: 12318 - DNA, 23 bp, Artificial sequence
  Reverse Primer
ttcattctgtacaattttgctcc

SEQ ID NO: 12319 - DNA, 18 bp, Artificial sequence
  Reverse Primer
attgcatgggggagacat

SEQ ID NO: 12320 - DNA, 28 bp, Artificial sequence
  Reverse Primer
aaatacaacgtattatatctccatgaaa

SEQ ID NO: 12321 - DNA, 20 bp, Artificial sequence
  Reverse Primer
aagaatcgaaagcctctgag

SEQ ID NO: 12322 - DNA, 19 bp, Artificial sequence
  Reverse Primer
tactttccaagtagccccg

SEQ ID NO: 12323 - DNA, 18 bp, Artificial sequence
  Reverse Primer
gggacaactgggtggatg

SEQ ID NO: 12324 - DNA, 22 bp, Artificial sequence
  Reverse Primer
ttcgtatttgcaaaaaatcctc

SEQ ID NO: 12325 - DNA, 28 bp, Artificial sequence
  Reverse Primer
aactagtgatcagaaatgaagaagttag

SEQ ID NO: 12326 - DNA, 21 bp, Artificial sequence
  Reverse Primer
ttgtctcttggcagtgtttct

SEQ ID NO: 12327 - DNA, 28 bp, Artificial sequence
  Reverse Primer
aatagtttttaaaatccagtgatgaatc

SEQ ID NO: 12328 - DNA, 27 bp, Artificial sequence
  Reverse Primer
aaacataaaaggtcaaactaractcat

SEQ ID NO: 12329 - DNA, 21 bp, Artificial sequence
  Reverse Primer
tagcacacaccaggacttttt

SEQ ID NO: 12330 - DNA, 26 bp, Artificial sequence
  Reverse Primer
aaaagtctttgaatttagatagccat

SEQ ID NO: 12331 - DNA, 23 bp, Artificial sequence
  Reverse Primer
tttttgagtttcatttggaaaac

SEQ ID NO: 12332 - DNA, 20 bp, Artificial sequence
  Reverse Primer
cacaaagcatttgactggag

SEQ ID NO: 12333 - DNA, 24 bp, Artificial sequence
  Reverse Primer
aagcaatttaaggatcaaaagaaa

SEQ ID NO: 12334 - DNA, 21 bp, Artificial sequence
  Reverse Primer
ggtccaaaataaggccaataa

SEQ ID NO: 12335 - DNA, 23 bp, Artificial sequence
  Reverse Primer
attttctcatcagctgaaacatg

SEQ ID NO: 12336 - DNA, 27 bp, Artificial sequence
  Reverse Primer
aacaataatgaaaaccagaatactgat

SEQ ID NO: 12337 - DNA, 26 bp, Artificial sequence
  Reverse Primer
cttttgttcataaaacagaactcaaa

SEQ ID NO: 12338 - DNA, 19 bp, Artificial sequence
  Reverse Primer
agctgcttcatgcttagcc

SEQ ID NO: 12339 - DNA, 27 bp, Artificial sequence
  Reverse Primer
ttgacttaygtttctttctactattgg

SEQ ID NO: 12340 - DNA, 26 bp, Artificial sequence
  Reverse Primer
gtggttatttttatgtgtcaggtaag

SEQ ID NO: 12341 - DNA, 25 bp, Artificial sequence
  Reverse Primer
atttcttatgggacaactttcattt

SEQ ID NO: 12342 - DNA, 25 bp, Artificial sequence
  Reverse Primer
aggtctaatctttttggaaatttga

SEQ ID NO: 12343 - DNA, 18 bp, Artificial sequence
  Reverse Primer
tgttggtttggggtgtct

SEQ ID NO: 12344 - DNA, 26 bp, Artificial sequence
  Reverse Primer
atttttagaaccacttagcattttca

SEQ ID NO: 12345 - DNA, 26 bp, Artificial sequence
  Reverse Primer
ttatatttaagcaaagacttgaaggc

SEQ ID NO: 12346 - DNA, 18 bp, Artificial sequence
  Reverse Primer
ctgmgagccrgagattca

SEQ ID NO: 12347 - DNA, 23 bp, Artificial sequence
  Reverse Primer
tttttctgttttacttctgccaa

SEQ ID NO: 12348 - DNA, 20 bp, Artificial sequence
  Reverse Primer
accctttaaaaggtcatgtc

SEQ ID NO: 12349 - DNA, 26 bp, Artificial sequence
  Reverse Primer
atgtagttatttttggtaatagcccc

SEQ ID NO: 12350 - DNA, 18 bp, Artificial sequence
  Reverse Primer
agcgttggaactggacgt

SEQ ID NO: 12351 - DNA, 23 bp, Artificial sequence
  Reverse Primer
agtaagaccaagaaggagcaagt

SEQ ID NO: 12352 - DNA, 27 bp, Artificial sequence
  Reverse Primer
tgaaaaagacctytgttactaaaactc

SEQ ID NO: 12353 - DNA, 24 bp, Artificial sequence
  Reverse Primer
caggtggcagagatttaaaattat

SEQ ID NO: 12354 - DNA, 23 bp, Artificial sequence
  Reverse Primer
tattgtttatctcagaccgtgct

SEQ ID NO: 12355 - DNA, 18 bp, Artificial sequence
  Reverse Primer
ttgaggctgtgctgcact

SEQ ID NO: 12356 - DNA, 29 bp, Artificial sequence
  Reverse Primer
aacttgaacttagctactatttttaaccc

SEQ ID NO: 12357 - DNA, 30 bp, Artificial sequence
  Reverse Primer
ttactagtggaaatggttaagataattagt

SEQ ID NO: 12358 - DNA, 30 bp, Artificial sequence
  Reverse Primer
ctcagaagaaattagttgtttattatatag

SEQ ID NO: 12359 - DNA, 28 bp, Artificial sequence
  Reverse Primer
tatataatgtttgaagtggaagtaatgg

SEQ ID NO: 12360 - DNA, 29 bp, Artificial sequence
  Reverse Primer
ctcttagaagatattttyactcctacaca

SEQ ID NO: 12361 - DNA, 23 bp, Artificial sequence
  Reverse Primer
ttttcagagaacaaaactgagga

SEQ ID NO: 12362 - DNA, 20 bp, Artificial sequence
  Reverse Primer
agtcagtcttcccactgtgc

SEQ ID NO: 12363 - DNA, 18 bp, Artificial sequence
  Reverse Primer
agcaggctaggacaggca

SEQ ID NO: 12364 - DNA, 27 bp, Artificial sequence
  Reverse Primer
aacttatggattctctgctgtacttac

SEQ ID NO: 12365 - DNA, 30 bp, Artificial sequence
  Reverse Primer
cagaaagtataatacaacctttttttaagt

SEQ ID NO: 12366 - DNA, 26 bp, Artificial sequence
  Reverse Primer
trtctgaggaactggtacttaatctg

SEQ ID NO: 12367 - DNA, 21 bp, Artificial sequence
  Reverse Primer
aattccattcccagaaatcaa

SEQ ID NO: 12368 - DNA, 25 bp, Artificial sequence
  Reverse Primer
taatrcactcccatatctctgaatg

SEQ ID NO: 12369 - DNA, 22 bp, Artificial sequence
  Reverse Primer
accttttgtggtgatcatttca

SEQ ID NO: 12370 - DNA, 22 bp, Artificial sequence
  Reverse Primer
tttgtgaggcatttttcttctc

SEQ ID NO: 12371 - DNA, 30 bp, Artificial sequence
  Reverse Primer
gctcatcagatagtaggtctaatagtaaga

SEQ ID NO: 12372 - DNA, 25 bp, Artificial sequence
  Reverse Primer
taccaatggtacaccttataaatgg

SEQ ID NO: 12373 - DNA, 18 bp, Artificial sequence
  Reverse Primer
atggagaggctctggggg

SEQ ID NO: 12374 - DNA, 27 bp, Artificial sequence
  Reverse Primer
tttctctgctgttttctatcttaatgt

SEQ ID NO: 12375 - DNA, 27 bp, Artificial sequence
  Reverse Primer
taaagctctaccatcattatcttctca

SEQ ID NO: 12376 - DNA, 28 bp, Artificial sequence
  Reverse Primer
attgacagatatttgtttacatttcttg

SEQ ID NO: 12377 - DNA, 30 bp, Artificial sequence
  Reverse Primer
aatgaatgaatacaagttatgttacactct

SEQ ID NO: 12378 - DNA, 22 bp, Artificial sequence
  Reverse Primer
aatgggagtcattgaagacatc

SEQ ID NO: 12379 - DNA, 30 bp, Artificial sequence
  Reverse Primer
ggtagctctatgttttcatatgtaataatt

SEQ ID NO: 12380 - DNA, 21 bp, Artificial sequence
  Reverse Primer
accttcaagggaaaaatgagg

SEQ ID NO: 12381 - DNA, 26 bp, Artificial sequence
  Reverse Primer
agaaagagttcatgtttaaggatgtt

SEQ ID NO: 12382 - DNA, 27 bp, Artificial sequence
  Reverse Primer
tactttccctttacttaaaatcatctg

SEQ ID NO: 12383 - DNA, 24 bp, Artificial sequence
  Reverse Primer
tagtagcttttaatgcacactttc

SEQ ID NO: 12384 - DNA, 24 bp, Artificial sequence
  Reverse Primer
ttttgtcccaaataaagattgact

SEQ ID NO: 12385 - DNA, 25 bp, Artificial sequence
  Reverse Primer
cagaaactttaagaagcaactcatt

SEQ ID NO: 12386 - DNA, 30 bp, Artificial sequence
  Reverse Primer
aacttacatgagagttttgtacattaagtc

SEQ ID NO: 12387 - DNA, 28 bp, Artificial sequence
  Reverse Primer
tatttacattatctaacagcatttggtc

SEQ ID NO: 12388 - DNA, 26 bp, Artificial sequence
  Reverse Primer
cacagaacatacctggataattaaca

SEQ ID NO: 12389 - DNA, 18 bp, Artificial sequence
  Reverse Primer
aaatggcccaggaaatgg

SEQ ID NO: 12390 - DNA, 28 bp, Artificial sequence
  Reverse Primer
atgtttccatgttcagaaatatattaga

SEQ ID NO: 12391 - DNA, 25 bp, Artificial sequence
  Reverse Primer
agaccaatgaaatgtgtatcctaca

SEQ ID NO: 12392 - DNA, 20 bp, Artificial sequence
  Reverse Primer
taaatcccatgatttgcctc

SEQ ID NO: 12393 - DNA, 23 bp, Artificial sequence
  Reverse Primer
acctcgtgactagagtctgttcc

SEQ ID NO: 12394 - DNA, 22 bp, Artificial sequence
  Reverse Primer
aaaactgtgaaggaatcctgtg

SEQ ID NO: 12395 - DNA, 28 bp, Artificial sequence
  Reverse Primer
agctactactagacttgattttmggatg

SEQ ID NO: 12396 - DNA, 18 bp, Artificial sequence
  Reverse Primer
tggacttcttggtggcag

SEQ ID NO: 12397 - DNA, 18 bp, Artificial sequence
  Reverse Primer
agccccttggtcagcact

SEQ ID NO: 12398 - DNA, 21 bp, Artificial sequence
  Reverse Primer
acagcctgcctatcctacatt

SEQ ID NO: 12399 - DNA, 19 bp, Artificial sequence
  Reverse Primer
agacctccgcaagacatgt

SEQ ID NO: 12400 - DNA, 19 bp, Artificial sequence
  Reverse Primer
taaaagcaaacgcaaagca

SEQ ID NO: 12401 - DNA, 26 bp, Artificial sequence
  Reverse Primer
gaccagtagaagaaccactgaatatc

SEQ ID NO: 12402 - DNA, 26 bp, Artificial sequence
  Reverse Primer
aaaattattttaataaggggwaacgg

SEQ ID NO: 12403 - DNA, 24 bp, Artificial sequence
  Reverse Primer
acagtgsagtcgatttaaatatgc

SEQ ID NO: 12404 - DNA, 22 bp, Artificial sequence
  Reverse Primer
ttcaaaaacccagcgtatattt

SEQ ID NO: 12405 - DNA, 20 bp, Artificial sequence
  Reverse Primer
aaaagtctggggtgggatac

SEQ ID NO: 12406 - DNA, 24 bp, Artificial sequence
  Reverse Primer
agtttatgttaggattcgcacttt

SEQ ID NO: 12407 - DNA, 26 bp, Artificial sequence
  Reverse Primer
aaagtatgacgtgacttagagactga

SEQ ID NO: 12408 - DNA, 20 bp, Artificial sequence
  Reverse Primer
aaaaccaagtccagaaagca

SEQ ID NO: 12409 - DNA, 21 bp, Artificial sequence
  Reverse Primer
aatttctggtcattctgctgc

SEQ ID NO: 12410 - DNA, 18 bp, Artificial sequence
  Reverse Primer
cgccactacctcatccac

SEQ ID NO: 12411 - DNA, 26 bp, Artificial sequence
  Reverse Primer
gactctcagtktgggtaactactagc

SEQ ID NO: 12412 - DNA, 18 bp, Artificial sequence
  Reverse Primer
accccagatcccgtcgct

SEQ ID NO: 12413 - DNA, 19 bp, Artificial sequence
  Reverse Primer
aacagcrgactgagaggga

SEQ ID NO: 12414 - DNA, 25 bp, Artificial sequence
  Reverse Primer
ttckgtaaaatccatttcataagag

SEQ ID NO: 12415 - DNA, 21 bp, Artificial sequence
  Reverse Primer
tatatcagtttcctggggttg

SEQ ID NO: 12416 - DNA, 23 bp, Artificial sequence
  Reverse Primer
tcaaggcacagttatctgttttg

SEQ ID NO: 12417 - DNA, 25 bp, Artificial sequence
  Reverse Primer
aaacaaaagggactttgtaaggtat

SEQ ID NO: 12418 - DNA, 25 bp, Artificial sequence
  Reverse Primer
cccttttcatactcttttgaatctc

SEQ ID NO: 12419 - DNA, 27 bp, Artificial sequence
  Reverse Primer
ttgccagtctaaaaatttaatacattc

SEQ ID NO: 12420 - DNA, 23 bp, Artificial sequence
  Reverse Primer
ttttccatttcatcatggttatg

SEQ ID NO: 12421 - DNA, 28 bp, Artificial sequence
  Reverse Primer
aaaacagactcacagacatagagaatag

SEQ ID NO: 12422 - DNA, 27 bp, Artificial sequence
  Reverse Primer
atcagtaagcaagtttagaaatgaaga

SEQ ID NO: 12423 - DNA, 26 bp, Artificial sequence
  Reverse Primer
aatattacacttctgcctactccttg

SEQ ID NO: 12424 - DNA, 25 bp, Artificial sequence
  Reverse Primer
aacacagcaatacctaggtcactaa

SEQ ID NO: 12425 - DNA, 25 bp, Artificial sequence
  Reverse Primer
ttaaagccttccttagaataaacca

SEQ ID NO: 12426 - DNA, 23 bp, Artificial sequence
  Reverse Primer
agaaggcatcctaaatcaagttt

SEQ ID NO: 12427 - DNA, 26 bp, Artificial sequence
  Reverse Primer
gcagaataatgaatgaatgaaatcta

SEQ ID NO: 12428 - DNA, 28 bp, Artificial sequence
  Reverse Primer
taagatgttatggaataatttctctcaa

SEQ ID NO: 12429 - DNA, 20 bp, Artificial sequence
  Reverse Primer
tgtctctaccccacaacctt

SEQ ID NO: 12430 - DNA, 30 bp, Artificial sequence
  Reverse Primer
attgaatagtaaactccatatttctttctc

SEQ ID NO: 12431 - DNA, 25 bp, Artificial sequence
  Reverse Primer
attttaattgacaactacattgcag

SEQ ID NO: 12432 - DNA, 24 bp, Artificial sequence
  Reverse Primer
tccccttctatttacctgttattc

SEQ ID NO: 12433 - DNA, 26 bp, Artificial sequence
  Reverse Primer
gactctcagtktgggtaactactagc

SEQ ID NO: 12434 - DNA, 23 bp, Artificial sequence
  Reverse Primer
ttactgaatgagaagtgggaaga

SEQ ID NO: 12435 - DNA, 28 bp, Artificial sequence
  Reverse Primer
cagtatctgaagagacaggtaaactagg

SEQ ID NO: 12436 - DNA, 29 bp, Artificial sequence
  Reverse Primer
aagaartaggaacaacctagtaaaagtct

SEQ ID NO: 12437 - DNA, 26 bp, Artificial sequence
  Reverse Primer
aatagaaatgcagacatagagaatgg

SEQ ID NO: 12438 - DNA, 24 bp, Artificial sequence
  Reverse Primer
atgcttctgtctcagaggaataac

SEQ ID NO: 12439 - DNA, 25 bp, Artificial sequence
  Reverse Primer
agaacaaatctttagccatgaaata

SEQ ID NO: 12440 - DNA, 27 bp, Artificial sequence
  Reverse Primer
tattttctccattttcaacttaacagt

SEQ ID NO: 12441 - DNA, 28 bp, Artificial sequence
  Reverse Primer
ttttatttctaagaattttctaaacccc

SEQ ID NO: 12442 - DNA, 21 bp, Artificial sequence
  Reverse Primer
aaaagaaaacgcagacctcat

SEQ ID NO: 12443 - DNA, 27 bp, Artificial sequence
  Reverse Primer
tatactgacattatttgtccttacgtg

SEQ ID NO: 12444 - DNA, 30 bp, Artificial sequence
  Reverse Primer
tttaaagtaggagtttccttagtcattatt

SEQ ID NO: 12445 - DNA, 26 bp, Artificial sequence
  Reverse Primer
taatactgcaaaacctatatgcactg

SEQ ID NO: 12446 - DNA, 27 bp, Artificial sequence
  Reverse Primer
atagagagaaagaaaaatgtaaggctt

SEQ ID NO: 12447 - DNA, 24 bp, Artificial sequence
  Reverse Primer
ttgtttttcctaaacacagacacc

SEQ ID NO: 12448 - DNA, 24 bp, Artificial sequence
  Reverse Primer
tggcaattagtctaaattctaccc

SEQ ID NO: 12449 - DNA, 24 bp, Artificial sequence
  Reverse Primer
attaattacacaagcaccagtcat

SEQ ID NO: 12450 - DNA, 21 bp, Artificial sequence
  Reverse Primer
tcatagtttacccaccctggt

SEQ ID NO: 12451 - DNA, 22 bp, Artificial sequence
  Reverse Primer
ctaaaaaaggaagactgccatg

SEQ ID NO: 12452 - DNA, 23 bp, Artificial sequence
  Reverse Primer
ttattgttccaagacaacgactg

SEQ ID NO: 12453 - DNA, 18 bp, Artificial sequence
  Reverse Primer
tttcaagcgtggtgaacg

SEQ ID NO: 12454 - DNA, 23 bp, Artificial sequence
  Reverse Primer
tctactcttttcctctcagcttg

SEQ ID NO: 12455 - DNA, 30 bp, Artificial sequence
  Reverse Primer
cccaaactactatacactatgaaattaaag

SEQ ID NO: 12456 - DNA, 27 bp, Artificial sequence
  Reverse Primer
gcttctgaaattagtcttcaaatacat

SEQ ID NO: 12457 - DNA, 28 bp, Artificial sequence
  Reverse Primer
aaaccatgagaatgtactatttacaaaa

SEQ ID NO: 12458 - DNA, 28 bp, Artificial sequence
  Reverse Primer
agaaagatatccatgtctttttaaagtc

SEQ ID NO: 12459 - DNA, 29 bp, Artificial sequence
  Reverse Primer
tacttaactactgaatcttttcaaagaca

SEQ ID NO: 12460 - DNA, 28 bp, Artificial sequence
  Reverse Primer
tgataagaagacctcatttgatatttaa

SEQ ID NO: 12461 - DNA, 26 bp, Artificial sequence
  Reverse Primer
attgttatgtattggacagtaatgca

SEQ ID NO: 12462 - DNA, 26 bp, Artificial sequence
  Reverse Primer
tttaaatgatgcataaatgagtcttg

SEQ ID NO: 12463 - DNA, 23 bp, Artificial sequence
  Reverse Primer
attaacgtgacactccaaaccta

SEQ ID NO: 12464 - DNA, 27 bp, Artificial sequence
  Reverse Primer
tatttctatgacagagacaaactgaaa

SEQ ID NO: 12465 - DNA, 26 bp, Artificial sequence
  Reverse Primer
tttttgaaataatctgtatttccagc

SEQ ID NO: 12466 - DNA, 26 bp, Artificial sequence
  Reverse Primer
cctccaaaaattatctatgaagttct

SEQ ID NO: 12467 - DNA, 25 bp, Artificial sequence
  Reverse Primer
tgttctgccttmttcataataaaaa

SEQ ID NO: 12468 - DNA, 22 bp, Artificial sequence
  Reverse Primer
ctgaaaatacctgctgtcttcc

SEQ ID NO: 12469 - DNA, 21 bp, Artificial sequence
  Reverse Primer
agctctactgtaagcaggctg

SEQ ID NO: 12470 - DNA, 26 bp, Artificial sequence
  Reverse Primer
tatttcttcaagtcttttctgatgat

SEQ ID NO: 12471 - DNA, 23 bp, Artificial sequence
  Reverse Primer
ttttggtgtattattgttggtgc

SEQ ID NO: 12472 - DNA, 24 bp, Artificial sequence
  Reverse Primer
ttgatgagtgtagcaaattctgtg

SEQ ID NO: 12473 - DNA, 30 bp, Artificial sequence
  Reverse Primer
agtaactataaaagtctctgaaccaaattt

SEQ ID NO: 12474 - DNA, 28 bp, Artificial sequence
  Reverse Primer
tacgttatctctttagttaaaccaacaa

SEQ ID NO: 12475 - DNA, 20 bp, Artificial sequence
  Reverse Primer
atcccccttttttcagagaa

SEQ ID NO: 12476 - DNA, 23 bp, Artificial sequence
  Reverse Primer
tattgtttatctcagaccgtgct

SEQ ID NO: 12477 - DNA, 21 bp, Artificial sequence
  Reverse Primer
agagggagaaccaaagatgtc

SEQ ID NO: 12478 - DNA, 18 bp, Artificial sequence
  Reverse Primer
agcccatgccaggacaga

SEQ ID NO: 12479 - DNA, 24 bp, Artificial sequence
  Reverse Primer
agataaagataaaaccagctgcaa

SEQ ID NO: 12480 - DNA, 24 bp, Artificial sequence
  Reverse Primer
aaatgtcaaataaaaaaggtttgg

SEQ ID NO: 12481 - DNA, 21 bp, Artificial sequence
  Reverse Primer
attaaggctgaatgggtatcg

SEQ ID NO: 12482 - DNA, 23 bp, Artificial sequence
  Reverse Primer
tttgcaaaatactgtctctaccc

SEQ ID NO: 12483 - DNA, 21 bp, Artificial sequence
  Reverse Primer
tttccagtttttgcctttacg

SEQ ID NO: 12484 - DNA, 19 bp, Artificial sequence
  Reverse Primer
tggtgtgcatggtacagtg

SEQ ID NO: 12485 - DNA, 22 bp, Artificial sequence
  Reverse Primer
acatgcacagcctcttctagtc

SEQ ID NO: 12486 - DNA, 19 bp, Artificial sequence
  Reverse Primer
tacctgtcttggcaatgga

SEQ ID NO: 12487 - DNA, 19 bp, Artificial sequence
  Reverse Primer
acgacagtcgcagctacag

SEQ ID NO: 12488 - DNA, 21 bp, Artificial sequence
  Reverse Primer
ttaattcttcacgtggctcac

SEQ ID NO: 12489 - DNA, 24 bp, Artificial sequence
  Reverse Primer
attcatttatttttgtagccttgc

SEQ ID NO: 12490 - DNA, 23 bp, Artificial sequence
  Reverse Primer
acaaatgtttattaaccaccagc

SEQ ID NO: 12491 - DNA, 29 bp, Artificial sequence
  Reverse Primer
agctccattcttatctgtcttagatatta

SEQ ID NO: 12492 - DNA, 24 bp, Artificial sequence
  Reverse Primer
attttcctgcagctaatctaattg

SEQ ID NO: 12493 - DNA, 24 bp, Artificial sequence
  Reverse Primer
attgagaagatctctttgagaagg

SEQ ID NO: 12494 - DNA, 21 bp, Artificial sequence
  Reverse Primer
attctttctcatyccacaccc

SEQ ID NO: 12495 - DNA, 18 bp, Artificial sequence
  Reverse Primer
tactgcgaaaggccagga

SEQ ID NO: 12496 - DNA, 28 bp, Artificial sequence
  Reverse Primer
ttattttaagtagaaatcttgacaagca

SEQ ID NO: 12497 - DNA, 20 bp, Artificial sequence
  Reverse Primer
attctttcagacaggctcca

SEQ ID NO: 12498 - DNA, 23 bp, Artificial sequence
  Reverse Primer
aaataagactgcaactgaatcca

SEQ ID NO: 12499 - DNA, 22 bp, Artificial sequence
  Reverse Primer
gaagttcatcatgactgcttcc

SEQ ID NO: 12500 - DNA, 25 bp, Artificial sequence
  Reverse Primer
cctatattamggcaaatatggagaa

SEQ ID NO: 12501 - DNA, 24 bp, Artificial sequence
  Reverse Primer
aaaagaagtaagatgcttttttcc

SEQ ID NO: 12502 - DNA, 24 bp, Artificial sequence
  Reverse Primer
taaatggaagaaaaaagagaaggc

SEQ ID NO: 12503 - DNA, 27 bp, Artificial sequence
  Reverse Primer
atatttcataacayaattctgcaagtg

SEQ ID NO: 12504 - DNA, 24 bp, Artificial sequence
  Reverse Primer
aaatttttcatttcctcaagttcc

SEQ ID NO: 12505 - DNA, 28 bp, Artificial sequence
  Reverse Primer
aatttactgagaaaaattaggtatggaa

SEQ ID NO: 12506 - DNA, 21 bp, Artificial sequence
  Reverse Primer
ctctccttggaaagacaaacc

SEQ ID NO: 12507 - DNA, 26 bp, Artificial sequence
  Reverse Primer
gttagaggaaagatttcaaaaattga

SEQ ID NO: 12508 - DNA, 20 bp, Artificial sequence
  Reverse Primer
tacaatgaaccctgcactcc

SEQ ID NO: 12509 - DNA, 21 bp, Artificial sequence
  Reverse Primer
aaggtggatctccaggaataa

SEQ ID NO: 12510 - DNA, 19 bp, Artificial sequence
  Reverse Primer
tccagtccaagtgaaggac

SEQ ID NO: 12511 - DNA, 24 bp, Artificial sequence
  Reverse Primer
yttggcttctcttctcagttttag

SEQ ID NO: 12512 - DNA, 24 bp, Artificial sequence
  Reverse Primer
tttgcaacataccaaatcactatg

SEQ ID NO: 12513 - DNA, 25 bp, Artificial sequence
  Reverse Primer
actttacagttgaatgaaatgagga

SEQ ID NO: 12514 - DNA, 29 bp, Artificial sequence
  Reverse Primer
tcagagttttgttctacttaaaaagtgta

SEQ ID NO: 12515 - DNA, 30 bp, Artificial sequence
  Reverse Primer
ataatgataacattrgtagtgagagatttg

SEQ ID NO: 12516 - DNA, 30 bp, Artificial sequence
  Reverse Primer
taacctctcttaagrttacattactctctt

SEQ ID NO: 12517 - DNA, 20 bp, Artificial sequence
  Reverse Primer
tttaaaacaacccagccaca

SEQ ID NO: 12518 - DNA, 18 bp, Artificial sequence
  Reverse Primer
tgacgcttggttatgcgg

SEQ ID NO: 12519 - DNA, 19 bp, Artificial sequence
  Reverse Primer
tgcactcacacagctgtca

SEQ ID NO: 12520 - DNA, 23 bp, Artificial sequence
  Reverse Primer
tacraagtgatgttttcactgct

SEQ ID NO: 12521 - DNA, 30 bp, Artificial sequence
  Reverse Primer
cattattattcaattagaaacttcctatta

SEQ ID NO: 12522 - DNA, 28 bp, Artificial sequence
  Reverse Primer
aatctgaaaaaagtgttataattgaggt

SEQ ID NO: 12523 - DNA, 18 bp, Artificial sequence
  Reverse Primer
gcactgcgagctaagctg

SEQ ID NO: 12524 - DNA, 21 bp, Artificial sequence
  Reverse Primer
gggtcagttgttgtcttcagc

SEQ ID NO: 12525 - DNA, 18 bp, Artificial sequence
  Reverse Primer
tacatgttggggggtgtt

SEQ ID NO: 12526 - DNA, 24 bp, Artificial sequence
  Reverse Primer
catttttacatttttygtcaaggt

SEQ ID NO: 12527 - DNA, 30 bp, Artificial sequence
  Reverse Primer
ttcatgttatatactgcatactatttcttt

SEQ ID NO: 12528 - DNA, 18 bp, Artificial sequence
  Reverse Primer
agcctcttcccagcagtg

SEQ ID NO: 12529 - DNA, 20 bp, Artificial sequence
  Reverse Primer
tattctccrtgccttcacct

SEQ ID NO: 12530 - DNA, 26 bp, Artificial sequence
  Reverse Primer
aagatagaagtagtctggatcacagg

SEQ ID NO: 12531 - DNA, 27 bp, Artificial sequence
  Reverse Primer
agttcttgcataaatcatatttcaact

SEQ ID NO: 12532 - DNA, 18 bp, Artificial sequence
  Reverse Primer
ttgggcactggggttatc

SEQ ID NO: 12533 - DNA, 23 bp, Artificial sequence
  Reverse Primer
atattctttcctctctcaggcag

SEQ ID NO: 12534 - DNA, 20 bp, Artificial sequence
  Reverse Primer
tgagatttaaggccaggttg

SEQ ID NO: 12535 - DNA, 24 bp, Artificial sequence
  Reverse Primer
atattattcgctttagtgcaggat

SEQ ID NO: 12536 - DNA, 23 bp, Artificial sequence
  Reverse Primer
tccttcaagagacaagaaatagc

SEQ ID NO: 12537 - DNA, 24 bp, Artificial sequence
  Reverse Primer
cactctttgattcttcaactgcta

SEQ ID NO: 12538 - DNA, 21 bp, Artificial sequence
  Reverse Primer
aattctgaaagcttgcgatct

SEQ ID NO: 12539 - DNA, 30 bp, Artificial sequence
  Reverse Primer
cattagtctatactgattaaaattttgctg

SEQ ID NO: 12540 - DNA, 20 bp, Artificial sequence
  Reverse Primer
aagggaatcccaagtggtag

SEQ ID NO: 12541 - DNA, 25 bp, Artificial sequence
  Reverse Primer
aaaactacatcagtggttctaagct

SEQ ID NO: 12542 - DNA, 21 bp, Artificial sequence
  Reverse Primer
aataggaaatcagccatggac

SEQ ID NO: 12543 - DNA, 27 bp, Artificial sequence
  Reverse Primer
ctacagttaaacagtgagaagctgtaa

SEQ ID NO: 12544 - DNA, 22 bp, Artificial sequence
  Reverse Primer
ctccaatgttgggtagatgttt

SEQ ID NO: 12545 - DNA, 18 bp, Artificial sequence
  Reverse Primer
aaccttgctcctacgcag

SEQ ID NO: 12546 - DNA, 25 bp, Artificial sequence
  Reverse Primer
ttttcttatgtaaaagaaggaagca

SEQ ID NO: 12547 - DNA, 18 bp, Artificial sequence
  Reverse Primer
ccagcatccccaactgta

SEQ ID NO: 12548 - DNA, 23 bp, Artificial sequence
  Reverse Primer
aatayagcccagaagtcagtttc

SEQ ID NO: 12549 - DNA, 19 bp, Artificial sequence
  Reverse Primer
aacgtgaatgtgctccaca

SEQ ID NO: 12550 - DNA, 20 bp, Artificial sequence
  Reverse Primer
acagcgcaaataccagctac

SEQ ID NO: 12551 - DNA, 26 bp, Artificial sequence
  Reverse Primer
aaaattctatgtgattcaccctaatg

SEQ ID NO: 12552 - DNA, 26 bp, Artificial sequence
  Reverse Primer
acctacaactacagctcagtttaacc

SEQ ID NO: 12553 - DNA, 19 bp, Artificial sequence
  Reverse Primer
tctcctacattgctgacgg

SEQ ID NO: 12554 - DNA, 23 bp, Artificial sequence
  Reverse Primer
ttcattgcttttcataatccaag

SEQ ID NO: 12555 - DNA, 23 bp, Artificial sequence
  Reverse Primer
aaccgtcttctgaaaggttctag

SEQ ID NO: 12556 - DNA, 26 bp, Artificial sequence
  Reverse Primer
aatttctatctttgtggtaggatagc

SEQ ID NO: 12557 - DNA, 26 bp, Artificial sequence
  Reverse Primer
ataatcagatgaagtattgaccagtg

SEQ ID NO: 12558 - DNA, 23 bp, Artificial sequence
  Reverse Primer
aatttattctttgccctgatttc

SEQ ID NO: 12559 - DNA, 18 bp, Artificial sequence
  Reverse Primer
cgctttgctgcactgagt

SEQ ID NO: 12560 - DNA, 21 bp, Artificial sequence
  Reverse Primer
tttcaaaggaagtgtcactgg

SEQ ID NO: 12561 - DNA, 26 bp, Artificial sequence
  Reverse Primer
attttagctccttgaatataagatcc

SEQ ID NO: 12562 - DNA, 27 bp, Artificial sequence
  Reverse Primer
aaaagtgatctctgtctgaatagagtc

SEQ ID NO: 12563 - DNA, 30 bp, Artificial sequence
  Reverse Primer
acattaaatagaaaatagacttgaagtgac

SEQ ID NO: 12564 - DNA, 25 bp, Artificial sequence
  Reverse Primer
ctgtagctatcagttaccatggttt

SEQ ID NO: 12565 - DNA, 28 bp, Artificial sequence
  Reverse Primer
tgtgtaatttatttgatgctaagttctt

SEQ ID NO: 12566 - DNA, 21 bp, Artificial sequence
  Reverse Primer
tagggagactcagggacattt

SEQ ID NO: 12567 - DNA, 26 bp, Artificial sequence
  Reverse Primer
aaattatttcattgctctctgacttc

SEQ ID NO: 12568 - DNA, 27 bp, Artificial sequence
  Reverse Primer
tttcataaacctgaagrtactaactga

SEQ ID NO: 12569 - DNA, 21 bp, Artificial sequence
  Reverse Primer
aactaccagggaagtccatca

SEQ ID NO: 12570 - DNA, 26 bp, Artificial sequence
  Reverse Primer
aaacaaaaagtctcagttaatccttt

SEQ ID NO: 12571 - DNA, 24 bp, Artificial sequence
  Reverse Primer
catttagggttttgtaggaaaaaa

SEQ ID NO: 12572 - DNA, 26 bp, Artificial sequence
  Reverse Primer
aacaattccacaatttcctagattaa

SEQ ID NO: 12573 - DNA, 18 bp, Artificial sequence
  Reverse Primer
tgggcaytggctccttca

SEQ ID NO: 12574 - DNA, 28 bp, Artificial sequence
  Reverse Primer
ttaataaatacttaaaggctagcaatga

SEQ ID NO: 12575 - DNA, 23 bp, Artificial sequence
  Reverse Primer
aaacctggctcacataataggtt

SEQ ID NO: 12576 - DNA, 20 bp, Artificial sequence
  Reverse Primer
aaattgcttcagggaacagg

SEQ ID NO: 12577 - DNA, 30 bp, Artificial sequence
  Reverse Primer
cttatttattctaaatagtagattataagt

SEQ ID NO: 12578 - DNA, 23 bp, Artificial sequence
  Reverse Primer
ttggggcatattatgtttacaca

SEQ ID NO: 12579 - DNA, 19 bp, Artificial sequence
  Reverse Primer
ttaaatccttccgcgtctg

SEQ ID NO: 12580 - DNA, 21 bp, Artificial sequence
  Reverse Primer
atttaacttggtccaagaggg

SEQ ID NO: 12581 - DNA, 20 bp, Artificial sequence
  Reverse Primer
ttagaactggccttttctgg

SEQ ID NO: 12582 - DNA, 30 bp, Artificial sequence
  Reverse Primer
cactttattaattgagaagattatatacct

SEQ ID NO: 12583 - DNA, 20 bp, Artificial sequence
  Reverse Primer
atttcagcaggtgtggtctg

SEQ ID NO: 12584 - DNA, 24 bp, Artificial sequence
  Reverse Primer
caaatttttaaatgttggcaacta

SEQ ID NO: 12585 - DNA, 23 bp, Artificial sequence
  Reverse Primer
atcacaggatcttccatacctct

SEQ ID NO: 12586 - DNA, 25 bp, Artificial sequence
  Reverse Primer
actctgttttggrttattctctttg

SEQ ID NO: 12587 - DNA, 24 bp, Artificial sequence
  Reverse Primer
aatgtttttagaaaagacccactc

SEQ ID NO: 12588 - DNA, 18 bp, Artificial sequence
  Reverse Primer
atagggcgatccagtgag

SEQ ID NO: 12589 - DNA, 24 bp, Artificial sequence
  Reverse Primer
tgagattgtggaatcaacatattg

SEQ ID NO: 12590 - DNA, 20 bp, Artificial sequence
  Reverse Primer
tctgaagtctgattgccacc

SEQ ID NO: 12591 - DNA, 26 bp, Artificial sequence
  Reverse Primer
tgattagaactgactaactttctcga

SEQ ID NO: 12592 - DNA, 25 bp, Artificial sequence
  Reverse Primer
gctgaaaaggaaatatgtaggtttt

SEQ ID NO: 12593 - DNA, 24 bp, Artificial sequence
  Reverse Primer
tcttaaccatgttcaagatcagaa

SEQ ID NO: 12594 - DNA, 22 bp, Artificial sequence
  Reverse Primer
ttttccactgtagctcatcaca

SEQ ID NO: 12595 - DNA, 23 bp, Artificial sequence
  Reverse Primer
atttcctactccaactctcctgt

SEQ ID NO: 12596 - DNA, 22 bp, Artificial sequence
  Reverse Primer
aaacagtccttttagttcccag

SEQ ID NO: 12597 - DNA, 28 bp, Artificial sequence
  Reverse Primer
taaaaacttttcttttactttatctggc

SEQ ID NO: 12598 - DNA, 26 bp, Artificial sequence
  Reverse Primer
ttgagctgtgtcttaaaattgttatt

SEQ ID NO: 12599 - DNA, 27 bp, Artificial sequence
  Reverse Primer
tgtatggctttatgataccatttaatt

SEQ ID NO: 12600 - DNA, 18 bp, Artificial sequence
  Reverse Primer
cccaaggcacttgcaaac

SEQ ID NO: 12601 - DNA, 30 bp, Artificial sequence
  Reverse Primer
gtataagggaactttcattaacttacatat

SEQ ID NO: 12602 - DNA, 18 bp, Artificial sequence
  Reverse Primer
atcaaccaccccaatccc

SEQ ID NO: 12603 - DNA, 30 bp, Artificial sequence
  Reverse Primer
aatatcaagtcagtactgtttaaaggatac

SEQ ID NO: 12604 - DNA, 29 bp, Artificial sequence
  Reverse Primer
actatttgtaaagttaataacatgggaca

SEQ ID NO: 12605 - DNA, 30 bp, Artificial sequence
  Reverse Primer
tattttcctccatatataactatcactttc

SEQ ID NO: 12606 - DNA, 22 bp, Artificial sequence
  Reverse Primer
ctctgtctaaagaagtgtgggg

SEQ ID NO: 12607 - DNA, 27 bp, Artificial sequence
  Reverse Primer
aaaagcttacttttagaagaatttcag

SEQ ID NO: 12608 - DNA, 22 bp, Artificial sequence
  Reverse Primer
aaggatgctgtataaggcagac

SEQ ID NO: 12609 - DNA, 18 bp, Artificial sequence
  Reverse Primer
aacacacacggggtggaa

SEQ ID NO: 12610 - DNA, 19 bp, Artificial sequence
  Reverse Primer
aacaggaggtttcaggtgc

SEQ ID NO: 12611 - DNA, 24 bp, Artificial sequence
  Reverse Primer
tactractgcggatataggatttg

SEQ ID NO: 12612 - DNA, 21 bp, Artificial sequence
  Reverse Primer
taaattcagtatgctgtggcc

SEQ ID NO: 12613 - DNA, 21 bp, Artificial sequence
  Reverse Primer
acggccaaaaataaaaatcaa

SEQ ID NO: 12614 - DNA, 19 bp, Artificial sequence
  Reverse Primer
tcatgacctgaaaaacgca

SEQ ID NO: 12615 - DNA, 23 bp, Artificial sequence
  Reverse Primer
ttccctaagtgcctatrgttctc

SEQ ID NO: 12616 - DNA, 19 bp, Artificial sequence
  Reverse Primer
ttacattccactccctccc

SEQ ID NO: 12617 - DNA, 18 bp, Artificial sequence
  Reverse Primer
tgggggttggagagggat

SEQ ID NO: 12618 - DNA, 22 bp, Artificial sequence
  Reverse Primer
taaaaccatccaggtaggttga

SEQ ID NO: 12619 - DNA, 18 bp, Artificial sequence
  Reverse Primer
tgaagagatggacggggt

SEQ ID NO: 12620 - DNA, 24 bp, Artificial sequence
  Reverse Primer
tttaaaatcctgcctactaaagga

SEQ ID NO: 12621 - DNA, 27 bp, Artificial sequence
  Reverse Primer
catacttactctgttcttcagatgaaa

SEQ ID NO: 12622 - DNA, 26 bp, Artificial sequence
  Reverse Primer
taactttaaaggacaattctgagaag

SEQ ID NO: 12623 - DNA, 26 bp, Artificial sequence
  Reverse Primer
taatagagttaatgccacaaatatgg

SEQ ID NO: 12624 - DNA, 24 bp, Artificial sequence
  Reverse Primer
tagagattgttacacccaaattga

SEQ ID NO: 12625 - DNA, 21 bp, Artificial sequence
  Reverse Primer
aagcacaaaactctgaggtgg

SEQ ID NO: 12626 - DNA, 25 bp, Artificial sequence
  Reverse Primer
tgtattyactgacattgtgttttga

SEQ ID NO: 12627 - DNA, 18 bp, Artificial sequence
  Reverse Primer
tgaaggcgaaaagaacgg

SEQ ID NO: 12628 - DNA, 28 bp, Artificial sequence
  Reverse Primer
aagatgtggagattaagtggtatatttt

SEQ ID NO: 12629 - DNA, 24 bp, Artificial sequence
  Reverse Primer
taaagggcttattcttgttcactc

SEQ ID NO: 12630 - DNA, 24 bp, Artificial sequence
  Reverse Primer
attatttggattctcataaccagc

SEQ ID NO: 12631 - DNA, 26 bp, Artificial sequence
  Reverse Primer
agaaataagcctaagcttaaacacac

SEQ ID NO: 12632 - DNA, 30 bp, Artificial sequence
  Reverse Primer
tgttgtcaatataaatagtaccattagaag

SEQ ID NO: 12633 - DNA, 24 bp, Artificial sequence
  Reverse Primer
ttaaatagccctttcactcaactt

SEQ ID NO: 12634 - DNA, 29 bp, Artificial sequence
  Reverse Primer
atttaaacttyactcccttagaaatattg

SEQ ID NO: 12635 - DNA, 27 bp, Artificial sequence
  Reverse Primer
tattaacctttattccttgagtctgaa

SEQ ID NO: 12636 - DNA, 23 bp, Artificial sequence
  Reverse Primer
ttggaacaaaatgaaaatgtgtt

SEQ ID NO: 12637 - DNA, 19 bp, Artificial sequence
  Reverse Primer
tgattatcttcatcggggc

SEQ ID NO: 12638 - DNA, 25 bp, Artificial sequence
  Reverse Primer
agttagcaacatttgaacatctagg

SEQ ID NO: 12639 - DNA, 25 bp, Artificial sequence
  Reverse Primer
atttgaaaaacaaaaaggagatctg

SEQ ID NO: 12640 - DNA, 25 bp, Artificial sequence
  Reverse Primer
tgcttggtttttgttttactagatt

SEQ ID NO: 12641 - DNA, 19 bp, Artificial sequence
  Reverse Primer
gagagcaggtgtgttgacc

SEQ ID NO: 12642 - DNA, 24 bp, Artificial sequence
  Reverse Primer
tttcaaaaacaaaacactttcttg

SEQ ID NO: 12643 - DNA, 22 bp, Artificial sequence
  Reverse Primer
tgacacctgtgactggtcttat

SEQ ID NO: 12644 - DNA, 24 bp, Artificial sequence
  Reverse Primer
aatagctgactaatacagtgtggg

SEQ ID NO: 12645 - DNA, 27 bp, Artificial sequence
  Reverse Primer
tgaaatagtgaataatgacttgaaagg

SEQ ID NO: 12646 - DNA, 28 bp, Artificial sequence
  Reverse Primer
tctagctaactcagttctaagagagaag

SEQ ID NO: 12647 - DNA, 23 bp, Artificial sequence
  Reverse Primer
tttattcagaaagaatagggcct

SEQ ID NO: 12648 - DNA, 19 bp, Artificial sequence
  Reverse Primer
ttcaaatccagttctgcca

SEQ ID NO: 12649 - DNA, 28 bp, Artificial sequence
  Reverse Primer
tcaacttaaagcatactctcttattctc

SEQ ID NO: 12650 - DNA, 24 bp, Artificial sequence
  Reverse Primer
attagaatgagcacagtgaaggtt

SEQ ID NO: 12651 - DNA, 23 bp, Artificial sequence
  Reverse Primer
tccatcttctttgaatttgatca

SEQ ID NO: 12652 - DNA, 23 bp, Artificial sequence
  Reverse Primer
attaaagtatcaggctgtggtgc

SEQ ID NO: 12653 - DNA, 24 bp, Artificial sequence
  Reverse Primer
taaaacactggtatccaaacatga

SEQ ID NO: 12654 - DNA, 30 bp, Artificial sequence
  Reverse Primer
taatagtgttaactattctaaaaaggaaaa

SEQ ID NO: 12655 - DNA, 18 bp, Artificial sequence
  Reverse Primer
tgcaagctctccatccac

SEQ ID NO: 12656 - DNA, 27 bp, Artificial sequence
  Reverse Primer
tattatgtcaggaactattccaggtac

SEQ ID NO: 12657 - DNA, 24 bp, Artificial sequence
  Reverse Primer
aaagcctgaaaaagtgataactct

SEQ ID NO: 12658 - DNA, 21 bp, Artificial sequence
  Reverse Primer
attcctccacgctctcataga

SEQ ID NO: 12659 - DNA, 26 bp, Artificial sequence
  Reverse Primer
tttttaatttctagccaaaacactct

SEQ ID NO: 12660 - DNA, 21 bp, Artificial sequence
  Reverse Primer
tttgttttgctagccaatctg

SEQ ID NO: 12661 - DNA, 21 bp, Artificial sequence
  Reverse Primer
cctaggttcaaaacccatgtc

SEQ ID NO: 12662 - DNA, 24 bp, Artificial sequence
  Reverse Primer
gtcagatgatggaatactgttcat

SEQ ID NO: 12663 - DNA, 20 bp, Artificial sequence
  Reverse Primer
cacacacacacctagcaacc

SEQ ID NO: 12664 - DNA, 19 bp, Artificial sequence
  Reverse Primer
atcctgaaggaagacgctg

SEQ ID NO: 12665 - DNA, 22 bp, Artificial sequence
  Reverse Primer
ttttaaaaaaacgattgatggc

SEQ ID NO: 12666 - DNA, 24 bp, Artificial sequence
  Reverse Primer
atatgtgtgtccttttgaatcatg

SEQ ID NO: 12667 - DNA, 25 bp, Artificial sequence
  Reverse Primer
taaatggaattactggamaagtacc

SEQ ID NO: 12668 - DNA, 30 bp, Artificial sequence
  Reverse Primer
ataaaccacctataataagaatagaaaata

SEQ ID NO: 12669 - DNA, 24 bp, Artificial sequence
  Reverse Primer
tatgaycattttggctcttgtatt

SEQ ID NO: 12670 - DNA, 28 bp, Artificial sequence
  Reverse Primer
tacataatatgttagctgataattgcaa

SEQ ID NO: 12671 - DNA, 23 bp, Artificial sequence
  Reverse Primer
tgcatgacattcatatttcagtc

SEQ ID NO: 12672 - DNA, 18 bp, Artificial sequence
  Reverse Primer
tttttgctgccacaggaa

SEQ ID NO: 12673 - DNA, 18 bp, Artificial sequence
  Reverse Primer
tcagaaggcacccctttt

SEQ ID NO: 12674 - DNA, 30 bp, Artificial sequence
  Reverse Primer
tagctcttaaaatttagtatatttctgttt

SEQ ID NO: 12675 - DNA, 26 bp, Artificial sequence
  Reverse Primer
aaaagaacatagaggccatattgtat

SEQ ID NO: 12676 - DNA, 19 bp, Artificial sequence
  Reverse Primer
ccaacagccacracatatc

SEQ ID NO: 12677 - DNA, 23 bp, Artificial sequence
  Reverse Primer
ctggaaagcaatttatgagacaa

SEQ ID NO: 12678 - DNA, 20 bp, Artificial sequence
  Reverse Primer
tgatcaggattttgctgaca

SEQ ID NO: 12679 - DNA, 27 bp, Artificial sequence
  Reverse Primer
aagtatgtatgtagcattgatcagacc

SEQ ID NO: 12680 - DNA, 22 bp, Artificial sequence
  Reverse Primer
attctgatttcagaacagtccc

SEQ ID NO: 12681 - DNA, 20 bp, Artificial sequence
  Reverse Primer
agatccttgtcatgccaact

SEQ ID NO: 12682 - DNA, 30 bp, Artificial sequence
  Reverse Primer
attgaatcaacaggtagtaataaagtacag

SEQ ID NO: 12683 - DNA, 23 bp, Artificial sequence
  Reverse Primer
tatttcatctgctttccctgtag

SEQ ID NO: 12684 - DNA, 27 bp, Artificial sequence
  Reverse Primer
tgaggattttacattttctttgatagt

SEQ ID NO: 12685 - DNA, 29 bp, Artificial sequence
  Reverse Primer
gatggaaaacctaaatacttttagatatg

SEQ ID NO: 12686 - DNA, 28 bp, Artificial sequence
  Reverse Primer
tttatccttcaatctcatctacaaatat

SEQ ID NO: 12687 - DNA, 23 bp, Artificial sequence
  Reverse Primer
atatccagcattccayaaaagag

SEQ ID NO: 12688 - DNA, 27 bp, Artificial sequence
  Reverse Primer
attatctcaggtcttgtaaaaattctc

SEQ ID NO: 12689 - DNA, 21 bp, Artificial sequence
  Reverse Primer
catgacaaggaattatccagc

SEQ ID NO: 12690 - DNA, 24 bp, Artificial sequence
  Reverse Primer
aattagggcgattacaaactagtg

SEQ ID NO: 12691 - DNA, 19 bp, Artificial sequence
  Reverse Primer
tatgcatggggctttaaca

SEQ ID NO: 12692 - DNA, 30 bp, Artificial sequence
  Reverse Primer
gatcctcattgatattctatttcatatata

SEQ ID NO: 12693 - DNA, 28 bp, Artificial sequence
  Reverse Primer
tagcagattataattgaagatgttttca

SEQ ID NO: 12694 - DNA, 30 bp, Artificial sequence
  Reverse Primer
ttttcaagatataatagaagtgtggttagt

SEQ ID NO: 12695 - DNA, 30 bp, Artificial sequence
  Reverse Primer
ttactccaggtaataaatgcttaattatac

SEQ ID NO: 12696 - DNA, 27 bp, Artificial sequence
  Reverse Primer
gattctaatttaggttgcattaaatca

SEQ ID NO: 12697 - DNA, 24 bp, Artificial sequence
  Reverse Primer
ttaaagtgtgcaagttcaaacact

SEQ ID NO: 12698 - DNA, 24 bp, Artificial sequence
  Reverse Primer
agcatccaattcgtgtactataag

SEQ ID NO: 12699 - DNA, 28 bp, Artificial sequence
  Reverse Primer
atttcaaaatacattaatcctagattgg

SEQ ID NO: 12700 - DNA, 21 bp, Artificial sequence
  Reverse Primer
acaccagagacatcctgaaag

SEQ ID NO: 12701 - DNA, 19 bp, Artificial sequence
  Reverse Primer
ttgcatacgtgggtttagg

SEQ ID NO: 12702 - DNA, 25 bp, Artificial sequence
  Reverse Primer
ataactctgttgccatttgattaga

SEQ ID NO: 12703 - DNA, 23 bp, Artificial sequence
  Reverse Primer
aaaagctaccgactctctttgag

SEQ ID NO: 12704 - DNA, 26 bp, Artificial sequence
  Reverse Primer
agtatgtttcagtttcacctaatcag

SEQ ID NO: 12705 - DNA, 24 bp, Artificial sequence
  Reverse Primer
aaatttaggttcatggtttcaaag

SEQ ID NO: 12706 - DNA, 25 bp, Artificial sequence
  Reverse Primer
tacaactctcgtagtaatgtcagcc

SEQ ID NO: 12707 - DNA, 27 bp, Artificial sequence
  Reverse Primer
aaagtaaagggtggtaagagtttttaa

SEQ ID NO: 12708 - DNA, 26 bp, Artificial sequence
  Reverse Primer
aggtttatttttgtctacatgaaggt

SEQ ID NO: 12709 - DNA, 26 bp, Artificial sequence
  Reverse Primer
tgatgacagtataaagcaagatttct

SEQ ID NO: 12710 - DNA, 20 bp, Artificial sequence
  Reverse Primer
gaagatggaagaggggaaga

SEQ ID NO: 12711 - DNA, 24 bp, Artificial sequence
  Reverse Primer
tcaccacaaaaaacagaataaaac

SEQ ID NO: 12712 - DNA, 18 bp, Artificial sequence
  Reverse Primer
cgcctgaaaccgtctcat

SEQ ID NO: 12713 - DNA, 24 bp, Artificial sequence
  Reverse Primer
ctaaccattagatgacactgctca

SEQ ID NO: 12714 - DNA, 24 bp, Artificial sequence
  Reverse Primer
tgcacatttgttttaaagatttct

SEQ ID NO: 12715 - DNA, 27 bp, Artificial sequence
  Reverse Primer
ttttattctttagcttcttagaatggg

SEQ ID NO: 12716 - DNA, 28 bp, Artificial sequence
  Reverse Primer
atttttctgtaagttagaactatttgca

SEQ ID NO: 12717 - DNA, 19 bp, Artificial sequence
  Reverse Primer
attctttgggcgtttacca

SEQ ID NO: 12718 - DNA, 24 bp, Artificial sequence
  Reverse Primer
tttgtgtgaaaattattgctgaag

SEQ ID NO: 12719 - DNA, 24 bp, Artificial sequence
  Reverse Primer
actctcactatgcacacttcactg

SEQ ID NO: 12720 - DNA, 21 bp, Artificial sequence
  Reverse Primer
tagacaagcaaagaaacgctc

SEQ ID NO: 12721 - DNA, 26 bp, Artificial sequence
  Reverse Primer
aagaaaaccagacatctgaagttagt

SEQ ID NO: 12722 - DNA, 20 bp, Artificial sequence
  Reverse Primer
actttcgacctttaaacgcg

SEQ ID NO: 12723 - DNA, 19 bp, Artificial sequence
  Reverse Primer
ttttggctttgctgatttg

SEQ ID NO: 12724 - DNA, 24 bp, Artificial sequence
  Reverse Primer
atattagagtcagaccggcagtaa

SEQ ID NO: 12725 - DNA, 27 bp, Artificial sequence
  Reverse Primer
taagggagtggttctaagattttaatt

SEQ ID NO: 12726 - DNA, 28 bp, Artificial sequence
  Reverse Primer
tataatagaagatgttccctacactcac

SEQ ID NO: 12727 - DNA, 26 bp, Artificial sequence
  Reverse Primer
tttctaaatgtttgaaggtagattgg

SEQ ID NO: 12728 - DNA, 24 bp, Artificial sequence
  Reverse Primer
aaagaaatgttaggcatgaaaaaa

SEQ ID NO: 12729 - DNA, 24 bp, Artificial sequence
  Reverse Primer
actattcaacttttttgcaggatt

SEQ ID NO: 12730 - DNA, 18 bp, Artificial sequence
  Reverse Primer
tggcgagaaccctatcca

SEQ ID NO: 12731 - DNA, 28 bp, Artificial sequence
  Reverse Primer
cattgtgtttagataactttcaatcact

SEQ ID NO: 12732 - DNA, 23 bp, Artificial sequence
  Reverse Primer
aagtgagccttttattgcatttt

SEQ ID NO: 12733 - DNA, 21 bp, Artificial sequence
  Reverse Primer
ttatttgtcatgagagccctg

SEQ ID NO: 12734 - DNA, 28 bp, Artificial sequence
  Reverse Primer
atcctagtacaataggaaactggactaa

SEQ ID NO: 12735 - DNA, 30 bp, Artificial sequence
  Reverse Primer
aaatatccagtaattatcaactattgctac

SEQ ID NO: 12736 - DNA, 27 bp, Artificial sequence
  Reverse Primer
aataagaaagaaaccaaacttctacag

SEQ ID NO: 12737 - DNA, 22 bp, Artificial sequence
  Reverse Primer
aaatttggaaaccatgaacatc

SEQ ID NO: 12738 - DNA, 28 bp, Artificial sequence
  Reverse Primer
tatctaagtttycacatttaagtcatca

SEQ ID NO: 12739 - DNA, 28 bp, Artificial sequence
  Reverse Primer
atttcttttactttcctttctattcctt

SEQ ID NO: 12740 - DNA, 25 bp, Artificial sequence
  Reverse Primer
atctagctctgctgtctcttagagg

SEQ ID NO: 12741 - DNA, 20 bp, Artificial sequence
  Reverse Primer
atcgtgaagttcccatgtca

SEQ ID NO: 12742 - DNA, 28 bp, Artificial sequence
  Reverse Primer
atttaattttctcaaygctgtaagatag

SEQ ID NO: 12743 - DNA, 21 bp, Artificial sequence
  Reverse Primer
accttctaccagctcactcct

SEQ ID NO: 12744 - DNA, 18 bp, Artificial sequence
  Reverse Primer
agctgtggcctcagcaca

SEQ ID NO: 12745 - DNA, 27 bp, Artificial sequence
  Reverse Primer
attcgtacttcctatattttatgtcca

SEQ ID NO: 12746 - DNA, 19 bp, Artificial sequence
  Reverse Primer
aattcatgttgggcactgg

SEQ ID NO: 12747 - DNA, 22 bp, Artificial sequence
  Reverse Primer
tcaaaggaattgctcttgagtc

SEQ ID NO: 12748 - DNA, 21 bp, Artificial sequence
  Reverse Primer
ttgaaatgtacacaggacggt

SEQ ID NO: 12749 - DNA, 27 bp, Artificial sequence
  Reverse Primer
agatgaaactgaatacctagagactca

SEQ ID NO: 12750 - DNA, 23 bp, Artificial sequence
  Reverse Primer
cttgatagcayttctgtgaggag

SEQ ID NO: 12751 - DNA, 22 bp, Artificial sequence
  Reverse Primer
ttgttctctttaaagtttggcc

SEQ ID NO: 12752 - DNA, 26 bp, Artificial sequence
  Reverse Primer
gaaccagaaaagagaatgtaattgtt

SEQ ID NO: 12753 - DNA, 18 bp, Artificial sequence
  Reverse Primer
ctccctccccaccaatcc

SEQ ID NO: 12754 - DNA, 22 bp, Artificial sequence
  Reverse Primer
tttgttagcatctctgtgtccc

SEQ ID NO: 12755 - DNA, 23 bp, Artificial sequence
  Reverse Primer
aagaaacaatagtgcctcaaaca

SEQ ID NO: 12756 - DNA, 25 bp, Artificial sequence
  Reverse Primer
aataaattctccttggagttcagtg

SEQ ID NO: 12757 - DNA, 28 bp, Artificial sequence
  Reverse Primer
gacttgttaattaaccttcattttaagg

SEQ ID NO: 12758 - DNA, 24 bp, Artificial sequence
  Reverse Primer
aatcagtgtgaagttgcaatactg

SEQ ID NO: 12759 - DNA, 22 bp, Artificial sequence
  Reverse Primer
ggtaataagctggtcaagagca

SEQ ID NO: 12760 - DNA, 23 bp, Artificial sequence
  Reverse Primer
aatatttgctgagcacctactgt

SEQ ID NO: 12761 - DNA, 20 bp, Artificial sequence
  Reverse Primer
taccagctaattttcctggg

SEQ ID NO: 12762 - DNA, 20 bp, Artificial sequence
  Reverse Primer
atgtatgggatccaygtcca

SEQ ID NO: 12763 - DNA, 30 bp, Artificial sequence
  Reverse Primer
tatacatttagatttatgagggaattagaa

SEQ ID NO: 12764 - DNA, 24 bp, Artificial sequence
  Reverse Primer
attcagtaaaagtgagaatgaggg

SEQ ID NO: 12765 - DNA, 27 bp, Artificial sequence
  Reverse Primer
aaaagattcattttagaaacacacagt

SEQ ID NO: 12766 - DNA, 22 bp, Artificial sequence
  Reverse Primer
ttgtttcaggtcagtgagaaaa

SEQ ID NO: 12767 - DNA, 27 bp, Artificial sequence
  Reverse Primer
atagagagggagaaagaaaaatatgaa

SEQ ID NO: 12768 - DNA, 22 bp, Artificial sequence
  Reverse Primer
attctgctcctaacttcagcac

SEQ ID NO: 12769 - DNA, 29 bp, Artificial sequence
  Reverse Primer
caacattatctacatgtcaagttacctaa

SEQ ID NO: 12770 - DNA, 19 bp, Artificial sequence
  Reverse Primer
aaactgagctatgctggcc

SEQ ID NO: 12771 - DNA, 18 bp, Artificial sequence
  Reverse Primer
gcttcagggtggaggaac

SEQ ID NO: 12772 - DNA, 26 bp, Artificial sequence
  Reverse Primer
cttcagttatagattaacttggggaa

SEQ ID NO: 12773 - DNA, 20 bp, Artificial sequence
  Reverse Primer
gagaacccggaatcaagact

SEQ ID NO: 12774 - DNA, 22 bp, Artificial sequence
  Reverse Primer
aggagggacaatgaagactttt

SEQ ID NO: 12775 - DNA, 28 bp, Artificial sequence
  Reverse Primer
taaatgggtcagtattaacagaaattaa

SEQ ID NO: 12776 - DNA, 28 bp, Artificial sequence
  Reverse Primer
ggaaaatacatcttctcaatctcatata

SEQ ID NO: 12777 - DNA, 18 bp, Artificial sequence
  Reverse Primer
gagacggaggagagccca

SEQ ID NO: 12778 - DNA, 30 bp, Artificial sequence
  Reverse Primer
acatgtatataattttctattcctgttctc

SEQ ID NO: 12779 - DNA, 25 bp, Artificial sequence
  Reverse Primer
ttaaatctatttaaaggggcagttc

SEQ ID NO: 12780 - DNA, 18 bp, Artificial sequence
  Reverse Primer
tgcgagcctgggaatccg

SEQ ID NO: 12781 - DNA, 20 bp, Artificial sequence
  Reverse Primer
atgctcagttcctcccactt

SEQ ID NO: 12782 - DNA, 22 bp, Artificial sequence
  Reverse Primer
aagaaacctcagaatgggattc

SEQ ID NO: 12783 - DNA, 29 bp, Artificial sequence
  Reverse Primer
aaaactcttaatttctttctgtctctatg

SEQ ID NO: 12784 - DNA, 27 bp, Artificial sequence
  Reverse Primer
tattctttcactggttaatcttctgtc

SEQ ID NO: 12785 - DNA, 25 bp, Artificial sequence
  Reverse Primer
ataagaaatttggaaagaaaacagg

SEQ ID NO: 12786 - DNA, 18 bp, Artificial sequence
  Reverse Primer
tgcccattggtttcctaa

SEQ ID NO: 12787 - DNA, 20 bp, Artificial sequence
  Reverse Primer
ttcagcaagtcttcagtccc

SEQ ID NO: 12788 - DNA, 18 bp, Artificial sequence
  Reverse Primer
aaaacctgcccaaaagga

SEQ ID NO: 12789 - DNA, 23 bp, Artificial sequence
  Reverse Primer
tcattctcatcaygacagtaggt

SEQ ID NO: 12790 - DNA, 25 bp, Artificial sequence
  Reverse Primer
aataatggttgcctaattagtacgg

SEQ ID NO: 12791 - DNA, 26 bp, Artificial sequence
  Reverse Primer
caatgaaactagaatgagttcagtca

SEQ ID NO: 12792 - DNA, 18 bp, Artificial sequence
  Reverse Primer
ccttgctgcgaggagatg

SEQ ID NO: 12793 - DNA, 27 bp, Artificial sequence
  Reverse Primer
aaattttaatgagttttaagtatggcc

SEQ ID NO: 12794 - DNA, 20 bp, Artificial sequence
  Reverse Primer
tcagtaaaacttcaccggca

SEQ ID NO: 12795 - DNA, 21 bp, Artificial sequence
  Reverse Primer
ttgaagtatgcctccactgat

SEQ ID NO: 12796 - DNA, 20 bp, Artificial sequence
  Reverse Primer
ccttctcagcagagaccaaa

SEQ ID NO: 12797 - DNA, 25 bp, Artificial sequence
  Reverse Primer
ttggtcatttcaagattatttcact

SEQ ID NO: 12798 - DNA, 22 bp, Artificial sequence
  Reverse Primer
attcaagctgaagttctgttgc

SEQ ID NO: 12799 - DNA, 24 bp, Artificial sequence
  Reverse Primer
atatcaaaacctgtaaratgccat

SEQ ID NO: 12800 - DNA, 18 bp, Artificial sequence
  Reverse Primer
tcaagaggctgcccccta

SEQ ID NO: 12801 - DNA, 19 bp, Artificial sequence
  Reverse Primer
aaactttggtcaggctccc

SEQ ID NO: 12802 - DNA, 30 bp, Artificial sequence
  Reverse Primer
aataacttgcttcatttaactatatgtctg

SEQ ID NO: 12803 - DNA, 30 bp, Artificial sequence
  Reverse Primer
atagtttagagacttacatgttttgaattc

SEQ ID NO: 12804 - DNA, 30 bp, Artificial sequence
  Reverse Primer
aatattccacttattactagtcctattcta

SEQ ID NO: 12805 - DNA, 19 bp, Artificial sequence
  Reverse Primer
aaatctgcatccccaagtc

SEQ ID NO: 12806 - DNA, 23 bp, Artificial sequence
  Reverse Primer
attcccaagtcacaagtaaatgg

SEQ ID NO: 12807 - DNA, 21 bp, Artificial sequence
  Reverse Primer
tgctagactctttgaagctcg

SEQ ID NO: 12808 - DNA, 21 bp, Artificial sequence
  Reverse Primer
ttttccccaaccatctctatt

SEQ ID NO: 12809 - DNA, 27 bp, Artificial sequence
  Reverse Primer
cctcaaattaacataccattgtttatc

SEQ ID NO: 12810 - DNA, 27 bp, Artificial sequence
  Reverse Primer
aatcattctatgaagtaggttctaccg

SEQ ID NO: 12811 - DNA, 18 bp, Artificial sequence
  Reverse Primer
aaggtaaagggggcacag

SEQ ID NO: 12812 - DNA, 21 bp, Artificial sequence
  Reverse Primer
tggtggtccctataccagagt

SEQ ID NO: 12813 - DNA, 30 bp, Artificial sequence
  Reverse Primer
tctcagaagaaattagttgtttattatata

SEQ ID NO: 12814 - DNA, 25 bp, Artificial sequence
  Reverse Primer
ttatttatcaaagactggaatgctg

SEQ ID NO: 12815 - DNA, 30 bp, Artificial sequence
  Reverse Primer
ttgttatatattttcaggtacgtataccat

SEQ ID NO: 12816 - DNA, 21 bp, Artificial sequence
  Reverse Primer
atttgttgcraaatgtttgct

SEQ ID NO: 12817 - DNA, 25 bp, Artificial sequence
  Reverse Primer
cttcaaagactgcagtagaagactc

SEQ ID NO: 12818 - DNA, 19 bp, Artificial sequence
  Reverse Primer
atccctggggctagaaatc

SEQ ID NO: 12819 - DNA, 20 bp, Artificial sequence
  Reverse Primer
ttccacacaactgcaagatt

SEQ ID NO: 12820 - DNA, 24 bp, Artificial sequence
  Reverse Primer
aagaaactgaggcataagacttca

SEQ ID NO: 12821 - DNA, 30 bp, Artificial sequence
  Reverse Primer
ataattacatcttcattgtaggattttata

SEQ ID NO: 12822 - DNA, 22 bp, Artificial sequence
  Reverse Primer
tgttcaaagttctcactcctgg

SEQ ID NO: 12823 - DNA, 26 bp, Artificial sequence
  Reverse Primer
gaatatgataaagaacaaaatggaca

SEQ ID NO: 12824 - DNA, 24 bp, Artificial sequence
  Reverse Primer
ctccaactattctcagattcctct

SEQ ID NO: 12825 - DNA, 23 bp, Artificial sequence
  Reverse Primer
aacctcttttttcattaccactg

SEQ ID NO: 12826 - DNA, 20 bp, Artificial sequence
  Reverse Primer
tytgctgcctgtaaactgtg

SEQ ID NO: 12827 - DNA, 22 bp, Artificial sequence
  Reverse Primer
taatctaattgcacctcctccc

SEQ ID NO: 12828 - DNA, 18 bp, Artificial sequence
  Reverse Primer
accttccagtccccggct

SEQ ID NO: 12829 - DNA, 21 bp, Artificial sequence
  Reverse Primer
tatcaagaaggagtgtggcaa

SEQ ID NO: 12830 - DNA, 24 bp, Artificial sequence
  Reverse Primer
carcattcagaggttcagaaatat

SEQ ID NO: 12831 - DNA, 21 bp, Artificial sequence
  Reverse Primer
aaagaggggctgtttatgcta

SEQ ID NO: 12832 - DNA, 18 bp, Artificial sequence
  Reverse Primer
ggccattcaatgtccctg

SEQ ID NO: 12833 - DNA, 24 bp, Artificial sequence
  Reverse Primer
agttagaaatgctttggtttgaga

SEQ ID NO: 12834 - DNA, 18 bp, Artificial sequence
  Reverse Primer
ttctttaccgccagcgcc

SEQ ID NO: 12835 - DNA, 28 bp, Artificial sequence
  Reverse Primer
tttactgtgaaataatgtactccacttg

SEQ ID NO: 12836 - DNA, 19 bp, Artificial sequence
  Reverse Primer
aaaagtccctgccctaatg

SEQ ID NO: 12837 - DNA, 25 bp, Artificial sequence
  Reverse Primer
aaagggaactaagtcacaataaacc

SEQ ID NO: 12838 - DNA, 19 bp, Artificial sequence
  Reverse Primer
cacttgatcacttggcatt

SEQ ID NO: 12839 - DNA, 26 bp, Artificial sequence
  Reverse Primer
tamaagtccatgagattttaaggttt

SEQ ID NO: 12840 - DNA, 23 bp, Artificial sequence
  Reverse Primer
tataaataagctttgaggccaca

SEQ ID NO: 12841 - DNA, 29 bp, Artificial sequence
  Reverse Primer
ttaatctactatgataggaaacaaatggt

SEQ ID NO: 12842 - DNA, 21 bp, Artificial sequence
  Reverse Primer
tttgctttgatgttccaactg

SEQ ID NO: 12843 - DNA, 24 bp, Artificial sequence
  Reverse Primer
acctagcaactaaagaaggacaag

SEQ ID NO: 12844 - DNA, 21 bp, Artificial sequence
  Reverse Primer
tatgcatcgaggatccattaa

SEQ ID NO: 12845 - DNA, 27 bp, Artificial sequence
  Reverse Primer
ttaaaagtaaaggaaawtttgaagagg

SEQ ID NO: 12846 - DNA, 25 bp, Artificial sequence
  Reverse Primer
aagactttctagttcagagaccctc

SEQ ID NO: 12847 - DNA, 25 bp, Artificial sequence
  Reverse Primer
tgcagtcagtagagtaattaaaggc

SEQ ID NO: 12848 - DNA, 18 bp, Artificial sequence
  Reverse Primer
gccgaacacgctctccct

SEQ ID NO: 12849 - DNA, 24 bp, Artificial sequence
  Reverse Primer
acccatttatctgagaggtctaca

SEQ ID NO: 12850 - DNA, 22 bp, Artificial sequence
  Reverse Primer
aagcttcctttcttccaaatct

SEQ ID NO: 12851 - DNA, 23 bp, Artificial sequence
  Reverse Primer
tattctgatgatgagagattgcg

SEQ ID NO: 12852 - DNA, 22 bp, Artificial sequence
  Reverse Primer
ttaggatgcttccaaatcagtc

SEQ ID NO: 12853 - DNA, 24 bp, Artificial sequence
  Reverse Primer
ccaataaaacaggcctaactttag

SEQ ID NO: 12854 - DNA, 19 bp, Artificial sequence
  Reverse Primer
tcgtccatcctgtgtcagt

SEQ ID NO: 12855 - DNA, 25 bp, Artificial sequence
  Reverse Primer
aaaggaagacatacaaatctgagaa

SEQ ID NO: 12856 - DNA, 26 bp, Artificial sequence
  Reverse Primer
aggaagtacacttttattgctttttt

SEQ ID NO: 12857 - DNA, 29 bp, Artificial sequence
  Reverse Primer
ttaagagtctacttgtaatgttttactcg

SEQ ID NO: 12858 - DNA, 18 bp, Artificial sequence
  Reverse Primer
tcacactggaaggctgca

SEQ ID NO: 12859 - DNA, 22 bp, Artificial sequence
  Reverse Primer
gtgacgaatctcttattgtccg

SEQ ID NO: 12860 - DNA, 18 bp, Artificial sequence
  Reverse Primer
acctsatgacctggggcc

SEQ ID NO: 12861 - DNA, 26 bp, Artificial sequence
  Reverse Primer
atgcctggtttactttattaactttg

SEQ ID NO: 12862 - DNA, 30 bp, Artificial sequence
  Reverse Primer
ctggagtttaaaaatataaacatcatacac

SEQ ID NO: 12863 - DNA, 22 bp, Artificial sequence
  Reverse Primer
tggtcccttaaaggaaaaagtc

SEQ ID NO: 12864 - DNA, 18 bp, Artificial sequence
  Reverse Primer
ccctctctgtgcttcggt

SEQ ID NO: 12865 - DNA, 23 bp, Artificial sequence
  Reverse Primer
tgcctgtcttggttgtacatatt

SEQ ID NO: 12866 - DNA, 28 bp, Artificial sequence
  Reverse Primer
caaaactaaaactagaggagatgaaagt

SEQ ID NO: 12867 - DNA, 18 bp, Artificial sequence
  Reverse Primer
accagaatgctccgcgca

SEQ ID NO: 12868 - DNA, 23 bp, Artificial sequence
  Reverse Primer
tgctgaaatcaactacagtcatg

SEQ ID NO: 12869 - DNA, 24 bp, Artificial sequence
  Reverse Primer
ataaatatttgagggcctgtaatg

SEQ ID NO: 12870 - DNA, 22 bp, Artificial sequence
  Reverse Primer
tcctatcggtgagacatttgtt

SEQ ID NO: 12871 - DNA, 21 bp, Artificial sequence
  Reverse Primer
aaacacaggaccaaatccatc

SEQ ID NO: 12872 - DNA, 30 bp, Artificial sequence
  Reverse Primer
gtgcttaaaatgaatactctatatttatca

SEQ ID NO: 12873 - DNA, 19 bp, Artificial sequence
  Reverse Primer
ccacttagggcacttccag

SEQ ID NO: 12874 - DNA, 26 bp, Artificial sequence
  Reverse Primer
aactgtagtcctttacatgttttcac

SEQ ID NO: 12875 - DNA, 26 bp, Artificial sequence
  Reverse Primer
aagtttgaaatagtgacagattgtcc

SEQ ID NO: 12876 - DNA, 21 bp, Artificial sequence
  Reverse Primer
ttcaagttcaggttttgctgt

SEQ ID NO: 12877 - DNA, 19 bp, Artificial sequence
  Reverse Primer
attctcccaactgggaagc

SEQ ID NO: 12878 - DNA, 24 bp, Artificial sequence
  Reverse Primer
aatatccaaatggattattccaaa

SEQ ID NO: 12879 - DNA, 18 bp, Artificial sequence
  Reverse Primer
atggagtcccagccttca

SEQ ID NO: 12880 - DNA, 28 bp, Artificial sequence
  Reverse Primer
ctgtttaaagtgttatggttaattcaaa

SEQ ID NO: 12881 - DNA, 18 bp, Artificial sequence
  Reverse Primer
tggagcactcccgtgatc

SEQ ID NO: 12882 - DNA, 19 bp, Artificial sequence
  Reverse Primer
tgaaccacggtcattctcc

SEQ ID NO: 12883 - DNA, 21 bp, Artificial sequence
  Reverse Primer
agactagagacaggagcccag

SEQ ID NO: 12884 - DNA, 18 bp, Artificial sequence
  Reverse Primer
agccctaagcagtccctg

SEQ ID NO: 12885 - DNA, 30 bp, Artificial sequence
  Reverse Primer
aacactagagtgtaaattttctagtaactt

SEQ ID NO: 12886 - DNA, 18 bp, Artificial sequence
  Reverse Primer
atgccgtttcctggctct

SEQ ID NO: 12887 - DNA, 25 bp, Artificial sequence
  Reverse Primer
tgtgcttcatcctttagatagaaaa

SEQ ID NO: 12888 - DNA, 27 bp, Artificial sequence
  Reverse Primer
tatttcaagcttgcagtcattagtata

SEQ ID NO: 12889 - DNA, 20 bp, Artificial sequence
  Reverse Primer
tttctgaacgtcaccaagac

SEQ ID NO: 12890 - DNA, 30 bp, Artificial sequence
  Reverse Primer
aatataaatctgtacatttaagcagtagtt

SEQ ID NO: 12891 - DNA, 30 bp, Artificial sequence
  Reverse Primer
agtagtattcactacatcacatattttcat

SEQ ID NO: 12892 - DNA, 25 bp, Artificial sequence
  Reverse Primer
ataaacactaaaagtcattggctga

SEQ ID NO: 12893 - DNA, 24 bp, Artificial sequence
  Reverse Primer
atgctgatatcttgttcaacgtag

SEQ ID NO: 12894 - DNA, 28 bp, Artificial sequence
  Reverse Primer
aaaaagagaacttagagatagtcctgtt

SEQ ID NO: 12895 - DNA, 20 bp, Artificial sequence
  Reverse Primer
acyttgatcccacacttcca

SEQ ID NO: 12896 - DNA, 21 bp, Artificial sequence
  Reverse Primer
tgcattgactaaaacccagac

SEQ ID NO: 12897 - DNA, 27 bp, Artificial sequence
  Reverse Primer
tgattatgaaactgaaacaaagtaaga

SEQ ID NO: 12898 - DNA, 23 bp, Artificial sequence
  Reverse Primer
agaccagaaaggcatctagtgtt

SEQ ID NO: 12899 - DNA, 20 bp, Artificial sequence
  Reverse Primer
ttttttggtgccgtaaaaag

SEQ ID NO: 12900 - DNA, 27 bp, Artificial sequence
  Reverse Primer
ttattaaaacctgattttctcaacatg

SEQ ID NO: 12901 - DNA, 25 bp, Artificial sequence
  Reverse Primer
aaagtctaattagaaatgagagggg

SEQ ID NO: 12902 - DNA, 22 bp, Artificial sequence
  Reverse Primer
taagtgcagctcagtctgctag

SEQ ID NO: 12903 - DNA, 26 bp, Artificial sequence
  Reverse Primer
tttgaacttgactttgacatttactt

SEQ ID NO: 12904 - DNA, 25 bp, Artificial sequence
  Reverse Primer
attttcaacagttttcactttcttc

SEQ ID NO: 12905 - DNA, 29 bp, Artificial sequence
  Reverse Primer
aaaagatagtatctgattacattggtgtc

SEQ ID NO: 12906 - DNA, 22 bp, Artificial sequence
  Reverse Primer
atgaattatcacacagcaagcc

SEQ ID NO: 12907 - DNA, 22 bp, Artificial sequence
  Reverse Primer
ggggagataattctgacaactg

SEQ ID NO: 12908 - DNA, 24 bp, Artificial sequence
  Reverse Primer
attctggaaaaattatttgcaatg

SEQ ID NO: 12909 - DNA, 24 bp, Artificial sequence
  Reverse Primer
gaaaacatttccaaaaaggaaata

SEQ ID NO: 12910 - DNA, 22 bp, Artificial sequence
  Reverse Primer
agttgaatctcctagggctttt

SEQ ID NO: 12911 - DNA, 28 bp, Artificial sequence
  Reverse Primer
aaactcagaaaaagtaaaataagaaggc

SEQ ID NO: 12912 - DNA, 20 bp, Artificial sequence
  Reverse Primer
catgacacagcacatgtgag

SEQ ID NO: 12913 - DNA, 22 bp, Artificial sequence
  Reverse Primer
aaactctgcttcggtgaattaa

SEQ ID NO: 12914 - DNA, 28 bp, Artificial sequence
  Reverse Primer
atgttgtcattttaagttctttcactaa

SEQ ID NO: 12915 - DNA, 21 bp, Artificial sequence
  Reverse Primer
aatgctgctcactgacagaaa

SEQ ID NO: 12916 - DNA, 21 bp, Artificial sequence
  Reverse Primer
aatttcacaatgaccgtgtcc

SEQ ID NO: 12917 - DNA, 27 bp, Artificial sequence
  Reverse Primer
ttaatatartaagttgctgaatttggc

SEQ ID NO: 12918 - DNA, 30 bp, Artificial sequence
  Reverse Primer
tcttctagaaaatagaactaataatatacc

SEQ ID NO: 12919 - DNA, 23 bp, Artificial sequence
  Reverse Primer
atggtagatagaagaaaccccag

SEQ ID NO: 12920 - DNA, 22 bp, Artificial sequence
  Reverse Primer
agcagtgaacagaacagacaac

SEQ ID NO: 12921 - DNA, 25 bp, Artificial sequence
  Reverse Primer
agttttggctataatctcaatgaca

SEQ ID NO: 12922 - DNA, 25 bp, Artificial sequence
  Reverse Primer
tttgattcaaattcacctctaaatg

SEQ ID NO: 12923 - DNA, 21 bp, Artificial sequence
  Reverse Primer
agacagacaataagcaggcaa

SEQ ID NO: 12924 - DNA, 24 bp, Artificial sequence
  Reverse Primer
attgttaagaaagctgtctggagt

SEQ ID NO: 12925 - DNA, 26 bp, Artificial sequence
  Reverse Primer
tttgtaaaagcacttagaacagtcag

SEQ ID NO: 12926 - DNA, 25 bp, Artificial sequence
  Reverse Primer
aatatgtaaacgaagaagcataagc

SEQ ID NO: 12927 - DNA, 20 bp, Artificial sequence
  Reverse Primer
aaaaatcacttggcttccct

SEQ ID NO: 12928 - DNA, 30 bp, Artificial sequence
  Reverse Primer
atattctttcaactacgttacatattttag

SEQ ID NO: 12929 - DNA, 22 bp, Artificial sequence
  Reverse Primer
attttattgacaaaagcaggca

SEQ ID NO: 12930 - DNA, 19 bp, Artificial sequence
  Reverse Primer
ttcacgagagctccaacct

SEQ ID NO: 12931 - DNA, 27 bp, Artificial sequence
  Reverse Primer
attaccacttgagtaatgatttcactt

SEQ ID NO: 12932 - DNA, 24 bp, Artificial sequence
  Reverse Primer
gcctatgtgtctattcaggagaat

SEQ ID NO: 12933 - DNA, 18 bp, Artificial sequence
  Reverse Primer
ctctaagcgctgggcagg

SEQ ID NO: 12934 - DNA, 21 bp, Artificial sequence
  Reverse Primer
tttaggaaggacaagcgactt

SEQ ID NO: 12935 - DNA, 24 bp, Artificial sequence
  Reverse Primer
atttgaatccaaaactgaatatgg

SEQ ID NO: 12936 - DNA, 25 bp, Artificial sequence
  Reverse Primer
taatttcctttgtaaaccatagcac

SEQ ID NO: 12937 - DNA, 22 bp, Artificial sequence
  Reverse Primer
agggagaatgatctagtgcctt

SEQ ID NO: 12938 - DNA, 22 bp, Artificial sequence
  Reverse Primer
aggacttacccacaaagtcttc

SEQ ID NO: 12939 - DNA, 28 bp, Artificial sequence
  Reverse Primer
aattaagctaatttaactcaacctgatc

SEQ ID NO: 12940 - DNA, 18 bp, Artificial sequence
  Reverse Primer
cctgcctgcactgctgca

SEQ ID NO: 12941 - DNA, 18 bp, Artificial sequence
  Reverse Primer
aagttggcacagaccggt

SEQ ID NO: 12942 - DNA, 18 bp, Artificial sequence
  Reverse Primer
gcctcctccctgtgtttt

SEQ ID NO: 12943 - DNA, 18 bp, Artificial sequence
  Reverse Primer
ccatgagcaggggtgaaa

SEQ ID NO: 12944 - DNA, 30 bp, Artificial sequence
  Reverse Primer
tgtacaatataaagacatctgattagtaga

SEQ ID NO: 12945 - DNA, 22 bp, Artificial sequence
  Reverse Primer
tgaactttaatggtggctgttt

SEQ ID NO: 12946 - DNA, 25 bp, Artificial sequence
  Reverse Primer
attttattacttagaggctgcaggt

SEQ ID NO: 12947 - DNA, 26 bp, Artificial sequence
  Reverse Primer
tattttttctattacattgcaagtgg

SEQ ID NO: 12948 - DNA, 23 bp, Artificial sequence
  Reverse Primer
aaggcatgtgtttatgatttgat

SEQ ID NO: 12949 - DNA, 25 bp, Artificial sequence
  Reverse Primer
ttagaagcatctgtataacctcagg

SEQ ID NO: 12950 - DNA, 24 bp, Artificial sequence
  Reverse Primer
ttttgtacttgaaacctcttcatc

SEQ ID NO: 12951 - DNA, 23 bp, Artificial sequence
  Reverse Primer
aatgaagcatttctgttgacttg

SEQ ID NO: 12952 - DNA, 18 bp, Artificial sequence
  Reverse Primer
aaaattcctgggacgtgg

SEQ ID NO: 12953 - DNA, 23 bp, Artificial sequence
  Reverse Primer
aatcacttcaaaaatatcagccc

SEQ ID NO: 12954 - DNA, 21 bp, Artificial sequence
  Reverse Primer
attctggagcccaaattactt

SEQ ID NO: 12955 - DNA, 20 bp, Artificial sequence
  Reverse Primer
aaatccaagaagatgcaacg

SEQ ID NO: 12956 - DNA, 21 bp, Artificial sequence
  Reverse Primer
tcttctgttagcttgagctgg

SEQ ID NO: 12957 - DNA, 22 bp, Artificial sequence
  Reverse Primer
aattcacttccagaatctgctg

SEQ ID NO: 12958 - DNA, 22 bp, Artificial sequence
  Reverse Primer
atggaaaatcttccacttctcc

SEQ ID NO: 12959 - DNA, 28 bp, Artificial sequence
  Reverse Primer
ggaaaataagagtttctctataactgga

SEQ ID NO: 12960 - DNA, 18 bp, Artificial sequence
  Reverse Primer
tgctgcacagccatgggt

SEQ ID NO: 12961 - DNA, 18 bp, Artificial sequence
  Reverse Primer
tctcacccaggctaaccc

SEQ ID NO: 12962 - DNA, 18 bp, Artificial sequence
  Reverse Primer
aagggaagggggagagag

SEQ ID NO: 12963 - DNA, 21 bp, Artificial sequence
  Reverse Primer
aggatctcatcttgttcctgg

SEQ ID NO: 12964 - DNA, 25 bp, Artificial sequence
  Reverse Primer
cagtaggatcaataaatagcaagca

SEQ ID NO: 12965 - DNA, 21 bp, Artificial sequence
  Reverse Primer
aatttcacaatgaccgtgtcc

SEQ ID NO: 12966 - DNA, 27 bp, Artificial sequence
  Reverse Primer
tatttttacagcagtatgtgttctgtg

SEQ ID NO: 12967 - DNA, 29 bp, Artificial sequence
  Reverse Primer
ttaagtgatgataagtttatgacaatgag

SEQ ID NO: 12968 - DNA, 21 bp, Artificial sequence
  Reverse Primer
gaagaccaaatatgcttgctg

SEQ ID NO: 12969 - DNA, 25 bp, Artificial sequence
  Reverse Primer
agttttattgcttacagattttgca

SEQ ID NO: 12970 - DNA, 21 bp, Artificial sequence
  Reverse Primer
aatgcaaattcaagttcagca

SEQ ID NO: 12971 - DNA, 28 bp, Artificial sequence
  Reverse Primer
acacygtcatgtaacatctatatgaatc

SEQ ID NO: 12972 - DNA, 19 bp, Artificial sequence
  Reverse Primer
ctcttcatcctgtccccat

SEQ ID NO: 12973 - DNA, 30 bp, Artificial sequence
  Reverse Primer
ataaatatgtgtgtatatgtgtttgtgtat

SEQ ID NO: 12974 - DNA, 30 bp, Artificial sequence
  Reverse Primer
ggattaatattgttatctacataaaagaaa

SEQ ID NO: 12975 - DNA, 20 bp, Artificial sequence
  Reverse Primer
aacaaccccgctattctttc

SEQ ID NO: 12976 - DNA, 22 bp, Artificial sequence
  Reverse Primer
accaacttgagtctggaatcag

SEQ ID NO: 12977 - DNA, 25 bp, Artificial sequence
  Reverse Primer
aaagatgaacatcagatcaagaaaa

SEQ ID NO: 12978 - DNA, 28 bp, Artificial sequence
  Reverse Primer
gtctttctaattaaatccacttctcatc

SEQ ID NO: 12979 - DNA, 25 bp, Artificial sequence
  Reverse Primer
aattgactagaactgagttgcaaag

SEQ ID NO: 12980 - DNA, 24 bp, Artificial sequence
  Reverse Primer
taggaaatctgtcagaaacttggt

SEQ ID NO: 12981 - DNA, 26 bp, Artificial sequence
  Reverse Primer
agagagagaggagatgtaaattctca

SEQ ID NO: 12982 - DNA, 19 bp, Artificial sequence
  Reverse Primer
tctttaaaggyggggatgg

SEQ ID NO: 12983 - DNA, 20 bp, Artificial sequence
  Reverse Primer
acgttgtcagccatgagttc

SEQ ID NO: 12984 - DNA, 23 bp, Artificial sequence
  Reverse Primer
aaagtggaaatgatgttcagttg

SEQ ID NO: 12985 - DNA, 25 bp, Artificial sequence
  Reverse Primer
tgttacttacatttcaaaacaggct

SEQ ID NO: 12986 - DNA, 28 bp, Artificial sequence
  Reverse Primer
taacatgaaattattaccttcagttcag

SEQ ID NO: 12987 - DNA, 26 bp, Artificial sequence
  Reverse Primer
agagaaacaatatcgataggaagatt

SEQ ID NO: 12988 - DNA, 21 bp, Artificial sequence
  Reverse Primer
attagttccaggrctcctctg

SEQ ID NO: 12989 - DNA, 25 bp, Artificial sequence
  Reverse Primer
taatgctggttaaacattttcattc

SEQ ID NO: 12990 - DNA, 21 bp, Artificial sequence
  Reverse Primer
ctcaggtgcatgagagctact

SEQ ID NO: 12991 - DNA, 19 bp, Artificial sequence
  Reverse Primer
cagtttttggagtgggtgc

SEQ ID NO: 12992 - DNA, 28 bp, Artificial sequence
  Reverse Primer
aaagctattaaattgtsaagctaagatt

SEQ ID NO: 12993 - DNA, 25 bp, Artificial sequence
  Reverse Primer
tgagcagacttaggttgttacagtt

SEQ ID NO: 12994 - DNA, 29 bp, Artificial sequence
  Reverse Primer
atatataagtgtaattcctgaccatgagt

SEQ ID NO: 12995 - DNA, 22 bp, Artificial sequence
  Reverse Primer
aatgccttcaactcatcttagc

SEQ ID NO: 12996 - DNA, 24 bp, Artificial sequence
  Reverse Primer
ttttaaaaacacttgcagtcacat

SEQ ID NO: 12997 - DNA, 28 bp, Artificial sequence
  Reverse Primer
aagatctttcctaattgaaaactactgt

SEQ ID NO: 12998 - DNA, 24 bp, Artificial sequence
  Reverse Primer
ggaagtagatgctggtagagaaac

SEQ ID NO: 12999 - DNA, 20 bp, Artificial sequence
  Reverse Primer
agggagctgatatcctcagg

SEQ ID NO: 13000 - DNA, 25 bp, Artificial sequence
  Reverse Primer
taaaccatagtgagtggtttagctc

SEQ ID NO: 13001 - DNA, 22 bp, Artificial sequence
  Reverse Primer
atacctgycaaaaccacttcaa

SEQ ID NO: 13002 - DNA, 19 bp, Artificial sequence
  Reverse Primer
atgtctgcacagcctctga

SEQ ID NO: 13003 - DNA, 23 bp, Artificial sequence
  Reverse Primer
aagctcatgagaaagacatgttc

SEQ ID NO: 13004 - DNA, 25 bp, Artificial sequence
  Reverse Primer
tcgtgaaaattcttctcattttaag

SEQ ID NO: 13005 - DNA, 20 bp, Artificial sequence
  Reverse Primer
atagacgccccttttgtttt

SEQ ID NO: 13006 - DNA, 24 bp, Artificial sequence
  Reverse Primer
tacagatatcaaaggaaggcagtc

SEQ ID NO: 13007 - DNA, 27 bp, Artificial sequence
  Reverse Primer
tcagatgataaaattctttaactggat

SEQ ID NO: 13008 - DNA, 26 bp, Artificial sequence
  Reverse Primer
aatatacattccaattactgcagttg

SEQ ID NO: 13009 - DNA, 28 bp, Artificial sequence
  Reverse Primer
gttactttttagtgtctgatggagatag

SEQ ID NO: 13010 - DNA, 27 bp, Artificial sequence
  Reverse Primer
ttggctagaattmtgagtaaatgatta

SEQ ID NO: 13011 - DNA, 30 bp, Artificial sequence
  Reverse Primer
ttatatgtgctgtcttctattttctttata

SEQ ID NO: 13012 - DNA, 22 bp, Artificial sequence
  Reverse Primer
tttcataaaatggcctagtgct

SEQ ID NO: 13013 - DNA, 30 bp, Artificial sequence
  Reverse Primer
tttatcttaattattcttctgtagaaggtg

SEQ ID NO: 13014 - DNA, 27 bp, Artificial sequence
  Reverse Primer
aagatttatcatctgtaggctatcaca

SEQ ID NO: 13015 - DNA, 27 bp, Artificial sequence
  Reverse Primer
aaaagtatttgggtagatttttaacct

SEQ ID NO: 13016 - DNA, 18 bp, Artificial sequence
  Reverse Primer
tccccaggtcgagtgcca

SEQ ID NO: 13017 - DNA, 22 bp, Artificial sequence
  Reverse Primer
aaatgtgtcatccattgattgg

SEQ ID NO: 13018 - DNA, 30 bp, Artificial sequence
  Reverse Primer
ctacatactatatatgatttcaactgtatg

SEQ ID NO: 13019 - DNA, 21 bp, Artificial sequence
  Reverse Primer
caagagacttctccaggacca

SEQ ID NO: 13020 - DNA, 18 bp, Artificial sequence
  Reverse Primer
tgacccagacccgcagct

SEQ ID NO: 13021 - DNA, 23 bp, Artificial sequence
  Reverse Primer
tacaaagaaaggcagtgtatcag

SEQ ID NO: 13022 - DNA, 26 bp, Artificial sequence
  Reverse Primer
taattgatgtatgaaaagtggactct

SEQ ID NO: 13023 - DNA, 23 bp, Artificial sequence
  Reverse Primer
gaacggtatttaaagcaaaatga

SEQ ID NO: 13024 - DNA, 24 bp, Artificial sequence
  Reverse Primer
tagtaagcgtgtaacttctggtca

SEQ ID NO: 13025 - DNA, 23 bp, Artificial sequence
  Reverse Primer
tctgaggcactttctgaagtatt

SEQ ID NO: 13026 - DNA, 18 bp, Artificial sequence
  Reverse Primer
tccggggtcctctccaag

SEQ ID NO: 13027 - DNA, 23 bp, Artificial sequence
  Reverse Primer
actttgacccatgaaatgttaga

SEQ ID NO: 13028 - DNA, 30 bp, Artificial sequence
  Reverse Primer
aattctttcaactaatatagtaataaccat

SEQ ID NO: 13029 - DNA, 26 bp, Artificial sequence
  Reverse Primer
attatttttaatgtacagttcagtgg

SEQ ID NO: 13030 - DNA, 23 bp, Artificial sequence
  Reverse Primer
ttttctaagtgaggctttgaaca

SEQ ID NO: 13031 - DNA, 23 bp, Artificial sequence
  Reverse Primer
ttacttcctctgcacagagattc

SEQ ID NO: 13032 - DNA, 24 bp, Artificial sequence
  Reverse Primer
aagcatttctgttgacttgaatac

SEQ ID NO: 13033 - DNA, 26 bp, Artificial sequence
  Reverse Primer
tatatgtttttcaactgcaacaaatc

SEQ ID NO: 13034 - DNA, 20 bp, Artificial sequence
  Reverse Primer
attaaaggaagaggtgggga

SEQ ID NO: 13035 - DNA, 28 bp, Artificial sequence
  Reverse Primer
tataattatgaagtttttcctcttcaag

SEQ ID NO: 13036 - DNA, 20 bp, Artificial sequence
  Reverse Primer
agcgcatctgtttcttcaaa

SEQ ID NO: 13037 - DNA, 18 bp, Artificial sequence
  Reverse Primer
tccctccatccggaaagt

SEQ ID NO: 13038 - DNA, 26 bp, Artificial sequence
  Reverse Primer
ttaagtatcatcattgtcgtttttct

SEQ ID NO: 13039 - DNA, 23 bp, Artificial sequence
  Reverse Primer
aaaagacctgactgcataccttc

SEQ ID NO: 13040 - DNA, 24 bp, Artificial sequence
  Reverse Primer
aagaaaagttagcaaactcagtgg

SEQ ID NO: 13041 - DNA, 18 bp, Artificial sequence
  Reverse Primer
tatgagcaggggagcaga

SEQ ID NO: 13042 - DNA, 24 bp, Artificial sequence
  Reverse Primer
aattttcccactgtaagtcaagtt

SEQ ID NO: 13043 - DNA, 27 bp, Artificial sequence
  Reverse Primer
tttataagatgcacagtcagatctaca

SEQ ID NO: 13044 - DNA, 26 bp, Artificial sequence
  Reverse Primer
tatcmaagtgtttgaaggattctatc

SEQ ID NO: 13045 - DNA, 19 bp, Artificial sequence
  Reverse Primer
accacaagggcttgttttc

SEQ ID NO: 13046 - DNA, 28 bp, Artificial sequence
  Reverse Primer
atttagatttatgagggaattagaactg

SEQ ID NO: 13047 - DNA, 30 bp, Artificial sequence
  Reverse Primer
ttcactgattctatgaygtaattatctata

SEQ ID NO: 13048 - DNA, 28 bp, Artificial sequence
  Reverse Primer
gaaaaaaattaacatataaactgcaagg

SEQ ID NO: 13049 - DNA, 22 bp, Artificial sequence
  Reverse Primer
tgactgcttttctaacaaccac

SEQ ID NO: 13050 - DNA, 22 bp, Artificial sequence
  Reverse Primer
ctcctgaggagacaagaaacag

SEQ ID NO: 13051 - DNA, 20 bp, Artificial sequence
  Reverse Primer
agacaaatgaattgcctgca

SEQ ID NO: 13052 - DNA, 21 bp, Artificial sequence
  Reverse Primer
taagactatggcgagcacatc

SEQ ID NO: 13053 - DNA, 27 bp, Artificial sequence
  Reverse Primer
aaataaaccttttaattgcaacttacg

SEQ ID NO: 13054 - DNA, 22 bp, Artificial sequence
  Reverse Primer
aacaggcagatgagaagagaga

SEQ ID NO: 13055 - DNA, 23 bp, Artificial sequence
  Reverse Primer
aatgatgagtagcctcatgtgtt

SEQ ID NO: 13056 - DNA, 27 bp, Artificial sequence
  Reverse Primer
aagtatgttggacatttaatctctgtt

SEQ ID NO: 13057 - DNA, 18 bp, Artificial sequence
  Reverse Primer
agccacacatgggagaac

SEQ ID NO: 13058 - DNA, 18 bp, Artificial sequence
  Reverse Primer
cacaggaggcaaaggtga

SEQ ID NO: 13059 - DNA, 30 bp, Artificial sequence
  Reverse Primer
ataactaatagatgtgaaacaaagagaagc

SEQ ID NO: 13060 - DNA, 18 bp, Artificial sequence
  Reverse Primer
tcccagttgttcctttgg

SEQ ID NO: 13061 - DNA, 28 bp, Artificial sequence
  Reverse Primer
tagactgagagacttcttcagttaaatg

SEQ ID NO: 13062 - DNA, 25 bp, Artificial sequence
  Reverse Primer
attgatttttgttcttacatgctgt

SEQ ID NO: 13063 - DNA, 27 bp, Artificial sequence
  Reverse Primer
atgtcagctgaagagaatattttagaa

SEQ ID NO: 13064 - DNA, 28 bp, Artificial sequence
  Reverse Primer
tttgtaacagataatatcaaattggaga

SEQ ID NO: 13065 - DNA, 18 bp, Artificial sequence
  Reverse Primer
gcctggggaaatgtccta

SEQ ID NO: 13066 - DNA, 18 bp, Artificial sequence
  Reverse Primer
tgtgggtgcagaggagca

SEQ ID NO: 13067 - DNA, 19 bp, Artificial sequence
  Reverse Primer
agagctgatctgccaggaa

SEQ ID NO: 13068 - DNA, 23 bp, Artificial sequence
  Reverse Primer
aagatgaaaaggctggaaataat

SEQ ID NO: 13069 - DNA, 20 bp, Artificial sequence
  Reverse Primer
attttggggttcttttgctg

SEQ ID NO: 13070 - DNA, 27 bp, Artificial sequence
  Reverse Primer
cattattctacaattagttcccacatt

SEQ ID NO: 13071 - DNA, 20 bp, Artificial sequence
  Reverse Primer
attagatccaagttccgcag

SEQ ID NO: 13072 - DNA, 18 bp, Artificial sequence
  Reverse Primer
aagagctggtgggaggtc

SEQ ID NO: 13073 - DNA, 22 bp, Artificial sequence
  Reverse Primer
atctcatgtgttccttagagcg

SEQ ID NO: 13074 - DNA, 25 bp, Artificial sequence
  Reverse Primer
aggtcttttatttttctctctgctt

SEQ ID NO: 13075 - DNA, 21 bp, Artificial sequence
  Reverse Primer
ttatttccggggttaagtgat

SEQ ID NO: 13076 - DNA, 20 bp, Artificial sequence
  Reverse Primer
tgaggcttctggttagatcc

SEQ ID NO: 13077 - DNA, 27 bp, Artificial sequence
  Reverse Primer
tttactttatacagccaaggataaaga

SEQ ID NO: 13078 - DNA, 26 bp, Artificial sequence
  Reverse Primer
taggtggttgtaaataaactttgttc

SEQ ID NO: 13079 - DNA, 25 bp, Artificial sequence
  Reverse Primer
caaatgatttcagtaacrcaaattt

SEQ ID NO: 13080 - DNA, 23 bp, Artificial sequence
  Reverse Primer
tttttgaagagacaggatgagat

SEQ ID NO: 13081 - DNA, 23 bp, Artificial sequence
  Reverse Primer
ttacctcctccttttcatgtctt

SEQ ID NO: 13082 - DNA, 22 bp, Artificial sequence
  Reverse Primer
ggtgctggaataagaagctatg

SEQ ID NO: 13083 - DNA, 26 bp, Artificial sequence
  Reverse Primer
tgtgtactgaacatgatagattgaca

SEQ ID NO: 13084 - DNA, 21 bp, Artificial sequence
  Reverse Primer
cgggcttagttacctctaggc

SEQ ID NO: 13085 - DNA, 19 bp, Artificial sequence
  Reverse Primer
aggccaattccacagtgtc

SEQ ID NO: 13086 - DNA, 24 bp, Artificial sequence
  Reverse Primer
tttctacttctgtttcccatgtct

SEQ ID NO: 13087 - DNA, 30 bp, Artificial sequence
  Reverse Primer
tatactcttaattcactttatacaatttct

SEQ ID NO: 13088 - DNA, 26 bp, Artificial sequence
  Reverse Primer
gtcatctaatcatagcaagatgaaga

SEQ ID NO: 13089 - DNA, 18 bp, Artificial sequence
  Reverse Primer
tgtcagcgcctggctctc

SEQ ID NO: 13090 - DNA, 19 bp, Artificial sequence
  Reverse Primer
cctgctgatgattccagtg

SEQ ID NO: 13091 - DNA, 25 bp, Artificial sequence
  Reverse Primer
tttactcccctaaagagtttttacc

SEQ ID NO: 13092 - DNA, 21 bp, Artificial sequence
  Reverse Primer
aatgcaaagaggagaagacgt

SEQ ID NO: 13093 - DNA, 19 bp, Artificial sequence
  Reverse Primer
aagtgagcctcttgccaga

SEQ ID NO: 13094 - DNA, 30 bp, Artificial sequence
  Reverse Primer
taatagtcaaaaacacttaccaagtaatct

SEQ ID NO: 13095 - DNA, 27 bp, Artificial sequence
  Reverse Primer
cagaagaatgacataaacactagagtg

SEQ ID NO: 13096 - DNA, 21 bp, Artificial sequence
  Reverse Primer
tttccaagacacacaaatcca

SEQ ID NO: 13097 - DNA, 28 bp, Artificial sequence
  Reverse Primer
taataaaaagtcccaaagtatctctttc

SEQ ID NO: 13098 - DNA, 25 bp, Artificial sequence
  Reverse Primer
aaaataaaatcacacctcctttagg

SEQ ID NO: 13099 - DNA, 28 bp, Artificial sequence
  Reverse Primer
taaaatctttacatcagatgttttcatg

SEQ ID NO: 13100 - DNA, 18 bp, Artificial sequence
  Reverse Primer
ccttgcatccactctggc

SEQ ID NO: 13101 - DNA, 30 bp, Artificial sequence
  Reverse Primer
aaagtatgttaacagaaatagaatatacat

SEQ ID NO: 13102 - DNA, 20 bp, Artificial sequence
  Reverse Primer
taggcaatgggaagaactga

SEQ ID NO: 13103 - DNA, 18 bp, Artificial sequence
  Reverse Primer
ttcctgcccccatcctgg

SEQ ID NO: 13104 - DNA, 23 bp, Artificial sequence
  Reverse Primer
aagtcctttttccaytgtgtacc

SEQ ID NO: 13105 - DNA, 20 bp, Artificial sequence
  Reverse Primer
taaaaatgcccggagtagtg

SEQ ID NO: 13106 - DNA, 21 bp, Artificial sequence
  Reverse Primer
gagcaaaacatacttcctgcc

SEQ ID NO: 13107 - DNA, 23 bp, Artificial sequence
  Reverse Primer
tacaatgataaggtctcttgcca

SEQ ID NO: 13108 - DNA, 20 bp, Artificial sequence
  Reverse Primer
aattgcatgaagacctgtcc

SEQ ID NO: 13109 - DNA, 26 bp, Artificial sequence
  Reverse Primer
atgcctttaaaatgtttaattctctg

SEQ ID NO: 13110 - DNA, 28 bp, Artificial sequence
  Reverse Primer
tttctaactcacctttgtatcatctaca

SEQ ID NO: 13111 - DNA, 20 bp, Artificial sequence
  Reverse Primer
tcatgctggatctttccttg

SEQ ID NO: 13112 - DNA, 18 bp, Artificial sequence
  Reverse Primer
actgcctggctccacctt

SEQ ID NO: 13113 - DNA, 28 bp, Artificial sequence
  Reverse Primer
ctgttttttgttcttctttaattctctt

SEQ ID NO: 13114 - DNA, 18 bp, Artificial sequence
  Reverse Primer
acttggaagcctcaccct

SEQ ID NO: 13115 - DNA, 23 bp, Artificial sequence
  Reverse Primer
tataaamtagaggcagagcagga

SEQ ID NO: 13116 - DNA, 30 bp, Artificial sequence
  Reverse Primer
aggtagagagtatatacatacatcgacaaa

SEQ ID NO: 13117 - DNA, 25 bp, Artificial sequence
  Reverse Primer
aaatatgacaaggagtrctcacaga

SEQ ID NO: 13118 - DNA, 18 bp, Artificial sequence
  Reverse Primer
aggaaatgcgtgggaagt

SEQ ID NO: 13119 - DNA, 27 bp, Artificial sequence
  Reverse Primer
aaaattctctggtttctctctaagagt

SEQ ID NO: 13120 - DNA, 22 bp, Artificial sequence
  Reverse Primer
tgcagtaaaaaggaagctaacc

SEQ ID NO: 13121 - DNA, 21 bp, Artificial sequence
  Reverse Primer
tttaggaaggacaagcgactt

SEQ ID NO: 13122 - DNA, 26 bp, Artificial sequence
  Reverse Primer
aaaaagtgataaacctaagaccacag

SEQ ID NO: 13123 - DNA, 24 bp, Artificial sequence
  Reverse Primer
taatagctcataaataaccagccc

SEQ ID NO: 13124 - DNA, 19 bp, Artificial sequence
  Reverse Primer
caacacactgacccactcc

SEQ ID NO: 13125 - DNA, 21 bp, Artificial sequence
  Reverse Primer
atgtttgggctcataaacagg

SEQ ID NO: 13126 - DNA, 23 bp, Artificial sequence
  Reverse Primer
taattttccctttagtgtcctgg

SEQ ID NO: 13127 - DNA, 29 bp, Artificial sequence
  Reverse Primer
taaaattctgtgaggaattgtatatatgc

SEQ ID NO: 13128 - DNA, 24 bp, Artificial sequence
  Reverse Primer
tcagttttagcagattattttgcc

SEQ ID NO: 13129 - DNA, 28 bp, Artificial sequence
  Reverse Primer
ttagtacatggtaatgtatctccttcat

SEQ ID NO: 13130 - DNA, 24 bp, Artificial sequence
  Reverse Primer
attcttagaatgccacaatgactt

SEQ ID NO: 13131 - DNA, 22 bp, Artificial sequence
  Reverse Primer
aaagtgtgatgctgaaggtacc

SEQ ID NO: 13132 - DNA, 27 bp, Artificial sequence
  Reverse Primer
atttaatctgcatcaacactaagattt

SEQ ID NO: 13133 - DNA, 23 bp, Artificial sequence
  Reverse Primer
aaagctttctagtttcctgatgg

SEQ ID NO: 13134 - DNA, 30 bp, Artificial sequence
  Reverse Primer
ataattcagcatagtcctacttattsatat

SEQ ID NO: 13135 - DNA, 18 bp, Artificial sequence
  Reverse Primer
tacaagcacacagagccg

SEQ ID NO: 13136 - DNA, 21 bp, Artificial sequence
  Reverse Primer
gcaacagactctctggtgatg

SEQ ID NO: 13137 - DNA, 20 bp, Artificial sequence
  Reverse Primer
ttctctctccctgcatgttt

SEQ ID NO: 13138 - DNA, 21 bp, Artificial sequence
  Reverse Primer
ttgcctttggaatamgtttcc

SEQ ID NO: 13139 - DNA, 27 bp, Artificial sequence
  Reverse Primer
ttttctacacatagctattgattgatg

SEQ ID NO: 13140 - DNA, 20 bp, Artificial sequence
  Reverse Primer
aagtggcttagcttgtgctg

SEQ ID NO: 13141 - DNA, 30 bp, Artificial sequence
  Reverse Primer
aaaacatctaaatattgtagaactagagaa

SEQ ID NO: 13142 - DNA, 25 bp, Artificial sequence
  Reverse Primer
agctgcaaaatcatgtcattatact

SEQ ID NO: 13143 - DNA, 23 bp, Artificial sequence
  Reverse Primer
tagctgtgtaagtgataggctgg

SEQ ID NO: 13144 - DNA, 21 bp, Artificial sequence
  Reverse Primer
taagtgccttctatgaccgtc

SEQ ID NO: 13145 - DNA, 26 bp, Artificial sequence
  Reverse Primer
ttaggaataggtagaggaattgagag

SEQ ID NO: 13146 - DNA, 19 bp, Artificial sequence
  Reverse Primer
ttggattgagttggcatca

SEQ ID NO: 13147 - DNA, 18 bp, Artificial sequence
  Reverse Primer
caagctccatgctgtcct

SEQ ID NO: 13148 - DNA, 25 bp, Artificial sequence
  Reverse Primer
attgtgagggtaacgtgtctactaa

SEQ ID NO: 13149 - DNA, 30 bp, Artificial sequence
  Reverse Primer
atagttatagttgaacctaacagaaacttc

SEQ ID NO: 13150 - DNA, 30 bp, Artificial sequence
  Reverse Primer
cttttaaagagtaaactcagtctcatgtaa

SEQ ID NO: 13151 - DNA, 28 bp, Artificial sequence
  Reverse Primer
tattcggatataaatgcagagttattta

SEQ ID NO: 13152 - DNA, 28 bp, Artificial sequence
  Reverse Primer
tatatttctttgtttgaagttgtattcg

SEQ ID NO: 13153 - DNA, 21 bp, Artificial sequence
  Reverse Primer
tacccttccttgttcatatgg

SEQ ID NO: 13154 - DNA, 18 bp, Artificial sequence
  Reverse Primer
atgtttgtcgggtgcagt

SEQ ID NO: 13155 - DNA, 20 bp, Artificial sequence
  Reverse Primer
atgactcggctagaaaaagg

SEQ ID NO: 13156 - DNA, 22 bp, Artificial sequence
  Reverse Primer
aaaaggagaaccctgagaatca

SEQ ID NO: 13157 - DNA, 22 bp, Artificial sequence
  Reverse Primer
cctcccagagaatttttctttc

SEQ ID NO: 13158 - DNA, 21 bp, Artificial sequence
  Reverse Primer
tttctcgtggtcattcagact

SEQ ID NO: 13159 - DNA, 24 bp, Artificial sequence
  Reverse Primer
gctactaatttgcaaggtagcttt

SEQ ID NO: 13160 - DNA, 22 bp, Artificial sequence
  Reverse Primer
ctcagagaataagcgagcactt

SEQ ID NO: 13161 - DNA, 24 bp, Artificial sequence
  Reverse Primer
ttacattgaatgaaaaaaggcttc

SEQ ID NO: 13162 - DNA, 19 bp, Artificial sequence
  Reverse Primer
caacgttctctggctttgc

SEQ ID NO: 13163 - DNA, 24 bp, Artificial sequence
  Reverse Primer
atcttcttgccctgatactacaag

SEQ ID NO: 13164 - DNA, 22 bp, Artificial sequence
  Reverse Primer
aatacacaatccatcccagaga

SEQ ID NO: 13165 - DNA, 28 bp, Artificial sequence
  Reverse Primer
aaaccttacacatacattcattttaatg

SEQ ID NO: 13166 - DNA, 30 bp, Artificial sequence
  Reverse Primer
agtcatacataaatcagtgagataaaattc

SEQ ID NO: 13167 - DNA, 23 bp, Artificial sequence
  Reverse Primer
aagatgaaaacycatgtcgtatg

SEQ ID NO: 13168 - DNA, 21 bp, Artificial sequence
  Reverse Primer
cagcatctggatctctgtttt

SEQ ID NO: 13169 - DNA, 24 bp, Artificial sequence
  Reverse Primer
aaatgatatgcctagaatgaatcc

SEQ ID NO: 13170 - DNA, 26 bp, Artificial sequence
  Reverse Primer
ttttccttttacaatacccttgtaac

SEQ ID NO: 13171 - DNA, 19 bp, Artificial sequence
  Reverse Primer
tttgaaagacaacccgagg

SEQ ID NO: 13172 - DNA, 30 bp, Artificial sequence
  Reverse Primer
ctagtagagtagctcatacagatcttcttc

SEQ ID NO: 13173 - DNA, 21 bp, Artificial sequence
  Reverse Primer
ctcttctcccaccttttcatc

SEQ ID NO: 13174 - DNA, 26 bp, Artificial sequence
  Reverse Primer
agacaccaggttataaagatacacaa

SEQ ID NO: 13175 - DNA, 19 bp, Artificial sequence
  Reverse Primer
tgtgagatttcagcctgca

SEQ ID NO: 13176 - DNA, 22 bp, Artificial sequence
  Reverse Primer
ataagaacgaggagatagggga

SEQ ID NO: 13177 - DNA, 18 bp, Artificial sequence
  Reverse Primer
aaggaggcagcagagagg

SEQ ID NO: 13178 - DNA, 21 bp, Artificial sequence
  Reverse Primer
ttaagggggaaaaagaaaatg

SEQ ID NO: 13179 - DNA, 18 bp, Artificial sequence
  Reverse Primer
tgatgggggcctgcagtg

SEQ ID NO: 13180 - DNA, 21 bp, Artificial sequence
  Reverse Primer
tgcctagtatcccttttccag

SEQ ID NO: 13181 - DNA, 22 bp, Artificial sequence
  Reverse Primer
tctgccagagtagacgttttct

SEQ ID NO: 13182 - DNA, 20 bp, Artificial sequence
  Reverse Primer
aaacctctgaagggctccta

SEQ ID NO: 13183 - DNA, 24 bp, Artificial sequence
  Reverse Primer
ttattttagagtgcaagatcagca

SEQ ID NO: 13184 - DNA, 22 bp, Artificial sequence
  Reverse Primer
tgacacttcacaatgatgtcct

SEQ ID NO: 13185 - DNA, 26 bp, Artificial sequence
  Reverse Primer
tcatttatgtaaagatgcacgtactc

SEQ ID NO: 13186 - DNA, 18 bp, Artificial sequence
  Reverse Primer
ccctcccaagttcctgga

SEQ ID NO: 13187 - DNA, 18 bp, Artificial sequence
  Reverse Primer
ctcccagagtttcccctc

SEQ ID NO: 13188 - DNA, 25 bp, Artificial sequence
  Reverse Primer
aagtgacttcacttaaccatttgat

SEQ ID NO: 13189 - DNA, 25 bp, Artificial sequence
  Reverse Primer
aaatctactttgtgccttagagatg

SEQ ID NO: 13190 - DNA, 23 bp, Artificial sequence
  Reverse Primer
tctcctgtttactgctcagaaca

SEQ ID NO: 13191 - DNA, 23 bp, Artificial sequence
  Reverse Primer
ttatargttatggaacgaggagg

SEQ ID NO: 13192 - DNA, 23 bp, Artificial sequence
  Reverse Primer
aataggaaaaagaaagtccctgg

SEQ ID NO: 13193 - DNA, 30 bp, Artificial sequence
  Reverse Primer
cataagtcattaaatactgatccytctaat

SEQ ID NO: 13194 - DNA, 24 bp, Artificial sequence
  Reverse Primer
ggggaggaaaaatatttgtttatg

SEQ ID NO: 13195 - DNA, 18 bp, Artificial sequence
  Reverse Primer
atggggtgagcatcctgg

SEQ ID NO: 13196 - DNA, 20 bp, Artificial sequence
  Reverse Primer
ttctattgggatttaggggc

SEQ ID NO: 13197 - DNA, 23 bp, Artificial sequence
  Reverse Primer
aaattttctaaacrttccttggc

SEQ ID NO: 13198 - DNA, 18 bp, Artificial sequence
  Reverse Primer
aaaaacaggcatttgggg

SEQ ID NO: 13199 - DNA, 29 bp, Artificial sequence
  Reverse Primer
tatrgttctcataccatattactttctgg

SEQ ID NO: 13200 - DNA, 30 bp, Artificial sequence
  Reverse Primer
acstgtaagtatgaaagaatgtataaccta

SEQ ID NO: 13201 - DNA, 20 bp, Artificial sequence
  Reverse Primer
aaacagggaaggatttgctc

SEQ ID NO: 13202 - DNA, 18 bp, Artificial sequence
  Reverse Primer
tacctgtccccacccttc

SEQ ID NO: 13203 - DNA, 28 bp, Artificial sequence
  Reverse Primer
taaagagtttttaccactagaattgttg

SEQ ID NO: 13204 - DNA, 24 bp, Artificial sequence
  Reverse Primer
ttaacatatggttgctgttgattg

SEQ ID NO: 13205 - DNA, 21 bp, Artificial sequence
  Reverse Primer
tgttcattttctgtcctccac

SEQ ID NO: 13206 - DNA, 22 bp, Artificial sequence
  Reverse Primer
aagagactgtagtcrggacagg

SEQ ID NO: 13207 - DNA, 28 bp, Artificial sequence
  Reverse Primer
tacaaacttaacttctcttgaaaatcac

SEQ ID NO: 13208 - DNA, 27 bp, Artificial sequence
  Reverse Primer
tatacaatacatttcagacacctttca

SEQ ID NO: 13209 - DNA, 19 bp, Artificial sequence
  Reverse Primer
aactcttagccacccgatg

SEQ ID NO: 13210 - DNA, 23 bp, Artificial sequence
  Reverse Primer
cataaggagtcagcaagtggtaa

SEQ ID NO: 13211 - DNA, 24 bp, Artificial sequence
  Reverse Primer
tgactataaagrggtgacagaaca

SEQ ID NO: 13212 - DNA, 24 bp, Artificial sequence
  Reverse Primer
tttacatctgttttctggatgact

SEQ ID NO: 13213 - DNA, 30 bp, Artificial sequence
  Reverse Primer
tatttactgaaaaaaatctacacataggtg

SEQ ID NO: 13214 - DNA, 29 bp, Artificial sequence
  Reverse Primer
aaacattaaataactctgttgatatctgc

SEQ ID NO: 13215 - DNA, 27 bp, Artificial sequence
  Reverse Primer
tacaaaataaaatcacacctcctttag

SEQ ID NO: 13216 - DNA, 30 bp, Artificial sequence
  Reverse Primer
aatgagttgaaaatctatacagtaatatcg

SEQ ID NO: 13217 - DNA, 25 bp, Artificial sequence
  Reverse Primer
tatgattatatcgcaaaagcctatc

SEQ ID NO: 13218 - DNA, 28 bp, Artificial sequence
  Reverse Primer
atttagtacagaatctgatggacagtag

SEQ ID NO: 13219 - DNA, 25 bp, Artificial sequence
  Reverse Primer
agttctaccaattgaatcagctatt

SEQ ID NO: 13220 - DNA, 27 bp, Artificial sequence
  Reverse Primer
aaaagtgttggacaactaaggattata

SEQ ID NO: 13221 - DNA, 22 bp, Artificial sequence
  Reverse Primer
atgtcaacagcatgttctttcc

SEQ ID NO: 13222 - DNA, 29 bp, Artificial sequence
  Reverse Primer
taagtattattaggattgtctgtgtgacc

SEQ ID NO: 13223 - DNA, 20 bp, Artificial sequence
  Reverse Primer
cacttcaacaggactccagg

SEQ ID NO: 13224 - DNA, 21 bp, Artificial sequence
  Reverse Primer
ctcagtgagggaaaaccattt

SEQ ID NO: 13225 - DNA, 22 bp, Artificial sequence
  Reverse Primer
acatttactgggttcattcagc

SEQ ID NO: 13226 - DNA, 29 bp, Artificial sequence
  Reverse Primer
tcagtgttatagattggttttatatatgc

SEQ ID NO: 13227 - DNA, 27 bp, Artificial sequence
  Reverse Primer
attggaattcacacatatacactattg

SEQ ID NO: 13228 - DNA, 23 bp, Artificial sequence
  Reverse Primer
aaaactcattcagtgatgcaaac

SEQ ID NO: 13229 - DNA, 22 bp, Artificial sequence
  Reverse Primer
aaacaaaacagctgacaagagc

SEQ ID NO: 13230 - DNA, 30 bp, Artificial sequence
  Reverse Primer
atgcattagggatactatactataaaaaaa

SEQ ID NO: 13231 - DNA, 24 bp, Artificial sequence
  Reverse Primer
taatgatggtgtgtttatctcgat

SEQ ID NO: 13232 - DNA, 24 bp, Artificial sequence
  Reverse Primer
aacttttcttttttggttgtgaat

SEQ ID NO: 13233 - DNA, 27 bp, Artificial sequence
  Reverse Primer
ttttaggctatacacaacagactatgc

SEQ ID NO: 13234 - DNA, 30 bp, Artificial sequence
  Reverse Primer
taactgaggataactagagtcaatatatgg

SEQ ID NO: 13235 - DNA, 25 bp, Artificial sequence
  Reverse Primer
atgagaagagttgaaatctgtaagg

SEQ ID NO: 13236 - DNA, 18 bp, Artificial sequence
  Reverse Primer
ttttgcagggcctgaagg

SEQ ID NO: 13237 - DNA, 27 bp, Artificial sequence
  Reverse Primer
ctgtcatcaaatttatcttttaattgg

SEQ ID NO: 13238 - DNA, 28 bp, Artificial sequence
  Reverse Primer
tattaaatttattaaaaggaggtggtgt

SEQ ID NO: 13239 - DNA, 25 bp, Artificial sequence
  Reverse Primer
attaaaatggtactttacctgagca

SEQ ID NO: 13240 - DNA, 23 bp, Artificial sequence
  Reverse Primer
agcaaaaatctgtaacaaccagt

SEQ ID NO: 13241 - DNA, 21 bp, Artificial sequence
  Reverse Primer
tttagagagcctcttctgcag

SEQ ID NO: 13242 - DNA, 22 bp, Artificial sequence
  Reverse Primer
tttttgtttctcttccttagcc

SEQ ID NO: 13243 - DNA, 22 bp, Artificial sequence
  Reverse Primer
rgtttaraacaaagtgtgctgc

SEQ ID NO: 13244 - DNA, 18 bp, Artificial sequence
  Reverse Primer
aaattgcccctggttgag

SEQ ID NO: 13245 - DNA, 29 bp, Artificial sequence
  Reverse Primer
taagatcatcagtaccacctttctatatt

SEQ ID NO: 13246 - DNA, 21 bp, Artificial sequence
  Reverse Primer
aggtctcccagctacagatgt

SEQ ID NO: 13247 - DNA, 18 bp, Artificial sequence
  Reverse Primer
tgtggagcttcctggtca

SEQ ID NO: 13248 - DNA, 23 bp, Artificial sequence
  Reverse Primer
aataaaagttgatgcagtcagga

SEQ ID NO: 13249 - DNA, 28 bp, Artificial sequence
  Reverse Primer
gaatttaacttttttaagctgaagttgt

SEQ ID NO: 13250 - DNA, 22 bp, Artificial sequence
  Reverse Primer
atgggcacactgaaaagataat

SEQ ID NO: 13251 - DNA, 20 bp, Artificial sequence
  Reverse Primer
atgtcatagcccagagaccc

SEQ ID NO: 13252 - DNA, 24 bp, Artificial sequence
  Reverse Primer
tatttaatggaggcttttatcctg

SEQ ID NO: 13253 - DNA, 25 bp, Artificial sequence
  Reverse Primer
tcctttttatctcatttctttatgc

SEQ ID NO: 13254 - DNA, 22 bp, Artificial sequence
  Reverse Primer
atgagtttttctcttgtttggg

SEQ ID NO: 13255 - DNA, 24 bp, Artificial sequence
  Reverse Primer
taatcccttactgtgaaattgatg

SEQ ID NO: 13256 - DNA, 23 bp, Artificial sequence
  Reverse Primer
ggaaaaagaaaatgactgaggtg

SEQ ID NO: 13257 - DNA, 27 bp, Artificial sequence
  Reverse Primer
ataactgtgatttttagtgactgtttc

SEQ ID NO: 13258 - DNA, 26 bp, Artificial sequence
  Reverse Primer
tttagggtctttgagctactttaaaa

SEQ ID NO: 13259 - DNA, 23 bp, Artificial sequence
  Reverse Primer
ctgcaatatgtctcatgtcacag

SEQ ID NO: 13260 - DNA, 18 bp, Artificial sequence
  Reverse Primer
ttccagtctcacagccct

SEQ ID NO: 13261 - DNA, 19 bp, Artificial sequence
  Reverse Primer
ataactgcctttgcaagcc

SEQ ID NO: 13262 - DNA, 23 bp, Artificial sequence
  Reverse Primer
ttgaagctgcagagttttttaaa

SEQ ID NO: 13263 - DNA, 25 bp, Artificial sequence
  Reverse Primer
aaacctagatcaaaatctgaagatg

SEQ ID NO: 13264 - DNA, 25 bp, Artificial sequence
  Reverse Primer
aaacatagtacatggctccagtaaa

SEQ ID NO: 13265 - DNA, 22 bp, Artificial sequence
  Reverse Primer
aaggatgtggacataacgttct

SEQ ID NO: 13266 - DNA, 23 bp, Artificial sequence
  Reverse Primer
agctgtcaaactttagctcatgt

SEQ ID NO: 13267 - DNA, 27 bp, Artificial sequence
  Reverse Primer
agttagtagtaaaagctgacttccaac

SEQ ID NO: 13268 - DNA, 22 bp, Artificial sequence
  Reverse Primer
agtttacatgtgttaccactgg

SEQ ID NO: 13269 - DNA, 21 bp, Artificial sequence
  Reverse Primer
gatgcgtgaaaaatgaaaagt

SEQ ID NO: 13270 - DNA, 27 bp, Artificial sequence
  Reverse Primer
aaccaagtgattctacttagagatgag

SEQ ID NO: 13271 - DNA, 18 bp, Artificial sequence
  Reverse Primer
gcaggggaatgagctggg

SEQ ID NO: 13272 - DNA, 23 bp, Artificial sequence
  Reverse Primer
aaacactcctttgggtctaatgt

SEQ ID NO: 13273 - DNA, 29 bp, Artificial sequence
  Reverse Primer
atctctgagctagtgtatcttgtattgta

SEQ ID NO: 13274 - DNA, 26 bp, Artificial sequence
  Reverse Primer
atagaattgaccaaagaagagtgagt

SEQ ID NO: 13275 - DNA, 25 bp, Artificial sequence
  Reverse Primer
tattccagaacctaggaagatctag

SEQ ID NO: 13276 - DNA, 30 bp, Artificial sequence
  Reverse Primer
ttatagaaaacttctcccaactaatttatc

SEQ ID NO: 13277 - DNA, 21 bp, Artificial sequence
  Reverse Primer
taccaagagatcactgctccc

SEQ ID NO: 13278 - DNA, 23 bp, Artificial sequence
  Reverse Primer
tgattgtgagaagagtccatagc

SEQ ID NO: 13279 - DNA, 26 bp, Artificial sequence
  Reverse Primer
tatgaggacgatgaaactatatgact

SEQ ID NO: 13280 - DNA, 27 bp, Artificial sequence
  Reverse Primer
atggcacttaagtttactgatgtttat

SEQ ID NO: 13281 - DNA, 21 bp, Artificial sequence
  Reverse Primer
aaatgcagtaggcttttaccg

SEQ ID NO: 13282 - DNA, 26 bp, Artificial sequence
  Reverse Primer
aaagacttggagctatttattcattt

SEQ ID NO: 13283 - DNA, 27 bp, Artificial sequence
  Reverse Primer
aacttgtacacataaagggtactctga

SEQ ID NO: 13284 - DNA, 20 bp, Artificial sequence
  Reverse Primer
gctaagaaaaggaggatggg

SEQ ID NO: 13285 - DNA, 21 bp, Artificial sequence
  Reverse Primer
tagaactgggtgctaacaggg

SEQ ID NO: 13286 - DNA, 22 bp, Artificial sequence
  Reverse Primer
tagatgagtgagtggcagagtg

SEQ ID NO: 13287 - DNA, 23 bp, Artificial sequence
  Reverse Primer
ttagcattctttgactgtttgct

SEQ ID NO: 13288 - DNA, 22 bp, Artificial sequence
  Reverse Primer
aaactgggttacacactggaaa

SEQ ID NO: 13289 - DNA, 27 bp, Artificial sequence
  Reverse Primer
gttcttttagagtgatgtgggtagtaa

SEQ ID NO: 13290 - DNA, 21 bp, Artificial sequence
  Reverse Primer
ttaataaggcagaaggggacc

SEQ ID NO: 13291 - DNA, 23 bp, Artificial sequence
  Reverse Primer
tgaggatataggctcatcaagag

SEQ ID NO: 13292 - DNA, 22 bp, Artificial sequence
  Reverse Primer
tatggagcaatctgcaacataa

SEQ ID NO: 13293 - DNA, 22 bp, Artificial sequence
  Reverse Primer
tgttaagagctgtagaggggag

SEQ ID NO: 13294 - DNA, 20 bp, Artificial sequence
  Reverse Primer
agcattcactgtggagctgt

SEQ ID NO: 13295 - DNA, 27 bp, Artificial sequence
  Reverse Primer
atgaagataataatagctgaaatcagg

SEQ ID NO: 13296 - DNA, 20 bp, Artificial sequence
  Reverse Primer
acctcaaggaacacatcctg

SEQ ID NO: 13297 - DNA, 27 bp, Artificial sequence
  Reverse Primer
tttcattttgaaaaacactttagtacc

SEQ ID NO: 13298 - DNA, 20 bp, Artificial sequence
  Reverse Primer
gtgcaggtacctctccactc

SEQ ID NO: 13299 - DNA, 28 bp, Artificial sequence
  Reverse Primer
cttgtcctttataatataatttgccttt

SEQ ID NO: 13300 - DNA, 20 bp, Artificial sequence
  Reverse Primer
ttgcctttctttcctgatcc

SEQ ID NO: 13301 - DNA, 26 bp, Artificial sequence
  Reverse Primer
taaaaaagtattagttccacctccag

SEQ ID NO: 13302 - DNA, 22 bp, Artificial sequence
  Reverse Primer
tagagactgtgtccactgtgtg

SEQ ID NO: 13303 - DNA, 24 bp, Artificial sequence
  Reverse Primer
tatttgcgactaccaaactgtaga

SEQ ID NO: 13304 - DNA, 23 bp, Artificial sequence
  Reverse Primer
atggactctgaacattaggacaa

SEQ ID NO: 13305 - DNA, 20 bp, Artificial sequence
  Reverse Primer
ctgagggagtccatgaaaaa

SEQ ID NO: 13306 - DNA, 23 bp, Artificial sequence
  Reverse Primer
aataccaaaagctcttcccttaa

SEQ ID NO: 13307 - DNA, 18 bp, Artificial sequence
  Reverse Primer
gaatcctggagggcctct

SEQ ID NO: 13308 - DNA, 23 bp, Artificial sequence
  Reverse Primer
tattttgttacagcagctggagt

SEQ ID NO: 13309 - DNA, 18 bp, Artificial sequence
  Reverse Primer
acacatgcccggatgact

SEQ ID NO: 13310 - DNA, 22 bp, Artificial sequence
  Reverse Primer
caaaatcctttccacaactctg

SEQ ID NO: 13311 - DNA, 26 bp, Artificial sequence
  Reverse Primer
ttagtaagggcagaggagagatatag

SEQ ID NO: 13312 - DNA, 21 bp, Artificial sequence
  Reverse Primer
atggtctttgtttgaaggctt

SEQ ID NO: 13313 - DNA, 24 bp, Artificial sequence
  Reverse Primer
aargagattctgattcaaygtctg

SEQ ID NO: 13314 - DNA, 25 bp, Artificial sequence
  Reverse Primer
cactttaggtgtgtgtagttcacat

SEQ ID NO: 13315 - DNA, 19 bp, Artificial sequence
  Reverse Primer
tttctgttgctgcttgcat

SEQ ID NO: 13316 - DNA, 18 bp, Artificial sequence
  Reverse Primer
aagttcaactgcgggcct

SEQ ID NO: 13317 - DNA, 20 bp, Artificial sequence
  Reverse Primer
aaaacaagcttcatttgggg

SEQ ID NO: 13318 - DNA, 23 bp, Artificial sequence
  Reverse Primer
tcttgtttcagtttctctccaca

SEQ ID NO: 13319 - DNA, 25 bp, Artificial sequence
  Reverse Primer
agaggcatcagagaaagattataca

SEQ ID NO: 13320 - DNA, 21 bp, Artificial sequence
  Reverse Primer
gtgaaataagagacagcccac

SEQ ID NO: 13321 - DNA, 29 bp, Artificial sequence
  Reverse Primer
taaactagaacttgaaggataatcagact

SEQ ID NO: 13322 - DNA, 21 bp, Artificial sequence
  Reverse Primer
tccaacatagcagattatggc

SEQ ID NO: 13323 - DNA, 21 bp, Artificial sequence
  Reverse Primer
ttctagaacacctgccaagtt

SEQ ID NO: 13324 - DNA, 19 bp, Artificial sequence
  Reverse Primer
cagaggtttcatcactggg

SEQ ID NO: 13325 - DNA, 18 bp, Artificial sequence
  Reverse Primer
tcagaggcagcatcacct

SEQ ID NO: 13326 - DNA, 27 bp, Artificial sequence
  Reverse Primer
ttgcaattattatttctgtaaggtttg

SEQ ID NO: 13327 - DNA, 27 bp, Artificial sequence
  Reverse Primer
aaaattaaaaatggtagtgagatgtga

SEQ ID NO: 13328 - DNA, 20 bp, Artificial sequence
  Reverse Primer
gyttctggtacccaaagagc

SEQ ID NO: 13329 - DNA, 23 bp, Artificial sequence
  Reverse Primer
tggctatggatagggtatgtacc

SEQ ID NO: 13330 - DNA, 22 bp, Artificial sequence
  Reverse Primer
ctagtttcagacccagcttctg

SEQ ID NO: 13331 - DNA, 29 bp, Artificial sequence
  Reverse Primer
gctattctttcatttaaggagacttacta

SEQ ID NO: 13332 - DNA, 24 bp, Artificial sequence
  Reverse Primer
ttattctatagcacagcacctgaa

SEQ ID NO: 13333 - DNA, 23 bp, Artificial sequence
  Reverse Primer
ttgcatgtctccaaaattcttac

SEQ ID NO: 13334 - DNA, 20 bp, Artificial sequence
  Reverse Primer
aaaagcctttgagctgcttt

SEQ ID NO: 13335 - DNA, 20 bp, Artificial sequence
  Reverse Primer
ttcactgggaagagtgacct

SEQ ID NO: 13336 - DNA, 25 bp, Artificial sequence
  Reverse Primer
ttgttygtttatagttgttgatgct

SEQ ID NO: 13337 - DNA, 22 bp, Artificial sequence
  Reverse Primer
agcttaaggaggyttctgtcaa

SEQ ID NO: 13338 - DNA, 27 bp, Artificial sequence
  Reverse Primer
acttagtactttgccctacttaaattg

SEQ ID NO: 13339 - DNA, 23 bp, Artificial sequence
  Reverse Primer
aatacatttctggtctttgcaag

SEQ ID NO: 13340 - DNA, 21 bp, Artificial sequence
  Reverse Primer
attttttgcatgttgaggaca

SEQ ID NO: 13341 - DNA, 20 bp, Artificial sequence
  Reverse Primer
ccttggcagttaaaaccaaa

SEQ ID NO: 13342 - DNA, 28 bp, Artificial sequence
  Reverse Primer
ataagactcctcagagaattaacttcag

SEQ ID NO: 13343 - DNA, 21 bp, Artificial sequence
  Reverse Primer
aaaatttcactgttgggttcc

SEQ ID NO: 13344 - DNA, 21 bp, Artificial sequence
  Reverse Primer
aaaaaagcccaaatgaaaaga

SEQ ID NO: 13345 - DNA, 18 bp, Artificial sequence
  Reverse Primer
gctctgtggaaygggcct

SEQ ID NO: 13346 - DNA, 22 bp, Artificial sequence
  Reverse Primer
tgttcagaagacttttgcagaa

SEQ ID NO: 13347 - DNA, 22 bp, Artificial sequence
  Reverse Primer
actagctcgatgtccaattctg

SEQ ID NO: 13348 - DNA, 22 bp, Artificial sequence
  Reverse Primer
actagctcgatgtccaattctg

SEQ ID NO: 13349 - DNA, 23 bp, Artificial sequence
  Reverse Primer
gaacaaatcacttaatyttggca

SEQ ID NO: 13350 - DNA, 26 bp, Artificial sequence
  Reverse Primer
cctgagataatgcatgaaatttatta

SEQ ID NO: 13351 - DNA, 18 bp, Artificial sequence
  Reverse Primer
aagcctgaagagggaggg

SEQ ID NO: 13352 - DNA, 18 bp, Artificial sequence
  Reverse Primer
tttgtagcccgcaccaaa

SEQ ID NO: 13353 - DNA, 21 bp, Artificial sequence
  Reverse Primer
aagcattgcttaagtgaagta

SEQ ID NO: 13354 - DNA, 21 bp, Artificial sequence
  Reverse Primer
atgaggggttggagaatgtaa

SEQ ID NO: 13355 - DNA, 20 bp, Artificial sequence
  Reverse Primer
aaaatttggagcaagggatt

SEQ ID NO: 13356 - DNA, 30 bp, Artificial sequence
  Reverse Primer
aatatatatttaagtctacagtggtgtttc

SEQ ID NO: 13357 - DNA, 19 bp, Artificial sequence
  Reverse Primer
atcaccacctctgggccta

SEQ ID NO: 13358 - DNA, 22 bp, Artificial sequence
  Reverse Primer
aatctctaccagaaccagggtt

SEQ ID NO: 13359 - DNA, 26 bp, Artificial sequence
  Reverse Primer
tacacagataacatcaagtgtcatca

SEQ ID NO: 13360 - DNA, 26 bp, Artificial sequence
  Reverse Primer
tacacagataacatcaagtgtcatca

SEQ ID NO: 13361 - DNA, 27 bp, Artificial sequence
  Reverse Primer
tggttacataatgatgaataacagtct

SEQ ID NO: 13362 - DNA, 28 bp, Artificial sequence
  Reverse Primer
attgtacttttaaactcaggtgattctt

SEQ ID NO: 13363 - DNA, 23 bp, Artificial sequence
  Reverse Primer
accaagactttccttcataacct

SEQ ID NO: 13364 - DNA, 21 bp, Artificial sequence
  Reverse Primer
ttaagggggaaaaagaaaatg

SEQ ID NO: 13365 - DNA, 21 bp, Artificial sequence
  Reverse Primer
gtcagcgctttatttgtagca

SEQ ID NO: 13366 - DNA, 20 bp, Artificial sequence
  Reverse Primer
ttgttctgtatgggtggagc

SEQ ID NO: 13367 - DNA, 26 bp, Artificial sequence
  Reverse Primer
gatgttttatgaaaaaaacaggaact

SEQ ID NO: 13368 - DNA, 18 bp, Artificial sequence
  Reverse Primer
agcaggatggagtcccag

SEQ ID NO: 13369 - DNA, 30 bp, Artificial sequence
  Reverse Primer
ttactatcattatttctttatttgagagag

SEQ ID NO: 13370 - DNA, 23 bp, Artificial sequence
  Reverse Primer
tggccttttattattttcacaaa

SEQ ID NO: 13371 - DNA, 23 bp, Artificial sequence
  Reverse Primer
actggactgttattatccccatt

SEQ ID NO: 13372 - DNA, 22 bp, Artificial sequence
  Reverse Primer
atgggtatcctgttgttttctg

SEQ ID NO: 13373 - DNA, 25 bp, Artificial sequence
  Reverse Primer
ttaataaagttcagtttagcaggcc

SEQ ID NO: 13374 - DNA, 19 bp, Artificial sequence
  Reverse Primer
accttccggttcctgatct

SEQ ID NO: 13375 - DNA, 19 bp, Artificial sequence
  Reverse Primer
tgtttgacctctcccaggt

SEQ ID NO: 13376 - DNA, 23 bp, Artificial sequence
  Reverse Primer
accaccagtgtaagaatccctat

SEQ ID NO: 13377 - DNA, 23 bp, Artificial sequence
  Reverse Primer
atttttacttgtgtcaacaggcc

SEQ ID NO: 13378 - DNA, 23 bp, Artificial sequence
  Reverse Primer
tcacaatgcatgaaacagtatct

SEQ ID NO: 13379 - DNA, 22 bp, Artificial sequence
  Reverse Primer
tttcaggaagcaatgacattta

SEQ ID NO: 13380 - DNA, 22 bp, Artificial sequence
  Reverse Primer
tttttggtggtttgtaatgatg

SEQ ID NO: 13381 - DNA, 27 bp, Artificial sequence
  Reverse Primer
ataaaactcaacagatgaagacattct

SEQ ID NO: 13382 - DNA, 23 bp, Artificial sequence
  Reverse Primer
aacaggacctgtactttcagacc

SEQ ID NO: 13383 - DNA, 23 bp, Artificial sequence
  Reverse Primer
aacgtctttatgtagcgatgtca

SEQ ID NO: 13384 - DNA, 20 bp, Artificial sequence
  Reverse Primer
tgttgtcctgaggactttgg

SEQ ID NO: 13385 - DNA, 21 bp, Artificial sequence
  Reverse Primer
aattgcagcatctatacggag

SEQ ID NO: 13386 - DNA, 24 bp, Artificial sequence
  Reverse Primer
aatggaagcagaagttgtaattct

SEQ ID NO: 13387 - DNA, 24 bp, Artificial sequence
  Reverse Primer
taaatgagttaatatgctcccagg

SEQ ID NO: 13388 - DNA, 20 bp, Artificial sequence
  Reverse Primer
ttccagattcttgggaaaac

SEQ ID NO: 13389 - DNA, 26 bp, Artificial sequence
  Reverse Primer
ttcctgacctatggaatttactttat

SEQ ID NO: 13390 - DNA, 22 bp, Artificial sequence
  Reverse Primer
tacactggggtcttgarcatat

SEQ ID NO: 13391 - DNA, 18 bp, Artificial sequence
  Reverse Primer
tgccttccctctgacctc

SEQ ID NO: 13392 - DNA, 18 bp, Artificial sequence
  Reverse Primer
aggctctggggggtttta

SEQ ID NO: 13393 - DNA, 23 bp, Artificial sequence
  Reverse Primer
ttagaatgaaaaggttggagagc

SEQ ID NO: 13394 - DNA, 27 bp, Artificial sequence
  Reverse Primer
aagtaatttgatcaataaggacaacag

SEQ ID NO: 13395 - DNA, 25 bp, Artificial sequence
  Reverse Primer
agagagtttgaaagttagggaattc

SEQ ID NO: 13396 - DNA, 19 bp, Artificial sequence
  Reverse Primer
gtgtggtgtgagtagggca

SEQ ID NO: 13397 - DNA, 24 bp, Artificial sequence
  Reverse Primer
atacatacggggaagataagatgc

SEQ ID NO: 13398 - DNA, 20 bp, Artificial sequence
  Reverse Primer
aaacaaagacaagcctagcg

SEQ ID NO: 13399 - DNA, 18 bp, Artificial sequence
  Reverse Primer
tgactgcagcatcagcca

SEQ ID NO: 13400 - DNA, 25 bp, Artificial sequence
  Reverse Primer
aacatccacttagtaaccaatgaag

SEQ ID NO: 13401 - DNA, 30 bp, Artificial sequence
  Reverse Primer
tacagaccctaacaaataataataattagc

SEQ ID NO: 13402 - DNA, 27 bp, Artificial sequence
  Reverse Primer
aagtttaccatatgtttcaaagtcact

SEQ ID NO: 13403 - DNA, 24 bp, Artificial sequence
  Reverse Primer
tctagccttgaactttaaaggtgt

SEQ ID NO: 13404 - DNA, 23 bp, Artificial sequence
  Reverse Primer
attctatgcttattttgctcacg

SEQ ID NO: 13405 - DNA, 30 bp, Artificial sequence
  Reverse Primer
tttctattaggtacaacagaaatataaggt

SEQ ID NO: 13406 - DNA, 22 bp, Artificial sequence
  Reverse Primer
agcaacgaaaagagtaggttga

SEQ ID NO: 13407 - DNA, 26 bp, Artificial sequence
  Reverse Primer
taacttaacaaactttgcttaggagc

SEQ ID NO: 13408 - DNA, 29 bp, Artificial sequence
  Reverse Primer
tttgtttcttctgattaggaaagatatac

SEQ ID NO: 13409 - DNA, 19 bp, Artificial sequence
  Reverse Primer
tattttgcctggcattttg

SEQ ID NO: 13410 - DNA, 18 bp, Artificial sequence
  Reverse Primer
tctgggaccacacacctg

SEQ ID NO: 13411 - DNA, 18 bp, Artificial sequence
  Reverse Primer
ttgctgagtcagcgtttc

SEQ ID NO: 13412 - DNA, 26 bp, Artificial sequence
  Reverse Primer
actgagtgactgaattgaactgatat

SEQ ID NO: 13413 - DNA, 18 bp, Artificial sequence
  Reverse Primer
ccagtgtctgggaccaca

SEQ ID NO: 13414 - DNA, 30 bp, Artificial sequence
  Reverse Primer
attaactgtagtacattatctaaaccaaga

SEQ ID NO: 13415 - DNA, 25 bp, Artificial sequence
  Reverse Primer
aaagtaaaataattctatgtggccc

SEQ ID NO: 13416 - DNA, 21 bp, Artificial sequence
  Reverse Primer
agatggcataagcagttctgc

SEQ ID NO: 13417 - DNA, 20 bp, Artificial sequence
  Reverse Primer
aacaaggacagcagttggag

SEQ ID NO: 13418 - DNA, 27 bp, Artificial sequence
  Reverse Primer
aattctttctgcttttatataggcttg

SEQ ID NO: 13419 - DNA, 18 bp, Artificial sequence
  Reverse Primer
ttgtgtctgttccatgcg

SEQ ID NO: 13420 - DNA, 18 bp, Artificial sequence
  Reverse Primer
gtgtgcatacatgcctgc

SEQ ID NO: 13421 - DNA, 29 bp, Artificial sequence
  Reverse Primer
atatatccatattctctactagctggtga

SEQ ID NO: 13422 - DNA, 25 bp, Artificial sequence
  Reverse Primer
acgtcgccaatatataataactgac

SEQ ID NO: 13423 - DNA, 19 bp, Artificial sequence
  Reverse Primer
cttgctctgcaacctcctt

SEQ ID NO: 13424 - DNA, 18 bp, Artificial sequence
  Reverse Primer
accccggctttaaaaggt

SEQ ID NO: 13425 - DNA, 23 bp, Artificial sequence
  Reverse Primer
attcattctcattcaaatgctga

SEQ ID NO: 13426 - DNA, 24 bp, Artificial sequence
  Reverse Primer
tgtatcacgagacaaggtaaaaaa

SEQ ID NO: 13427 - DNA, 20 bp, Artificial sequence
  Reverse Primer
tcacttagcaggtcacttgg

SEQ ID NO: 13428 - DNA, 19 bp, Artificial sequence
  Reverse Primer
tcccatcagtctctcctgc

SEQ ID NO: 13429 - DNA, 19 bp, Artificial sequence
  Reverse Primer
ccgttcacttatctgccac

SEQ ID NO: 13430 - DNA, 18 bp, Artificial sequence
  Reverse Primer
ccccagcactttcagatg

SEQ ID NO: 13431 - DNA, 25 bp, Artificial sequence
  Reverse Primer
aataatctgcatagaaaattccaga

SEQ ID NO: 13432 - DNA, 18 bp, Artificial sequence
  Reverse Primer
gcatgcatgtgaagctcc

SEQ ID NO: 13433 - DNA, 21 bp, Artificial sequence
  Reverse Primer
ttgtacagccagccttaaagc

SEQ ID NO: 13434 - DNA, 21 bp, Artificial sequence
  Reverse Primer
tcacctgccactttgtagaaa

SEQ ID NO: 13435 - DNA, 18 bp, Artificial sequence
  Reverse Primer
gccaccctaggagtcctc

SEQ ID NO: 13436 - DNA, 21 bp, Artificial sequence
  Reverse Primer
atctggaagatgacgagcttg

SEQ ID NO: 13437 - DNA, 23 bp, Artificial sequence
  Reverse Primer
acaaccaaccttcacattatctc

SEQ ID NO: 13438 - DNA, 24 bp, Artificial sequence
  Reverse Primer
taattcctctctgtcttccttcag

SEQ ID NO: 13439 - DNA, 24 bp, Artificial sequence
  Reverse Primer
ttaatagcattctatgggtccatt

SEQ ID NO: 13440 - DNA, 18 bp, Artificial sequence
  Reverse Primer
tccccctcattgcagcta

SEQ ID NO: 13441 - DNA, 22 bp, Artificial sequence
  Reverse Primer
tactttctcttcctcaacagcc

SEQ ID NO: 13442 - DNA, 21 bp, Artificial sequence
  Reverse Primer
agcttcattggcttacacaag

SEQ ID NO: 13443 - DNA, 22 bp, Artificial sequence
  Reverse Primer
ttcatctcctgacgtaacaaac

SEQ ID NO: 13444 - DNA, 25 bp, Artificial sequence
  Reverse Primer
tgaaggctgttacctgtatagatct

SEQ ID NO: 13445 - DNA, 18 bp, Artificial sequence
  Reverse Primer
atctggctttggagggac

SEQ ID NO: 13446 - DNA, 28 bp, Artificial sequence
  Reverse Primer
ataattcattaacactaagttcactgcc

SEQ ID NO: 13447 - DNA, 23 bp, Artificial sequence
  Reverse Primer
aaaatacagcagatccatttagc

SEQ ID NO: 13448 - DNA, 21 bp, Artificial sequence
  Reverse Primer
ttctttaagaccagggactgc

SEQ ID NO: 13449 - DNA, 25 bp, Artificial sequence
  Reverse Primer
agaacatgtaaaacaagaagacctg

SEQ ID NO: 13450 - DNA, 23 bp, Artificial sequence
  Reverse Primer
aagtttccagtaatagasacccc

SEQ ID NO: 13451 - DNA, 20 bp, Artificial sequence
  Reverse Primer
aatctagggtcacaccaccc

SEQ ID NO: 13452 - DNA, 19 bp, Artificial sequence
  Reverse Primer
attatccccggctctcttc

SEQ ID NO: 13453 - DNA, 25 bp, Artificial sequence
  Reverse Primer
atttgtcagaagtatgtttgtggtc

SEQ ID NO: 13454 - DNA, 18 bp, Artificial sequence
  Reverse Primer
tgggtcatgaggggacct

SEQ ID NO: 13455 - DNA, 30 bp, Artificial sequence
  Reverse Primer
aatatgttacattacatgattactatctgt

SEQ ID NO: 13456 - DNA, 28 bp, Artificial sequence
  Reverse Primer
acatattgataaattctccttggtaatc

SEQ ID NO: 13457 - DNA, 29 bp, Artificial sequence
  Reverse Primer
ttatagtagagaaacttagcagacacctt

SEQ ID NO: 13458 - DNA, 24 bp, Artificial sequence
  Reverse Primer
taaaaggaacaagagraagtctcc

SEQ ID NO: 13459 - DNA, 19 bp, Artificial sequence
  Reverse Primer
tgctacagccaaccatgtt

SEQ ID NO: 13460 - DNA, 24 bp, Artificial sequence
  Reverse Primer
ggattattttgctttcctttgtaa

SEQ ID NO: 13461 - DNA, 19 bp, Artificial sequence
  Reverse Primer
tactccctcggtgacattg

SEQ ID NO: 13462 - DNA, 22 bp, Artificial sequence
  Reverse Primer
agctttttctctctgctgtgtg

SEQ ID NO: 13463 - DNA, 24 bp, Artificial sequence
  Reverse Primer
aacttccaatacagaaagcaaaac

SEQ ID NO: 13464 - DNA, 24 bp, Artificial sequence
  Reverse Primer
taccaaaaactggttttcaaactt

SEQ ID NO: 13465 - DNA, 18 bp, Artificial sequence
  Reverse Primer
tgtgatcgtgggtccctt

SEQ ID NO: 13466 - DNA, 20 bp, Artificial sequence
  Reverse Primer
agccttatgtcttggctgag

SEQ ID NO: 13467 - DNA, 21 bp, Artificial sequence
  Reverse Primer
agatcagaagctggtgaaggt

SEQ ID NO: 13468 - DNA, 28 bp, Artificial sequence
  Reverse Primer
aatactaggcattcttattttgaaagtg

SEQ ID NO: 13469 - DNA, 27 bp, Artificial sequence
  Reverse Primer
atattgagtcatacaaatgttttggtt

SEQ ID NO: 13470 - DNA, 18 bp, Artificial sequence
  Reverse Primer
tatcatcgcttcccgtgc

SEQ ID NO: 13471 - DNA, 25 bp, Artificial sequence
  Reverse Primer
aagagaagatgtgatctttttcaga

SEQ ID NO: 13472 - DNA, 23 bp, Artificial sequence
  Reverse Primer
agggccaactgtaagttatatgc

SEQ ID NO: 13473 - DNA, 24 bp, Artificial sequence
  Reverse Primer
acaaagcctaaaatrtttgtctgg

SEQ ID NO: 13474 - DNA, 20 bp, Artificial sequence
  Reverse Primer
atgctccagaatgtgttacg

SEQ ID NO: 13475 - DNA, 22 bp, Artificial sequence
  Reverse Primer
tctatggcagatctctcagatg

SEQ ID NO: 13476 - DNA, 28 bp, Artificial sequence
  Reverse Primer
cagctgagaaattatacagataaaaatt

SEQ ID NO: 13477 - DNA, 20 bp, Artificial sequence
  Reverse Primer
agacaaagagcctcagcaaa

SEQ ID NO: 13478 - DNA, 24 bp, Artificial sequence
  Reverse Primer
taaatatccagaagtggaattggt

SEQ ID NO: 13479 - DNA, 26 bp, Artificial sequence
  Reverse Primer
aactgtaagttctgggtacaaagatt

SEQ ID NO: 13480 - DNA, 18 bp, Artificial sequence
  Reverse Primer
cggatgatggggtggaga

SEQ ID NO: 13481 - DNA, 21 bp, Artificial sequence
  Reverse Primer
tctaattattttgctgcccag

SEQ ID NO: 13482 - DNA, 22 bp, Artificial sequence
  Reverse Primer
artagcgtttaattttgcaggg

SEQ ID NO: 13483 - DNA, 20 bp, Artificial sequence
  Reverse Primer
tttcaaatccttgctgatgg

SEQ ID NO: 13484 - DNA, 21 bp, Artificial sequence
  Reverse Primer
tctctgtgctggttgctttat

SEQ ID NO: 13485 - DNA, 24 bp, Artificial sequence
  Reverse Primer
agagcagggtgactgtagaagtat

SEQ ID NO: 13486 - DNA, 26 bp, Artificial sequence
  Reverse Primer
ataaagattcacaaatggacctagag

SEQ ID NO: 13487 - DNA, 18 bp, Artificial sequence
  Reverse Primer
tttggttgctgagtgtgg

SEQ ID NO: 13488 - DNA, 19 bp, Artificial sequence
  Reverse Primer
tttctcccctgagtttgtg

SEQ ID NO: 13489 - DNA, 28 bp, Artificial sequence
  Reverse Primer
ccatttgtgacaatcagtataataaatt

SEQ ID NO: 13490 - DNA, 18 bp, Artificial sequence
  Reverse Primer
atcccctcccgtccgtct

SEQ ID NO: 13491 - DNA, 18 bp, Artificial sequence
  Reverse Primer
gggttctatcgctgctcg

SEQ ID NO: 13492 - DNA, 21 bp, Artificial sequence
  Reverse Primer
aatktccttccagcaatttgt

SEQ ID NO: 13493 - DNA, 21 bp, Artificial sequence
  Reverse Primer
tttgtgggttctgctctacag

SEQ ID NO: 13494 - DNA, 20 bp, Artificial sequence
  Reverse Primer
atacgtgtgcctgtcaacac

SEQ ID NO: 13495 - DNA, 21 bp, Artificial sequence
  Reverse Primer
ttctgtcagctgctcagaaac

SEQ ID NO: 13496 - DNA, 24 bp, Artificial sequence
  Reverse Primer
tagtcatccagtcaggactagagc

SEQ ID NO: 13497 - DNA, 26 bp, Artificial sequence
  Reverse Primer
taggagagtactagtacacagtgggc

SEQ ID NO: 13498 - DNA, 24 bp, Artificial sequence
  Reverse Primer
tttagttctcctgatttttgacct

SEQ ID NO: 13499 - DNA, 22 bp, Artificial sequence
  Reverse Primer
aagccaaaataacatcaggaca

SEQ ID NO: 13500 - DNA, 30 bp, Artificial sequence
  Reverse Primer
aaatggtactatagttatatgtgacgtaac

SEQ ID NO: 13501 - DNA, 30 bp, Artificial sequence
  Reverse Primer
taagtaaatagatagaaatggttgagaaca

SEQ ID NO: 13502 - DNA, 20 bp, Artificial sequence
  Reverse Primer
aaacctgcatctcctgttcg

SEQ ID NO: 13503 - DNA, 18 bp, Artificial sequence
  Reverse Primer
accctcacygctctctcc

SEQ ID NO: 13504 - DNA, 22 bp, Artificial sequence
  Reverse Primer
tcaaagaaaggaagagctgatg

SEQ ID NO: 13505 - DNA, 22 bp, Artificial sequence
  Reverse Primer
gttggtgaaattgacctaagct

SEQ ID NO: 13506 - DNA, 27 bp, Artificial sequence
  Reverse Primer
aaaaagcctcttgaattagtaaacatt

SEQ ID NO: 13507 - DNA, 28 bp, Artificial sequence
  Reverse Primer
atctagaagactggacaatgtatttttt

SEQ ID NO: 13508 - DNA, 28 bp, Artificial sequence
  Reverse Primer
gctatagtcatcataaagggttaattct

SEQ ID NO: 13509 - DNA, 20 bp, Artificial sequence
  Reverse Primer
aaaattcatcacggctatgc

SEQ ID NO: 13510 - DNA, 26 bp, Artificial sequence
  Reverse Primer
tcttgaatcttattttgcctagattt

SEQ ID NO: 13511 - DNA, 18 bp, Artificial sequence
  Reverse Primer
agtggggctgcctgcagt

SEQ ID NO: 13512 - DNA, 23 bp, Artificial sequence
  Reverse Primer
aagaacaacccataagactgtgg

SEQ ID NO: 13513 - DNA, 27 bp, Artificial sequence
  Reverse Primer
tctagtgtagttaatctctcctagggg

SEQ ID NO: 13514 - DNA, 26 bp, Artificial sequence
  Reverse Primer
ttttaaaactgagaaaactgacaatg

SEQ ID NO: 13515 - DNA, 27 bp, Artificial sequence
  Reverse Primer
tttctatcttgttagattcagtccatt

SEQ ID NO: 13516 - DNA, 21 bp, Artificial sequence
  Reverse Primer
tttagaaggagggtctctcca

SEQ ID NO: 13517 - DNA, 23 bp, Artificial sequence
  Reverse Primer
gaatcagaacaaaattttctggg

SEQ ID NO: 13518 - DNA, 26 bp, Artificial sequence
  Reverse Primer
taatgttaactttatgagcttcagga

SEQ ID NO: 13519 - DNA, 20 bp, Artificial sequence
  Reverse Primer
aggttctccaagcattcacc

SEQ ID NO: 13520 - DNA, 23 bp, Artificial sequence
  Reverse Primer
tttcctttgctatttctgagatg

SEQ ID NO: 13521 - DNA, 21 bp, Artificial sequence
  Reverse Primer
atgtcgtctctctaccatggg

SEQ ID NO: 13522 - DNA, 26 bp, Artificial sequence
  Reverse Primer
tatgatttcytcaatcctagtgaaag

SEQ ID NO: 13523 - DNA, 23 bp, Artificial sequence
  Reverse Primer
agaagtcagtgttggagactcac

SEQ ID NO: 13524 - DNA, 18 bp, Artificial sequence
  Reverse Primer
tctgctccaagtgcaacg

SEQ ID NO: 13525 - DNA, 24 bp, Artificial sequence
  Reverse Primer
attaatgatgcctaacttggagtg

SEQ ID NO: 13526 - DNA, 20 bp, Artificial sequence
  Reverse Primer
tgactgggataagaagcgtg

SEQ ID NO: 13527 - DNA, 29 bp, Artificial sequence
  Reverse Primer
aacttacatttagacaattaaacagcttg

SEQ ID NO: 13528 - DNA, 20 bp, Artificial sequence
  Reverse Primer
cactgcttatttgccaacaa

SEQ ID NO: 13529 - DNA, 21 bp, Artificial sequence
  Reverse Primer
tatggcatctagcaaaggact

SEQ ID NO: 13530 - DNA, 28 bp, Artificial sequence
  Reverse Primer
tattgtacagacctttttaaagkattca

SEQ ID NO: 13531 - DNA, 18 bp, Artificial sequence
  Reverse Primer
gggaccaggctgctatca

SEQ ID NO: 13532 - DNA, 26 bp, Artificial sequence
  Reverse Primer
aagataaagacaatgctaaagaaatg

SEQ ID NO: 13533 - DNA, 26 bp, Artificial sequence
  Reverse Primer
aaatgctccagtttttatttaaagtc

SEQ ID NO: 13534 - DNA, 26 bp, Artificial sequence
  Reverse Primer
acactgatgtatctaacagctcagac

SEQ ID NO: 13535 - DNA, 19 bp, Artificial sequence
  Reverse Primer
ttgtaatgggcaaacatgg

SEQ ID NO: 13536 - DNA, 28 bp, Artificial sequence
  Reverse Primer
aatgaaattaaaatagagcattgtacac

SEQ ID NO: 13537 - DNA, 22 bp, Artificial sequence
  Reverse Primer
tattatctttccctctggcatc

SEQ ID NO: 13538 - DNA, 30 bp, Artificial sequence
  Reverse Primer
gtttatacttgaagaaattttactgaactt

SEQ ID NO: 13539 - DNA, 19 bp, Artificial sequence
  Reverse Primer
ttacccacctacccttcct

SEQ ID NO: 13540 - DNA, 22 bp, Artificial sequence
  Reverse Primer
ttattcattgattccctgacca

SEQ ID NO: 13541 - DNA, 19 bp, Artificial sequence
  Reverse Primer
acctgtgcctgagtaggct

SEQ ID NO: 13542 - DNA, 25 bp, Artificial sequence
  Reverse Primer
taatttacgactcaaacacgctatt

SEQ ID NO: 13543 - DNA, 28 bp, Artificial sequence
  Reverse Primer
acaaaaaaactgattatatacaaaacgg

SEQ ID NO: 13544 - DNA, 22 bp, Artificial sequence
  Reverse Primer
ttaaaaagtggcttgttgacct

SEQ ID NO: 13545 - DNA, 19 bp, Artificial sequence
  Reverse Primer
aatccaayccatttcacca

SEQ ID NO: 13546 - DNA, 27 bp, Artificial sequence
  Reverse Primer
ctaaaggagaattaaaaaagaatggtt

SEQ ID NO: 13547 - DNA, 20 bp, Artificial sequence
  Reverse Primer
ggctgccttcttttgtttac

SEQ ID NO: 13548 - DNA, 27 bp, Artificial sequence
  Reverse Primer
attttatagctgatgaaactgagaaac

SEQ ID NO: 13549 - DNA, 25 bp, Artificial sequence
  Reverse Primer
taatggagatcttttcatttatgca

SEQ ID NO: 13550 - DNA, 30 bp, Artificial sequence
  Reverse Primer
tgaagatactataagtttaatcaaagactg

SEQ ID NO: 13551 - DNA, 30 bp, Artificial sequence
  Reverse Primer
agtgatatagtcactaatattttaaccaat

SEQ ID NO: 13552 - DNA, 21 bp, Artificial sequence
  Reverse Primer
tactgaatgctgsrcatggtt

SEQ ID NO: 13553 - DNA, 26 bp, Artificial sequence
  Reverse Primer
ccctttattgtacagacctttttaaa

SEQ ID NO: 13554 - DNA, 24 bp, Artificial sequence
  Reverse Primer
tttttactgtgtgagttccaagtg

SEQ ID NO: 13555 - DNA, 23 bp, Artificial sequence
  Reverse Primer
aactgacacaaacctgagaactg

SEQ ID NO: 13556 - DNA, 27 bp, Artificial sequence
  Reverse Primer
tgctacttgattatttgtttagaacag

SEQ ID NO: 13557 - DNA, 26 bp, Artificial sequence
  Reverse Primer
ttacaataagtgtgttttgtcaaagg

SEQ ID NO: 13558 - DNA, 22 bp, Artificial sequence
  Reverse Primer
cagaaaaggacattcatgaagc

SEQ ID NO: 13559 - DNA, 28 bp, Artificial sequence
  Reverse Primer
taagtctaatgtttgaggaaatgtctag

SEQ ID NO: 13560 - DNA, 30 bp, Artificial sequence
  Reverse Primer
tttatgtaaaagctcacttatataatcttc

SEQ ID NO: 13561 - DNA, 23 bp, Artificial sequence
  Reverse Primer
tgaattcaatgaacgtttttctg

SEQ ID NO: 13562 - DNA, 22 bp, Artificial sequence
  Reverse Primer
atctctcacattaccccatgaa

SEQ ID NO: 13563 - DNA, 20 bp, Artificial sequence
  Reverse Primer
aaacaatgaaggcrcaaaga

SEQ ID NO: 13564 - DNA, 23 bp, Artificial sequence
  Reverse Primer
aatatttaaatgcaattctgggg

SEQ ID NO: 13565 - DNA, 18 bp, Artificial sequence
  Reverse Primer
agaamtgcagccacgctt

SEQ ID NO: 13566 - DNA, 30 bp, Artificial sequence
  Reverse Primer
atagttgtaaagtggaactataacaattaa

SEQ ID NO: 13567 - DNA, 28 bp, Artificial sequence
  Reverse Primer
atagtctagatttagtgagtcaagggaa

SEQ ID NO: 13568 - DNA, 26 bp, Artificial sequence
  Reverse Primer
tatagctgataaatgtggtcaagaaa

SEQ ID NO: 13569 - DNA, 26 bp, Artificial sequence
  Reverse Primer
ataaacaaatatgttgtaggagcatg

SEQ ID NO: 13570 - DNA, 18 bp, Artificial sequence
  Reverse Primer
agggtccccagagccact

SEQ ID NO: 13571 - DNA, 22 bp, Artificial sequence
  Reverse Primer
aagacctgggtattaacagcaa

SEQ ID NO: 13572 - DNA, 29 bp, Artificial sequence
  Reverse Primer
acaaaaaagtagttcttagcttttgtaca

SEQ ID NO: 13573 - DNA, 20 bp, Artificial sequence
  Reverse Primer
agttaggcctacaggcagga

SEQ ID NO: 13574 - DNA, 24 bp, Artificial sequence
  Reverse Primer
tttcttaaaatttcattaatcggc

SEQ ID NO: 13575 - DNA, 23 bp, Artificial sequence
  Reverse Primer
attctggattacaatccatacgg

SEQ ID NO: 13576 - DNA, 30 bp, Artificial sequence
  Reverse Primer
gttatatttacatagttactaggggcagtt

SEQ ID NO: 13577 - DNA, 23 bp, Artificial sequence
  Reverse Primer
tattgaagaccatcctcctaagc

SEQ ID NO: 13578 - DNA, 26 bp, Artificial sequence
  Reverse Primer
aaacatcctgcttaaggaattaatag

SEQ ID NO: 13579 - DNA, 18 bp, Artificial sequence
  Reverse Primer
ttgatyctcggggctccc

SEQ ID NO: 13580 - DNA, 19 bp, Artificial sequence
  Reverse Primer
ccatggttaagatccccat

SEQ ID NO: 13581 - DNA, 24 bp, Artificial sequence
  Reverse Primer
ataaagatttatgaaagggctttg

SEQ ID NO: 13582 - DNA, 28 bp, Artificial sequence
  Reverse Primer
gtgtcatattttgatagtttwtccaagt

SEQ ID NO: 13583 - DNA, 27 bp, Artificial sequence
  Reverse Primer
aatgagtaagtcttttgtgagtctgat

SEQ ID NO: 13584 - DNA, 23 bp, Artificial sequence
  Reverse Primer
agacagctgatgttgttagtcca

SEQ ID NO: 13585 - DNA, 22 bp, Artificial sequence
  Reverse Primer
tgataggaattagcagaagcag

SEQ ID NO: 13586 - DNA, 27 bp, Artificial sequence
  Reverse Primer
gttttgttcatgaaaatattcatactg

SEQ ID NO: 13587 - DNA, 28 bp, Artificial sequence
  Reverse Primer
aatcagtacattctgtatttgaatgttt

SEQ ID NO: 13588 - DNA, 21 bp, Artificial sequence
  Reverse Primer
agctgctttttcttctgcttt

SEQ ID NO: 13589 - DNA, 19 bp, Artificial sequence
  Reverse Primer
cacccctaaactgcaggtg

SEQ ID NO: 13590 - DNA, 23 bp, Artificial sequence
  Reverse Primer
gttttctctttcactgttaggca

SEQ ID NO: 13591 - DNA, 24 bp, Artificial sequence
  Reverse Primer
tcaaattgagaaagaaagtgattg

SEQ ID NO: 13592 - DNA, 23 bp, Artificial sequence
  Reverse Primer
aaaaatagtaaaccagcacacta

SEQ ID NO: 13593 - DNA, 26 bp, Artificial sequence
  Reverse Primer
aatttaggtttacagctgtattctgc

SEQ ID NO: 13594 - DNA, 25 bp, Artificial sequence
  Reverse Primer
aaataacatacctccttatggaagg

SEQ ID NO: 13595 - DNA, 20 bp, Artificial sequence
  Reverse Primer
agatgaatgtcactgagcgg

SEQ ID NO: 13596 - DNA, 21 bp, Artificial sequence
  Reverse Primer
tggagatgaatgtcactgagc

SEQ ID NO: 13597 - DNA, 24 bp, Artificial sequence
  Reverse Primer
taatccttcatttcagagcaaatc

SEQ ID NO: 13598 - DNA, 26 bp, Artificial sequence
  Reverse Primer
ttgttcacaactttctgaatctttaa

SEQ ID NO: 13599 - DNA, 18 bp, Artificial sequence
  Reverse Primer
tccctgcaacacccactc

SEQ ID NO: 13600 - DNA, 24 bp, Artificial sequence
  Reverse Primer
atgtctgcaagattcttctctttt

SEQ ID NO: 13601 - DNA, 19 bp, Artificial sequence
  Reverse Primer
tatttctccctggctctgg

SEQ ID NO: 13602 - DNA, 21 bp, Artificial sequence
  Reverse Primer
tagtcaactttggcaaaaccg

SEQ ID NO: 13603 - DNA, 30 bp, Artificial sequence
  Reverse Primer
ttttcttagttgtctacaataaaaagtgag

SEQ ID NO: 13604 - DNA, 20 bp, Artificial sequence
  Reverse Primer
gcatgcaagcctataaatgg

SEQ ID NO: 13605 - DNA, 18 bp, Artificial sequence
  Reverse Primer
aaaagacagccctgctcc

SEQ ID NO: 13606 - DNA, 27 bp, Artificial sequence
  Reverse Primer
tcttctgatttcagaataagatcaaat

SEQ ID NO: 13607 - DNA, 23 bp, Artificial sequence
  Reverse Primer
tgttctaattcactgtttgcagg

SEQ ID NO: 13608 - DNA, 18 bp, Artificial sequence
  Reverse Primer
agctcactccctccaggg

SEQ ID NO: 13609 - DNA, 26 bp, Artificial sequence
  Reverse Primer
tttcaaatatgcagtttttagaacac

SEQ ID NO: 13610 - DNA, 22 bp, Artificial sequence
  Reverse Primer
aatttctccrggaagcatttat

SEQ ID NO: 13611 - DNA, 19 bp, Artificial sequence
  Reverse Primer
agaccttgaggccatctca

SEQ ID NO: 13612 - DNA, 23 bp, Artificial sequence
  Reverse Primer
tatcatctccatgatgaggaaat

SEQ ID NO: 13613 - DNA, 20 bp, Artificial sequence
  Reverse Primer
tctcagaggacagtgcatcg

SEQ ID NO: 13614 - DNA, 29 bp, Artificial sequence
  Reverse Primer
tctctcacatatattatgagatcacaact

SEQ ID NO: 13615 - DNA, 27 bp, Artificial sequence
  Reverse Primer
tgataaaatgttagcttcttttgtttc

SEQ ID NO: 13616 - DNA, 23 bp, Artificial sequence
  Reverse Primer
taatttattcaaccagtctccca

SEQ ID NO: 13617 - DNA, 18 bp, Artificial sequence
  Reverse Primer
aagtgagcgtgaggggct

SEQ ID NO: 13618 - DNA, 30 bp, Artificial sequence
  Reverse Primer
gagaagtctctttaacaatagaattacaaa

SEQ ID NO: 13619 - DNA, 30 bp, Artificial sequence
  Reverse Primer
gtagatatttgagcaaagttaaacagttat

SEQ ID NO: 13620 - DNA, 29 bp, Artificial sequence
  Reverse Primer
tatgctaaatcttatttaatggactatgc

SEQ ID NO: 13621 - DNA, 23 bp, Artificial sequence
  Reverse Primer
tgcaattaaccagagatatgagc

SEQ ID NO: 13622 - DNA, 24 bp, Artificial sequence
  Reverse Primer
atgaatcagatcctctactcttcc

SEQ ID NO: 13623 - DNA, 20 bp, Artificial sequence
  Reverse Primer
ccaacaatgattccaaggtg

SEQ ID NO: 13624 - DNA, 26 bp, Artificial sequence
  Reverse Primer
tgtttttactgaatgtcttgaatgtt

SEQ ID NO: 13625 - DNA, 20 bp, Artificial sequence
  Reverse Primer
aggcatcagcaaattttttg

SEQ ID NO: 13626 - DNA, 28 bp, Artificial sequence
  Reverse Primer
taactcttacctaaagttaatttcccac

SEQ ID NO: 13627 - DNA, 26 bp, Artificial sequence
  Reverse Primer
cagatatttcatactctcagttgcat

SEQ ID NO: 13628 - DNA, 18 bp, Artificial sequence
  Reverse Primer
tctcggctcttayggagc

SEQ ID NO: 13629 - DNA, 21 bp, Artificial sequence
  Reverse Primer
agaggaaacaaacacaagacc

SEQ ID NO: 13630 - DNA, 22 bp, Artificial sequence
  Reverse Primer
actcttacctctcgactggagg

SEQ ID NO: 13631 - DNA, 22 bp, Artificial sequence
  Reverse Primer
agcctccatttcttctaggact

SEQ ID NO: 13632 - DNA, 21 bp, Artificial sequence
  Reverse Primer
ttgtcctgtgagatayagggg

SEQ ID NO: 13633 - DNA, 23 bp, Artificial sequence
  Reverse Primer
ttgcatggattaatcaatttttg

SEQ ID NO: 13634 - DNA, 26 bp, Artificial sequence
  Reverse Primer
tggtatttaaaagcaggttacagata

SEQ ID NO: 13635 - DNA, 18 bp, Artificial sequence
  Reverse Primer
tcacttgctcacatgggg

SEQ ID NO: 13636 - DNA, 20 bp, Artificial sequence
  Reverse Primer
tagtgtcgcagaatcgaaca

SEQ ID NO: 13637 - DNA, 22 bp, Artificial sequence
  Reverse Primer
atcagggaagaactatcacctc

SEQ ID NO: 13638 - DNA, 18 bp, Artificial sequence
  Reverse Primer
acaccaccatgggacatg

SEQ ID NO: 13639 - DNA, 24 bp, Artificial sequence
  Reverse Primer
taaactttctcatttgaaggaacc

SEQ ID NO: 13640 - DNA, 29 bp, Artificial sequence
  Reverse Primer
taacagtcctctgacatatatacaaagag

SEQ ID NO: 13641 - DNA, 28 bp, Artificial sequence
  Reverse Primer
aaaagtcttattattcccattcttactg

SEQ ID NO: 13642 - DNA, 21 bp, Artificial sequence
  Reverse Primer
agtgcttgaaacaacacaacc

SEQ ID NO: 13643 - DNA, 27 bp, Artificial sequence
  Reverse Primer
cttaattttctttattataattgggcc

SEQ ID NO: 13644 - DNA, 18 bp, Artificial sequence
  Reverse Primer
taaccaaaccctggctgg

SEQ ID NO: 13645 - DNA, 24 bp, Artificial sequence
  Reverse Primer
tgtataatatcctctcccactcct

SEQ ID NO: 13646 - DNA, 23 bp, Artificial sequence
  Reverse Primer
agttgcttcataaatccaagtgg

SEQ ID NO: 13647 - DNA, 25 bp, Artificial sequence
  Reverse Primer
agtatgtacagcaccattgtacagt

SEQ ID NO: 13648 - DNA, 28 bp, Artificial sequence
  Reverse Primer
tttaatatcatgcattttgaactactag

SEQ ID NO: 13649 - DNA, 30 bp, Artificial sequence
  Reverse Primer
aaataatttatagaggagagattatttacc

SEQ ID NO: 13650 - DNA, 28 bp, Artificial sequence
  Reverse Primer
acacacatacacatactcaatttttttt

SEQ ID NO: 13651 - DNA, 24 bp, Artificial sequence
  Reverse Primer
agagtagccagaaattcagactca

SEQ ID NO: 13652 - DNA, 23 bp, Artificial sequence
  Reverse Primer
aaattcgtaagtacctgagctcc

SEQ ID NO: 13653 - DNA, 22 bp, Artificial sequence
  Reverse Primer
atccctgtaccaagatcacaga

SEQ ID NO: 13654 - DNA, 24 bp, Artificial sequence
  Reverse Primer
tagaacaamaaaacttcctttcca

SEQ ID NO: 13655 - DNA, 22 bp, Artificial sequence
  Reverse Primer
atacaggggaggagataggttc

SEQ ID NO: 13656 - DNA, 18 bp, Artificial sequence
  Reverse Primer
aacacgccccyagttcat

SEQ ID NO: 13657 - DNA, 27 bp, Artificial sequence
  Reverse Primer
cagtatagcatttcctcttgagataat

SEQ ID NO: 13658 - DNA, 19 bp, Artificial sequence
  Reverse Primer
atataaatggcccgtgagc

SEQ ID NO: 13659 - DNA, 18 bp, Artificial sequence
  Reverse Primer
aaactgccgcccatcctc

SEQ ID NO: 13660 - DNA, 25 bp, Artificial sequence
  Reverse Primer
tttataaatcctctgcaaatttctg

SEQ ID NO: 13661 - DNA, 22 bp, Artificial sequence
  Reverse Primer
actcacagacttagttgctccg

SEQ ID NO: 13662 - DNA, 21 bp, Artificial sequence
  Reverse Primer
taagcagtctgaacagcaagc

SEQ ID NO: 13663 - DNA, 26 bp, Artificial sequence
  Reverse Primer
gttagtctgttaaaagcatgttctca

SEQ ID NO: 13664 - DNA, 22 bp, Artificial sequence
  Reverse Primer
gacaaaatgtgtcagcagtagc

SEQ ID NO: 13665 - DNA, 27 bp, Artificial sequence
  Reverse Primer
attaacactgtattttgaccaagaagt

SEQ ID NO: 13666 - DNA, 27 bp, Artificial sequence
  Reverse Primer
tgtgtacaaagtatgcaagaaaaataa

SEQ ID NO: 13667 - DNA, 24 bp, Artificial sequence
  Reverse Primer
atasaacttgacagagctgtaccc

SEQ ID NO: 13668 - DNA, 25 bp, Artificial sequence
  Reverse Primer
aaaagaatcaaaggacagagttttt

SEQ ID NO: 13669 - DNA, 22 bp, Artificial sequence
  Reverse Primer
aaagttccacatccaagaacag

SEQ ID NO: 13670 - DNA, 28 bp, Artificial sequence
  Reverse Primer
aaaaataatttcagatacctttcaagtg

SEQ ID NO: 13671 - DNA, 22 bp, Artificial sequence
  Reverse Primer
ttgaagaagagtcttgagcgtc

SEQ ID NO: 13672 - DNA, 24 bp, Artificial sequence
  Reverse Primer
aaaacaattacctattgatttgcc

SEQ ID NO: 13673 - DNA, 20 bp, Artificial sequence
  Reverse Primer
ttctggtctgacgtcatcct

SEQ ID NO: 13674 - DNA, 26 bp, Artificial sequence
  Reverse Primer
agagaagttagataatttgcctgaaa

SEQ ID NO: 13675 - DNA, 25 bp, Artificial sequence
  Reverse Primer
acaatagctcattggtaataatgga

SEQ ID NO: 13676 - DNA, 30 bp, Artificial sequence
  Reverse Primer
ttacacaatattgaatataaacaactacag

SEQ ID NO: 13677 - DNA, 22 bp, Artificial sequence
  Reverse Primer
ttaacgtcactgctgtttatcc

SEQ ID NO: 13678 - DNA, 28 bp, Artificial sequence
  Reverse Primer
taagtataaatttatcattggcttttcc

SEQ ID NO: 13679 - DNA, 20 bp, Artificial sequence
  Reverse Primer
cagtgagagcgaatgacaca

SEQ ID NO: 13680 - DNA, 24 bp, Artificial sequence
  Reverse Primer
tttttatgtcttggctctccttac

SEQ ID NO: 13681 - DNA, 25 bp, Artificial sequence
  Reverse Primer
aatatggcttgaatcagtcattatc

SEQ ID NO: 13682 - DNA, 19 bp, Artificial sequence
  Reverse Primer
ttcccttccaaagacagga

SEQ ID NO: 13683 - DNA, 18 bp, Artificial sequence
  Reverse Primer
agcagtccgggcagagct

SEQ ID NO: 13684 - DNA, 26 bp, Artificial sequence
  Reverse Primer
atcagaaaagagatccttgtagaaca

SEQ ID NO: 13685 - DNA, 18 bp, Artificial sequence
  Reverse Primer
aagggagcagggttgggg

SEQ ID NO: 13686 - DNA, 18 bp, Artificial sequence
  Reverse Primer
tggcaacccacgcctgta

SEQ ID NO: 13687 - DNA, 22 bp, Artificial sequence
  Reverse Primer
cctgcattttctcagattgtag

SEQ ID NO: 13688 - DNA, 21 bp, Artificial sequence
  Reverse Primer
atgggaggtatgctttcagaa

SEQ ID NO: 13689 - DNA, 22 bp, Artificial sequence
  Reverse Primer
tttcagaggacacttaccagag

SEQ ID NO: 13690 - DNA, 24 bp, Artificial sequence
  Reverse Primer
gtgttgaattctgacactagcttt

SEQ ID NO: 13691 - DNA, 19 bp, Artificial sequence
  Reverse Primer
ttctttgtggctgatcctg

SEQ ID NO: 13692 - DNA, 21 bp, Artificial sequence
  Reverse Primer
attcaaggaaacaaacagcct

SEQ ID NO: 13693 - DNA, 22 bp, Artificial sequence
  Reverse Primer
tttgaacacaggtgttgaattc

SEQ ID NO: 13694 - DNA, 25 bp, Artificial sequence
  Reverse Primer
tgtcacattttaacagtcaacaaga

SEQ ID NO: 13695 - DNA, 21 bp, Artificial sequence
  Reverse Primer
ttgaagaggtcatggtcagat

SEQ ID NO: 13696 - DNA, 24 bp, Artificial sequence
  Reverse Primer
ggaagagatgaagaggatatttcc

SEQ ID NO: 13697 - DNA, 29 bp, Artificial sequence
  Reverse Primer
ttacttaggtcagaaaaagataatttgtg

SEQ ID NO: 13698 - DNA, 18 bp, Artificial sequence
  Reverse Primer
agtggacgctgcagacag

SEQ ID NO: 13699 - DNA, 26 bp, Artificial sequence
  Reverse Primer
atatggtactcaaatccttagatgga

SEQ ID NO: 13700 - DNA, 19 bp, Artificial sequence
  Reverse Primer
atttggtttcctgccaaga

SEQ ID NO: 13701 - DNA, 20 bp, Artificial sequence
  Reverse Primer
tttgaaagtgcaaaacatgg

SEQ ID NO: 13702 - DNA, 20 bp, Artificial sequence
  Reverse Primer
agcagtagtccatgctacgc

SEQ ID NO: 13703 - DNA, 26 bp, Artificial sequence
  Reverse Primer
ttctcattagstggtagattacttga

SEQ ID NO: 13704 - DNA, 19 bp, Artificial sequence
  Reverse Primer
tgtccccaaactcctgttc

SEQ ID NO: 13705 - DNA, 23 bp, Artificial sequence
  Reverse Primer
agatcagagtgatgggactatcc

SEQ ID NO: 13706 - DNA, 18 bp, Artificial sequence
  Reverse Primer
tcccgcccgacacagatg

SEQ ID NO: 13707 - DNA, 24 bp, Artificial sequence
  Reverse Primer
tttatatagactggatgagctggg

SEQ ID NO: 13708 - DNA, 24 bp, Artificial sequence
  Reverse Primer
cgaatgtcaaattgtggatttata

SEQ ID NO: 13709 - DNA, 25 bp, Artificial sequence
  Reverse Primer
taacaacgtgtttgaaaactatgac

SEQ ID NO: 13710 - DNA, 30 bp, Artificial sequence
  Reverse Primer
ttagtagggagtatgtttttaattgactac

SEQ ID NO: 13711 - DNA, 24 bp, Artificial sequence
  Reverse Primer
tagatttcaraggttagatcaggg

SEQ ID NO: 13712 - DNA, 24 bp, Artificial sequence
  Reverse Primer
tttgtgtccattttttagacacac

SEQ ID NO: 13713 - DNA, 21 bp, Artificial sequence
  Reverse Primer
ccagagtttctttgggttgat

SEQ ID NO: 13714 - DNA, 24 bp, Artificial sequence
  Reverse Primer
taagtacaaaggcaggacctaaaa

SEQ ID NO: 13715 - DNA, 26 bp, Artificial sequence
  Reverse Primer
aggaataaaatgctttaaatgacatc

SEQ ID NO: 13716 - DNA, 30 bp, Artificial sequence
  Reverse Primer
caagactgtaaaaaataagtgaatactgta

SEQ ID NO: 13717 - DNA, 20 bp, Artificial sequence
  Reverse Primer
tattttccactgggaatggc

SEQ ID NO: 13718 - DNA, 25 bp, Artificial sequence
  Reverse Primer
atcatttactccataaatcaagctg

SEQ ID NO: 13719 - DNA, 26 bp, Artificial sequence
  Reverse Primer
aacagagaacaaaaattaaaaagctg

SEQ ID NO: 13720 - DNA, 24 bp, Artificial sequence
  Reverse Primer
aaattgttcactgaatttaatggg

SEQ ID NO: 13721 - DNA, 20 bp, Artificial sequence
  Reverse Primer
atctgaccaaccagcttctg

SEQ ID NO: 13722 - DNA, 28 bp, Artificial sequence
  Reverse Primer
agatgattattctggaaaagagataact

SEQ ID NO: 13723 - DNA, 22 bp, Artificial sequence
  Reverse Primer
aatcttgggggaaaagattatc

SEQ ID NO: 13724 - DNA, 18 bp, Artificial sequence
  Reverse Primer
atgtttgcacccctggca

SEQ ID NO: 13725 - DNA, 29 bp, Artificial sequence
  Reverse Primer
tctttatgttgaattaagaaagtagtgtg

SEQ ID NO: 13726 - DNA, 21 bp, Artificial sequence
  Reverse Primer
atttgagccaagctaaccatc

SEQ ID NO: 13727 - DNA, 22 bp, Artificial sequence
  Reverse Primer
aatcccaaccttctactaccct

SEQ ID NO: 13728 - DNA, 20 bp, Artificial sequence
  Reverse Primer
atgccaatacaaaaccttcc

SEQ ID NO: 13729 - DNA, 21 bp, Artificial sequence
  Reverse Primer
tttgaacagagagatgccaaa

SEQ ID NO: 13730 - DNA, 29 bp, Artificial sequence
  Reverse Primer
atatctcttaaagtacttatcctacatgg

SEQ ID NO: 13731 - DNA, 28 bp, Artificial sequence
  Reverse Primer
atatatttttactctttccatttgcttc

SEQ ID NO: 13732 - DNA, 20 bp, Artificial sequence
  Reverse Primer
agacagttgcgatgggatat

SEQ ID NO: 13733 - DNA, 25 bp, Artificial sequence
  Reverse Primer
aagttgtttgatttacttgcttgtt

SEQ ID NO: 13734 - DNA, 20 bp, Artificial sequence
  Reverse Primer
attatcgtggtggttaccca

SEQ ID NO: 13735 - DNA, 21 bp, Artificial sequence
  Reverse Primer
acattgatccattgaaactgc

SEQ ID NO: 13736 - DNA, 18 bp, Artificial sequence
  Reverse Primer
gcagggagcagtttcagg

SEQ ID NO: 13737 - DNA, 25 bp, Artificial sequence
  Reverse Primer
aaaatcactcattgttcactcactt

SEQ ID NO: 13738 - DNA, 25 bp, Artificial sequence
  Reverse Primer
aacttgtaccattaaaccacaaacc

SEQ ID NO: 13739 - DNA, 23 bp, Artificial sequence
  Reverse Primer
ttcttgagacaattagcattgtg

SEQ ID NO: 13740 - DNA, 29 bp, Artificial sequence
  Reverse Primer
tttgttctttacctaaattctytacaact

SEQ ID NO: 13741 - DNA, 27 bp, Artificial sequence
  Reverse Primer
tgtgcccatatgaatattagttactta

SEQ ID NO: 13742 - DNA, 21 bp, Artificial sequence
  Reverse Primer
tttgtttctcccactgagtga

SEQ ID NO: 13743 - DNA, 21 bp, Artificial sequence
  Reverse Primer
tggtctacacacacacatgca

SEQ ID NO: 13744 - DNA, 30 bp, Artificial sequence
  Reverse Primer
tctatacattgataacagataactcatcaa

SEQ ID NO: 13745 - DNA, 23 bp, Artificial sequence
  Reverse Primer
taagcacagtgtgaattctttga

SEQ ID NO: 13746 - DNA, 20 bp, Artificial sequence
  Reverse Primer
aactgcatcttgtttccagg

SEQ ID NO: 13747 - DNA, 25 bp, Artificial sequence
  Reverse Primer
tkaaaacattcctcccttatctaaa

SEQ ID NO: 13748 - DNA, 30 bp, Artificial sequence
  Reverse Primer
agaaaatgtcaataatatgatatatgtccc

SEQ ID NO: 13749 - DNA, 29 bp, Artificial sequence
  Reverse Primer
aacttccatctagttcctaataagatttt

SEQ ID NO: 13750 - DNA, 20 bp, Artificial sequence
  Reverse Primer
tggcctcaaggaartatctc

SEQ ID NO: 13751 - DNA, 21 bp, Artificial sequence
  Reverse Primer
aggcttttctaaaccaggctt

SEQ ID NO: 13752 - DNA, 30 bp, Artificial sequence
  Reverse Primer
aagactctgggtaaatagaaagtattagta

SEQ ID NO: 13753 - DNA, 23 bp, Artificial sequence
  Reverse Primer
aagatccactagagaaggcaatg

SEQ ID NO: 13754 - DNA, 19 bp, Artificial sequence
  Reverse Primer
atgaccggcataacaactg

SEQ ID NO: 13755 - DNA, 20 bp, Artificial sequence
  Reverse Primer
tagaccacgagcaaaagctg

SEQ ID NO: 13756 - DNA, 30 bp, Artificial sequence
  Reverse Primer
taaaagctcacttatataatcttctccttt

SEQ ID NO: 13757 - DNA, 26 bp, Artificial sequence
  Reverse Primer
ttagtgggaggaattgagtaataatt

SEQ ID NO: 13758 - DNA, 24 bp, Artificial sequence
  Reverse Primer
ttttcttttttgcttcatctttct

SEQ ID NO: 13759 - DNA, 22 bp, Artificial sequence
  Reverse Primer
aaactcccactactgtcaagga

SEQ ID NO: 13760 - DNA, 26 bp, Artificial sequence
  Reverse Primer
aatttgaaagtagaactacaactgca

SEQ ID NO: 13761 - DNA, 21 bp, Artificial sequence
  Reverse Primer
aaaayactgatttcacgtcct

SEQ ID NO: 13762 - DNA, 21 bp, Artificial sequence
  Reverse Primer
attcaaacagctcactcttgc

SEQ ID NO: 13763 - DNA, 23 bp, Artificial sequence
  Reverse Primer
ttcttaactgtgcccatcatatt

SEQ ID NO: 13764 - DNA, 26 bp, Artificial sequence
  Reverse Primer
tatggatttatggttagtttttcatg

SEQ ID NO: 13765 - DNA, 28 bp, Artificial sequence
  Reverse Primer
atataccctttgacttattagcatatcc

SEQ ID NO: 13766 - DNA, 28 bp, Artificial sequence
  Reverse Primer
ttttatataaagtagacctgagtcatcc

SEQ ID NO: 13767 - DNA, 27 bp, Artificial sequence
  Reverse Primer
attactgtctcaaagaaataccagact

SEQ ID NO: 13768 - DNA, 27 bp, Artificial sequence
  Reverse Primer
aattttatratagggactacatgctgt

SEQ ID NO: 13769 - DNA, 24 bp, Artificial sequence
  Reverse Primer
aagaatgactggaacaaggttatt

SEQ ID NO: 13770 - DNA, 25 bp, Artificial sequence
  Reverse Primer
tgcataatccagtgaagtatgttaa

SEQ ID NO: 13771 - DNA, 19 bp, Artificial sequence
  Reverse Primer
gttttcctgatcacccctc

SEQ ID NO: 13772 - DNA, 18 bp, Artificial sequence
  Reverse Primer
gggaggagcctcccttct

SEQ ID NO: 13773 - DNA, 27 bp, Artificial sequence
  Reverse Primer
tttctcagattacaaatactagtctgc

SEQ ID NO: 13774 - DNA, 24 bp, Artificial sequence
  Reverse Primer
taaaaagtttgacaaaagtggaag

SEQ ID NO: 13775 - DNA, 29 bp, Artificial sequence
  Reverse Primer
taagaatgtagtagtgaattgatctgaaa

SEQ ID NO: 13776 - DNA, 23 bp, Artificial sequence
  Reverse Primer
tctttgtatgatttggaaagcag

SEQ ID NO: 13777 - DNA, 28 bp, Artificial sequence
  Reverse Primer
tatacccaaatataaagccttaggtaaa

SEQ ID NO: 13778 - DNA, 28 bp, Artificial sequence
  Reverse Primer
tacgaacaaaatggtaattttaatagag

SEQ ID NO: 13779 - DNA, 28 bp, Artificial sequence
  Reverse Primer
aaaacatttaaaatacactgtacatcca

SEQ ID NO: 13780 - DNA, 23 bp, Artificial sequence
  Reverse Primer
aaagtttatattcttgcccatgg

SEQ ID NO: 13781 - DNA, 24 bp, Artificial sequence
  Reverse Primer
aattgttttgtttattttgctcct

SEQ ID NO: 13782 - DNA, 21 bp, Artificial sequence
  Reverse Primer
aaaggatcatggtggagactt

SEQ ID NO: 13783 - DNA, 24 bp, Artificial sequence
  Reverse Primer
aaaacatcacacacttgctagaaa

SEQ ID NO: 13784 - DNA, 22 bp, Artificial sequence
  Reverse Primer
tacaaagaaaacctgcatgaaa

SEQ ID NO: 13785 - DNA, 23 bp, Artificial sequence
  Reverse Primer
ttaaaacagggaaaaaattaagc

SEQ ID NO: 13786 - DNA, 20 bp, Artificial sequence
  Reverse Primer
tgaggatctagccctctcaa

SEQ ID NO: 13787 - DNA, 20 bp, Artificial sequence
  Reverse Primer
aagtagaaagcacagggcag

SEQ ID NO: 13788 - DNA, 21 bp, Artificial sequence
  Reverse Primer
ttttattggtggcatttgaag

SEQ ID NO: 13789 - DNA, 19 bp, Artificial sequence
  Reverse Primer
tttccatcccctgtcagtc

SEQ ID NO: 13790 - DNA, 24 bp, Artificial sequence
  Reverse Primer
ttgacctgaaattatgtttgtgtg

SEQ ID NO: 13791 - DNA, 27 bp, Artificial sequence
  Reverse Primer
aacctttgctagctattatctttaaca

SEQ ID NO: 13792 - DNA, 18 bp, Artificial sequence
  Reverse Primer
gctggcctggaatctcag

SEQ ID NO: 13793 - DNA, 22 bp, Artificial sequence
  Reverse Primer
actctgcctctttgtgtttctc

SEQ ID NO: 13794 - DNA, 30 bp, Artificial sequence
  Reverse Primer
tttctcatagtctatattctttgttctatc

SEQ ID NO: 13795 - DNA, 23 bp, Artificial sequence
  Reverse Primer
cagaatttaaatgaggtttgacg

SEQ ID NO: 13796 - DNA, 18 bp, Artificial sequence
  Reverse Primer
acctcggaattaaggcga

SEQ ID NO: 13797 - DNA, 29 bp, Artificial sequence
  Reverse Primer
cttgaaatactcttggatttagaagataa

SEQ ID NO: 13798 - DNA, 28 bp, Artificial sequence
  Reverse Primer
cttaaattttatgttttggttgttacag

SEQ ID NO: 13799 - DNA, 18 bp, Artificial sequence
  Reverse Primer
atccaggccctttcccaa

SEQ ID NO: 13800 - DNA, 22 bp, Artificial sequence
  Reverse Primer
aaaatgattcagacggttttcc

SEQ ID NO: 13801 - DNA, 18 bp, Artificial sequence
  Reverse Primer
tctttggcattgcaagca

SEQ ID NO: 13802 - DNA, 23 bp, Artificial sequence
  Reverse Primer
aagatgaagtaggccttctcaaa

SEQ ID NO: 13803 - DNA, 18 bp, Artificial sequence
  Reverse Primer
tgcaggggaagcagaagt

SEQ ID NO: 13804 - DNA, 21 bp, Artificial sequence
  Reverse Primer
acacaggtcccagagatcttg

SEQ ID NO: 13805 - DNA, 30 bp, Artificial sequence
  Reverse Primer
gaagccagtagagtactaaaataaataatt

SEQ ID NO: 13806 - DNA, 19 bp, Artificial sequence
  Reverse Primer
cgggatccgggtttgtgta

SEQ ID NO: 13807 - DNA, 30 bp, Artificial sequence
  Reverse Primer
tttactcatactagactcatttctttctgt

SEQ ID NO: 13808 - DNA, 24 bp, Artificial sequence
  Reverse Primer
tttgctaaagacaaagttcttctg

SEQ ID NO: 13809 - DNA, 18 bp, Artificial sequence
  Reverse Primer
caagggctggatcagagg

SEQ ID NO: 13810 - DNA, 20 bp, Artificial sequence
  Reverse Primer
ttttctgcctwaatcccatg

SEQ ID NO: 13811 - DNA, 18 bp, Artificial sequence
  Reverse Primer
tgctctgtgctgcgtgtt

SEQ ID NO: 13812 - DNA, 19 bp, Artificial sequence
  Reverse Primer
tggtgcctaagggtcaact

SEQ ID NO: 13813 - DNA, 27 bp, Artificial sequence
  Reverse Primer
tttaaagatatgtctgaaaggagaatg

SEQ ID NO: 13814 - DNA, 22 bp, Artificial sequence
  Reverse Primer
gcggttcaaagaaacagtaaca

SEQ ID NO: 13815 - DNA, 26 bp, Artificial sequence
  Reverse Primer
ttatttccatgagttatctaccttgg

SEQ ID NO: 13816 - DNA, 21 bp, Artificial sequence
  Reverse Primer
tcagggtactgctctgctaac

SEQ ID NO: 13817 - DNA, 18 bp, Artificial sequence
  Reverse Primer
tgggggcatggtgaagga

SEQ ID NO: 13818 - DNA, 19 bp, Artificial sequence
  Reverse Primer
accatcctccaggacatga

SEQ ID NO: 13819 - DNA, 23 bp, Artificial sequence
  Reverse Primer
atctgtaacagacgtggaacact

SEQ ID NO: 13820 - DNA, 21 bp, Artificial sequence
  Reverse Primer
tatcccaagagtcacatgctt

SEQ ID NO: 13821 - DNA, 26 bp, Artificial sequence
  Reverse Primer
ttatctctcaatatgctaaaaaacca

SEQ ID NO: 13822 - DNA, 22 bp, Artificial sequence
  Reverse Primer
agaaatcatagcagttgtgcct

SEQ ID NO: 13823 - DNA, 18 bp, Artificial sequence
  Reverse Primer
aggttgcagccattcctc

SEQ ID NO: 13824 - DNA, 27 bp, Artificial sequence
  Reverse Primer
tgatatcataaatgtaccctatccatt

SEQ ID NO: 13825 - DNA, 29 bp, Artificial sequence
  Reverse Primer
cacatgggatattataataaacagaattc

SEQ ID NO: 13826 - DNA, 24 bp, Artificial sequence
  Reverse Primer
aatgaggtatttttagcttttgcc

SEQ ID NO: 13827 - DNA, 24 bp, Artificial sequence
  Reverse Primer
tcaggacaggtaaatgagtatctc

SEQ ID NO: 13828 - DNA, 23 bp, Artificial sequence
  Reverse Primer
gcttctcacctgtatgttttctc

SEQ ID NO: 13829 - DNA, 19 bp, Artificial sequence
  Reverse Primer
ttaccctgtggtcagaacg

SEQ ID NO: 13830 - DNA, 19 bp, Artificial sequence
  Reverse Primer
ttctttggtggcagactcc

SEQ ID NO: 13831 - DNA, 20 bp, Artificial sequence
  Reverse Primer
aaactagggcaaggtgaagg

SEQ ID NO: 13832 - DNA, 19 bp, Artificial sequence
  Reverse Primer
actgcctcccaagacagtg

SEQ ID NO: 13833 - DNA, 27 bp, Artificial sequence
  Reverse Primer
ctatttcccacattcttaaaacttaaa

SEQ ID NO: 13834 - DNA, 23 bp, Artificial sequence
  Reverse Primer
ccatcaaatccatatctmcacac

SEQ ID NO: 13835 - DNA, 24 bp, Artificial sequence
  Reverse Primer
tacaattccatcatctaaaccaca

SEQ ID NO: 13836 - DNA, 30 bp, Artificial sequence
  Reverse Primer
ataactgagacatttttagtcctagttttc

SEQ ID NO: 13837 - DNA, 24 bp, Artificial sequence
  Reverse Primer
aggaaaaagatatttcctgacctg

SEQ ID NO: 13838 - DNA, 29 bp, Artificial sequence
  Reverse Primer
caaagtgactcagttataaatacatgtgt

SEQ ID NO: 13839 - DNA, 25 bp, Artificial sequence
  Reverse Primer
aagaatttaaaagagaaaaacccac

SEQ ID NO: 13840 - DNA, 27 bp, Artificial sequence
  Reverse Primer
agtaaggaatataagctctgcacataa

SEQ ID NO: 13841 - DNA, 19 bp, Artificial sequence
  Reverse Primer
gatgcctcgtgaaataccc

SEQ ID NO: 13842 - DNA, 26 bp, Artificial sequence
  Reverse Primer
gagccaggaacatttatattttttat

SEQ ID NO: 13843 - DNA, 24 bp, Artificial sequence
  Reverse Primer
agaatttatttgaaggtgctttca

SEQ ID NO: 13844 - DNA, 19 bp, Artificial sequence
  Reverse Primer
aggttcaagaaggagggga

SEQ ID NO: 13845 - DNA, 19 bp, Artificial sequence
  Reverse Primer
tctgtgagatcaggaaggg

SEQ ID NO: 13846 - DNA, 21 bp, Artificial sequence
  Reverse Primer
aaaaggagaatgtccaggtga

SEQ ID NO: 13847 - DNA, 18 bp, Artificial sequence
  Reverse Primer
tggaggtcgtgaagtggt

SEQ ID NO: 13848 - DNA, 28 bp, Artificial sequence
  Reverse Primer
gttaagttcaatcaagaccaaatatagg

SEQ ID NO: 13849 - DNA, 27 bp, Artificial sequence
  Reverse Primer
tgagtcaactaaartctaattcagacc

SEQ ID NO: 13850 - DNA, 22 bp, Artificial sequence
  Reverse Primer
tgctgaagaacagcaaatagat

SEQ ID NO: 13851 - DNA, 21 bp, Artificial sequence
  Reverse Primer
ctgtaagcaagcagcagattt

SEQ ID NO: 13852 - DNA, 18 bp, Artificial sequence
  Reverse Primer
atccttcccactggagcc

SEQ ID NO: 13853 - DNA, 23 bp, Artificial sequence
  Reverse Primer
aattttgcaaacttacttggctt

SEQ ID NO: 13854 - DNA, 21 bp, Artificial sequence
  Reverse Primer
attgtcagctttctcwtgcaa

SEQ ID NO: 13855 - DNA, 19 bp, Artificial sequence
  Reverse Primer
aaagtgaaggtcaaggcca

SEQ ID NO: 13856 - DNA, 21 bp, Artificial sequence
  Reverse Primer
aaaccccagaccaataacttg

SEQ ID NO: 13857 - DNA, 22 bp, Artificial sequence
  Reverse Primer
ttgttgcatcttttctgagtgt

SEQ ID NO: 13858 - DNA, 23 bp, Artificial sequence
  Reverse Primer
tgtcagagtagcaatcagacatg

SEQ ID NO: 13859 - DNA, 27 bp, Artificial sequence
  Reverse Primer
gctgtattcgtctatttttttaaatgt

SEQ ID NO: 13860 - DNA, 26 bp, Artificial sequence
  Reverse Primer
acatcttcttgaaattgaaattcttg

SEQ ID NO: 13861 - DNA, 26 bp, Artificial sequence
  Reverse Primer
atttttcctcttctcttccttatctc

SEQ ID NO: 13862 - DNA, 20 bp, Artificial sequence
  Reverse Primer
aaggtcttccctctttccct

SEQ ID NO: 13863 - DNA, 25 bp, Artificial sequence
  Reverse Primer
ttaaaagttagcctcaaaatgatcc

SEQ ID NO: 13864 - DNA, 25 bp, Artificial sequence
  Reverse Primer
aattaatttgtttcacctctggatt

SEQ ID NO: 13865 - DNA, 27 bp, Artificial sequence
  Reverse Primer
gaattatctcattttcttatctgcaag

SEQ ID NO: 13866 - DNA, 18 bp, Artificial sequence
  Reverse Primer
tgaagccaaaggacagcg

SEQ ID NO: 13867 - DNA, 19 bp, Artificial sequence
  Reverse Primer
aaagtgaaggtcaaggcca

SEQ ID NO: 13868 - DNA, 27 bp, Artificial sequence
  Reverse Primer
aatttatgatccttcagaaagtagtga

SEQ ID NO: 13869 - DNA, 24 bp, Artificial sequence
  Reverse Primer
aaaaattgacagaagtgaaggtgt

SEQ ID NO: 13870 - DNA, 27 bp, Artificial sequence
  Reverse Primer
gagtggaaagctcttactctttatttt

SEQ ID NO: 13871 - DNA, 23 bp, Artificial sequence
  Reverse Primer
tggtaaactacacattccctgtg

SEQ ID NO: 13872 - DNA, 29 bp, Artificial sequence
  Reverse Primer
catataaaaatacctttaactcaaggatc

SEQ ID NO: 13873 - DNA, 27 bp, Artificial sequence
  Reverse Primer
ttcttatgctagtatgaaacttttcca

SEQ ID NO: 13874 - DNA, 19 bp, Artificial sequence
  Reverse Primer
tggtaaatccacaaaggcc

SEQ ID NO: 13875 - DNA, 22 bp, Artificial sequence
  Reverse Primer
gctgtgtcttcccctacataag

SEQ ID NO: 13876 - DNA, 22 bp, Artificial sequence
  Reverse Primer
tttgggaaattcattcacagtc

SEQ ID NO: 13877 - DNA, 27 bp, Artificial sequence
  Reverse Primer
ttyrtatgtggattaccatgacatatt

SEQ ID NO: 13878 - DNA, 18 bp, Artificial sequence
  Reverse Primer
gggtccagagtccagctg

SEQ ID NO: 13879 - DNA, 24 bp, Artificial sequence
  Reverse Primer
tgttgttagtagggtgtttctttc

SEQ ID NO: 13880 - DNA, 20 bp, Artificial sequence
  Reverse Primer
actaaaccaccaccaccttg

SEQ ID NO: 13881 - DNA, 22 bp, Artificial sequence
  Reverse Primer
ttcatttaccccaatttttcat

SEQ ID NO: 13882 - DNA, 18 bp, Artificial sequence
  Reverse Primer
tgyagggccacacagctg

SEQ ID NO: 13883 - DNA, 30 bp, Artificial sequence
  Reverse Primer
cttgtgatatagaaaatgctaatagtctgt

SEQ ID NO: 13884 - DNA, 25 bp, Artificial sequence
  Reverse Primer
aaaggaaaaggttrtgatgataatg

SEQ ID NO: 13885 - DNA, 18 bp, Artificial sequence
  Reverse Primer
aaatgtcgtctgcgcgag

SEQ ID NO: 13886 - DNA, 23 bp, Artificial sequence
  Reverse Primer
catttctgataaattcccaagtg

SEQ ID NO: 13887 - DNA, 18 bp, Artificial sequence
  Reverse Primer
ttgacatgaacagggcag

SEQ ID NO: 13888 - DNA, 26 bp, Artificial sequence
  Reverse Primer
agttacaatttttatttgttgctcac

SEQ ID NO: 13889 - DNA, 18 bp, Artificial sequence
  Reverse Primer
ttctagaaaggggagccg

SEQ ID NO: 13890 - DNA, 26 bp, Artificial sequence
  Reverse Primer
tttaataggtagaactgtcaggaagg

SEQ ID NO: 13891 - DNA, 22 bp, Artificial sequence
  Reverse Primer
tatataaaggcccaagatcgtg

SEQ ID NO: 13892 - DNA, 20 bp, Artificial sequence
  Reverse Primer
aaatttgcctggaattgttg

SEQ ID NO: 13893 - DNA, 30 bp, Artificial sequence
  Reverse Primer
aaaacacacttatatagtacactcaagaaa

SEQ ID NO: 13894 - DNA, 24 bp, Artificial sequence
  Reverse Primer
tcgctataagggttacacagttac

SEQ ID NO: 13895 - DNA, 23 bp, Artificial sequence
  Reverse Primer
aaaataaagggagaaagactccg

SEQ ID NO: 13896 - DNA, 26 bp, Artificial sequence
  Reverse Primer
tttaattttgaatagaactgcacaga

SEQ ID NO: 13897 - DNA, 22 bp, Artificial sequence
  Reverse Primer
attgtgctggtaatctgcattt

SEQ ID NO: 13898 - DNA, 23 bp, Artificial sequence
  Reverse Primer
aaaattcatgcaaagacaacatt

SEQ ID NO: 13899 - DNA, 20 bp, Artificial sequence
  Reverse Primer
ttcaggaatcctttgcattg

SEQ ID NO: 13900 - DNA, 26 bp, Artificial sequence
  Reverse Primer
ttcataaggtatttgaatgtcacttg

SEQ ID NO: 13901 - DNA, 23 bp, Artificial sequence
  Reverse Primer
tcatcattgaactttcagttgag

SEQ ID NO: 13902 - DNA, 30 bp, Artificial sequence
  Reverse Primer
atatataataactgacattatggctgaaat

SEQ ID NO: 13903 - DNA, 20 bp, Artificial sequence
  Reverse Primer
aggagatcctgctcaaggac

SEQ ID NO: 13904 - DNA, 28 bp, Artificial sequence
  Reverse Primer
aatacaataaacactggaattttctttc

SEQ ID NO: 13905 - DNA, 27 bp, Artificial sequence
  Reverse Primer
aaaagaaagcacatctatctttacaac

SEQ ID NO: 13906 - DNA, 23 bp, Artificial sequence
  Reverse Primer
ttccagctcaatatcactgaatc

SEQ ID NO: 13907 - DNA, 22 bp, Artificial sequence
  Reverse Primer
aacagagaaaactgtggaaccc

SEQ ID NO: 13908 - DNA, 22 bp, Artificial sequence
  Reverse Primer
ttttatgtggagctggaatctg

SEQ ID NO: 13909 - DNA, 18 bp, Artificial sequence
  Reverse Primer
atacagggggagaagccg

SEQ ID NO: 13910 - DNA, 28 bp, Artificial sequence
  Reverse Primer
agggaattaatattgtttaagaaacaca

SEQ ID NO: 13911 - DNA, 20 bp, Artificial sequence
  Reverse Primer
aaaatcaggcagacagagcc

SEQ ID NO: 13912 - DNA, 20 bp, Artificial sequence
  Reverse Primer
aactcratgcttgaaggagc

SEQ ID NO: 13913 - DNA, 21 bp, Artificial sequence
  Reverse Primer
atggttgtttcctgtggaatt

SEQ ID NO: 13914 - DNA, 21 bp, Artificial sequence
  Reverse Primer
aggaagaagtagcaacccact

SEQ ID NO: 13915 - DNA, 28 bp, Artificial sequence
  Reverse Primer
actgcttaataactttgaagaaaacttt

SEQ ID NO: 13916 - DNA, 25 bp, Artificial sequence
  Reverse Primer
tcagattcytcaaatcaatgtttta

SEQ ID NO: 13917 - DNA, 24 bp, Artificial sequence
  Reverse Primer
gatgaatacaaatgtatacagcca

SEQ ID NO: 13918 - DNA, 18 bp, Artificial sequence
  Reverse Primer
agtgggctgctgactcca

SEQ ID NO: 13919 - DNA, 18 bp, Artificial sequence
  Reverse Primer
aggcctccagaacggata

SEQ ID NO: 13920 - DNA, 28 bp, Artificial sequence
  Reverse Primer
acttataaaaatcataataggcaaggaa

SEQ ID NO: 13921 - DNA, 25 bp, Artificial sequence
  Reverse Primer
aaagactttgtagtgggagagaact

SEQ ID NO: 13922 - DNA, 29 bp, Artificial sequence
  Reverse Primer
attacttcttatctgaggtatttgaaaga

SEQ ID NO: 13923 - DNA, 30 bp, Artificial sequence
  Reverse Primer
gtgttatatttttccttcagatatatttcc

SEQ ID NO: 13924 - DNA, 21 bp, Artificial sequence
  Reverse Primer
agctgatgccatttacattca

SEQ ID NO: 13925 - DNA, 21 bp, Artificial sequence
  Reverse Primer
tggatcaacaatatccctcct

SEQ ID NO: 13926 - DNA, 22 bp, Artificial sequence
  Reverse Primer
taagtttgattcgacaaagctg

SEQ ID NO: 13927 - DNA, 25 bp, Artificial sequence
  Reverse Primer
acactgtccctgtatcctactgtaa

SEQ ID NO: 13928 - DNA, 26 bp, Artificial sequence
  Reverse Primer
atcaaagatacatctacatgtggaaa

SEQ ID NO: 13929 - DNA, 27 bp, Artificial sequence
  Reverse Primer
agaagaaatgagtatctgattaaacca

SEQ ID NO: 13930 - DNA, 19 bp, Artificial sequence
  Reverse Primer
tttgtaattggcagcaacg

SEQ ID NO: 13931 - DNA, 22 bp, Artificial sequence
  Reverse Primer
taagagagtctcacrgaggagc

SEQ ID NO: 13932 - DNA, 26 bp, Artificial sequence
  Reverse Primer
ttaatagcatggttgatagaaatctg

SEQ ID NO: 13933 - DNA, 28 bp, Artificial sequence
  Reverse Primer
atacagtactgtgtatcatttaatccca

SEQ ID NO: 13934 - DNA, 18 bp, Artificial sequence
  Reverse Primer
atgcgcacttcagtctcg

SEQ ID NO: 13935 - DNA, 28 bp, Artificial sequence
  Reverse Primer
cttcttgtctttttgttttaaatttacc

SEQ ID NO: 13936 - DNA, 18 bp, Artificial sequence
  Reverse Primer
agtttcaggrtggagggg

SEQ ID NO: 13937 - DNA, 21 bp, Artificial sequence
  Reverse Primer
ttgtgctatcctgccaaatag

SEQ ID NO: 13938 - DNA, 23 bp, Artificial sequence
  Reverse Primer
tttttgcttttaaaacatccaga

SEQ ID NO: 13939 - DNA, 25 bp, Artificial sequence
  Reverse Primer
ttaaaaaatccacttggtactcatt

SEQ ID NO: 13940 - DNA, 24 bp, Artificial sequence
  Reverse Primer
attggaaaattcatactggaaaga

SEQ ID NO: 13941 - DNA, 23 bp, Artificial sequence
  Reverse Primer
ttgaaattttaagcatcactgct

SEQ ID NO: 13942 - DNA, 21 bp, Artificial sequence
  Reverse Primer
tgaaagcccatgttttacaca

SEQ ID NO: 13943 - DNA, 26 bp, Artificial sequence
  Reverse Primer
attcttcaagtaatttaacagaggct

SEQ ID NO: 13944 - DNA, 25 bp, Artificial sequence
  Reverse Primer
attcaccacttcttagattgattca

SEQ ID NO: 13945 - DNA, 23 bp, Artificial sequence
  Reverse Primer
gagaaacagtaatttgcgtgaat

SEQ ID NO: 13946 - DNA, 19 bp, Artificial sequence
  Reverse Primer
aggagggcattatggtgag

SEQ ID NO: 13947 - DNA, 26 bp, Artificial sequence
  Reverse Primer
aggagaaagaagaattaatcaacaaa

SEQ ID NO: 13948 - DNA, 18 bp, Artificial sequence
  Reverse Primer
ctgcccaccacgctgaag

SEQ ID NO: 13949 - DNA, 21 bp, Artificial sequence
  Reverse Primer
tatggagagaactggagcacc

SEQ ID NO: 13950 - DNA, 23 bp, Artificial sequence
  Reverse Primer
attcatcacttagggacacagtg

SEQ ID NO: 13951 - DNA, 24 bp, Artificial sequence
  Reverse Primer
tgcagcaaacaaaataataaatcc

SEQ ID NO: 13952 - DNA, 18 bp, Artificial sequence
  Reverse Primer
ttacggatcaaggcagcc

SEQ ID NO: 13953 - DNA, 19 bp, Artificial sequence
  Reverse Primer
atgaaggcagrgaytggag

SEQ ID NO: 13954 - DNA, 30 bp, Artificial sequence
  Reverse Primer
agtatatggatttaaagaaggagctactag

SEQ ID NO: 13955 - DNA, 27 bp, Artificial sequence
  Reverse Primer
acttagaaatttcacataaaagcaatg

SEQ ID NO: 13956 - DNA, 25 bp, Artificial sequence
  Reverse Primer
aaaccttatgaatgtactgaatgtg

SEQ ID NO: 13957 - DNA, 28 bp, Artificial sequence
  Reverse Primer
aatagtctatttccattccataaaagaa

SEQ ID NO: 13958 - DNA, 24 bp, Artificial sequence
  Reverse Primer
ttaggttcccagaaaaactaagtg

SEQ ID NO: 13959 - DNA, 22 bp, Artificial sequence
  Reverse Primer
tataggaaggtcaagctgctca

SEQ ID NO: 13960 - DNA, 28 bp, Artificial sequence
  Reverse Primer
caaaacgttgttaatatttaatatctgg

SEQ ID NO: 13961 - DNA, 29 bp, Artificial sequence
  Reverse Primer
tctcgatatttatagttttccatkatatg

SEQ ID NO: 13962 - DNA, 18 bp, Artificial sequence
  Reverse Primer
caccagcagggacagacc

SEQ ID NO: 13963 - DNA, 22 bp, Artificial sequence
  Reverse Primer
tctcttattgattcctgccaga

SEQ ID NO: 13964 - DNA, 27 bp, Artificial sequence
  Reverse Primer
atattacactcattgtctcttttgacc

SEQ ID NO: 13965 - DNA, 24 bp, Artificial sequence
  Reverse Primer
atgctattcctctcttgatgtttt

SEQ ID NO: 13966 - DNA, 22 bp, Artificial sequence
  Reverse Primer
tcattgcaatacagccattaca

SEQ ID NO: 13967 - DNA, 22 bp, Artificial sequence
  Reverse Primer
tacaaagcaaagatatgaccgc

SEQ ID NO: 13968 - DNA, 26 bp, Artificial sequence
  Reverse Primer
aatttgaattattgactaggataccc

SEQ ID NO: 13969 - DNA, 25 bp, Artificial sequence
  Reverse Primer
aattaaytatctaaccacttctgaa

SEQ ID NO: 13970 - DNA, 26 bp, Artificial sequence
  Reverse Primer
atgtttactttcagataatgcaatca

SEQ ID NO: 13971 - DNA, 24 bp, Artificial sequence
  Reverse Primer
aataaacagcagaacttgaacctg

SEQ ID NO: 13972 - DNA, 21 bp, Artificial sequence
  Reverse Primer
aattagatgtttgggttccga

SEQ ID NO: 13973 - DNA, 23 bp, Artificial sequence
  Reverse Primer
tactagagctcagctcacaaacg

SEQ ID NO: 13974 - DNA, 30 bp, Artificial sequence
  Reverse Primer
ttaacattactattagtgtgtgttgtatcc

SEQ ID NO: 13975 - DNA, 29 bp, Artificial sequence
  Reverse Primer
tctgtctgtgtatgtacttaacctatctg

SEQ ID NO: 13976 - DNA, 30 bp, Artificial sequence
  Reverse Primer
tagaacagaaaatgtagagaaaaatatgtc

SEQ ID NO: 13977 - DNA, 18 bp, Artificial sequence
  Reverse Primer
tcccatctggtcatccat

SEQ ID NO: 13978 - DNA, 20 bp, Artificial sequence
  Reverse Primer
accgagtgtgtgttttggac

SEQ ID NO: 13979 - DNA, 22 bp, Artificial sequence
  Reverse Primer
ttagtttgctagagcgtcacaa

SEQ ID NO: 13980 - DNA, 26 bp, Artificial sequence
  Reverse Primer
tactgtaggatttcagtttatggagg

SEQ ID NO: 13981 - DNA, 28 bp, Artificial sequence
  Reverse Primer
atgatatgcctctaagaaaataggtatt

SEQ ID NO: 13982 - DNA, 28 bp, Artificial sequence
  Reverse Primer
tctacttcattatttatcctttttttgc

SEQ ID NO: 13983 - DNA, 22 bp, Artificial sequence
  Reverse Primer
ttcaggatcaatatggtcctct

SEQ ID NO: 13984 - DNA, 20 bp, Artificial sequence
  Reverse Primer
agttggacaagctcaccaac

SEQ ID NO: 13985 - DNA, 24 bp, Artificial sequence
  Reverse Primer
atatgaaaagatgcagagatgtgt

SEQ ID NO: 13986 - DNA, 19 bp, Artificial sequence
  Reverse Primer
gaggatgaccttcagctcg

SEQ ID NO: 13987 - DNA, 24 bp, Artificial sequence
  Reverse Primer
ttattgctgtacagttggatatgg

SEQ ID NO: 13988 - DNA, 21 bp, Artificial sequence
  Reverse Primer
atatgcagcagaaagcctctc

SEQ ID NO: 13989 - DNA, 26 bp, Artificial sequence
  Reverse Primer
tgaaacaaatgtaacataaagtttgc

SEQ ID NO: 13990 - DNA, 27 bp, Artificial sequence
  Reverse Primer
tcgcacactgaaatagtctattatatc

SEQ ID NO: 13991 - DNA, 19 bp, Artificial sequence
  Reverse Primer
gagagaggcggggtcctta

SEQ ID NO: 13992 - DNA, 24 bp, Artificial sequence
  Reverse Primer
taaactacataagcacctggcata

SEQ ID NO: 13993 - DNA, 24 bp, Artificial sequence
  Reverse Primer
tgctacttttgaaagatcatcatc

SEQ ID NO: 13994 - DNA, 20 bp, Artificial sequence
  Reverse Primer
agaaggaggacatcacacga

SEQ ID NO: 13995 - DNA, 27 bp, Artificial sequence
  Reverse Primer
aaccttacattgaaggtatgattagtg

SEQ ID NO: 13996 - DNA, 29 bp, Artificial sequence
  Reverse Primer
atatattcctttttccctatgtrgtttat

SEQ ID NO: 13997 - DNA, 21 bp, Artificial sequence
  Reverse Primer
acaaaaaaggatttcaagcag

SEQ ID NO: 13998 - DNA, 19 bp, Artificial sequence
  Reverse Primer
actccacggacaactggat

SEQ ID NO: 13999 - DNA, 23 bp, Artificial sequence
  Reverse Primer
gtgttcaaacatttggatatggt

SEQ ID NO: 14000 - DNA, 22 bp, Artificial sequence
  Reverse Primer
caagcttgatatcctatggagc

SEQ ID NO: 14001 - DNA, 22 bp, Artificial sequence
  Reverse Primer
ttcagctcataaacaacaggag

SEQ ID NO: 14002 - DNA, 18 bp, Artificial sequence
  Reverse Primer
atgtttgtcgggtgcagt

SEQ ID NO: 14003 - DNA, 18 bp, Artificial sequence
  Reverse Primer
actgagcacacgcagggg

SEQ ID NO: 14004 - DNA, 18 bp, Artificial sequence
  Reverse Primer
cagttgctccttctgggg

SEQ ID NO: 14005 - DNA, 18 bp, Artificial sequence
  Reverse Primer
gtgacagtgccttggcca

SEQ ID NO: 14006 - DNA, 18 bp, Artificial sequence
  Reverse Primer
acagggaattcctccgct

SEQ ID NO: 14007 - DNA, 24 bp, Artificial sequence
  Reverse Primer
acagacttaggaggtgattttgaa

SEQ ID NO: 14008 - DNA, 25 bp, Artificial sequence
  Reverse Primer
tttctcatcaataccagttaatcac

SEQ ID NO: 14009 - DNA, 24 bp, Artificial sequence
  Reverse Primer
atttttcaatttaaatggctcatc

SEQ ID NO: 14010 - DNA, 23 bp, Artificial sequence
  Reverse Primer
tcaactcagatttgcttgacttt

SEQ ID NO: 14011 - DNA, 24 bp, Artificial sequence
  Reverse Primer
aggacacaagagtggttagacatt

SEQ ID NO: 14012 - DNA, 19 bp, Artificial sequence
  Reverse Primer
agacaygcaagggaacatc

SEQ ID NO: 14013 - DNA, 18 bp, Artificial sequence
  Reverse Primer
gtaatgtgccaggccctc

SEQ ID NO: 14014 - DNA, 18 bp, Artificial sequence
  Reverse Primer
tgctctcacagccttcca

SEQ ID NO: 14015 - DNA, 18 bp, Artificial sequence
  Reverse Primer
tgtggtgctctgcgtgta

SEQ ID NO: 14016 - DNA, 27 bp, Artificial sequence
  Reverse Primer
cttcacacattcaataataaaaccttt

SEQ ID NO: 14017 - DNA, 18 bp, Artificial sequence
  Reverse Primer
atgaccttggcttgctgg

SEQ ID NO: 14018 - DNA, 21 bp, Artificial sequence
  Reverse Primer
attttgagaccttgatgagcg

SEQ ID NO: 14019 - DNA, 21 bp, Artificial sequence
  Reverse Primer
aaraaccagaacacaaacagc

SEQ ID NO: 14020 - DNA, 24 bp, Artificial sequence
  Reverse Primer
aaggcttgattttaataaggattg

SEQ ID NO: 14021 - DNA, 30 bp, Artificial sequence
  Reverse Primer
actatcaagttatatgataagcagtaattt

SEQ ID NO: 14022 - DNA, 28 bp, Artificial sequence
  Reverse Primer
tattgcatatcaataatactagctggat

SEQ ID NO: 14023 - DNA, 26 bp, Artificial sequence
  Reverse Primer
aattttctagcaattaaagagtggtc

SEQ ID NO: 14024 - DNA, 22 bp, Artificial sequence
  Reverse Primer
gatgaaggcattctaagcagag

SEQ ID NO: 14025 - DNA, 18 bp, Artificial sequence
  Reverse Primer
ggcccacagcactgtaga

SEQ ID NO: 14026 - DNA, 25 bp, Artificial sequence
  Reverse Primer
agcataaattgttgtagtgtttttg

SEQ ID NO: 14027 - DNA, 29 bp, Artificial sequence
  Reverse Primer
tagtatatatgtttccaggctactctctc

SEQ ID NO: 14028 - DNA, 22 bp, Artificial sequence
  Reverse Primer
ttacagcgtgtaagtttcttgg

SEQ ID NO: 14029 - DNA, 25 bp, Artificial sequence
  Reverse Primer
ttagattgaaccaaagcattaaaag

SEQ ID NO: 14030 - DNA, 28 bp, Artificial sequence
  Reverse Primer
tttatttataatatgggtgtggagtaaa

SEQ ID NO: 14031 - DNA, 25 bp, Artificial sequence
  Reverse Primer
aaactgagtaaccaaatgagtgttt

SEQ ID NO: 14032 - DNA, 19 bp, Artificial sequence
  Reverse Primer
tckgctttgctccatcttc

SEQ ID NO: 14033 - DNA, 27 bp, Artificial sequence
  Reverse Primer
taattttacaggatttaattctggtct

SEQ ID NO: 14034 - DNA, 24 bp, Artificial sequence
  Reverse Primer
ttaaaagttgttttttctggattg

SEQ ID NO: 14035 - DNA, 20 bp, Artificial sequence
  Reverse Primer
ccatcatctgaatccacctt

SEQ ID NO: 14036 - DNA, 28 bp, Artificial sequence
  Reverse Primer
ttaatattaatttttgtgatgaccttcc

SEQ ID NO: 14037 - DNA, 22 bp, Artificial sequence
  Reverse Primer
aaaatttacctcccacacatca

SEQ ID NO: 14038 - DNA, 19 bp, Artificial sequence
  Reverse Primer
cataacccaaagcagctgg

SEQ ID NO: 14039 - DNA, 25 bp, Artificial sequence
  Reverse Primer
tctgcygcactagaatataagtttc

SEQ ID NO: 14040 - DNA, 30 bp, Artificial sequence
  Reverse Primer
gtctatttagttaattattgcagtatttgt

SEQ ID NO: 14041 - DNA, 26 bp, Artificial sequence
  Reverse Primer
attttaaaaattgccactgagtagat

SEQ ID NO: 14042 - DNA, 21 bp, Artificial sequence
  Reverse Primer
atttcagccttgactaggtgg

SEQ ID NO: 14043 - DNA, 22 bp, Artificial sequence
  Reverse Primer
aagtagggccacaattacaagg

SEQ ID NO: 14044 - DNA, 20 bp, Artificial sequence
  Reverse Primer
ataaaagggttgttgcttgg

SEQ ID NO: 14045 - DNA, 21 bp, Artificial sequence
  Reverse Primer
acctagtcatggctcttgacc

SEQ ID NO: 14046 - DNA, 18 bp, Artificial sequence
  Reverse Primer
aggagggagggaggctca

SEQ ID NO: 14047 - DNA, 28 bp, Artificial sequence
  Reverse Primer
taccttgaaaactacatttactaccaac

SEQ ID NO: 14048 - DNA, 23 bp, Artificial sequence
  Reverse Primer
ttcaatctaagtagccttgtccc

SEQ ID NO: 14049 - DNA, 22 bp, Artificial sequence
  Reverse Primer
aaaatttacctcccacacatca

SEQ ID NO: 14050 - DNA, 21 bp, Artificial sequence
  Reverse Primer
aatgctccaattccttgaatc

SEQ ID NO: 14051 - DNA, 29 bp, Artificial sequence
  Reverse Primer
tcacatcagtggtagtaaaataaatgtat

SEQ ID NO: 14052 - DNA, 30 bp, Artificial sequence; identical to SEQ ID NO: 12813
  Reverse Primer

SEQ ID NO: 14053 - DNA, 30 bp, Artificial sequence
  Reverse Primer
ttatgagtactctgttaaaaatagacttaa

SEQ ID NO: 14054 - DNA, 28 bp, Artificial sequence
  Reverse Primer
atcactttagcagttaattcacaatatt

SEQ ID NO: 14055 - DNA, 29 bp, Artificial sequence
  Reverse Primer
tgtagtagtaaccttttttctcctaagtg

SEQ ID NO: 14056 - DNA, 27 bp, Artificial sequence
  Reverse Primer
aaaaacagttgttaatgaaagaaaacc

SEQ ID NO: 14057 - DNA, 23 bp, Artificial sequence
  Reverse Primer
tctgttgagctacagaggaaaaa

SEQ ID NO: 14058 - DNA, 26 bp, Artificial sequence
  Reverse Primer
agttctataaatgggttgaatttgaa

SEQ ID NO: 14059 - DNA, 20 bp, Artificial sequence
  Reverse Primer
ctgtgctgagactcccagat

SEQ ID NO: 14060 - DNA, 19 bp, Artificial sequence
  Reverse Primer
ttccattacctcccactgc

SEQ ID NO: 14061 - DNA, 30 bp, Artificial sequence
  Reverse Primer
tttcacttagaagttacttgatattaaaag

SEQ ID NO: 14062 - DNA, 21 bp, Artificial sequence
  Reverse Primer
atctggaattgggtcatctct

SEQ ID NO: 14063 - DNA, 22 bp, Artificial sequence
  Reverse Primer
acactatgttgtcctcacatgg

SEQ ID NO: 14064 - DNA, 27 bp, Artificial sequence
  Reverse Primer
ttttgtaaaataatcgatgctttactc

SEQ ID NO: 14065 - DNA, 19 bp, Artificial sequence
  Reverse Primer
aactctgtggaagcaccca

SEQ ID NO: 14066 - DNA, 21 bp, Artificial sequence
  Reverse Primer
tctcctggctcatgtagagag

SEQ ID NO: 14067 - DNA, 26 bp, Artificial sequence
  Reverse Primer
gtgcaacacattaatgagtcatagta

SEQ ID NO: 14068 - DNA, 24 bp, Artificial sequence
  Reverse Primer
taacagacagttattgggacacaa

SEQ ID NO: 14069 - DNA, 23 bp, Artificial sequence
  Reverse Primer
tggccatatgtaatatgtaggga

SEQ ID NO: 14070 - DNA, 28 bp, Artificial sequence
  Reverse Primer
aatgcattagaaatctaaaatatcatgc

SEQ ID NO: 14071 - DNA, 22 bp, Artificial sequence
  Reverse Primer
ccygataactgtgttggatctg

SEQ ID NO: 14072 - DNA, 22 bp, Artificial sequence
  Reverse Primer
ttttcaggaactagagctctgc

SEQ ID NO: 14073 - DNA, 19 bp, Artificial sequence
  Reverse Primer
tctgaggggcaaagagaag

SEQ ID NO: 14074 - DNA, 27 bp, Artificial sequence
  Reverse Primer
ttgcatatttgattagctaraacctat

SEQ ID NO: 14075 - DNA, 24 bp, Artificial sequence
  Reverse Primer
ttcatccacattatggtttgtatt

SEQ ID NO: 14076 - DNA, 18 bp, Artificial sequence
  Reverse Primer
agggtggggggacacaga

SEQ ID NO: 14077 - DNA, 20 bp, Artificial sequence
  Reverse Primer
atgttgctgattgacttccc

SEQ ID NO: 14078 - DNA, 18 bp, Artificial sequence
  Reverse Primer
tagggctcctctgaaggg

SEQ ID NO: 14079 - DNA, 24 bp, Artificial sequence
  Reverse Primer
aatagctgaattttctgtgctttg

SEQ ID NO: 14080 - DNA, 22 bp, Artificial sequence
  Reverse Primer
ttttagaatgcagctttgtgac

SEQ ID NO: 14081 - DNA, 24 bp, Artificial sequence
  Reverse Primer
agggacatgaaaagatactttctg

SEQ ID NO: 14082 - DNA, 21 bp, Artificial sequence
  Reverse Primer
ttcttgttgctccacagattg

SEQ ID NO: 14083 - DNA, 29 bp, Artificial sequence
  Reverse Primer
taagctctaggaataaaatgatgagtaag

SEQ ID NO: 14084 - DNA, 23 bp, Artificial sequence
  Reverse Primer
aattaggctaacaggtaggcaga

SEQ ID NO: 14085 - DNA, 28 bp, Artificial sequence
  Reverse Primer
tacatttttctttattatgactttggac

SEQ ID NO: 14086 - DNA, 25 bp, Artificial sequence
  Reverse Primer
ctgcaycattgtatatttctaccag

SEQ ID NO: 14087 - DNA, 24 bp, Artificial sequence
  Reverse Primer
ttttgagaaggaracaaattatgg

SEQ ID NO: 14088 - DNA, 18 bp, Artificial sequence
  Reverse Primer
cagccagctgttcacgca

SEQ ID NO: 14089 - DNA, 21 bp, Artificial sequence
  Reverse Primer
aaagggattttgtttgctttt

SEQ ID NO: 14090 - DNA, 21 bp, Artificial sequence
  Reverse Primer
atttttgagggagaaaccatg

SEQ ID NO: 14091 - DNA, 29 bp, Artificial sequence
  Reverse Primer
attaaatatagctgtctttatctttgtgc

SEQ ID NO: 14092 - DNA, 30 bp, Artificial sequence
  Reverse Primer
ccaattagatataagttacctgttatttag

SEQ ID NO: 14093 - DNA, 25 bp, Artificial sequence
  Reverse Primer
aagatcattttatgtccttctgtca

SEQ ID NO: 14094 - DNA, 27 bp, Artificial sequence
  Reverse Primer
attacgtcttatgttgtttccataatc

SEQ ID NO: 14095 - DNA, 25 bp, Artificial sequence
  Reverse Primer
armaatattacagtgttcccttcca

SEQ ID NO: 14096 - DNA, 25 bp, Artificial sequence
  Reverse Primer
aattactcggactagaggaaactct

SEQ ID NO: 14097 - DNA, 24 bp, Artificial sequence
  Reverse Primer
tatcttctgctctctgtcctcttg

SEQ ID NO: 14098 - DNA, 20 bp, Artificial sequence
  Reverse Primer
aaaagcctaccttccatccc

SEQ ID NO: 14099 - DNA, 19 bp, Artificial sequence
  Reverse Primer
acaagtctgcagttgctgc

SEQ ID NO: 14100 - DNA, 24 bp, Artificial sequence
  Reverse Primer
agtggcataatcagattcaaattt

SEQ ID NO: 14101 - DNA, 24 bp, Artificial sequence
  Reverse Primer
tcctttgatgatcacatacatttt

SEQ ID NO: 14102 - DNA, 25 bp, Artificial sequence
  Reverse Primer
tttttttgttttctaaacagtccag

SEQ ID NO: 14103 - DNA, 18 bp, Artificial sequence
  Reverse Primer
tcctgtcgatcctgtgcc

SEQ ID NO: 14104 - DNA, 26 bp, Artificial sequence
  Reverse Primer
agccttttgtatcatattttgtttct

SEQ ID NO: 14105 - DNA, 21 bp, Artificial sequence
  Reverse Primer
attcttgctcttggaactccc

SEQ ID NO: 14106 - DNA, 22 bp, Artificial sequence
  Reverse Primer
atattctgtgctgttttcctgc

SEQ ID NO: 14107 - DNA, 20 bp, Artificial sequence
  Reverse Primer
tccttgccatgttactgctt

SEQ ID NO: 14108 - DNA, 28 bp, Artificial sequence
  Reverse Primer
aaggaaatttaaatgttaaaasacctac

SEQ ID NO: 14109 - DNA, 23 bp, Artificial sequence
  Reverse Primer
tggtggatcagcaagtataaaag

SEQ ID NO: 14110 - DNA, 28 bp, Artificial sequence
  Reverse Primer
gaaagagaaaagatattaaggagatcag

SEQ ID NO: 14111 - DNA, 22 bp, Artificial sequence
  Reverse Primer
tgctctccttgatcatgtttac

SEQ ID NO: 14112 - DNA, 23 bp, Artificial sequence
  Reverse Primer
atttacagagttccatcgtttgt

SEQ ID NO: 14113 - DNA, 18 bp, Artificial sequence
  Reverse Primer
ttgaacggaagccttgcc

SEQ ID NO: 14114 - DNA, 26 bp, Artificial sequence
  Reverse Primer
tccacaagtgttattattcataaagc

SEQ ID NO: 14115 - DNA, 24 bp, Artificial sequence
  Reverse Primer
gaggaaatatgtccatcaacattt

SEQ ID NO: 14116 - DNA, 18 bp, Artificial sequence
  Reverse Primer
tagatggggaaacgtgct

SEQ ID NO: 14117 - DNA, 29 bp, Artificial sequence
  Reverse Primer
tcttgagaggtaagatttttacaatattc

SEQ ID NO: 14118 - DNA, 20 bp, Artificial sequence
  Reverse Primer
cctgagggtggagtacaaag

SEQ ID NO: 14119 - DNA, 22 bp, Artificial sequence
  Reverse Primer
tccacatttgatgatgaaacag

SEQ ID NO: 14120 - DNA, 28 bp, Artificial sequence
  Reverse Primer
tataatgggcaagtgatgtaataatatg

SEQ ID NO: 14121 - DNA, 18 bp, Artificial sequence
  Reverse Primer
tgcactttcctcggatga

SEQ ID NO: 14122 - DNA, 23 bp, Artificial sequence
  Reverse Primer
tttgctaatckagtccaatctca

SEQ ID NO: 14123 - DNA, 19 bp, Artificial sequence
  Reverse Primer
atcccatctccccttttct

SEQ ID NO: 14124 - DNA, 26 bp, Artificial sequence
  Reverse Primer
aacaaggggagtagtattgtttttta

SEQ ID NO: 14125 - DNA, 25 bp, Artificial sequence
  Reverse Primer
ttaagattcctgtaaggtaggtgtg

SEQ ID NO: 14126 - DNA, 21 bp, Artificial sequence
  Reverse Primer
aggtttaggagaaggggtttg

SEQ ID NO: 14127 - DNA, 23 bp, Artificial sequence
  Reverse Primer
tgtcttgacatcacctyatttga

SEQ ID NO: 14128 - DNA, 30 bp, Artificial sequence
  Reverse Primer
agttatgatatataaaatgaatagactgga

SEQ ID NO: 14129 - DNA, 30 bp, Artificial sequence
  Reverse Primer
atataaagatctcagtaaaggtaattacac

SEQ ID NO: 14130 - DNA, 25 bp, Artificial sequence
  Reverse Primer
ttacattagaaaaatccaccctaca

SEQ ID NO: 14131 - DNA, 28 bp, Artificial sequence
  Reverse Primer
atatgtttcacatttatacaacacaaca

SEQ ID NO: 14132 - DNA, 25 bp, Artificial sequence
  Reverse Primer
acttttccacggtagtagtaacaca

SEQ ID NO: 14133 - DNA, 19 bp, Artificial sequence
  Reverse Primer
acagcacagccagaatagc

SEQ ID NO: 14134 - DNA, 25 bp, Artificial sequence
  Reverse Primer
taatccgaactttctgtgtagtgtc

SEQ ID NO: 14135 - DNA, 19 bp, Artificial sequence
  Reverse Primer
ccatctaccccaaaaccag

SEQ ID NO: 14136 - DNA, 26 bp, Artificial sequence
  Reverse Primer
tattttatccactgcaattacacaat

SEQ ID NO: 14137 - DNA, 21 bp, Artificial sequence
  Reverse Primer
aaaaatttgaaaaacctggca

SEQ ID NO: 14138 - DNA, 25 bp, Artificial sequence
  Reverse Primer
ttttacagtttcttggagcttttta

SEQ ID NO: 14139 - DNA, 20 bp, Artificial sequence
  Reverse Primer
taggaaagtatggccagcag

SEQ ID NO: 14140 - DNA, 23 bp, Artificial sequence
  Reverse Primer
aattacaggcaaggaagaagaaa

SEQ ID NO: 14141 - DNA, 29 bp, Artificial sequence
  Reverse Primer
tttcttgtttctaagatagagtgtattgg

SEQ ID NO: 14142 - DNA, 20 bp, Artificial sequence
  Reverse Primer
ttctggagctctgtgacaag

SEQ ID NO: 14143 - DNA, 24 bp, Artificial sequence
  Reverse Primer
gtattgcatcataaagatgaaccc

SEQ ID NO: 14144 - DNA, 23 bp, Artificial sequence
  Reverse Primer
aagagcagcagagaaatgtaaaa

SEQ ID NO: 14145 - DNA, 28 bp, Artificial sequence
  Reverse Primer
ataatattttccagcatcatttagaatc

SEQ ID NO: 14146 - DNA, 24 bp, Artificial sequence
  Reverse Primer
attttattgagacatcctcaagct

SEQ ID NO: 14147 - DNA, 28 bp, Artificial sequence
  Reverse Primer
aattgtattagaattataaatggatggg

SEQ ID NO: 14148 - DNA, 22 bp, Artificial sequence
  Reverse Primer
agagaggcccttgatctattca

SEQ ID NO: 14149 - DNA, 27 bp, Artificial sequence
  Reverse Primer
ggtcagaaactattatcagatgaaaaa

SEQ ID NO: 14150 - DNA, 23 bp, Artificial sequence
  Reverse Primer
tgtgtatttcatcatttccctct

SEQ ID NO: 14151 - DNA, 27 bp, Artificial sequence
  Reverse Primer
attcaacattactcagagacagaagat

SEQ ID NO: 14152 - DNA, 21 bp, Artificial sequence
  Reverse Primer
ttgttcaccatagtcccatga

SEQ ID NO: 14153 - DNA, 25 bp, Artificial sequence
  Reverse Primer
ttatgttgtttgaaactcctaaacc

SEQ ID NO: 14154 - DNA, 23 bp, Artificial sequence
  Reverse Primer
aaagagaatatcggaggraaaat

SEQ ID NO: 14155 - DNA, 20 bp, Artificial sequence
  Reverse Primer
attctattccccmcaaagca

SEQ ID NO: 14156 - DNA, 18 bp, Artificial sequence
  Reverse Primer
agcggttccttcagagcc

SEQ ID NO: 14157 - DNA, 24 bp, Artificial sequence
  Reverse Primer
aaaaataattcaagagcagtggtt

SEQ ID NO: 14158 - DNA, 19 bp, Artificial sequence
  Reverse Primer
taacaccggccattatctg

SEQ ID NO: 14159 - DNA, 20 bp, Artificial sequence
  Reverse Primer
tgtcctttgaatccaagttg

SEQ ID NO: 14160 - DNA, 19 bp, Artificial sequence
  Reverse Primer
ttcaaagctgtggagcatg

SEQ ID NO: 14161 - DNA, 27 bp, Artificial sequence
  Reverse Primer
aacagattacaggaagctatgaataaa

SEQ ID NO: 14162 - DNA, 18 bp, Artificial sequence
  Reverse Primer
ttcctggacctcctccct

SEQ ID NO: 14163 - DNA, 20 bp, Artificial sequence
  Reverse Primer
tgagtttgacgcccttagtt

SEQ ID NO: 14164 - DNA, 26 bp, Artificial sequence
  Reverse Primer
ttctcatatgaacacttctctcatct

SEQ ID NO: 14165 - DNA, 24 bp, Artificial sequence
  Reverse Primer
aataattacaagtccacaggcatc

SEQ ID NO: 14166 - DNA, 18 bp, Artificial sequence
  Reverse Primer
agggaagtccacagaggc

SEQ ID NO: 14167 - DNA, 20 bp, Artificial sequence
  Reverse Primer
aggaagagcaacacagcttc

SEQ ID NO: 14168 - DNA, 24 bp, Artificial sequence
  Reverse Primer
aatctcagtcacgttgtatcttgg

SEQ ID NO: 14169 - DNA, 24 bp, Artificial sequence
  Reverse Primer
tagcctcttgatgaaaagaaactg

SEQ ID NO: 14170 - DNA, 24 bp, Artificial sequence
  Reverse Primer
atatatgcatgcctcttgtctttc

SEQ ID NO: 14171 - DNA, 22 bp, Artificial sequence
  Reverse Primer
atacctgaaatttagcctctgc

SEQ ID NO: 14172 - DNA, 24 bp, Artificial sequence
  Reverse Primer
tttctgagttgcattgtgatactg

SEQ ID NO: 14173 - DNA, 18 bp, Artificial sequence
  Reverse Primer
tccgaggggccttcagac

SEQ ID NO: 14174 - DNA, 28 bp, Artificial sequence
  Reverse Primer
ttgaacttaatattttcctagattcctt

SEQ ID NO: 14175 - DNA, 21 bp, Artificial sequence
  Reverse Primer
cttggggtattttcagaagct

SEQ ID NO: 14176 - DNA, 28 bp, Artificial sequence
  Reverse Primer
aataatgaccttccaagattatatagca

SEQ ID NO: 14177 - DNA, 21 bp, Artificial sequence
  Reverse Primer
ccctgaggtctctcatgaatt

SEQ ID NO: 14178 - DNA, 24 bp, Artificial sequence
  Reverse Primer
agagctagtttgggtaaaggtagc

SEQ ID NO: 14179 - DNA, 26 bp, Artificial sequence
  Reverse Primer
aatgtaaagatgttggtttacctacc

SEQ ID NO: 14180 - DNA, 24 bp, Artificial sequence
  Reverse Primer
tatattttcagttccaaaagggat

SEQ ID NO: 14181 - DNA, 20 bp, Artificial sequence
  Reverse Primer
gaggggagaggtaaggtgaa

SEQ ID NO: 14182 - DNA, 27 bp, Artificial sequence
  Reverse Primer
aaatttcaattcaagattatcacagac

SEQ ID NO: 14183 - DNA, 19 bp, Artificial sequence
  Reverse Primer
ctcctccttccccttctca

SEQ ID NO: 14184 - DNA, 23 bp, Artificial sequence
  Reverse Primer
ttccttcattatcagcttcaaaa

SEQ ID NO: 14185 - DNA, 26 bp, Artificial sequence
  Reverse Primer
tacaaattcaatccttagactgaaag

SEQ ID NO: 14186 - DNA, 29 bp, Artificial sequence
  Reverse Primer
taaatctcactttttctggttagtaaatc

SEQ ID NO: 14187 - DNA, 21 bp, Artificial sequence
  Reverse Primer
tgcrrtgaaggagctacaaga

SEQ ID NO: 14188 - DNA, 19 bp, Artificial sequence
  Reverse Primer
tcaccagctttccatcctc

SEQ ID NO: 14189 - DNA, 27 bp, Artificial sequence
  Reverse Primer
atgcatatatgttgtataagcattgaa

SEQ ID NO: 14190 - DNA, 24 bp, Artificial sequence
  Reverse Primer
agacctggagaaatatkttaaagg

SEQ ID NO: 14191 - DNA, 23 bp, Artificial sequence
  Reverse Primer
tatgttggaagtcacatttaccc

SEQ ID NO: 14192 - DNA, 18 bp, Artificial sequence
  Reverse Primer
acatcccccgcatgcaga

SEQ ID NO: 14193 - DNA, 23 bp, Artificial sequence
  Reverse Primer
atatgttatttttggatggtggg

SEQ ID NO: 14194 - DNA, 24 bp, Artificial sequence
  Reverse Primer
aaatattagacacagatttgccct

SEQ ID NO: 14195 - DNA, 20 bp, Artificial sequence
  Reverse Primer
aggagatggtgagtcctgag

SEQ ID NO: 14196 - DNA, 24 bp, Artificial sequence
  Reverse Primer
aaagagagaacgatctaaaacagg

SEQ ID NO: 14197 - DNA, 23 bp, Artificial sequence
  Reverse Primer
cagtgactrgatgacagaggatc

SEQ ID NO: 14198 - DNA, 22 bp, Artificial sequence
  Reverse Primer
tctttgttcctcacctcatttt

SEQ ID NO: 14199 - DNA, 18 bp, Artificial sequence
  Reverse Primer
aaacccatccttgtgggc

SEQ ID NO: 14200 - DNA, 21 bp, Artificial sequence
  Reverse Primer
aaagaagaacactggtgggag

SEQ ID NO: 14201 - DNA, 25 bp, Artificial sequence
  Reverse Primer
tatatctgaagagttggtgaggact

SEQ ID NO: 14202 - DNA, 18 bp, Artificial sequence
  Reverse Primer
tgggcacaaaaggagcta

SEQ ID NO: 14203 - DNA, 22 bp, Artificial sequence
  Reverse Primer
tcatctaagtgccttgatgagc

SEQ ID NO: 14204 - DNA, 20 bp, Artificial sequence
  Reverse Primer
taggggctgacaaagacttc

SEQ ID NO: 14205 - DNA, 18 bp, Artificial sequence
  Reverse Primer
atgatgaacagcagccac

SEQ ID NO: 14206 - DNA, 20 bp, Artificial sequence
  Reverse Primer
atggagaggcccatttagtg

SEQ ID NO: 14207 - DNA, 20 bp, Artificial sequence
  Reverse Primer
tggcactgctaatgttttgg

SEQ ID NO: 14208 - DNA, 24 bp, Artificial sequence
  Reverse Primer
tggttagctagaaaatgaaggaat

SEQ ID NO: 14209 - DNA, 26 bp, Artificial sequence
  Reverse Primer
aaccttatctcttcctctacttttca

SEQ ID NO: 14210 - DNA, 27 bp, Artificial sequence
  Reverse Primer
tttctatagctgctcaaataaatgtct

SEQ ID NO: 14211 - DNA, 25 bp, Artificial sequence
  Reverse Primer
aaaaggagctatccaagattactca

SEQ ID NO: 14212 - DNA, 18 bp, Artificial sequence
  Reverse Primer
actgttgctgccgcccgt

SEQ ID NO: 14213 - DNA, 21 bp, Artificial sequence
  Reverse Primer
gcaccaggcaggcatgttata

SEQ ID NO: 14214 - DNA, 18 bp, Artificial sequence
  Reverse Primer
ttcccagaacccgaggtg

SEQ ID NO: 14215 - DNA, 27 bp, Artificial sequence
  Reverse Primer
agtgaatgagtaagtcttttgtgagtc

SEQ ID NO: 14216 - DNA, 18 bp, Artificial sequence
  Reverse Primer
gtggagaagcctcccaaa

SEQ ID NO: 14217 - DNA, 22 bp, Artificial sequence
  Reverse Primer
tctagcaaacctttaagccaaa

SEQ ID NO: 14218 - DNA, 22 bp, Artificial sequence
  Reverse Primer
gcagttgtcttgttcactgtgt

SEQ ID NO: 14219 - DNA, 21 bp, Artificial sequence
  Reverse Primer
gtatccttctgttggtctccc

SEQ ID NO: 14220 - DNA, 25 bp, Artificial sequence
  Reverse Primer
tacagtttactcaggaagcttgaga

SEQ ID NO: 14221 - DNA, 21 bp, Artificial sequence
  Reverse Primer
ttcagtggtgaagactcttgc

SEQ ID NO: 14222 - DNA, 27 bp, Artificial sequence
  Reverse Primer
aaagagtcattagaattttgaaagtga

SEQ ID NO: 14223 - DNA, 23 bp, Artificial sequence
  Reverse Primer
aaattccaactttttctgttgtg

SEQ ID NO: 14224 - DNA, 26 bp, Artificial sequence
  Reverse Primer
ataattcctcaaggtaagttaagcac

SEQ ID NO: 14225 - DNA, 26 bp, Artificial sequence
  Reverse Primer
taatgaccttcaaaataggaaaaaac

SEQ ID NO: 14226 - DNA, 24 bp, Artificial sequence
  Reverse Primer
taaaagctaatgacaggatctttg

SEQ ID NO: 14227 - DNA, 24 bp, Artificial sequence
  Reverse Primer
aagagctctgtgacttcctgtaga

SEQ ID NO: 14228 - DNA, 24 bp, Artificial sequence
  Reverse Primer
aaaaataaaatgtgctttgaaagg

SEQ ID NO: 14229 - DNA, 26 bp, Artificial sequence
  Reverse Primer
aaattaacacagcattgtaaatcaac

SEQ ID NO: 14230 - DNA, 24 bp, Artificial sequence
  Reverse Primer
aatcatcctgaggattagctgtag

SEQ ID NO: 14231 - DNA, 26 bp, Artificial sequence
  Reverse Primer
tcgactgtacatttattagctcattt

SEQ ID NO: 14232 - DNA, 18 bp, Artificial sequence
  Reverse Primer
agggagactgcccttcca

SEQ ID NO: 14233 - DNA, 30 bp, Artificial sequence
  Reverse Primer
atctcagactataagtttataatttctccc

SEQ ID NO: 14234 - DNA, 24 bp, Artificial sequence
  Reverse Primer
ttctggaatttgtgaaatttaatc

SEQ ID NO: 14235 - DNA, 18 bp, Artificial sequence
  Reverse Primer
accaggcccgcttgtcac

SEQ ID NO: 14236 - DNA, 27 bp, Artificial sequence
  Reverse Primer
aaactccataaagttaggacttctctc

SEQ ID NO: 14237 - DNA, 22 bp, Artificial sequence
  Reverse Primer
agccttgtgcttagacatgatt

SEQ ID NO: 14238 - DNA, 18 bp, Artificial sequence
  Reverse Primer
gccctcaggcactgtcag

SEQ ID NO: 14239 - DNA, 22 bp, Artificial sequence
  Reverse Primer
agcacaaaagcacatagacaca

SEQ ID NO: 14240 - DNA, 23 bp, Artificial sequence
  Reverse Primer
atgatcttgttctggaaatctcc

SEQ ID NO: 14241 - DNA, 21 bp, Artificial sequence
  Reverse Primer
tgattacatccatgcyagagg

SEQ ID NO: 14242 - DNA, 27 bp, Artificial sequence
  Reverse Primer
acagtctcttgaattttaaaacacatc

SEQ ID NO: 14243 - DNA, 18 bp, Artificial sequence
  Reverse Primer
aaaattcttcaggccgcc

SEQ ID NO: 14244 - DNA, 23 bp, Artificial sequence
  Reverse Primer
tgttctgagtccttcagagtgtt

SEQ ID NO: 14245 - DNA, 22 bp, Artificial sequence
  Reverse Primer
tgtgttgaacaggatagacagc

SEQ ID NO: 14246 - DNA, 25 bp, Artificial sequence
  Reverse Primer
aaaattttctcttcagtctgctttc

SEQ ID NO: 14247 - DNA, 30 bp, Artificial sequence
  Reverse Primer
tgtactattttttgtaaytagtctgttgat

SEQ ID NO: 14248 - DNA, 28 bp, Artificial sequence
  Reverse Primer
tataagataaattaggcaaggacagtac

SEQ ID NO: 14249 - DNA, 23 bp, Artificial sequence
  Reverse Primer
atttaatcaaaccaggatctgtg

SEQ ID NO: 14250 - DNA, 20 bp, Artificial sequence
  Reverse Primer
actgtggaggagactgcaag

SEQ ID NO: 14251 - DNA, 26 bp, Artificial sequence
  Reverse Primer
ttaaaatatcaacaggaacacagaac

SEQ ID NO: 14252 - DNA, 20 bp, Artificial sequence
  Reverse Primer
accaaagaggggaatcaaag

SEQ ID NO: 14253 - DNA, 21 bp, Artificial sequence
  Reverse Primer
agccgagaggttttgtgtact

SEQ ID NO: 14254 - DNA, 21 bp, Artificial sequence
  Reverse Primer
tcttcatgacactggtgttgg

SEQ ID NO: 14255 - DNA, 27 bp, Artificial sequence
  Reverse Primer
tagagcacagggaactagatttaatat

SEQ ID NO: 14256 - DNA, 23 bp, Artificial sequence
  Reverse Primer
tttcattacttgcattggtactg

SEQ ID NO: 14257 - DNA, 23 bp, Artificial sequence
  Reverse Primer
agggcaggtaaaagaawtatcaa

SEQ ID NO: 14258 - DNA, 29 bp, Artificial sequence
  Reverse Primer
taagtataaccaagtgactaaatcctagc

SEQ ID NO: 14259 - DNA, 24 bp, Artificial sequence
  Reverse Primer
aattgctttgtcatttaaaaggtc

SEQ ID NO: 14260 - DNA, 28 bp, Artificial sequence
  Reverse Primer
tggacacttaytatgaaacaaattatct

SEQ ID NO: 14261 - DNA, 22 bp, Artificial sequence
  Reverse Primer
ttgccaacatagtaatttcacc

SEQ ID NO: 14262 - DNA, 30 bp, Artificial sequence
  Reverse Primer
ctaaacttcttatacttctccatgtattag

SEQ ID NO: 14263 - DNA, 24 bp, Artificial sequence
  Reverse Primer
ttccaaacacaatgagttatcaaa

SEQ ID NO: 14264 - DNA, 23 bp, Artificial sequence
  Reverse Primer
atgcatgttcaattctttgtttc

SEQ ID NO: 14265 - DNA, 30 bp, Artificial sequence
  Reverse Primer
gattctaagataatagacttatacgacaaa

SEQ ID NO: 14266 - DNA, 23 bp, Artificial sequence
  Reverse Primer
taatgttttactgctcttgaggg

SEQ ID NO: 14267 - DNA, 25 bp, Artificial sequence
  Reverse Primer
aaaagagggaattctttttataagc

SEQ ID NO: 14268 - DNA, 19 bp, Artificial sequence
  Reverse Primer
accaggtgtccaaccactc

SEQ ID NO: 14269 - DNA, 23 bp, Artificial sequence
  Reverse Primer
taggtttaggaagtgcattcaca

SEQ ID NO: 14270 - DNA, 26 bp, Artificial sequence
  Reverse Primer
atgatagtgatgatgtcataggactg

SEQ ID NO: 14271 - DNA, 20 bp, Artificial sequence
  Reverse Primer
atcactttcctcctcttggc

SEQ ID NO: 14272 - DNA, 22 bp, Artificial sequence
  Reverse Primer
tgatttacattcaacccactca

SEQ ID NO: 14273 - DNA, 22 bp, Artificial sequence
  Reverse Primer
gacaaggctgaaattggttaac

SEQ ID NO: 14274 - DNA, 21 bp, Artificial sequence
  Reverse Primer
ccctaggacttgcctagagac

SEQ ID NO: 14275 - DNA, 21 bp, Artificial sequence
  Reverse Primer
aactagagtctccctcctccc

SEQ ID NO: 14276 - DNA, 27 bp, Artificial sequence
  Reverse Primer
aatactttggacacagtagtaaggatt

SEQ ID NO: 14277 - DNA, 21 bp, Artificial sequence
  Reverse Primer
ttttataggccaatcactcgg

SEQ ID NO: 14278 - DNA, 18 bp, Artificial sequence
  Reverse Primer
ggaggagggatgacctgg

SEQ ID NO: 14279 - DNA, 27 bp, Artificial sequence
  Reverse Primer
tatcaaaatttatatgtgcacttcagt

SEQ ID NO: 14280 - DNA, 21 bp, Artificial sequence
  Reverse Primer
tatcttgtgcctggtagcatt

SEQ ID NO: 14281 - DNA, 22 bp, Artificial sequence
  Reverse Primer
tcataagtcaatccatccattc

SEQ ID NO: 14282 - DNA, 28 bp, Artificial sequence
  Reverse Primer
taaagcctgaatttaatactctatgacc

SEQ ID NO: 14283 - DNA, 18 bp, Artificial sequence
  Reverse Primer
tcattgggttccctgggc

SEQ ID NO: 14284 - DNA, 23 bp, Artificial sequence
  Reverse Primer
aaacagcaatgtacctggagtta

SEQ ID NO: 14285 - DNA, 24 bp, Artificial sequence
  Reverse Primer
tgtataaagatggatgaggcaata

SEQ ID NO: 14286 - DNA, 28 bp, Artificial sequence
  Reverse Primer
tttgtttatccttacttaatttcaagtc

SEQ ID NO: 14287 - DNA, 27 bp, Artificial sequence
  Reverse Primer
aaaacttatcagccctaaagctatatg

SEQ ID NO: 14288 - DNA, 24 bp, Artificial sequence
  Reverse Primer
ttatgagatagtgttgtttcctcc

SEQ ID NO: 14289 - DNA, 25 bp, Artificial sequence
  Reverse Primer
gcatgatggcttgtcttatacttat

SEQ ID NO: 14290 - DNA, 28 bp, Artificial sequence
  Reverse Primer
tattgtgtaacaagcatcattatagaag

SEQ ID NO: 14291 - DNA, 23 bp, Artificial sequence
  Reverse Primer
ttgttttttgttcaaaaggaagc

SEQ ID NO: 14292 - DNA, 18 bp, Artificial sequence
  Reverse Primer
catgggagactgcctcca

SEQ ID NO: 14293 - DNA, 20 bp, Artificial sequence
  Reverse Primer
acacagctataaagcaggcg

SEQ ID NO: 14294 - DNA, 22 bp, Artificial sequence
  Reverse Primer
ttaacaccactgaactgtacgc

SEQ ID NO: 14295 - DNA, 23 bp, Artificial sequence
  Reverse Primer
tggtcaccctttaacaagtctat

SEQ ID NO: 14296 - DNA, 18 bp, Artificial sequence
  Reverse Primer
acacgtgtccagggctcc

SEQ ID NO: 14297 - DNA, 24 bp, Artificial sequence
  Reverse Primer
acattcttaaatgaaactggcttt

SEQ ID NO: 14298 - DNA, 18 bp, Artificial sequence
  Reverse Primer
gcaggtcaggtggtgtgg

SEQ ID NO: 14299 - DNA, 20 bp, Artificial sequence
  Reverse Primer
aggccacagtacaaggaacc

SEQ ID NO: 14300 - DNA, 25 bp, Artificial sequence
  Reverse Primer
ttcaaactcagactagaacctatgc

SEQ ID NO: 14301 - DNA, 26 bp, Artificial sequence
  Reverse Primer
tagccaaggaaatattttaacattct

SEQ ID NO: 14302 - DNA, 28 bp, Artificial sequence
  Reverse Primer
taaattgtagacttaatctcaaaaaagg

SEQ ID NO: 14303 - DNA, 18 bp, Artificial sequence
  Reverse Primer
tttcctcatgctggcaga

SEQ ID NO: 14304 - DNA, 27 bp, Artificial sequence
  Reverse Primer
ttatcgactagcatgttatttctatgg

SEQ ID NO: 14305 - DNA, 18 bp, Artificial sequence
  Reverse Primer
accggcagggtgtaacga

SEQ ID NO: 14306 - DNA, 18 bp, Artificial sequence
  Reverse Primer
tccctgcaaaagcctcag

SEQ ID NO: 14307 - DNA, 30 bp, Artificial sequence
  Reverse Primer
ttaaatgactttattaacagacttcttaac

SEQ ID NO: 14308 - DNA, 18 bp, Artificial sequence
  Reverse Primer
aaggtcatcagcgccgac

SEQ ID NO: 14309 - DNA, 25 bp, Artificial sequence
  Reverse Primer
aatgtcactggaatatgtctttctg

SEQ ID NO: 14310 - DNA, 19 bp, Artificial sequence
  Reverse Primer
tgcccctcrtcttctcttc

SEQ ID NO: 14311 - DNA, 23 bp, Artificial sequence
  Reverse Primer
atggtgttaaacgaatactggaa

SEQ ID NO: 14312 - DNA, 28 bp, Artificial sequence
  Reverse Primer
aatttcttctaacagaaaagaagtcaac

SEQ ID NO: 14313 - DNA, 24 bp, Artificial sequence
  Reverse Primer
aaaacacaaataaatagcatgtgc

SEQ ID NO: 14314 - DNA, 27 bp, Artificial sequence
  Reverse Primer
aaaatgagctgatttatgtaaactgtt

SEQ ID NO: 14315 - DNA, 26 bp, Artificial sequence
  Reverse Primer
tttcagtgttgaaagtgatagatttt

SEQ ID NO: 14316 - DNA, 24 bp, Artificial sequence
  Reverse Primer
aaagaactgaaagatacaaatccg

SEQ ID NO: 14317 - DNA, 18 bp, Artificial sequence
  Reverse Primer
gccctcaggcactgtcag

SEQ ID NO: 14318 - DNA, 22 bp, Artificial sequence
  Reverse Primer
attcagcaacccaggatatatg

SEQ ID NO: 14319 - DNA, 21 bp, Artificial sequence
  Reverse Primer
ttgaggagccattctaccttc

SEQ ID NO: 14320 - DNA, 30 bp, Artificial sequence
  Reverse Primer
gaatacatgaggtcacaactaattttatat

SEQ ID NO: 14321 - DNA, 27 bp, Artificial sequence
  Reverse Primer
ataaattgccaccatataaaaattacc

SEQ ID NO: 14322 - DNA, 18 bp, Artificial sequence
  Reverse Primer
ttttccccctgtgttcct

SEQ ID NO: 14323 - DNA, 28 bp, Artificial sequence
  Reverse Primer
ataatttttgatgatatgactcttcttc

SEQ ID NO: 14324 - DNA, 22 bp, Artificial sequence
  Reverse Primer
aaaattaacaagggcaagcttt

SEQ ID NO: 14325 - DNA, 18 bp, Artificial sequence
  Reverse Primer
aatagggagccatggagg

SEQ ID NO: 14326 - DNA, 19 bp, Artificial sequence
  Reverse Primer
atagctgctttccaaggga

SEQ ID NO: 14327 - DNA, 26 bp, Artificial sequence
  Reverse Primer
attaagtctggattgacttcaactct

SEQ ID NO: 14328 - DNA, 25 bp, Artificial sequence
  Reverse Primer
aacatctatacttcatgagctcctc

SEQ ID NO: 14329 - DNA, 25 bp, Artificial sequence
  Reverse Primer
aacatctatacttcatgagctcctc

SEQ ID NO: 14330 - DNA, 25 bp, Artificial sequence
  Reverse Primer
gtattaaagaasgggttttctgatt

SEQ ID NO: 14331 - DNA, 21 bp, Artificial sequence
  Reverse Primer
ttcttcaaaggcagcatgtaa

SEQ ID NO: 14332 - DNA, 22 bp, Artificial sequence
  Reverse Primer
tcataagtcaatccatccattc

SEQ ID NO: 14333 - DNA, 28 bp, Artificial sequence
  Reverse Primer
taaagcctgaatttaatactctatgacc

SEQ ID NO: 14334 - DNA, 18 bp, Artificial sequence
  Reverse Primer
tcattgggttccctgggc

SEQ ID NO: 14335 - DNA, 19 bp, Artificial sequence
  Reverse Primer
tttagggcttggtcctgtg

SEQ ID NO: 14336 - DNA, 21 bp, Artificial sequence
  Reverse Primer
tactccacagaaaagaggcaa

SEQ ID NO: 14337 - DNA, 22 bp, Artificial sequence
  Reverse Primer
acaatcaccctcacatygtatc

SEQ ID NO: 14338 - DNA, 20 bp, Artificial sequence
  Reverse Primer
taatggcccttgatagcaaa

SEQ ID NO: 14339 - DNA, 23 bp, Artificial sequence
  Reverse Primer
taacatccagtcacaggaaattg

SEQ ID NO: 14340 - DNA, 18 bp, Artificial sequence
  Reverse Primer
agcagtccctctccacac

SEQ ID NO: 14341 - DNA, 28 bp, Artificial sequence
  Reverse Primer
actatgaatgttttaatttgaatactgg

SEQ ID NO: 14342 - DNA, 28 bp, Artificial sequence
  Reverse Primer
tataagataaattaggcaaggacagtac

SEQ ID NO: 14343 - DNA, 27 bp, Artificial sequence
  Reverse Primer
tttcttagagttactcgaaactgaatg

SEQ ID NO: 14344 - DNA, 26 bp, Artificial sequence
  Reverse Primer
atatatcagtgtcctggcatataacc

SEQ ID NO: 14345 - DNA, 23 bp, Artificial sequence
  Reverse Primer
acttgttttagggaggaaaaagg

SEQ ID NO: 14346 - DNA, 19 bp, Artificial sequence
  Reverse Primer
ctgaactctccctgcctct

SEQ ID NO: 14347 - DNA, 22 bp, Artificial sequence
  Reverse Primer
aaataccaagaaagcacactgg

SEQ ID NO: 14348 - DNA, 25 bp, Artificial sequence
  Reverse Primer
ttgtcaaggtacatgtctttatcag

SEQ ID NO: 14349 - DNA, 23 bp, Artificial sequence
  Reverse Primer
tatgatagaccttgattgccagt

SEQ ID NO: 14350 - DNA, 28 bp, Artificial sequence
  Reverse Primer
atggtaaagtaattatcctccaattaaa

SEQ ID NO: 14351 - DNA, 25 bp, Artificial sequence
  Reverse Primer
tctgaaggataaagataagaggctt

SEQ ID NO: 14352 - DNA, 30 bp, Artificial sequence
  Reverse Primer
taatagatatcttacaagcttctgattaag

SEQ ID NO: 14353 - DNA, 25 bp, Artificial sequence
  Reverse Primer
aatattacataatgctcctccactg

SEQ ID NO: 14354 - DNA, 21 bp, Artificial sequence
  Reverse Primer
ctgggaaatcccataacagag

SEQ ID NO: 14355 - DNA, 21 bp, Artificial sequence
  Reverse Primer
tttgtggaagagcttcagaga

SEQ ID NO: 14356 - DNA, 23 bp, Artificial sequence
  Reverse Primer
ccaactactaagcctgcactcta

SEQ ID NO: 14357 - DNA, 24 bp, Artificial sequence
  Reverse Primer
acaaaggtagttgctttcttctca

SEQ ID NO: 14358 - DNA, 24 bp, Artificial sequence
  Reverse Primer
taaactcactctgctgctattgtc

SEQ ID NO: 14359 - DNA, 22 bp, Artificial sequence
  Reverse Primer
tcatcttttgtttttcctccag

SEQ ID NO: 14360 - DNA, 23 bp, Artificial sequence
  Reverse Primer
aaacagcaatgtacctggagtta

SEQ ID NO: 14361 - DNA, 24 bp, Artificial sequence
  Reverse Primer
tgtataaagatggatgaggcaata

SEQ ID NO: 14362 - DNA, 28 bp, Artificial sequence
  Reverse Primer
tttgtttatccttacttaatttcaagtc

SEQ ID NO: 14363 - DNA, 27 bp, Artificial sequence
  Reverse Primer
aaaacttatcagccctaaagctatatg

SEQ ID NO: 14364 - DNA, 24 bp, Artificial sequence
  Reverse Primer
ttatgagatagtgttgtttcctcc

SEQ ID NO: 14365 - DNA, 25 bp, Artificial sequence
  Reverse Primer
gcatgatggcttgtcttatacttat

SEQ ID NO: 14366 - DNA, 28 bp, Artificial sequence
  Reverse Primer
tattgtgtaacaagcatcattatagaag

SEQ ID NO: 14367 - DNA, 23 bp, Artificial sequence
  Reverse Primer
ttgttttttgttcaaaaggaagc

SEQ ID NO: 14368 - DNA, 18 bp, Artificial sequence
  Reverse Primer
catgggagactgcctcca

SEQ ID NO: 14369 - DNA, 20 bp, Artificial sequence
  Reverse Primer
acacagctataaagcaggcg

SEQ ID NO: 14370 - DNA, 22 bp, Artificial sequence
  Reverse Primer
ttaacaccactgaactgtacgc

SEQ ID NO: 14371 - DNA, 23 bp, Artificial sequence
  Reverse Primer
tggtcaccctttaacaagtctat

SEQ ID NO: 14372 - DNA, 18 bp, Artificial sequence
  Reverse Primer
acacgtgtccagggctcc

SEQ ID NO: 14373 - DNA, 24 bp, Artificial sequence
  Reverse Primer
acattcttaaatgaaactggcttt

SEQ ID NO: 14374 - DNA, 26 bp, Artificial sequence
  Reverse Primer
tggcaaaactaatacatttgtaaagt

SEQ ID NO: 14375 - DNA, 30 bp, Artificial sequence
  Reverse Primer
tatatatgtgtcttaggcttaaaaaggtaa

SEQ ID NO: 14376 - DNA, 28 bp, Artificial sequence
  Reverse Primer
attatgtctattgtgaagtcatcaagac

SEQ ID NO: 14377 - DNA, 22 bp, Artificial sequence
  Reverse Primer
aaagtgaacgaatgaatcaagc

SEQ ID NO: 14378 - DNA, 19 bp, Artificial sequence
  Reverse Primer
tacctcaccatgaacctcg

SEQ ID NO: 14379 - DNA, 22 bp, Artificial sequence
  Reverse Primer
tgtatggactcagaaagaagca

SEQ ID NO: 14380 - DNA, 21 bp, Artificial sequence
  Reverse Primer
ttctcttcctcatgagctgtt

SEQ ID NO: 14381 - DNA, 26 bp, Artificial sequence
  Reverse Primer
ataatgttgcagaatttccttcttat

SEQ ID NO: 14382 - DNA, 23 bp, Artificial sequence
  Reverse Primer
tgtgatgctcgggtaagtataac

SEQ ID NO: 14383 - DNA, 30 bp, Artificial sequence
  Reverse Primer
ataaactgtaaaggatatctatttattccc

SEQ ID NO: 14384 - DNA, 22 bp, Artificial sequence
  Reverse Primer
tcttaagaatacaggttcccgg

SEQ ID NO: 14385 - DNA, 30 bp, Artificial sequence
  Reverse Primer
atctgaatactagtgagattttatatgtgt

SEQ ID NO: 14386 - DNA, 18 bp, Artificial sequence
  Reverse Primer
aaaggaaggagggcctac

SEQ ID NO: 14387 - DNA, 30 bp, Artificial sequence
  Reverse Primer
aaaggtatgctgagtagttaagactctatt

SEQ ID NO: 14388 - DNA, 29 bp, Artificial sequence
  Reverse Primer
atatctcaggaacttaactaaatgtaagg

SEQ ID NO: 14389 - DNA, 25 bp, Artificial sequence
  Reverse Primer
tcaatttcatgcacataatagatcc

SEQ ID NO: 14390 - DNA, 30 bp, Artificial sequence
  Reverse Primer
taaaacaagcttaatttgtattaggtagtc

SEQ ID NO: 14391 - DNA, 18 bp, Artificial sequence
  Reverse Primer
gaggacaagctgggacca

SEQ ID NO: 14392 - DNA, 18 bp, Artificial sequence
  Reverse Primer
agtcatgaaggcagcagc

SEQ ID NO: 14393 - DNA, 23 bp, Artificial sequence
  Reverse Primer
agaccctattgtaagtggaggat

SEQ ID NO: 14394 - DNA, 27 bp, Artificial sequence
  Reverse Primer
acagtctcttgaattttaaaacacatc

SEQ ID NO: 14395 - DNA, 25 bp, Artificial sequence
  Reverse Primer
tataaagggaaggtcaacataaaga

SEQ ID NO: 14396 - DNA, 18 bp, Artificial sequence
  Reverse Primer
atgccctgggaggcacca

SEQ ID NO: 14397 - DNA, 18 bp, Artificial sequence
  Reverse Primer
tgcccatcatgatctcct

SEQ ID NO: 14398 - DNA, 21 bp, Artificial sequence
  Reverse Primer
aattatctgccaaccagctct

SEQ ID NO: 14399 - DNA, 23 bp, Artificial sequence
  Reverse Primer
attcatctcttgtggtcatcagt

SEQ ID NO: 14400 - DNA, 25 bp, Artificial sequence
  Reverse Primer
aaatcagaagaaaaaataccttcct

SEQ ID NO: 14401 - DNA, 19 bp, Artificial sequence
  Reverse Primer
agaccaccgatcagaaagc

SEQ ID NO: 14402 - DNA, 22 bp, Artificial sequence
  Reverse Primer
tgggcttagattcacttctctg

SEQ ID NO: 14403 - DNA, 21 bp, Artificial sequence
  Reverse Primer
tgtagtggaaatgcaaagtcc

SEQ ID NO: 14404 - DNA, 24 bp, Artificial sequence
  Reverse Primer
ttaatctattcgcttccagttttg

SEQ ID NO: 14405 - DNA, 18 bp, Artificial sequence
  Reverse Primer
tcaggacaccccctcaat

SEQ ID NO: 14406 - DNA, 23 bp, Artificial sequence
  Reverse Primer
attttggattcaggtaggttagg

SEQ ID NO: 14407 - DNA, 18 bp, Artificial sequence
  Reverse Primer
aaaattcttcaggccgcc

SEQ ID NO: 14408 - DNA, 28 bp, Artificial sequence
  Reverse Primer
acacattttctgctttaggataaatatt

SEQ ID NO: 14409 - DNA, 18 bp, Artificial sequence
  Reverse Primer
aaggacgacaggcaggtt

SEQ ID NO: 14410 - DNA, 30 bp, Artificial sequence
  Reverse Primer
tataactaataagcaaacagttaacaagct

SEQ ID NO: 14411 - DNA, 29 bp, Artificial sequence
  Reverse Primer
atctggaaaagaatatgtacgtataactg

SEQ ID NO: 14412 - DNA, 21 bp, Artificial sequence
  Reverse Primer
ttttgtgttgctcatccgtat

SEQ ID NO: 14413 - DNA, 21 bp, Artificial sequence
  Reverse Primer
agtttggtcttgacttcccat

SEQ ID NO: 14414 - DNA, 22 bp, Artificial sequence
  Reverse Primer
agccttgtgcttagacatgatt

SEQ ID NO: 14415 - DNA, 29 bp, Artificial sequence
  Reverse Primer
ctctgaatactagagataacttcacgatc

SEQ ID NO: 14416 - DNA, 23 bp, Artificial sequence
  Reverse Primer
acaaagaggatggaatcacttct

SEQ ID NO: 14417 - DNA, 22 bp, Artificial sequence
  Reverse Primer
agcacaaaagcacatagacaca

SEQ ID NO: 14418 - DNA, 30 bp, Artificial sequence
  Reverse Primer
atatagttttggaaaccattactctatagg

SEQ ID NO: 14419 - DNA, 18 bp, Artificial sequence
  Reverse Primer
atccgggcatctcccagt

SEQ ID NO: 14420 - DNA, 29 bp, Artificial sequence
  Reverse Primer
ttttcctatatagatataaatgccagttc

SEQ ID NO: 14421 - DNA, 23 bp, Artificial sequence
  Reverse Primer
aaatacaaagctggagatgaaag

SEQ ID NO: 14422 - DNA, 19 bp, Artificial sequence
  Reverse Primer
cacttcctgtgacctgcac

SEQ ID NO: 14423 - DNA, 28 bp, Artificial sequence
  Reverse Primer
aagtatctccttttacttcttaaacacc

SEQ ID NO: 14424 - DNA, 18 bp, Artificial sequence
  Reverse Primer
aagacagcatggacggtc

SEQ ID NO: 14425 - DNA, 19 bp, Artificial sequence
  Reverse Primer
aagtctccagaccagtgcc

SEQ ID NO: 14426 - DNA, 20 bp, Artificial sequence
  Reverse Primer
agctgttcagtagccgtgaa

SEQ ID NO: 14427 - DNA, 24 bp, Artificial sequence
  Reverse Primer
tttaatgtactgacacatcaatgc

SEQ ID NO: 14428 - DNA, 27 bp, Artificial sequence
  Reverse Primer
agttttcaatgtaaaaaattacaaggc

SEQ ID NO: 14429 - DNA, 28 bp, Artificial sequence
  Reverse Primer
actaaaatatcataatctttttgactgc

SEQ ID NO: 14430 - DNA, 22 bp, Artificial sequence
  Reverse Primer
atttttatggatgagaacaccg

SEQ ID NO: 14431 - DNA, 23 bp, Artificial sequence
  Reverse Primer
tttgtttgagttcaaattccatt

SEQ ID NO: 14432 - DNA, 30 bp, Artificial sequence
  Reverse Primer
gttatattttgtatccaaatcagatgatag

SEQ ID NO: 14433 - DNA, 28 bp, Artificial sequence
  Reverse Primer
atttttaagtttcttacctaatttgagc

SEQ ID NO: 14434 - DNA, 22 bp, Artificial sequence
  Reverse Primer
tgtgttgaacaggatagacagc

SEQ ID NO: 14435 - DNA, 21 bp, Artificial sequence
  Reverse Primer
cagaacaagtgctccatacgt

SEQ ID NO: 14436 - DNA, 22 bp, Artificial sequence
  Reverse Primer
aaaaacgagataatgagcttcc

SEQ ID NO: 14437 - DNA, 27 bp, Artificial sequence
  Reverse Primer
atgaaatctacaaaaaattcctgtaag

SEQ ID NO: 14438 - DNA, 24 bp, Artificial sequence
  Reverse Primer
aaatctttgcaatttaggatcttc

SEQ ID NO: 14439 - DNA, 21 bp, Artificial sequence
  Reverse Primer
attacgattttacatcccgct

SEQ ID NO: 14440 - DNA, 25 bp, Artificial sequence
  Reverse Primer
actcttgggtgtatctcttaactgg

SEQ ID NO: 14441 - DNA, 27 bp, Artificial sequence
  Reverse Primer
tgttttatagaaagacaggaagaacat

SEQ ID NO: 14442 - DNA, 27 bp, Artificial sequence
  Reverse Primer
ttatattgagtcaagaaaatatgcaag

SEQ ID NO: 14443 - DNA, 19 bp, Artificial sequence
  Reverse Primer
tcatgtgaaggtgaacgtg

SEQ ID NO: 14444 - DNA, 18 bp, Artificial sequence
  Reverse Primer
aggatggggaaggagccc

SEQ ID NO: 14445 - DNA, 24 bp, Artificial sequence
  Reverse Primer
tgccttttgtctgtaaaaaaactt

SEQ ID NO: 14446 - DNA, 23 bp, Artificial sequence
  Reverse Primer
tgaataaattttcaggtacaggc

SEQ ID NO: 14447 - DNA, 28 bp, Artificial sequence
  Reverse Primer
tgacttttactctaaaataattcatgct

SEQ ID NO: 14448 - DNA, 24 bp, Artificial sequence
  Reverse Primer
aaatattttcatcatcttcccaca

SEQ ID NO: 14449 - DNA, 27 bp, Artificial sequence
  Reverse Primer
acttttgaagcagtarcagtttatttt

SEQ ID NO: 14450 - DNA, 20 bp, Artificial sequence
  Reverse Primer
ataaatgctcgctttccaga

SEQ ID NO: 14451 - DNA, 25 bp, Artificial sequence
  Reverse Primer
ataactgttcacttgattcctcttc

SEQ ID NO: 14452 - DNA, 23 bp, Artificial sequence
  Reverse Primer
ccctgacaacaataaactttcaa

SEQ ID NO: 14453 - DNA, 26 bp, Artificial sequence
  Reverse Primer
tataaaccrcttcataaagtttgtgt

SEQ ID NO: 14454 - DNA, 26 bp, Artificial sequence
  Reverse Primer
aattaaacttggtttcagacttaagg

SEQ ID NO: 14455 - DNA, 29 bp, Artificial sequence
  Reverse Primer
tttctactagataaacagtgtcatgctaa

SEQ ID NO: 14456 - DNA, 25 bp, Artificial sequence
  Reverse Primer
attcatttcttctctcacaagttca

SEQ ID NO: 14457 - DNA, 22 bp, Artificial sequence
  Reverse Primer
ctctcgctggtgatacatttct

SEQ ID NO: 14458 - DNA, 28 bp, Artificial sequence
  Reverse Primer
aaatccttttttattacragtgtaaagc

SEQ ID NO: 14459 - DNA, 22 bp, Artificial sequence
  Reverse Primer
ctgtacttctccccaaattgaa

SEQ ID NO: 14460 - DNA, 25 bp, Artificial sequence
  Reverse Primer
atttactggcagagaatcatcttag

SEQ ID NO: 14461 - DNA, 24 bp, Artificial sequence
  Reverse Primer
agaggtattttctcaccttgtctc

SEQ ID NO: 14462 - DNA, 26 bp, Artificial sequence
  Reverse Primer
taaagcatttttatttcatagcacag

SEQ ID NO: 14463 - DNA, 30 bp, Artificial sequence
  Reverse Primer
agttacctatatgaagaatgtttgtaccta

SEQ ID NO: 14464 - DNA, 27 bp, Artificial sequence
  Reverse Primer
atgggcatggttactacaatatataaa

SEQ ID NO: 14465 - DNA, 22 bp, Artificial sequence
  Reverse Primer
ctggctccattctaagctttag

SEQ ID NO: 14466 - DNA, 19 bp, Artificial sequence
  Reverse Primer
atgctgatttccaaaggga

SEQ ID NO: 14467 - DNA, 21 bp, Artificial sequence
  Reverse Primer
acctccacacttatccttcct

SEQ ID NO: 14468 - DNA, 19 bp, Artificial sequence
  Reverse Primer
aattttccactgggtgtgg

SEQ ID NO: 14469 - DNA, 26 bp, Artificial sequence
  Reverse Primer
atttgttaaggacaaaaaatctcaac

SEQ ID NO: 14470 - DNA, 22 bp, Artificial sequence
  Reverse Primer
ttctaccctgtaaktaaggccc

SEQ ID NO: 14471 - DNA, 22 bp, Artificial sequence
  Reverse Primer
aggttgtacatgagtcacagca

SEQ ID NO: 14472 - DNA, 27 bp, Artificial sequence
  Reverse Primer
gcttgaattaaaacttacacctaactg

SEQ ID NO: 14473 - DNA, 20 bp, Artificial sequence
  Reverse Primer
gtgctgggagacagtttttc

SEQ ID NO: 14474 - DNA, 19 bp, Artificial sequence
  Reverse Primer
tgctaatcccaaattccca

SEQ ID NO: 14475 - DNA, 30 bp, Artificial sequence
  Reverse Primer
atattattgtacatagttcaaactggtgtc

SEQ ID NO: 14476 - DNA, 29 bp, Artificial sequence
  Reverse Primer
taaataagctagttcatgtaaagtccttc

SEQ ID NO: 14477 - DNA, 21 bp, Artificial sequence
  Reverse Primer
aaagrcttgtgtgccactaga

SEQ ID NO: 14478 - DNA, 18 bp, Artificial sequence
  Reverse Primer
tcctttctcgttcgtcga

SEQ ID NO: 14479 - DNA, 25 bp, Artificial sequence
  Reverse Primer
tatttttccagtcatctttgaagac

SEQ ID NO: 14480 - DNA, 23 bp, Artificial sequence
  Reverse Primer
aaatcagaggtgaagtcaggact

SEQ ID NO: 14481 - DNA, 19 bp, Artificial sequence
  Reverse Primer
ttacacagtggctggcttc

SEQ ID NO: 14482 - DNA, 24 bp, Artificial sequence
  Reverse Primer
aaggtgattgaactcaaattcatt

SEQ ID NO: 14483 - DNA, 22 bp, Artificial sequence
  Reverse Primer
ccagctttgtcactgaagaatt

SEQ ID NO: 14484 - DNA, 26 bp, Artificial sequence
  Reverse Primer
acagagagcaccttatttagtgaatt

SEQ ID NO: 14485 - DNA, 28 bp, Artificial sequence
  Reverse Primer
gatcttaggaaaagaaatctgaaaatag

SEQ ID NO: 14486 - DNA, 26 bp, Artificial sequence
  Reverse Primer
tctgaacaattatagtcagatttcct

SEQ ID NO: 14487 - DNA, 18 bp, Artificial sequence
  Reverse Primer
tggtggagccctgtgtgg

SEQ ID NO: 14488 - DNA, 25 bp, Artificial sequence
  Reverse Primer
tattgctctacttgaaatgtgtttg

SEQ ID NO: 14489 - DNA, 19 bp, Artificial sequence
  Reverse Primer
acaccccagccacgagcat

SEQ ID NO: 14490 - DNA, 19 bp, Artificial sequence
  Reverse Primer
acacccctcaccaccttag

SEQ ID NO: 14491 - DNA, 22 bp, Artificial sequence
  Reverse Primer
acacaccttgtagttttcaggc

SEQ ID NO: 14492 - DNA, 30 bp, Artificial sequence
  Reverse Primer
cttacaactaaattagatagaaattcagtc

SEQ ID NO: 14493 - DNA, 26 bp, Artificial sequence
  Reverse Primer
aaaggaagaaattyraaaaacagatg

SEQ ID NO: 14494 - DNA, 23 bp, Artificial sequence
  Reverse Primer
tgatagcctgttatgctgatttt

SEQ ID NO: 14495 - DNA, 27 bp, Artificial sequence
  Reverse Primer
tgactaatacagaaagagaggaaacat

SEQ ID NO: 14496 - DNA, 23 bp, Artificial sequence
  Reverse Primer
tttacatattttgacagtgtgcc

SEQ ID NO: 14497 - DNA, 21 bp, Artificial sequence
  Reverse Primer
tcaattcctctacatcaggca

SEQ ID NO: 14498 - DNA, 18 bp, Artificial sequence
  Reverse Primer
agaagcctgcctcctgcc

SEQ ID NO: 14499 - DNA, 22 bp, Artificial sequence
  Reverse Primer
attgggtttgagacttgagtga

SEQ ID NO: 14500 - DNA, 24 bp, Artificial sequence
  Reverse Primer
tgctctagagmgaagttttgtagc

SEQ ID NO: 14501 - DNA, 18 bp, Artificial sequence
  Reverse Primer
cactgtccacacccctca

SEQ ID NO: 14502 - DNA, 25 bp, Artificial sequence
  Reverse Primer
agaaagaaaaatgaaactggaattg

SEQ ID NO: 14503 - DNA, 27 bp, Artificial sequence
  Reverse Primer
tattttcagattatctgttacgtttca

SEQ ID NO: 14504 - DNA, 19 bp, Artificial sequence
  Reverse Primer
acagaggytcagcttggag

SEQ ID NO: 14505 - DNA, 23 bp, Artificial sequence
  Reverse Primer
aatatgtcttctaattcatgccc

SEQ ID NO: 14506 - DNA, 23 bp, Artificial sequence
  Reverse Primer
tgttctgagtccttcagagtgtt

SEQ ID NO: 14507 - DNA, 20 bp, Artificial sequence
  Reverse Primer
gcctgaaggtcagaggtctc

SEQ ID NO: 14508 - DNA, 25 bp, Artificial sequence
  Reverse Primer
aaaaacagggtatacacaccaataa

SEQ ID NO: 14509 - DNA, 18 bp, Artificial sequence
  Reverse Primer
tgaaaatggcccccttct

SEQ ID NO: 14510 - DNA, 25 bp, Artificial sequence
  Reverse Primer
tatatctgtcatccctaaacctgaa

SEQ ID NO: 14511 - DNA, 24 bp, Artificial sequence
  Reverse Primer
tgatgtgaatattgtgatgattga

SEQ ID NO: 14512 - DNA, 23 bp, Artificial sequence
  Reverse Primer
aaagaactgatgtcagaaactgg

SEQ ID NO: 14513 - DNA, 24 bp, Artificial sequence
  Reverse Primer
aaatgttgtcacagtagtacccaa

SEQ ID NO: 14514 - DNA, 25 bp, Artificial sequence
  Reverse Primer
gggaaattatacaatcatgtttgag

SEQ ID NO: 14515 - DNA, 27 bp, Artificial sequence
  Reverse Primer
attatcagtcccatattacaaatgaag

SEQ ID NO: 14516 - DNA, 25 bp, Artificial sequence
  Reverse Primer
aaagagatttagacaaaagcacagc

SEQ ID NO: 14517 - DNA, 30 bp, Artificial sequence
  Reverse Primer
ttttcctaatagtcatatctacatgaaaac

SEQ ID NO: 14518 - DNA, 22 bp, Artificial sequence
  Reverse Primer
tatttcccctgatgacaagtgt

SEQ ID NO: 14519 - DNA, 26 bp, Artificial sequence
  Reverse Primer
aatcaagtaaactctctcatttcacc

SEQ ID NO: 14520 - DNA, 21 bp, Artificial sequence
  Reverse Primer
tttccagagcctgaggttact

SEQ ID NO: 14521 - DNA, 24 bp, Artificial sequence
  Reverse Primer
taatcacttcgattctttcagtgt

SEQ ID NO: 14522 - DNA, 27 bp, Artificial sequence
  Reverse Primer
tttgcttttaaatgaggtaagacttag

SEQ ID NO: 14523 - DNA, 28 bp, Artificial sequence
  Reverse Primer
tactttttctacatacaaacatgatgag

SEQ ID NO: 14524 - DNA, 27 bp, Artificial sequence
  Reverse Primer
ctctttccagacattcctttaattata

SEQ ID NO: 14525 - DNA, 25 bp, Artificial sequence
  Reverse Primer
atagctttgttgaccttagcactaa

SEQ ID NO: 14526 - DNA, 27 bp, Artificial sequence
  Reverse Primer
aattatttaagtaacctgagacagacc

SEQ ID NO: 14527 - DNA, 22 bp, Artificial sequence
  Reverse Primer
tttaagcatggtaggtgtctgc

SEQ ID NO: 14528 - DNA, 24 bp, Artificial sequence
  Reverse Primer
accactcatctcaatttcattttt

SEQ ID NO: 14529 - DNA, 22 bp, Artificial sequence
  Reverse Primer
aatggcatctcagagaaaaatt

SEQ ID NO: 14530 - DNA, 24 bp, Artificial sequence
  Reverse Primer
acctacaggtggtcagatattttg

SEQ ID NO: 14531 - DNA, 23 bp, Artificial sequence
  Reverse Primer
aaggtatcactctcatatgcctc

SEQ ID NO: 14532 - DNA, 19 bp, Artificial sequence
  Reverse Primer
aggaaacgcattcagcttg

SEQ ID NO: 14533 - DNA, 25 bp, Artificial sequence
  Reverse Primer
ttggtaagaagtagaaatggatgat

SEQ ID NO: 14534 - DNA, 25 bp, Artificial sequence
  Reverse Primer
tggctatttaaatattacacaatcc

SEQ ID NO: 14535 - DNA, 26 bp, Artificial sequence
  Reverse Primer
taatgaagatttgatagaggaaacag

SEQ ID NO: 14536 - DNA, 28 bp, Artificial sequence
  Reverse Primer
ttattgaatttttcaagtacttattggg

SEQ ID NO: 14537 - DNA, 22 bp, Artificial sequence
  Reverse Primer
ggagctactgataccaaggaga

SEQ ID NO: 14538 - DNA, 20 bp, Artificial sequence
  Reverse Primer
tgaagtaggctgtgagaggc

SEQ ID NO: 14539 - DNA, 20 bp, Artificial sequence
  Reverse Primer
aaaaaacatccttcctgcaa

SEQ ID NO: 14540 - DNA, 22 bp, Artificial sequence
  Reverse Primer
aaaaagagccaaagtgagtcat

SEQ ID NO: 14541 - DNA, 27 bp, Artificial sequence
  Reverse Primer
ctttctggccaatattaagtacaatat

SEQ ID NO: 14542 - DNA, 22 bp, Artificial sequence
  Reverse Primer
acaatgaagaaccaccatgatt

SEQ ID NO: 14543 - DNA, 28 bp, Artificial sequence
  Reverse Primer
taaaagtagggttacaatttaacagtga

SEQ ID NO: 14544 - DNA, 25 bp, Artificial sequence
  Reverse Primer
atttgttaagtatacaccatggagc

SEQ ID NO: 14545 - DNA, 28 bp, Artificial sequence
  Reverse Primer
aacaataatgtggttacaaagaaataca

SEQ ID NO: 14546 - DNA, 28 bp, Artificial sequence
  Reverse Primer
tagtttcatttaaatcattttctcactg

SEQ ID NO: 14547 - DNA, 28 bp, Artificial sequence
  Reverse Primer
actagctatctgtttacacatgtagtgc

SEQ ID NO: 14548 - DNA, 27 bp, Artificial sequence
  Reverse Primer
aaaaatctgtgaagtgtatgagtgtac

SEQ ID NO: 14549 - DNA, 24 bp, Artificial sequence
  Reverse Primer
aaattaaagatacttgcattggga

SEQ ID NO: 14550 - DNA, 21 bp, Artificial sequence
  Reverse Primer
ggaaggggaaaatcaattaag

SEQ ID NO: 14551 - DNA, 26 bp, Artificial sequence
  Reverse Primer
ttttgcaactgaattataaccatact

SEQ ID NO: 14552 - DNA, 30 bp, Artificial sequence
  Reverse Primer
tataatatatgcatagcactgattcctatt

SEQ ID NO: 14553 - DNA, 26 bp, Artificial sequence
  Reverse Primer
agtatcacaaaagattattgctagcc

SEQ ID NO: 14554 - DNA, 21 bp, Artificial sequence
  Reverse Primer
atgaatgaatgtctgtctccc

SEQ ID NO: 14555 - DNA, 24 bp, Artificial sequence
  Reverse Primer
agttcaatgtgactgcaaaattaa

SEQ ID NO: 14556 - DNA, 26 bp, Artificial sequence
  Reverse Primer
tatgtcagaaatgtgagacagttttt

SEQ ID NO: 14557 - DNA, 21 bp, Artificial sequence
  Reverse Primer
aaatatgtcaaatggacccac

SEQ ID NO: 14558 - DNA, 21 bp, Artificial sequence
  Reverse Primer
ttcgtgtcttgtcgacatctt

SEQ ID NO: 14559 - DNA, 30 bp, Artificial sequence
  Reverse Primer
ttacatctaagaatatgtaaggagtcattt

SEQ ID NO: 14560 - DNA, 26 bp, Artificial sequence
  Reverse Primer
aaactaaaaccccaacctaataattc

SEQ ID NO: 14561 - DNA, 25 bp, Artificial sequence
  Reverse Primer
aaaagtcactagacagatggatgat

SEQ ID NO: 14562 - DNA, 23 bp, Artificial sequence
  Reverse Primer
atatgctttcaaatcaatcttgg

SEQ ID NO: 14563 - DNA, 27 bp, Artificial sequence
  Reverse Primer
tagaaagtactcccactctatagcact

SEQ ID NO: 14564 - DNA, 22 bp, Artificial sequence
  Reverse Primer
aaatcaactcttggaagaagcg

SEQ ID NO: 14565 - DNA, 30 bp, Artificial sequence
  Reverse Primer
aaaagactcagctaatttatactctaaaag

SEQ ID NO: 14566 - DNA, 27 bp, Artificial sequence
  Reverse Primer
atttattaatatactgagccaccagtc

SEQ ID NO: 14567 - DNA, 25 bp, Artificial sequence
  Reverse Primer
ttagaacactttttcatccctaacg

SEQ ID NO: 14568 - DNA, 30 bp, Artificial sequence
  Reverse Primer
aatatggtgaggaaattaatataagagttg

SEQ ID NO: 14569 - DNA, 21 bp, Artificial sequence
  Reverse Primer
tgattacatccatgcyagagg

SEQ ID NO: 14570 - DNA, 28 bp, Artificial sequence
  Reverse Primer
aacttcttttctgatttcttgwctagat

SEQ ID NO: 14571 - DNA, 27 bp, Artificial sequence
  Reverse Primer
aaaatgataatgatgtgataggaaatc

SEQ ID NO: 14572 - DNA, 24 bp, Artificial sequence
  Reverse Primer
acatcagtaaaaaccaaaaacagc

SEQ ID NO: 14573 - DNA, 28 bp, Artificial sequence
  Reverse Primer
tatatatacttgccaaaaaatatggcta

SEQ ID NO: 14574 - DNA, 26 bp, Artificial sequence
  Reverse Primer
aaaaaaatcttatctaccctgtgaag

SEQ ID NO: 14575 - DNA, 23 bp, Artificial sequence
  Reverse Primer
tgttatcattcagaactgcctct

SEQ ID NO: 14576 - DNA, 24 bp, Artificial sequence
  Reverse Primer
aaatggagaaaatgaaaggtatga

SEQ ID NO: 14577 - DNA, 21 bp, Artificial sequence
  Reverse Primer
ttttctgcagttcacacttcc

SEQ ID NO: 14578 - DNA, 27 bp, Artificial sequence
  Reverse Primer
aattgtttatatggaacaaagtcctta

SEQ ID NO: 14579 - DNA, 21 bp, Artificial sequence
  Reverse Primer
ttgcctagttaatgccaaaac

SEQ ID NO: 14580 - DNA, 23 bp, Artificial sequence
  Reverse Primer
ttatttactccttgtcattccca

SEQ ID NO: 14581 - DNA, 22 bp, Artificial sequence
  Reverse Primer
taggtcattttacttctgggcc

SEQ ID NO: 14582 - DNA, 24 bp, Artificial sequence
  Reverse Primer
aaaataatagacccactcaaggag

SEQ ID NO: 14583 - DNA, 26 bp, Artificial sequence
  Reverse Primer
ttaaaatatcaacaggaacacagaac

SEQ ID NO: 14584 - DNA, 23 bp, Artificial sequence
  Reverse Primer
tctgctgacagtaacaacagcta

SEQ ID NO: 14585 - DNA, 24 bp, Artificial sequence
  Reverse Primer
agaatatcagagagtgatcccact

SEQ ID NO: 14586 - DNA, 22 bp, Artificial sequence
  Reverse Primer
tgaggagcagacattattcaaa

SEQ ID NO: 14587 - DNA, 25 bp, Artificial sequence
  Reverse Primer
tttttatcccactatacgtcttgtt

SEQ ID NO: 14588 - DNA, 18 bp, Artificial sequence
  Reverse Primer
actcagaggcgagcactc

SEQ ID NO: 14589 - DNA, 19 bp, Artificial sequence
  Reverse Primer
attttcagaagcagggagg

SEQ ID NO: 14590 - DNA, 26 bp, Artificial sequence
  Reverse Primer
gagtttcaaattaatgaattatgggt

SEQ ID NO: 14591 - DNA, 23 bp, Artificial sequence
  Reverse Primer
atgatcttgttctggaaatctcc

SEQ ID NO: 14592 - DNA, 18 bp, Artificial sequence
  Reverse Primer
ttggtggctcagtcggtt

SEQ ID NO: 14593 - DNA, 30 bp, Artificial sequence
  Reverse Primer
taaaaactagtaggagtaactctayaatat

SEQ ID NO: 14594 - DNA, 20 bp, Artificial sequence
  Reverse Primer
tcttggaaacatcaagcagg

SEQ ID NO: 14595 - DNA, 30 bp, Artificial sequence; identical to SEQ ID NO: 14247
  Reverse Primer

SEQ ID NO: 14596 - DNA, 20 bp, Artificial sequence
  Reverse Primer
actgtggaggagactgcaag

SEQ ID NO: 14597 - DNA, 30 bp, Artificial sequence
  Reverse Primer
ggatattatagttaaagaaaaggaactctt

SEQ ID NO: 14598 - DNA, 22 bp, Artificial sequence
  Reverse Primer
ttcatccttagagttccctttg

SEQ ID NO: 14599 - DNA, 23 bp, Artificial sequence
  Reverse Primer
ttcaatctctctcctttattgca

SEQ ID NO: 14600 - DNA, 18 bp, Artificial sequence
  Reverse Primer
agcccccacctagtttgc

SEQ ID NO: 14601 - DNA, 28 bp, Artificial sequence
  Reverse Primer
aatgaatcaaagtattaaatctgtttcc

SEQ ID NO: 14602 - DNA, 18 bp, Artificial sequence
  Reverse Primer
atcctttccccacacctg

SEQ ID NO: 14603 - DNA, 27 bp, Artificial sequence
  Reverse Primer
tatgctgcatctgtattttacataaat

SEQ ID NO: 14604 - DNA, 20 bp, Artificial sequence
  Reverse Primer
ttatgggttatggcaaaagg

SEQ ID NO: 14605 - DNA, 24 bp, Artificial sequence
  Forward Primer
attcccaagaaagacaatttaatg

SEQ ID NO: 14606 - DNA, 20 bp, Artificial sequence
  Forward Primer
atggagaaactgaggcagag

SEQ ID NO: 14607 - DNA, 21 bp, Artificial sequence
  Forward Primer
gctttctaggctttaaaaatt

SEQ ID NO: 14608 - DNA, 19 bp, Artificial sequence
  Forward Primer
ccagaaaaggcagtctcta

SEQ ID NO: 14609 - DNA, 26 bp, Artificial sequence
  Forward Primer
catgtaattttcccatttagactttt

SEQ ID NO: 14610 - DNA, 24 bp, Artificial sequence
  Forward Primer
aaaatcaaaggtaattttttccct

SEQ ID NO: 14611 - DNA, 21 bp, Artificial sequence
  Forward Primer
tttgtgcagagatggatcaat

SEQ ID NO: 14612 - DNA, 20 bp, Artificial sequence
  Forward Primer
attcaggactgtcctcaccc

SEQ ID NO: 14613 - DNA, 21 bp, Artificial sequence
  Forward Primer
aaatagaaacctaggtggggc

SEQ ID NO: 14614 - DNA, 19 bp, Artificial sequence
  Forward Primer
ggcttagggtgccatttat

SEQ ID NO: 14615 - DNA, 22 bp, Artificial sequence
  Forward Primer
attgagagaatcacccctacaa

SEQ ID NO: 14616 - DNA, 22 bp, Artificial sequence
  Forward Primer
attcgttaggtgagactaatgg

SEQ ID NO: 14617 - DNA, 19 bp, Artificial sequence
  Forward Primer
aggttctggggtgtgatgt

SEQ ID NO: 14618 - DNA, 20 bp, Artificial sequence
  Forward Primer
ctagtgaatgctcagcttct

SEQ ID NO: 14619 - DNA, 20 bp, Artificial sequence
  Forward Primer
gcaatttgggattacaaagt

SEQ ID NO: 14620 - DNA, 21 bp, Artificial sequence
  Forward Primer
gctcctccagtttctagctat

SEQ ID NO: 14621 - DNA, 20 bp, Artificial sequence
  Forward Primer
agtcataagggctttaggag

SEQ ID NO: 14622 - DNA, 18 bp, Artificial sequence
  Forward Primer
cacagagrcagtgcccag

SEQ ID NO: 14623 - DNA, 20 bp, Artificial sequence
  Forward Primer
aattacagaatcctcgggct

SEQ ID NO: 14624 - DNA, 24 bp, Artificial sequence
  Forward Primer
aaagactgttggagagaaggacta

SEQ ID NO: 14625 - DNA, 26 bp, Artificial sequence
  Forward Primer
ataagtcggacatcttctactctttg

SEQ ID NO: 14626 - DNA, 18 bp, Artificial sequence
  Forward Primer
attgagaaacggcctggc

SEQ ID NO: 14627 - DNA, 18 bp, Artificial sequence
  Forward Primer
acgggaagccttttagcc

SEQ ID NO: 14628 - DNA, 24 bp, Artificial sequence
  Forward Primer
gtattttctctttacatttcacaa

SEQ ID NO: 14629 - DNA, 26 bp, Artificial sequence
  Forward Primer
ataaaactgaaaaattgagaagtcca

SEQ ID NO: 14630 - DNA, 29 bp, Artificial sequence
  Forward Primer
tttacctaattcctgtaaatacttttgac

SEQ ID NO: 14631 - DNA, 22 bp, Artificial sequence
  Forward Primer
ttatttcttccctctggggtat

SEQ ID NO: 14632 - DNA, 23 bp, Artificial sequence
  Forward Primer
atcttctttcctgtccttcttga

SEQ ID NO: 14633 - DNA, 30 bp, Artificial sequence
  Forward Primer
attttcattagctataagtcagaatactgg

SEQ ID NO: 14634 - DNA, 25 bp, Artificial sequence
  Forward Primer
aaaagcaaggtaacttcaatttttc

SEQ ID NO: 14635 - DNA, 23 bp, Artificial sequence
  Forward Primer
ttgcaagggatgaaatctactaa

SEQ ID NO: 14636 - DNA, 21 bp, Artificial sequence
  Forward Primer
tttgtttgttgaatgagggaa

SEQ ID NO: 14637 - DNA, 23 bp, Artificial sequence
  Forward Primer
ataatagcaacagagcagacagc

SEQ ID NO: 14638 - DNA, 19 bp, Artificial sequence
  Forward Primer
tttcaaagtccccaaagga

SEQ ID NO: 14639 - DNA, 24 bp, Artificial sequence
  Forward Primer
aaattaggcataacagctaccttg

SEQ ID NO: 14640 - DNA, 18 bp, Artificial sequence
  Forward Primer
ggttgtggaatcttccgg

SEQ ID NO: 14641 - DNA, 21 bp, Artificial sequence
  Forward Primer
tttaaatgcaaattccatcca

SEQ ID NO: 14642 - DNA, 21 bp, Artificial sequence
  Forward Primer
actctcctttgccatttctca

SEQ ID NO: 14643 - DNA, 22 bp, Artificial sequence
  Forward Primer
aaaacatgatccagacaggtgt

SEQ ID NO: 14644 - DNA, 18 bp, Artificial sequence
  Forward Primer
tgggctctttccagcatc

SEQ ID NO: 14645 - DNA, 20 bp, Artificial sequence
  Forward Primer
gggaggagttttcacataga

SEQ ID NO: 14646 - DNA, 18 bp, Artificial sequence
  Forward Primer
agcagcgacttccccata

SEQ ID NO: 14647 - DNA, 28 bp, Artificial sequence
  Forward Primer
aatttttacaaaagtgtcaattactcac

SEQ ID NO: 14648 - DNA, 27 bp, Artificial sequence
  Forward Primer
agaaaattccctaaaactgactttaaa

SEQ ID NO: 14649 - DNA, 19 bp, Artificial sequence
  Forward Primer
gtggtgttcctttgtggaa

SEQ ID NO: 14650 - DNA, 25 bp, Artificial sequence
  Forward Primer
ttaaaattattccagcctaactgag

SEQ ID NO: 14651 - DNA, 22 bp, Artificial sequence
  Forward Primer
ttcattttaccaagaggaaaca

SEQ ID NO: 14652 - DNA, 26 bp, Artificial sequence
  Forward Primer
aatatacatttgtgcaactcaaaatg

SEQ ID NO: 14653 - DNA, 21 bp, Artificial sequence
  Forward Primer
aggatttgtgtcaaactccag

SEQ ID NO: 14654 - DNA, 22 bp, Artificial sequence
  Forward Primer
ttttcatagctgtccacttgaa

SEQ ID NO: 14655 - DNA, 24 bp, Artificial sequence
  Forward Primer
acttcaaaaactaggaccaacaat

SEQ ID NO: 14656 - DNA, 23 bp, Artificial sequence
  Forward Primer
agtgattcagaaaccactgaagc

SEQ ID NO: 14657 - DNA, 24 bp, Artificial sequence
  Forward Primer
caaaacaggcaatattctaaatta

SEQ ID NO: 14658 - DNA, 29 bp, Artificial sequence
  Forward Primer
acactttcctcttatgcaaatatatctac

SEQ ID NO: 14659 - DNA, 18 bp, Artificial sequence
  Forward Primer
tttgaaagggccaggatc

SEQ ID NO: 14660 - DNA, 20 bp, Artificial sequence
  Forward Primer
aaatgctgccagtatgttgg

SEQ ID NO: 14661 - DNA, 23 bp, Artificial sequence
  Forward Primer
aaaaattctctctcgtctgtcct

SEQ ID NO: 14662 - DNA, 18 bp, Artificial sequence
  Forward Primer
ctacatcgaggggcctga

SEQ ID NO: 14663 - DNA, 27 bp, Artificial sequence
  Forward Primer
cttagaaatcaaatcatgaaattatgg

SEQ ID NO: 14664 - DNA, 26 bp, Artificial sequence
  Forward Primer
cagcattgaagattatgttaaaaaag

SEQ ID NO: 14665 - DNA, 28 bp, Artificial sequence
  Forward Primer
ctgataaaacgataatttttactgtttg

SEQ ID NO: 14666 - DNA, 28 bp, Artificial sequence
  Forward Primer
aaattacagaggtaatatgtgattttgg

SEQ ID NO: 14667 - DNA, 23 bp, Artificial sequence
  Forward Primer
aagtgagttagtctgacaggggt

SEQ ID NO: 14668 - DNA, 18 bp, Artificial sequence
  Forward Primer
tcgtctcctcctctgctc

SEQ ID NO: 14669 - DNA, 22 bp, Artificial sequence
  Forward Primer
acaggatttcctaagtccaacc

SEQ ID NO: 14670 - DNA, 30 bp, Artificial sequence
  Forward Primer
agactaaatgacctattaaattaagtgtat

SEQ ID NO: 14671 - DNA, 25 bp, Artificial sequence
  Forward Primer
aaaacattccaaattacatcttgtc

SEQ ID NO: 14672 - DNA, 22 bp, Artificial sequence
  Forward Primer
tggaaacaatccaacactgata

SEQ ID NO: 14673 - DNA, 28 bp, Artificial sequence
  Forward Primer
tgtctaggagataaaactgataggattt

SEQ ID NO: 14674 - DNA, 24 bp, Artificial sequence
  Forward Primer
aaagcatttttagggagaagtaca

SEQ ID NO: 14675 - DNA, 19 bp, Artificial sequence
  Forward Primer
ccatctttgccacttactc

SEQ ID NO: 14676 - DNA, 21 bp, Artificial sequence
  Forward Primer
aatcatgtctctcgtcctcag

SEQ ID NO: 14677 - DNA, 21 bp, Artificial sequence
  Forward Primer
tctcagtttggttatgttgcc

SEQ ID NO: 14678 - DNA, 25 bp, Artificial sequence
  Forward Primer
attcctgtttggatcatttatgtaa

SEQ ID NO: 14679 - DNA, 26 bp, Artificial sequence
  Forward Primer
attaattaaccctagatgggaatacc

SEQ ID NO: 14680 - DNA, 25 bp, Artificial sequence
  Forward Primer
cagacttggaggaaatgttaaatta

SEQ ID NO: 14681 - DNA, 22 bp, Artificial sequence
  Forward Primer
tcaggaaatgtaggaaaatgag

SEQ ID NO: 14682 - DNA, 24 bp, Artificial sequence
  Forward Primer
tgcaattgttttactagttgactg

SEQ ID NO: 14683 - DNA, 24 bp, Artificial sequence
  Forward Primer
aacctgaatgtcatagtattttga

SEQ ID NO: 14684 - DNA, 24 bp, Artificial sequence
  Forward Primer
ggactggacatctaatttatcaat

SEQ ID NO: 14685 - DNA, 23 bp, Artificial sequence
  Forward Primer
acctgtacaatggtagatgttct

SEQ ID NO: 14686 - DNA, 22 bp, Artificial sequence
  Forward Primer
aataggcatccagcttctaacc

SEQ ID NO: 14687 - DNA, 19 bp, Artificial sequence
  Forward Primer
acgtggatggcaaactaca

SEQ ID NO: 14688 - DNA, 27 bp, Artificial sequence
  Forward Primer
aatacctaagatcagccaggtatatct

SEQ ID NO: 14689 - DNA, 27 bp, Artificial sequence
  Forward Primer
atttagaagtttaactgtttgtctgtg

SEQ ID NO: 14690 - DNA, 28 bp, Artificial sequence
  Forward Primer
gtagaagtcatttgtgtttttcattatc

SEQ ID NO: 14691 - DNA, 28 bp, Artificial sequence
  Forward Primer
ttaaagtgtgatgacattagaacagata

SEQ ID NO: 14692 - DNA, 21 bp, Artificial sequence
  Forward Primer
taatggtgtcggttcatctct

SEQ ID NO: 14693 - DNA, 28 bp, Artificial sequence
  Forward Primer
ataagtaattttgagtgtcttattttgg

SEQ ID NO: 14694 - DNA, 24 bp, Artificial sequence
  Forward Primer
gatgagttagttaaccctgctgtg

SEQ ID NO: 14695 - DNA, 20 bp, Artificial sequence
  Forward Primer
aaagactccagggagaggag

SEQ ID NO: 14696 - DNA, 24 bp, Artificial sequence
  Forward Primer
aggtataggaaaaatgaaaaagag

SEQ ID NO: 14697 - DNA, 24 bp, Artificial sequence
  Forward Primer
tgaagcaagtgaatatactctttt

SEQ ID NO: 14698 - DNA, 22 bp, Artificial sequence
  Forward Primer
attaccaagtgtgcaagtgatg

SEQ ID NO: 14699 - DNA, 21 bp, Artificial sequence
  Forward Primer
tttccctgtaagatgacacct

SEQ ID NO: 14700 - DNA, 23 bp, Artificial sequence
  Forward Primer
tcaccaataactttccattgaga

SEQ ID NO: 14701 - DNA, 23 bp, Artificial sequence
  Forward Primer
gctaactgctctcttttctatgt

SEQ ID NO: 14702 - DNA, 21 bp, Artificial sequence
  Forward Primer
atgcattgcagaagtccttta

SEQ ID NO: 14703 - DNA, 22 bp, Artificial sequence
  Forward Primer
attactcaagggagctctcacg

SEQ ID NO: 14704 - DNA, 19 bp, Artificial sequence
  Forward Primer
tagaaagaggcgtgtgtgc

SEQ ID NO: 14705 - DNA, 21 bp, Artificial sequence
  Forward Primer
tcctggatattttcagtgtga

SEQ ID NO: 14706 - DNA, 20 bp, Artificial sequence
  Forward Primer
actagattgagaggtcctgg

SEQ ID NO: 14707 - DNA, 20 bp, Artificial sequence
  Forward Primer
attgaggtgagcttgcctag

SEQ ID NO: 14708 - DNA, 26 bp, Artificial sequence
  Forward Primer
aatttagtcctgtcaaaagattcttg

SEQ ID NO: 14709 - DNA, 22 bp, Artificial sequence
  Forward Primer
ttagggtttaaggtgctctgaa

SEQ ID NO: 14710 - DNA, 21 bp, Artificial sequence
  Forward Primer
tggtagccaactggtgtaaca

SEQ ID NO: 14711 - DNA, 20 bp, Artificial sequence
  Forward Primer
acacagcaccccagattatc

SEQ ID NO: 14712 - DNA, 18 bp, Artificial sequence
  Forward Primer
acgctggccacccacaca

SEQ ID NO: 14713 - DNA, 23 bp, Artificial sequence
  Forward Primer
aaagtaacagtgatggtggaaag

SEQ ID NO: 14714 - DNA, 20 bp, Artificial sequence
  Forward Primer
accagctgagtcactgatgc

SEQ ID NO: 14715 - DNA, 21 bp, Artificial sequence
  Forward Primer
ttcatcagttgaggcctaagt

SEQ ID NO: 14716 - DNA, 22 bp, Artificial sequence
  Forward Primer
ataaggacctgcaatttttgaa

SEQ ID NO: 14717 - DNA, 24 bp, Artificial sequence
  Forward Primer
ttaayggttttgagtgagctttag

SEQ ID NO: 14718 - DNA, 23 bp, Artificial sequence
  Forward Primer
ttcaaatataaacctttgctttc

SEQ ID NO: 14719 - DNA, 25 bp, Artificial sequence
  Forward Primer
ttgtttttctcctatttgcmtattt

SEQ ID NO: 14720 - DNA, 26 bp, Artificial sequence
  Forward Primer
aataattctaagcctacttaaaactg

SEQ ID NO: 14721 - DNA, 27 bp, Artificial sequence
  Forward Primer
aaaatacagtcatgattctcattatcc

SEQ ID NO: 14722 - DNA, 30 bp, Artificial sequence
  Forward Primer
tgtgatgtttatgtaaactataaatgaagg

SEQ ID NO: 14723 - DNA, 30 bp, Artificial sequence
  Forward Primer
attctaaagtaaatgtataggtacccacta

SEQ ID NO: 14724 - DNA, 27 bp, Artificial sequence
  Forward Primer
acatttacaaagttgcaaatacagtac

SEQ ID NO: 14725 - DNA, 30 bp, Artificial sequence
  Forward Primer
tattttaaatgtctagttataatgaagggg

SEQ ID NO: 14726 - DNA, 25 bp, Artificial sequence
  Forward Primer
aacatgacatcagatagagaaattc

SEQ ID NO: 14727 - DNA, 21 bp, Artificial sequence
  Forward Primer
aatggaataatggcttctaaa

SEQ ID NO: 14728 - DNA, 22 bp, Artificial sequence
  Forward Primer
aaatgattttaagtggttgggc

SEQ ID NO: 14729 - DNA, 24 bp, Artificial sequence
  Forward Primer
ttaccctcctaccacatagaattc

SEQ ID NO: 14730 - DNA, 20 bp, Artificial sequence
  Forward Primer
aaccaattctattccagccc

SEQ ID NO: 14731 - DNA, 30 bp, Artificial sequence
  Forward Primer
gcactattatactcaatgttactactagag

SEQ ID NO: 14732 - DNA, 24 bp, Artificial sequence
  Forward Primer
tggattttataaagatcactcttg

SEQ ID NO: 14733 - DNA, 23 bp, Artificial sequence
  Forward Primer
aaggtcatgaatgagctatttga

SEQ ID NO: 14734 - DNA, 26 bp, Artificial sequence
  Forward Primer
ttttacatggttctttattcctagaa

SEQ ID NO: 14735 - DNA, 24 bp, Artificial sequence
  Forward Primer
ttaaatctaaggtgtcagcacatt

SEQ ID NO: 14736 - DNA, 23 bp, Artificial sequence
  Forward Primer
tttggggtataaaatctagaagt

SEQ ID NO: 14737 - DNA, 22 bp, Artificial sequence
  Forward Primer
aaagtgtacaaattcactgtca

SEQ ID NO: 14738 - DNA, 27 bp, Artificial sequence
  Forward Primer
taatctcatctaaaccatattctcttg

SEQ ID NO: 14739 - DNA, 24 bp, Artificial sequence
  Forward Primer
ttaaaaggatcctacaaattcctg

SEQ ID NO: 14740 - DNA, 28 bp, Artificial sequence
  Forward Primer
tatttgttggattaagtaggtttctaaa

SEQ ID NO: 14741 - DNA, 21 bp, Artificial sequence
  Forward Primer
aartgtgaccttggaattgaa

SEQ ID NO: 14742 - DNA, 28 bp, Artificial sequence
  Forward Primer
ctctttttttcaaactatttctttgtct

SEQ ID NO: 14743 - DNA, 24 bp, Artificial sequence
  Forward Primer
aatagacaagtcaacttcagatgc

SEQ ID NO: 14744 - DNA, 28 bp, Artificial sequence
  Forward Primer
cctcagatttactaaacaaaaatatcaa

SEQ ID NO: 14745 - DNA, 28 bp, Artificial sequence
  Forward Primer
atgatgccagatatatttcatattgtaa

SEQ ID NO: 14746 - DNA, 30 bp, Artificial sequence
  Forward Primer
aaattatagtatgtgtaaagtgtacaatgt

SEQ ID NO: 14747 - DNA, 26 bp, Artificial sequence
  Forward Primer
tttgtgattaagacctcttatttctg

SEQ ID NO: 14748 - DNA, 27 bp, Artificial sequence
  Forward Primer
tttctaaaaaagctgttgatctatttg

SEQ ID NO: 14749 - DNA, 23 bp, Artificial sequence
  Forward Primer
agacatcaggtgtggttgttagt

SEQ ID NO: 14750 - DNA, 22 bp, Artificial sequence
  Forward Primer
atgaacttgaactgattggctt

SEQ ID NO: 14751 - DNA, 24 bp, Artificial sequence
  Forward Primer
atttttggattatctgagtattgc

SEQ ID NO: 14752 - DNA, 21 bp, Artificial sequence
  Forward Primer
tttccctacctcatctaatct

SEQ ID NO: 14753 - DNA, 22 bp, Artificial sequence
  Forward Primer
ataaaaagagaaggaacagggg

SEQ ID NO: 14754 - DNA, 18 bp, Artificial sequence
  Forward Primer
tgacacccccagagcttc

SEQ ID NO: 14755 - DNA, 19 bp, Artificial sequence
  Forward Primer
aatatccgaaggaggggac

SEQ ID NO: 14756 - DNA, 24 bp, Artificial sequence
  Forward Primer
taaatgaaaggtcatggaatctct

SEQ ID NO: 14757 - DNA, 18 bp, Artificial sequence
  Forward Primer
tgtggccaggatggaggc

SEQ ID NO: 14758 - DNA, 26 bp, Artificial sequence
  Forward Primer
acatcttatctcttctttgtccattt

SEQ ID NO: 14759 - DNA, 24 bp, Artificial sequence
  Forward Primer
aggaagaagactctaacttacaag

SEQ ID NO: 14760 - DNA, 24 bp, Artificial sequence
  Forward Primer
ttattttttaggcctttgaagttt

SEQ ID NO: 14761 - DNA, 21 bp, Artificial sequence
  Forward Primer
tcattgaaacatttgacatcg

SEQ ID NO: 14762 - DNA, 20 bp, Artificial sequence
  Forward Primer
tgtctgttgagcttctggaa

SEQ ID NO: 14763 - DNA, 18 bp, Artificial sequence
  Forward Primer
tgccaggaagggaagaat

SEQ ID NO: 14764 - DNA, 20 bp, Artificial sequence
  Forward Primer
tgttgaaagtggagaccagg

SEQ ID NO: 14765 - DNA, 24 bp, Artificial sequence
  Forward Primer
aattgtaaaatgtcctttggaaca

SEQ ID NO: 14766 - DNA, 18 bp, Artificial sequence
  Forward Primer
ggccctcggaaaatccag

SEQ ID NO: 14767 - DNA, 21 bp, Artificial sequence
  Forward Primer
tttgaaatccccctaaatgaa

SEQ ID NO: 14768 - DNA, 22 bp, Artificial sequence
  Forward Primer
aatagctggaaggcatttctac

SEQ ID NO: 14769 - DNA, 25 bp, Artificial sequence
  Forward Primer
atgagaaaacacattgtattgtttg

SEQ ID NO: 14770 - DNA, 28 bp, Artificial sequence
  Forward Primer
atttgttgaagagagtaccactaagttt

SEQ ID NO: 14771 - DNA, 19 bp, Artificial sequence
  Forward Primer
cacagatattggtggctct

SEQ ID NO: 14772 - DNA, 25 bp, Artificial sequence
  Forward Primer
aaaaataaaaagccagattctaagc

SEQ ID NO: 14773 - DNA, 23 bp, Artificial sequence
  Forward Primer
atacatcaaaaatgcatcctcaa

SEQ ID NO: 14774 - DNA, 30 bp, Artificial sequence
  Forward Primer
ctactcagtttataatttgatgatgttact

SEQ ID NO: 14775 - DNA, 23 bp, Artificial sequence
  Forward Primer
gctcattttaaacaaatcttctt

SEQ ID NO: 14776 - DNA, 28 bp, Artificial sequence
  Forward Primer
ttctagaagtaaacaagaatccaatacc

SEQ ID NO: 14777 - DNA, 30 bp, Artificial sequence
  Forward Primer
tttatagattcttctacatagttaaaatgg

SEQ ID NO: 14778 - DNA, 19 bp, Artificial sequence
  Forward Primer
agcatcttgatttgcgact

SEQ ID NO: 14779 - DNA, 20 bp, Artificial sequence
  Forward Primer
taaagcccttaagccacact

SEQ ID NO: 14780 - DNA, 25 bp, Artificial sequence
  Forward Primer
agacaaaaggtcagatcagatatac

SEQ ID NO: 14781 - DNA, 24 bp, Artificial sequence
  Forward Primer
ttctaataccacagacaacccttc

SEQ ID NO: 14782 - DNA, 18 bp, Artificial sequence
  Forward Primer
tgcttggggagcaaagga

SEQ ID NO: 14783 - DNA, 21 bp, Artificial sequence
  Forward Primer
agatgtaaccatgaagtggca

SEQ ID NO: 14784 - DNA, 19 bp, Artificial sequence
  Forward Primer
tttgcaaagcttagacggc

SEQ ID NO: 14785 - DNA, 18 bp, Artificial sequence
  Forward Primer
gggtcttcccaaacgggg

SEQ ID NO: 14786 - DNA, 20 bp, Artificial sequence
  Forward Primer
acctcctccaggaagttttc

SEQ ID NO: 14787 - DNA, 26 bp, Artificial sequence
  Forward Primer
ttccatgtgacttaargtagtttctc

SEQ ID NO: 14788 - DNA, 18 bp, Artificial sequence
  Forward Primer
tctctgctgcctgccaca

SEQ ID NO: 14789 - DNA, 19 bp, Artificial sequence
  Forward Primer
ctgagttttgttcctggtg

SEQ ID NO: 14790 - DNA, 24 bp, Artificial sequence
  Forward Primer
tctaaaagaaattcccagcataaa

SEQ ID NO: 14791 - DNA, 26 bp, Artificial sequence
  Forward Primer
aggaagagtagagagactagaattgc

SEQ ID NO: 14792 - DNA, 27 bp, Artificial sequence
  Forward Primer
atgctgattttattcacttatcctaag

SEQ ID NO: 14793 - DNA, 26 bp, Artificial sequence
  Forward Primer
atttatagtggagagctctaagcagt

SEQ ID NO: 14794 - DNA, 23 bp, Artificial sequence
  Forward Primer
aatgtttcattggttctgatttc

SEQ ID NO: 14795 - DNA, 20 bp, Artificial sequence
  Forward Primer
ccatcagtctacatttccca

SEQ ID NO: 14796 - DNA, 23 bp, Artificial sequence
  Forward Primer
tccttaaatcactggagataatg

SEQ ID NO: 14797 - DNA, 27 bp, Artificial sequence
  Forward Primer
aatggatcttaacaataaaaagttgag

SEQ ID NO: 14798 - DNA, 24 bp, Artificial sequence
  Forward Primer
tcattagttgatttacaaagttgt

SEQ ID NO: 14799 - DNA, 26 bp, Artificial sequence
  Forward Primer
tattttctccccttagagtaagaaca

SEQ ID NO: 14800 - DNA, 21 bp, Artificial sequence
  Forward Primer
tgcctcattttcaaaacacat

SEQ ID NO: 14801 - DNA, 21 bp, Artificial sequence
  Forward Primer
atgctttagtttcccataagt

SEQ ID NO: 14802 - DNA, 30 bp, Artificial sequence
  Forward Primer
tagaggatcataacaaacctattatctaat

SEQ ID NO: 14803 - DNA, 19 bp, Artificial sequence
  Forward Primer
aatttcagcaaggcttccc

SEQ ID NO: 14804 - DNA, 22 bp, Artificial sequence
  Forward Primer
tgagctttcttatttcccagac

SEQ ID NO: 14805 - DNA, 19 bp, Artificial sequence
  Forward Primer
taaattgtggacagggcag

SEQ ID NO: 14806 - DNA, 23 bp, Artificial sequence
  Forward Primer
ctgttgttgtgtttatatttcct

SEQ ID NO: 14807 - DNA, 25 bp, Artificial sequence
  Forward Primer
atccttttgtaattccctttctaga

SEQ ID NO: 14808 - DNA, 29 bp, Artificial sequence
  Forward Primer
tttaaaatactacaggttaccaaagaaga

SEQ ID NO: 14809 - DNA, 28 bp, Artificial sequence
  Forward Primer
aatatgtagcaaaagttgacttaaagag

SEQ ID NO: 14810 - DNA, 26 bp, Artificial sequence
  Forward Primer
aatatccatcccactagttaagatgt

SEQ ID NO: 14811 - DNA, 24 bp, Artificial sequence
  Forward Primer
acttttttactcctttgttttagt

SEQ ID NO: 14812 - DNA, 22 bp, Artificial sequence
  Forward Primer
agctaatgacatctgcactttg

SEQ ID NO: 14813 - DNA, 20 bp, Artificial sequence
  Forward Primer
accagtgcagctgacctaca

SEQ ID NO: 14814 - DNA, 22 bp, Artificial sequence
  Forward Primer
aacatgcaacagcacagagtat

SEQ ID NO: 14815 - DNA, 21 bp, Artificial sequence
  Forward Primer
atgtgaaatccccttatcaca

SEQ ID NO: 14816 - DNA, 21 bp, Artificial sequence
  Forward Primer
cggattacactggatctgaac

SEQ ID NO: 14817 - DNA, 22 bp, Artificial sequence
  Forward Primer
aaaatgattccagccattatga

SEQ ID NO: 14818 - DNA, 29 bp, Artificial sequence
  Forward Primer
taagtgaaagagttctatctagagcctaa

SEQ ID NO: 14819 - DNA, 22 bp, Artificial sequence
  Forward Primer
aattttctgggtgacttgtcag

SEQ ID NO: 14820 - DNA, 25 bp, Artificial sequence
  Forward Primer
taattgaatcttggaaaatatggtg

SEQ ID NO: 14821 - DNA, 18 bp, Artificial sequence
  Forward Primer
tggcattgcaggcggatt

SEQ ID NO: 14822 - DNA, 25 bp, Artificial sequence
  Forward Primer
aaattaatgatgaacattcgaactg

SEQ ID NO: 14823 - DNA, 26 bp, Artificial sequence
  Forward Primer
aataagttctggatagcatcacacta

SEQ ID NO: 14824 - DNA, 26 bp, Artificial sequence
  Forward Primer
tctttcagaacactataaaaacaagg

SEQ ID NO: 14825 - DNA, 23 bp, Artificial sequence
  Forward Primer
attacaattgagttgggaactcc

SEQ ID NO: 14826 - DNA, 24 bp, Artificial sequence
  Forward Primer
aaagaatgatgagattgtgtcaaa

SEQ ID NO: 14827 - DNA, 28 bp, Artificial sequence
  Forward Primer
tgtcatcaaaatggtaatagatattttc

SEQ ID NO: 14828 - DNA, 24 bp, Artificial sequence
  Forward Primer
aaagttcataattagaacaagggc

SEQ ID NO: 14829 - DNA, 22 bp, Artificial sequence
  Forward Primer
agctgagaaataatggaacagc

SEQ ID NO: 14830 - DNA, 20 bp, Artificial sequence
  Forward Primer
cactctttcttcctcttcct

SEQ ID NO: 14831 - DNA, 22 bp, Artificial sequence
  Forward Primer
ttcaagtttctttggctttcat

SEQ ID NO: 14832 - DNA, 28 bp, Artificial sequence
  Forward Primer
tccattttcttagataatatttagaggc

SEQ ID NO: 14833 - DNA, 20 bp, Artificial sequence
  Forward Primer
agatctctgcatcctggtcc

SEQ ID NO: 14834 - DNA, 18 bp, Artificial sequence
  Forward Primer
tagggtggttgtggggct

SEQ ID NO: 14835 - DNA, 25 bp, Artificial sequence
  Forward Primer
ttcagaattcttgacaggaacttaa

SEQ ID NO: 14836 - DNA, 23 bp, Artificial sequence
  Forward Primer
ttttatctaactgaaagaggccg

SEQ ID NO: 14837 - DNA, 20 bp, Artificial sequence
  Forward Primer
acttacgcatgtcgaacaga

SEQ ID NO: 14838 - DNA, 18 bp, Artificial sequence
  Forward Primer
tgctgctagcggatgagg

SEQ ID NO: 14839 - DNA, 21 bp, Artificial sequence
  Forward Primer
accttctagctcgctctcaga

SEQ ID NO: 14840 - DNA, 18 bp, Artificial sequence
  Forward Primer
agccatcatggcacttct

SEQ ID NO: 14841 - DNA, 21 bp, Artificial sequence
  Forward Primer
agctggttttaggtgacaaaa

SEQ ID NO: 14842 - DNA, 18 bp, Artificial sequence
  Forward Primer
cacgaacacggtcatacg

SEQ ID NO: 14843 - DNA, 21 bp, Artificial sequence
  Forward Primer
tatgacttcatggacctgctg

SEQ ID NO: 14844 - DNA, 20 bp, Artificial sequence
  Forward Primer
cactcctttctcttcctctc

SEQ ID NO: 14845 - DNA, 22 bp, Artificial sequence
  Forward Primer
attatgtcccttcagtttctgg

SEQ ID NO: 14846 - DNA, 27 bp, Artificial sequence
  Forward Primer
tatttattcaacacacaattactgagg

SEQ ID NO: 14847 - DNA, 23 bp, Artificial sequence
  Forward Primer
atttgaaattctgaaacagttgg

SEQ ID NO: 14848 - DNA, 20 bp, Artificial sequence
  Forward Primer
agcctttcctctgtcagtga

SEQ ID NO: 14849 - DNA, 19 bp, Artificial sequence
  Forward Primer
ggaaagcttgaggggataa

SEQ ID NO: 14850 - DNA, 19 bp, Artificial sequence
  Forward Primer
cccaaaatcgtgatcaaat

SEQ ID NO: 14851 - DNA, 30 bp, Artificial sequence
  Forward Primer
agtatgcttttctttaatattatcaggagt

SEQ ID NO: 14852 - DNA, 27 bp, Artificial sequence
  Forward Primer
actgaacatattctaataacttagggg

SEQ ID NO: 14853 - DNA, 22 bp, Artificial sequence
  Forward Primer
ttcaggttcttctttctttcct

SEQ ID NO: 14854 - DNA, 24 bp, Artificial sequence
  Forward Primer
aaattatctgaaactacagtgcaa

SEQ ID NO: 14855 - DNA, 24 bp, Artificial sequence
  Forward Primer
aacttcaggagttgaattaatcta

SEQ ID NO: 14856 - DNA, 21 bp, Artificial sequence
  Forward Primer
tcatctttgaaacaatcaaca

SEQ ID NO: 14857 - DNA, 30 bp, Artificial sequence
  Forward Primer
tattatcatcatcatagttaacactattct

SEQ ID NO: 14858 - DNA, 21 bp, Artificial sequence
  Forward Primer
tatcagcatgattttgtcagg

SEQ ID NO: 14859 - DNA, 21 bp, Artificial sequence
  Forward Primer
tcttcatgtctgaggatcttt

SEQ ID NO: 14860 - DNA, 23 bp, Artificial sequence
  Forward Primer
tatggggacatcttagattcagt

SEQ ID NO: 14861 - DNA, 25 bp, Artificial sequence
  Forward Primer
gagtaaaaatggattggagaaaatt

SEQ ID NO: 14862 - DNA, 27 bp, Artificial sequence
  Forward Primer
aaacactatcaatcatattgtcttgaa

SEQ ID NO: 14863 - DNA, 19 bp, Artificial sequence
  Forward Primer
ccacggatcgagagtttag

SEQ ID NO: 14864 - DNA, 30 bp, Artificial sequence
  Forward Primer
ggtgtttatagaatataactaagaaaaaca

SEQ ID NO: 14865 - DNA, 21 bp, Artificial sequence
  Forward Primer
tcatgcttttttagtgtctca

SEQ ID NO: 14866 - DNA, 21 bp, Artificial sequence
  Forward Primer
tagtgaatgaccccatttcag

SEQ ID NO: 14867 - DNA, 27 bp, Artificial sequence
  Forward Primer
ataaagtagatcagctttttcactcat

SEQ ID NO: 14868 - DNA, 20 bp, Artificial sequence
  Forward Primer
atggctccagaattgttttc

SEQ ID NO: 14869 - DNA, 21 bp, Artificial sequence
  Forward Primer
ctgcaagctttgttttcaaac

SEQ ID NO: 14870 - DNA, 20 bp, Artificial sequence
  Forward Primer
ggcttgtgctttatttttac

SEQ ID NO: 14871 - DNA, 26 bp, Artificial sequence
  Forward Primer
aaattttatgaaaaacagatagaggg

SEQ ID NO: 14872 - DNA, 27 bp, Artificial sequence
  Forward Primer
tttgaagtgtactgataatcaaagaga

SEQ ID NO: 14873 - DNA, 21 bp, Artificial sequence
  Forward Primer
tattaggggtcagacctttat

SEQ ID NO: 14874 - DNA, 19 bp, Artificial sequence
  Forward Primer
aggagagaggagaatccag

SEQ ID NO: 14875 - DNA, 18 bp, Artificial sequence
  Forward Primer
tggggacttgtgttgctt

SEQ ID NO: 14876 - DNA, 23 bp, Artificial sequence
  Forward Primer
atattcccatttcctggtatcag

SEQ ID NO: 14877 - DNA, 30 bp, Artificial sequence
  Forward Primer
gtcaattagtttttagtagtgtatacttct

SEQ ID NO: 14878 - DNA, 26 bp, Artificial sequence
  Forward Primer
taaatcactgacttttctttcttcaa

SEQ ID NO: 14879 - DNA, 24 bp, Artificial sequence
  Forward Primer
aagggtaagaaatcagctctgtaa

SEQ ID NO: 14880 - DNA, 23 bp, Artificial sequence
  Forward Primer
atttatcctcacttctgtttctt

SEQ ID NO: 14881 - DNA, 27 bp, Artificial sequence
  Forward Primer
aactgatgctaagcatattttacattt

SEQ ID NO: 14882 - DNA, 23 bp, Artificial sequence
  Forward Primer
tggatacaaacatagaaaatgag

SEQ ID NO: 14883 - DNA, 28 bp, Artificial sequence
  Forward Primer
acaaagagtaagaaacaacttaatgact

SEQ ID NO: 14884 - DNA, 19 bp, Artificial sequence
  Forward Primer
ctgaaagggtaggacagcc

SEQ ID NO: 14885 - DNA, 20 bp, Artificial sequence
  Forward Primer
aactcagagcggaaaatgta

SEQ ID NO: 14886 - DNA, 23 bp, Artificial sequence
  Forward Primer
ttttattgccctttacttttttg

SEQ ID NO: 14887 - DNA, 21 bp, Artificial sequence
  Forward Primer
aaagattagtgcccacgtctg

SEQ ID NO: 14888 - DNA, 20 bp, Artificial sequence
  Forward Primer
ctttcctctggttttccttg

SEQ ID NO: 14889 - DNA, 27 bp, Artificial sequence
  Forward Primer
acctgttaattcacatagtgatttctt

SEQ ID NO: 14890 - DNA, 23 bp, Artificial sequence
  Forward Primer
aggaatgaggttttttgttttgt

SEQ ID NO: 14891 - DNA, 23 bp, Artificial sequence
  Forward Primer
ttataacatatgatgtctgccta

SEQ ID NO: 14892 - DNA, 28 bp, Artificial sequence
  Forward Primer
aaattagtaaaagatcaatgaggaagaa

SEQ ID NO: 14893 - DNA, 18 bp, Artificial sequence
  Forward Primer
tctgagaaccggcatctg

SEQ ID NO: 14894 - DNA, 20 bp, Artificial sequence
  Forward Primer
actcttttttccccactttg

SEQ ID NO: 14895 - DNA, 25 bp, Artificial sequence
  Forward Primer
ttttcctcaaatactccagtttaga

SEQ ID NO: 14896 - DNA, 19 bp, Artificial sequence
  Forward Primer
ctgctgggggtctaagtag

SEQ ID NO: 14897 - DNA, 23 bp, Artificial sequence
  Forward Primer
gaacggaacttattcgtatatag

SEQ ID NO: 14898 - DNA, 23 bp, Artificial sequence
  Forward Primer
tactaatacaaacccattgctgg

SEQ ID NO: 14899 - DNA, 19 bp, Artificial sequence
  Forward Primer
gttccagaggaggcagaaa

SEQ ID NO: 14900 - DNA, 18 bp, Artificial sequence
  Forward Primer
tcataagggcaccagctg

SEQ ID NO: 14901 - DNA, 23 bp, Artificial sequence
  Forward Primer
aatcaggctgagaataagaggaa

SEQ ID NO: 14902 - DNA, 20 bp, Artificial sequence
  Forward Primer
tcacgagcatttgtgacaag

SEQ ID NO: 14903 - DNA, 18 bp, Artificial sequence
  Forward Primer
aaaatcccacattcagcg

SEQ ID NO: 14904 - DNA, 18 bp, Artificial sequence
  Forward Primer
gggcaggattgcagacag

SEQ ID NO: 14905 - DNA, 21 bp, Artificial sequence
  Forward Primer
gggtctgcattagtttttaga

SEQ ID NO: 14906 - DNA, 24 bp, Artificial sequence
  Forward Primer
aactcaacaaaaacaagtagggtc

SEQ ID NO: 14907 - DNA, 19 bp, Artificial sequence
  Forward Primer
taggcatcctctggacagg

SEQ ID NO: 14908 - DNA, 26 bp, Artificial sequence
  Forward Primer
aaaaggctgtaaggataatttaattc

SEQ ID NO: 14909 - DNA, 24 bp, Artificial sequence
  Forward Primer
atgatcagtgagaactcttcaatg

SEQ ID NO: 14910 - DNA, 26 bp, Artificial sequence
  Forward Primer
aagagaacctgttcataagttcattt

SEQ ID NO: 14911 - DNA, 28 bp, Artificial sequence
  Forward Primer
cttaccagtcttcataaaataaaaaatg

SEQ ID NO: 14912 - DNA, 22 bp, Artificial sequence
  Forward Primer
aggacaaaatggaatagaaaat

SEQ ID NO: 14913 - DNA, 30 bp, Artificial sequence
  Forward Primer
cagttaaatttcttcatctttatataggtc

SEQ ID NO: 14914 - DNA, 27 bp, Artificial sequence
  Forward Primer
attaaatcacagaaattaaaccatgtc

SEQ ID NO: 14915 - DNA, 27 bp, Artificial sequence
  Forward Primer
atttctttttaattatatggctctggt

SEQ ID NO: 14916 - DNA, 25 bp, Artificial sequence
  Forward Primer
aagcttattaaagacaaatgaatgg

SEQ ID NO: 14917 - DNA, 27 bp, Artificial sequence
  Forward Primer
attttaataatatggtttcatggtgac

SEQ ID NO: 14918 - DNA, 21 bp, Artificial sequence
  Forward Primer
ttctgagcaaactacttcttg

SEQ ID NO: 14919 - DNA, 23 bp, Artificial sequence
  Forward Primer
ccattgagattacataagtttct

SEQ ID NO: 14920 - DNA, 28 bp, Artificial sequence
  Forward Primer
tcttctaatttacctgtattaaattctg

SEQ ID NO: 14921 - DNA, 21 bp, Artificial sequence
  Forward Primer
ccctagtacccactaatctgc

SEQ ID NO: 14922 - DNA, 28 bp, Artificial sequence
  Forward Primer
ttattagtctatgctatctacctggaag

SEQ ID NO: 14923 - DNA, 19 bp, Artificial sequence
  Forward Primer
gacccagttcaggtgtcac

SEQ ID NO: 14924 - DNA, 30 bp, Artificial sequence
  Forward Primer
gtctaagatgttagaatttcttttttaaga

SEQ ID NO: 14925 - DNA, 25 bp, Artificial sequence
  Forward Primer
atctgtattccaaagatctcacttc

SEQ ID NO: 14926 - DNA, 18 bp, Artificial sequence
  Forward Primer
tggggcgtggctcttcta

SEQ ID NO: 14927 - DNA, 27 bp, Artificial sequence
  Forward Primer
aaaaataatttgcttagaagaaacagg

SEQ ID NO: 14928 - DNA, 23 bp, Artificial sequence
  Forward Primer
aaaacaaccacagaacagaaaga

SEQ ID NO: 14929 - DNA, 28 bp, Artificial sequence
  Forward Primer
atcttacagtcaaactgaataagacaga

SEQ ID NO: 14930 - DNA, 20 bp, Artificial sequence
  Forward Primer
tgaatgcaacacaaagaagg

SEQ ID NO: 14931 - DNA, 27 bp, Artificial sequence
  Forward Primer
taaaaaccagagtgagtacctgtattt

SEQ ID NO: 14932 - DNA, 26 bp, Artificial sequence
  Forward Primer
ttactattccaagtgtaaagcagact

SEQ ID NO: 14933 - DNA, 27 bp, Artificial sequence
  Forward Primer
ggattactttatgtatcaaaaaacatg

SEQ ID NO: 14934 - DNA, 23 bp, Artificial sequence
  Forward Primer
attctaacaaaccgaggatactg

SEQ ID NO: 14935 - DNA, 24 bp, Artificial sequence
  Forward Primer
ttgttatttattcacagacatttg

SEQ ID NO: 14936 - DNA, 19 bp, Artificial sequence
  Forward Primer
atgtccagagcaatttggc

SEQ ID NO: 14937 - DNA, 18 bp, Artificial sequence
  Forward Primer
atgggtgagccacacgtg

SEQ ID NO: 14938 - DNA, 18 bp, Artificial sequence
  Forward Primer
aagccggaaggaggaaag

SEQ ID NO: 14939 - DNA, 23 bp, Artificial sequence
  Forward Primer
aaattctttcttccgatttcatt

SEQ ID NO: 14940 - DNA, 21 bp, Artificial sequence
  Forward Primer
aagcttcagtaggctgtgttg

SEQ ID NO: 14941 - DNA, 19 bp, Artificial sequence
  Forward Primer
tttgcccaattcatcttcc

SEQ ID NO: 14942 - DNA, 22 bp, Artificial sequence
  Forward Primer
aaatagcccagtaaccttttcc

SEQ ID NO: 14943 - DNA, 24 bp, Artificial sequence
  Forward Primer
aaacccagacacagtacactagct

SEQ ID NO: 14944 - DNA, 20 bp, Artificial sequence
  Forward Primer
tcatgcttagctccttggtc

SEQ ID NO: 14945 - DNA, 21 bp, Artificial sequence
  Forward Primer
aatgacgacagctactgcatc

SEQ ID NO: 14946 - DNA, 20 bp, Artificial sequence
  Forward Primer
agcaaactggaacaccaaga

SEQ ID NO: 14947 - DNA, 18 bp, Artificial sequence
  Forward Primer
accacacctgcagatgcc

SEQ ID NO: 14948 - DNA, 22 bp, Artificial sequence
  Forward Primer
tgaagtgggaaactttctaccc

SEQ ID NO: 14949 - DNA, 19 bp, Artificial sequence
  Forward Primer
tggggcaggagtttgatat

SEQ ID NO: 14950 - DNA, 19 bp, Artificial sequence
  Forward Primer
gtgagcagacggacaatga

SEQ ID NO: 14951 - DNA, 27 bp, Artificial sequence
  Forward Primer
aatgatcgttttgttactaaaatcttc

SEQ ID NO: 14952 - DNA, 24 bp, Artificial sequence
  Forward Primer
attttaaagaagcagtgaaaaacc

SEQ ID NO: 14953 - DNA, 25 bp, Artificial sequence
  Forward Primer
aaatatagtgctcatctgtgtctcc

SEQ ID NO: 14954 - DNA, 25 bp, Artificial sequence
  Forward Primer
gacagtcctatttatactttgagaa

SEQ ID NO: 14955 - DNA, 28 bp, Artificial sequence
  Forward Primer
ctcaaattcctaaaataaacactaaaca

SEQ ID NO: 14956 - DNA, 24 bp, Artificial sequence
  Forward Primer
tggtttctcakttgcttttaatta

SEQ ID NO: 14957 - DNA, 24 bp, Artificial sequence
  Forward Primer
atatttcatccccatgtcaactat

SEQ ID NO: 14958 - DNA, 19 bp, Artificial sequence
  Forward Primer
ttgtggaactcccattgag

SEQ ID NO: 14959 - DNA, 24 bp, Artificial sequence
  Forward Primer
taaaagatgagaaaaaggaatcca

SEQ ID NO: 14960 - DNA, 26 bp, Artificial sequence
  Forward Primer
tacaatacttttcgttgtttcctagt

SEQ ID NO: 14961 - DNA, 21 bp, Artificial sequence
  Forward Primer
aagtggtgtatgtacctgggg

SEQ ID NO: 14962 - DNA, 20 bp, Artificial sequence
  Forward Primer
crtgagacctcaggcaagta

SEQ ID NO: 14963 - DNA, 23 bp, Artificial sequence
  Forward Primer
gccaaattgctaaaatatgattg

SEQ ID NO: 14964 - DNA, 26 bp, Artificial sequence
  Forward Primer
attaatactgtttctgtctccttcaa

SEQ ID NO: 14965 - DNA, 27 bp, Artificial sequence
  Forward Primer
ccttamtagcaaaacatagtcttagga

SEQ ID NO: 14966 - DNA, 26 bp, Artificial sequence
  Forward Primer
ataaggaaatggaaagttattgctta

SEQ ID NO: 14967 - DNA, 20 bp, Artificial sequence
  Forward Primer
tagtttttcaattgcctcat

SEQ ID NO: 14968 - DNA, 28 bp, Artificial sequence
  Forward Primer
ccataacagtacatttttatctagcatt

SEQ ID NO: 14969 - DNA, 24 bp, Artificial sequence
  Forward Primer
aaccctgtacagtgtgttactgag

SEQ ID NO: 14970 - DNA, 22 bp, Artificial sequence
  Forward Primer
taatcctgacgatacatgaaaa

SEQ ID NO: 14971 - DNA, 26 bp, Artificial sequence
  Forward Primer
aggaaacacctcttatgtttctaatc

SEQ ID NO: 14972 - DNA, 20 bp, Artificial sequence
  Forward Primer
agtctttattgagcgcttgg

SEQ ID NO: 14973 - DNA, 21 bp, Artificial sequence
  Forward Primer
gcatttatcaacaaagagaga

SEQ ID NO: 14974 - DNA, 25 bp, Artificial sequence
  Forward Primer
aataatgtcacatgacttgtgtttt

SEQ ID NO: 14975 - DNA, 22 bp, Artificial sequence
  Forward Primer
ataagctttcattcccatgagg

SEQ ID NO: 14976 - DNA, 25 bp, Artificial sequence
  Forward Primer
acttcacaacagccttgtaaattaa

SEQ ID NO: 14977 - DNA, 21 bp, Artificial sequence
  Forward Primer
accctctccaaaacctagttc

SEQ ID NO: 14978 - DNA, 27 bp, Artificial sequence
  Forward Primer
tataagagaaggggagaaaagatactg

SEQ ID NO: 14979 - DNA, 28 bp, Artificial sequence
  Forward Primer
actttcaagtgttctttgttcttatttt

SEQ ID NO: 14980 - DNA, 24 bp, Artificial sequence
  Forward Primer
aatagcaggaaatgtacaaaaagg

SEQ ID NO: 14981 - DNA, 20 bp, Artificial sequence
  Forward Primer
aaagaattctctggcacagc

SEQ ID NO: 14982 - DNA, 22 bp, Artificial sequence
  Forward Primer
aaaaattcccccaaatattctg

SEQ ID NO: 14983 - DNA, 23 bp, Artificial sequence
  Forward Primer
aagctgtcattgtagagaacaac

SEQ ID NO: 14984 - DNA, 23 bp, Artificial sequence
  Forward Primer
aggaaataagagattgtgaacac

SEQ ID NO: 14985 - DNA, 22 bp, Artificial sequence
  Forward Primer
atctgccaaattactagcataa

SEQ ID NO: 14986 - DNA, 29 bp, Artificial sequence
  Forward Primer
aaagattctctcatctgaatagcttataa

SEQ ID NO: 14987 - DNA, 24 bp, Artificial sequence
  Forward Primer
aatcagttgcatcaagaaagaatt

SEQ ID NO: 14988 - DNA, 18 bp, Artificial sequence
  Forward Primer
tcgcggccactcctaaaa

SEQ ID NO: 14989 - DNA, 22 bp, Artificial sequence
  Forward Primer
aaatgagttccgttcatctgac

SEQ ID NO: 14990 - DNA, 26 bp, Artificial sequence
  Forward Primer
agcatttaaaaacagctttacaactt

SEQ ID NO: 14991 - DNA, 24 bp, Artificial sequence
  Forward Primer
tttttgaaagttcccttagtgact

SEQ ID NO: 14992 - DNA, 25 bp, Artificial sequence
  Forward Primer
tattctctcttatttccctgtctga

SEQ ID NO: 14993 - DNA, 22 bp, Artificial sequence
  Forward Primer
atatgcttaattcctcaacaac

SEQ ID NO: 14994 - DNA, 20 bp, Artificial sequence
  Forward Primer
cctccgtagtctgaaaagta

SEQ ID NO: 14995 - DNA, 19 bp, Artificial sequence
  Forward Primer
attttggcaacacacactt

SEQ ID NO: 14996 - DNA, 20 bp, Artificial sequence
  Forward Primer
tgatgaaaacctgagtgatg

SEQ ID NO: 14997 - DNA, 18 bp, Artificial sequence
  Forward Primer
atatcgactcacccccgg

SEQ ID NO: 14998 - DNA, 25 bp, Artificial sequence
  Forward Primer
taagctctttccacaaacaagtatt

SEQ ID NO: 14999 - DNA, 18 bp, Artificial sequence
  Forward Primer
tgcaggggaattcttggc

SEQ ID NO: 15000 - DNA, 18 bp, Artificial sequence
  Forward Primer
cgccagtctcgcttaaga

SEQ ID NO: 15001 - DNA, 27 bp, Artificial sequence
  Forward Primer
aaaaataacttaaaggacttccctagt

SEQ ID NO: 15002 - DNA, 19 bp, Artificial sequence
  Forward Primer
acctccacccttccaactt

SEQ ID NO: 15003 - DNA, 19 bp, Artificial sequence
  Forward Primer
agagagaagacagaagggg

SEQ ID NO: 15004 - DNA, 20 bp, Artificial sequence
  Forward Primer
tcagtacctacggtgtgcct

SEQ ID NO: 15005 - DNA, 25 bp, Artificial sequence
  Forward Primer
caatctgcatcattacattactacc

SEQ ID NO: 15006 - DNA, 18 bp, Artificial sequence
  Forward Primer
tttatccccaacccgaga

SEQ ID NO: 15007 - DNA, 22 bp, Artificial sequence
  Forward Primer
tcatttcttagttttgccaagt

SEQ ID NO: 15008 - DNA, 26 bp, Artificial sequence
  Forward Primer
tttacaaaaattgtctactcatggtt

SEQ ID NO: 15009 - DNA, 24 bp, Artificial sequence
  Forward Primer
aattttattacacggtttttctgc

SEQ ID NO: 15010 - DNA, 18 bp, Artificial sequence
  Forward Primer
cttgtgtgtcgaatcgca

SEQ ID NO: 15011 - DNA, 21 bp, Artificial sequence
  Forward Primer
tccaagtttctgactcctaaa

SEQ ID NO: 15012 - DNA, 27 bp, Artificial sequence
  Forward Primer
aataattacaataaatctggacaatgg

SEQ ID NO: 15013 - DNA, 26 bp, Artificial sequence
  Forward Primer
tttaaaagggtgaagtataccctaca

SEQ ID NO: 15014 - DNA, 30 bp, Artificial sequence
  Forward Primer
tattagcaaagagttatattacttgactac

SEQ ID NO: 15015 - DNA, 27 bp, Artificial sequence
  Forward Primer
aagagtatctggctcatattaagacag

SEQ ID NO: 15016 - DNA, 20 bp, Artificial sequence
  Forward Primer
aacacacaatttggccttcc

SEQ ID NO: 15017 - DNA, 24 bp, Artificial sequence
  Forward Primer
caaatttagtatcttcaaaccata

SEQ ID NO: 15018 - DNA, 23 bp, Artificial sequence
  Forward Primer
ttgataaaatccaagagcttaat

SEQ ID NO: 15019 - DNA, 25 bp, Artificial sequence
  Forward Primer
aatagtcaataaatgagctgagaaa

SEQ ID NO: 15020 - DNA, 23 bp, Artificial sequence
  Forward Primer
ttcaggtttccacaaaataacat

SEQ ID NO: 15021 - DNA, 20 bp, Artificial sequence
  Forward Primer
tactcacttcctccaccaga

SEQ ID NO: 15022 - DNA, 23 bp, Artificial sequence
  Forward Primer
taagaagacagacaaggagacta

SEQ ID NO: 15023 - DNA, 27 bp, Artificial sequence
  Forward Primer
ttatggtgtcattatcttaaagagtgc

SEQ ID NO: 15024 - DNA, 30 bp, Artificial sequence
  Forward Primer
ttaaattataataagctatgtaagaactct

SEQ ID NO: 15025 - DNA, 24 bp, Artificial sequence
  Forward Primer
tttacacagaatgagcctcttatc

SEQ ID NO: 15026 - DNA, 22 bp, Artificial sequence
  Forward Primer
tgcagttaaaatcaaaaatctg

SEQ ID NO: 15027 - DNA, 21 bp, Artificial sequence
  Forward Primer
gtgaattttagaaattccgtt

SEQ ID NO: 15028 - DNA, 25 bp, Artificial sequence
  Forward Primer
ttttggtaacattaacttctcaatg

SEQ ID NO: 15029 - DNA, 24 bp, Artificial sequence
  Forward Primer
agcctaatacttctagaattgctc

SEQ ID NO: 15030 - DNA, 18 bp, Artificial sequence
  Forward Primer
agtggtcggcttccaaag

SEQ ID NO: 15031 - DNA, 24 bp, Artificial sequence
  Forward Primer
caaaacatttactttacatttcct

SEQ ID NO: 15032 - DNA, 22 bp, Artificial sequence
  Forward Primer
aaaagtggtacagatgaaccca

SEQ ID NO: 15033 - DNA, 23 bp, Artificial sequence
  Forward Primer
atagttggagaatcctgtttcct

SEQ ID NO: 15034 - DNA, 30 bp, Artificial sequence
  Forward Primer
attcttaatattgtgttataagactctggg

SEQ ID NO: 15035 - DNA, 19 bp, Artificial sequence
  Forward Primer
agattgatggcctcatgct

SEQ ID NO: 15036 - DNA, 23 bp, Artificial sequence
  Forward Primer
agtcccctgagtaatatagcagc

SEQ ID NO: 15037 - DNA, 19 bp, Artificial sequence
  Forward Primer
aatttttcccatcactgct

SEQ ID NO: 15038 - DNA, 25 bp, Artificial sequence
  Forward Primer
aacctagactagcttagcagaagtt

SEQ ID NO: 15039 - DNA, 18 bp, Artificial sequence
  Forward Primer
attggccgtctgacagaa

SEQ ID NO: 15040 - DNA, 25 bp, Artificial sequence
  Forward Primer
ttctaagattgctccaatgtatagg

SEQ ID NO: 15041 - DNA, 22 bp, Artificial sequence
  Forward Primer
acttacacccaacctgctatct

SEQ ID NO: 15042 - DNA, 18 bp, Artificial sequence
  Forward Primer
tgtcccagacacacgaac

SEQ ID NO: 15043 - DNA, 22 bp, Artificial sequence
  Forward Primer
aatgactgttaagcttttcgga

SEQ ID NO: 15044 - DNA, 23 bp, Artificial sequence
  Forward Primer
ttaattccctgaaaaatcagctt

SEQ ID NO: 15045 - DNA, 18 bp, Artificial sequence
  Forward Primer
acaggcagtcagacggtg

SEQ ID NO: 15046 - DNA, 18 bp, Artificial sequence
  Forward Primer
tgcgtcactttgcagagc

SEQ ID NO: 15047 - DNA, 21 bp, Artificial sequence
  Forward Primer
aagaaagtctgaccattgctg

SEQ ID NO: 15048 - DNA, 20 bp, Artificial sequence
  Forward Primer
gcagagtcgaaattgtaagt

SEQ ID NO: 15049 - DNA, 30 bp, Artificial sequence
  Forward Primer
aggtaaaaacaatttatatgtctatgtgtg

SEQ ID NO: 15050 - DNA, 26 bp, Artificial sequence
  Forward Primer
cacatcttcaaacgatatctaaaaaa

SEQ ID NO: 15051 - DNA, 23 bp, Artificial sequence
  Forward Primer
ttgtggtgtaactccttatgtat

SEQ ID NO: 15052 - DNA, 27 bp, Artificial sequence
  Forward Primer
ggtaaaatatcattctgaagatcaaaa

SEQ ID NO: 15053 - DNA, 29 bp, Artificial sequence
  Forward Primer
aacaagtgatctattttaacatgtacaga

SEQ ID NO: 15054 - DNA, 24 bp, Artificial sequence
  Forward Primer
taaacaaaagagaaagaggcaaga

SEQ ID NO: 15055 - DNA, 26 bp, Artificial sequence
  Forward Primer
atacatgtaccctgataagaaaggac

SEQ ID NO: 15056 - DNA, 30 bp, Artificial sequence
  Forward Primer
tttttataaagtgagacactcataaatagg

SEQ ID NO: 15057 - DNA, 23 bp, Artificial sequence
  Forward Primer
ttttgtgtttgggaaaaaataag

SEQ ID NO: 15058 - DNA, 21 bp, Artificial sequence
  Forward Primer
agtcattcctgcatttaaaac

SEQ ID NO: 15059 - DNA, 23 bp, Artificial sequence
  Forward Primer
cacctgagagaaatcaaatttca

SEQ ID NO: 15060 - DNA, 28 bp, Artificial sequence
  Forward Primer
ttttggtagatattctgattaaagacag

SEQ ID NO: 15061 - DNA, 24 bp, Artificial sequence
  Forward Primer
tttctcatccaataaaactcaaag

SEQ ID NO: 15062 - DNA, 22 bp, Artificial sequence
  Forward Primer
caaatcaagaaacagctaatga

SEQ ID NO: 15063 - DNA, 23 bp, Artificial sequence
  Forward Primer
tgcttagaattatgatgcttttc

SEQ ID NO: 15064 - DNA, 21 bp, Artificial sequence
  Forward Primer
tattgaaatgagagaatggcg

SEQ ID NO: 15065 - DNA, 22 bp, Artificial sequence
  Forward Primer
tatgatgcctctttccctatgt

SEQ ID NO: 15066 - DNA, 28 bp, Artificial sequence
  Forward Primer
gaccataatatacatttttctgaaatca

SEQ ID NO: 15067 - DNA, 22 bp, Artificial sequence
  Forward Primer
agcatactgttcacattatctg

SEQ ID NO: 15068 - DNA, 18 bp, Artificial sequence
  Forward Primer
tttacaagcagcccttgc

SEQ ID NO: 15069 - DNA, 24 bp, Artificial sequence
  Forward Primer
tgaagctcataaaaatgtttacat

SEQ ID NO: 15070 - DNA, 30 bp, Artificial sequence
  Forward Primer
ataagaaacaaaagagtaaatataccaagc

SEQ ID NO: 15071 - DNA, 26 bp, Artificial sequence
  Forward Primer
accttatctattacaaggttctcctg

SEQ ID NO: 15072 - DNA, 27 bp, Artificial sequence
  Forward Primer
gcagtatttttttcctctctaaacttt

SEQ ID NO: 15073 - DNA, 19 bp, Artificial sequence
  Forward Primer
aaagcaatctatggcattg

SEQ ID NO: 15074 - DNA, 19 bp, Artificial sequence
  Forward Primer
tgaaaccaaaggtccagct

SEQ ID NO: 15075 - DNA, 25 bp, Artificial sequence
  Forward Primer
tttataaattcagtttacacaccag

SEQ ID NO: 15076 - DNA, 24 bp, Artificial sequence
  Forward Primer
aatcaaggatttcaacaaaatcat

SEQ ID NO: 15077 - DNA, 23 bp, Artificial sequence
  Forward Primer
caaaaatggcaaaaataatttcc

SEQ ID NO: 15078 - DNA, 22 bp, Artificial sequence
  Forward Primer
ttcacagatgagacggaataca

SEQ ID NO: 15079 - DNA, 18 bp, Artificial sequence
  Forward Primer
agagggagaggccccttc

SEQ ID NO: 15080 - DNA, 26 bp, Artificial sequence
  Forward Primer
ttattttggaattgctatattgagag

SEQ ID NO: 15081 - DNA, 27 bp, Artificial sequence
  Forward Primer
aattagaattcaagctattcaatgaag

SEQ ID NO: 15082 - DNA, 27 bp, Artificial sequence
  Forward Primer
tttctgtgaaagcaaaaatatagattc

SEQ ID NO: 15083 - DNA, 27 bp, Artificial sequence
  Forward Primer
ctatgcagtgacacatgataattattt

SEQ ID NO: 15084 - DNA, 19 bp, Artificial sequence
  Forward Primer
ctctcctgtgttccacatg

SEQ ID NO: 15085 - DNA, 20 bp, Artificial sequence
  Forward Primer
accgattattgtttcaacgc

SEQ ID NO: 15086 - DNA, 22 bp, Artificial sequence
  Forward Primer
atgtgactgcacattttgagag

SEQ ID NO: 15087 - DNA, 21 bp, Artificial sequence
  Forward Primer
aagcttttcttgcaaacaacc

SEQ ID NO: 15088 - DNA, 18 bp, Artificial sequence
  Forward Primer
ggtggtgggatgaactgg

SEQ ID NO: 15089 - DNA, 18 bp, Artificial sequence
  Forward Primer
tccaaccacattggctct

SEQ ID NO: 15090 - DNA, 27 bp, Artificial sequence
  Forward Primer
ctccataaatttcaattgataagaaag

SEQ ID NO: 15091 - DNA, 28 bp, Artificial sequence
  Forward Primer
tcttgaaaattatgtttgagataaatcc

SEQ ID NO: 15092 - DNA, 23 bp, Artificial sequence
  Forward Primer
ttatgccagaacgtaagagtatg

SEQ ID NO: 15093 - DNA, 24 bp, Artificial sequence
  Forward Primer
attaaatagggcataaggtggttt

SEQ ID NO: 15094 - DNA, 26 bp, Artificial sequence
  Forward Primer
ataataatggtctttggttctctgac

SEQ ID NO: 15095 - DNA, 26 bp, Artificial sequence
  Forward Primer
tactgatcatgtatgtgaattttatc

SEQ ID NO: 15096 - DNA, 25 bp, Artificial sequence
  Forward Primer
tttagtaaatgacattttcccaatg

SEQ ID NO: 15097 - DNA, 30 bp, Artificial sequence
  Forward Primer
aagaagtaatactcttgtaattaacatagg

SEQ ID NO: 15098 - DNA, 29 bp, Artificial sequence
  Forward Primer
tacctgttttatatgagctaagaatgatt

SEQ ID NO: 15099 - DNA, 25 bp, Artificial sequence
  Forward Primer
aaaaattaaatggttatgtcaggtg

SEQ ID NO: 15100 - DNA, 21 bp, Artificial sequence
  Forward Primer
tacaagtgacccaatcatcat

SEQ ID NO: 15101 - DNA, 27 bp, Artificial sequence
  Forward Primer
agaaataccttgagtatttgaagtcat

SEQ ID NO: 15102 - DNA, 20 bp, Artificial sequence
  Forward Primer
gatggatcagaactagcctt

SEQ ID NO: 15103 - DNA, 27 bp, Artificial sequence
  Forward Primer
aagcttgttagtgatttctaaagagta

SEQ ID NO: 15104 - DNA, 18 bp, Artificial sequence
  Forward Primer
attcccacggcactgacg

SEQ ID NO: 15105 - DNA, 19 bp, Artificial sequence
  Forward Primer
aaacactgtgtcagccctg

SEQ ID NO: 15106 - DNA, 19 bp, Artificial sequence
  Forward Primer
gcagtccccgtgtaagaaa

SEQ ID NO: 15107 - DNA, 20 bp, Artificial sequence
  Forward Primer
ttggacatgttctcagagcc

SEQ ID NO: 15108 - DNA, 22 bp, Artificial sequence
  Forward Primer
tggaggagacagagaagactct

SEQ ID NO: 15109 - DNA, 20 bp, Artificial sequence
  Forward Primer
aagatccgaaactgaaaaca

SEQ ID NO: 15110 - DNA, 22 bp, Artificial sequence
  Forward Primer
ttaaggaatttacccaaggtca

SEQ ID NO: 15111 - DNA, 24 bp, Artificial sequence
  Forward Primer
tatcttacccatcttggactctgt

SEQ ID NO: 15112 - DNA, 28 bp, Artificial sequence
  Forward Primer
aagatgatgaagataaaagagaaaaaga

SEQ ID NO: 15113 - DNA, 22 bp, Artificial sequence
  Forward Primer
attcccactagtgtccatgaga

SEQ ID NO: 15114 - DNA, 19 bp, Artificial sequence
  Forward Primer
aataatttttgcgtgtcgg

SEQ ID NO: 15115 - DNA, 23 bp, Artificial sequence
  Forward Primer
agagatcgaatcctcatcttctg

SEQ ID NO: 15116 - DNA, 29 bp, Artificial sequence
  Forward Primer
taaaaggtgtagctcttacactagtaaca

SEQ ID NO: 15117 - DNA, 18 bp, Artificial sequence
  Forward Primer
gcttggctggagttggtg

SEQ ID NO: 15118 - DNA, 23 bp, Artificial sequence
  Forward Primer
aaggctgtgactaaatacctacg

SEQ ID NO: 15119 - DNA, 18 bp, Artificial sequence
  Forward Primer
acggcatatgttccaacc

SEQ ID NO: 15120 - DNA, 20 bp, Artificial sequence
  Forward Primer
accaaggaccattctagcag

SEQ ID NO: 15121 - DNA, 20 bp, Artificial sequence
  Forward Primer
agttctctttcagcgttcct

SEQ ID NO: 15122 - DNA, 24 bp, Artificial sequence
  Forward Primer
atatttaaatccattcccttgaca

SEQ ID NO: 15123 - DNA, 26 bp, Artificial sequence
  Forward Primer
ataaaaatgcttaacaggcaaatatc

SEQ ID NO: 15124 - DNA, 24 bp, Artificial sequence
  Forward Primer
tcaagataatatatatgcagcaaa

SEQ ID NO: 15125 - DNA, 28 bp, Artificial sequence
  Forward Primer
aatagaaatgatagtttgttctttatgc

SEQ ID NO: 15126 - DNA, 22 bp, Artificial sequence
  Forward Primer
cactcaagtaaggcaagaacct

SEQ ID NO: 15127 - DNA, 30 bp, Artificial sequence
  Forward Primer
aattctaacataaaaggttgtatactgtgt

SEQ ID NO: 15128 - DNA, 27 bp, Artificial sequence
  Forward Primer
taaaaatgttcaaatttctctaagctg

SEQ ID NO: 15129 - DNA, 24 bp, Artificial sequence
  Forward Primer
aaatagcagtagaacttggagata

SEQ ID NO: 15130 - DNA, 24 bp, Artificial sequence
  Forward Primer
tttaaagattcactcaacaattag

SEQ ID NO: 15131 - DNA, 28 bp, Artificial sequence
  Forward Primer
aaacggtacttcttagattgataaattt

SEQ ID NO: 15132 - DNA, 22 bp, Artificial sequence
  Forward Primer
aaagtgagcataacaaagcctg

SEQ ID NO: 15133 - DNA, 26 bp, Artificial sequence
  Forward Primer
actgagtcacttttctgtatacctga

SEQ ID NO: 15134 - DNA, 28 bp, Artificial sequence
  Forward Primer
ttaatataatcctacgataaagggtttt

SEQ ID NO: 15135 - DNA, 24 bp, Artificial sequence
  Forward Primer
tccagcttgtgtttattcactagt

SEQ ID NO: 15136 - DNA, 30 bp, Artificial sequence
  Forward Primer
tctttctaacaacacttaaatctaaaactg

SEQ ID NO: 15137 - DNA, 27 bp, Artificial sequence
  Forward Primer
taataaatcagattggggtgttatatc

SEQ ID NO: 15138 - DNA, 27 bp, Artificial sequence
  Forward Primer
accaccatatatttggatttaataatc

SEQ ID NO: 15139 - DNA, 28 bp, Artificial sequence
  Forward Primer
atcaaatctgcatatcaagatattaaac

SEQ ID NO: 15140 - DNA, 25 bp, Artificial sequence
  Forward Primer
ttaactataacacagaccaatgggt

SEQ ID NO: 15141 - DNA, 22 bp, Artificial sequence
  Forward Primer
gctagtatttgtttctctggac

SEQ ID NO: 15142 - DNA, 25 bp, Artificial sequence
  Forward Primer
tattgattgtagagcttcttttgct

SEQ ID NO: 15143 - DNA, 24 bp, Artificial sequence
  Forward Primer
tgtgtacaggtgatttataaaggc

SEQ ID NO: 15144 - DNA, 28 bp, Artificial sequence
  Forward Primer
aatagtatgaataaaaagagcacaattc

SEQ ID NO: 15145 - DNA, 21 bp, Artificial sequence
  Forward Primer
atgttggtaagaaaggaatca

SEQ ID NO: 15146 - DNA, 28 bp, Artificial sequence
  Forward Primer
taaaagtcaatatggaacaatgataaag

SEQ ID NO: 15147 - DNA, 25 bp, Artificial sequence
  Forward Primer
aacagataatgagcttcatctaccc

SEQ ID NO: 15148 - DNA, 27 bp, Artificial sequence
  Forward Primer
atgcatgaacaagagtagatcttaact

SEQ ID NO: 15149 - DNA, 29 bp, Artificial sequence
  Forward Primer
aaataatctttcctaatatcagaagatcc

SEQ ID NO: 15150 - DNA, 26 bp, Artificial sequence
  Forward Primer
ctactctagcaataatttccaaagct

SEQ ID NO: 15151 - DNA, 24 bp, Artificial sequence
  Forward Primer
atcatgtaaaccaaatcactagta

SEQ ID NO: 15152 - DNA, 28 bp, Artificial sequence
  Forward Primer
tatatcaaggttgtataccaaagaaaga

SEQ ID NO: 15153 - DNA, 18 bp, Artificial sequence
  Forward Primer
tgcctccaaccacaattc

SEQ ID NO: 15154 - DNA, 22 bp, Artificial sequence
  Forward Primer
aataaaatcatccaccttcacc

SEQ ID NO: 15155 - DNA, 28 bp, Artificial sequence
  Forward Primer
catattaacagttatatttgggttgaga

SEQ ID NO: 15156 - DNA, 28 bp, Artificial sequence
  Forward Primer
aaaattaacttcagaatttattaggctg

SEQ ID NO: 15157 - DNA, 22 bp, Artificial sequence
  Forward Primer
agaaactgaatttgtggaattc

SEQ ID NO: 15158 - DNA, 20 bp, Artificial sequence
  Forward Primer
tggcaactgtctcaaaaaca

SEQ ID NO: 15159 - DNA, 22 bp, Artificial sequence
  Forward Primer
tttatttttggcaactccaaac

SEQ ID NO: 15160 - DNA, 20 bp, Artificial sequence
  Forward Primer
gaaagtctcttatccccctt

SEQ ID NO: 15161 - DNA, 19 bp, Artificial sequence
  Forward Primer
cttgatttcgatggcatgg

SEQ ID NO: 15162 - DNA, 25 bp, Artificial sequence
  Forward Primer
aaaacctaacatattcactacctgg

SEQ ID NO: 15163 - DNA, 23 bp, Artificial sequence
  Forward Primer
atgcaagtatcacatctaagaat

SEQ ID NO: 15164 - DNA, 24 bp, Artificial sequence
  Forward Primer
tagtaatgccagagccacaatata

SEQ ID NO: 15165 - DNA, 18 bp, Artificial sequence
  Forward Primer
atatgcccgtgactccgc

SEQ ID NO: 15166 - DNA, 18 bp, Artificial sequence
  Forward Primer
aagctcagaagtggctcg

SEQ ID NO: 15167 - DNA, 19 bp, Artificial sequence
  Forward Primer
atagaggggacaggaggga

SEQ ID NO: 15168 - DNA, 22 bp, Artificial sequence
  Forward Primer
ttggagatttcccagagatact

SEQ ID NO: 15169 - DNA, 18 bp, Artificial sequence
  Forward Primer
cgggtgacaaggaagcat

SEQ ID NO: 15170 - DNA, 19 bp, Artificial sequence
  Forward Primer
atattcccatcaacggctg

SEQ ID NO: 15171 - DNA, 20 bp, Artificial sequence
  Forward Primer
tatctggccaaatgctgtct

SEQ ID NO: 15172 - DNA, 23 bp, Artificial sequence
  Forward Primer
aatgtgcaaggtcatgtgttatc

SEQ ID NO: 15173 - DNA, 22 bp, Artificial sequence
  Forward Primer
attcttttgccttgttctaacc

SEQ ID NO: 15174 - DNA, 23 bp, Artificial sequence
  Forward Primer
ttttaaaaatgtgatccttggag

SEQ ID NO: 15175 - DNA, 20 bp, Artificial sequence
  Forward Primer
agcagctgaagcacagaaag

SEQ ID NO: 15176 - DNA, 21 bp, Artificial sequence
  Forward Primer
tcccttaccattattctgttc

SEQ ID NO: 15177 - DNA, 18 bp, Artificial sequence
  Forward Primer
aacagctgtcaggaggca

SEQ ID NO: 15178 - DNA, 21 bp, Artificial sequence
  Forward Primer
aaaccgaattagaaaactcgg

SEQ ID NO: 15179 - DNA, 22 bp, Artificial sequence
  Forward Primer
agtgggtaagactctgagctcc

SEQ ID NO: 15180 - DNA, 20 bp, Artificial sequence
  Forward Primer
tagaagagcctcccgagatt

SEQ ID NO: 15181 - DNA, 22 bp, Artificial sequence
  Forward Primer
ttttccagagggtaatcatcag

SEQ ID NO: 15182 - DNA, 18 bp, Artificial sequence
  Forward Primer
ygtgtgtaacgtgggcag

SEQ ID NO: 15183 - DNA, 18 bp, Artificial sequence
  Forward Primer
aaatcgcagctccaggtc

SEQ ID NO: 15184 - DNA, 18 bp, Artificial sequence
  Forward Primer
tgcagaggtgcagaaaag

SEQ ID NO: 15185 - DNA, 19 bp, Artificial sequence
  Forward Primer
acttggagcatcgaaaacc

SEQ ID NO: 15186 - DNA, 27 bp, Artificial sequence
  Forward Primer
caaacaggctatgctttaatgtatatt

SEQ ID NO: 15187 - DNA, 21 bp, Artificial sequence
  Forward Primer
aaatagtgaatgacaggggga

SEQ ID NO: 15188 - DNA, 28 bp, Artificial sequence
  Forward Primer
agaagaggatagtgtgatatgtaccttc

SEQ ID NO: 15189 - DNA, 18 bp, Artificial sequence
  Forward Primer
tgattggcagtgtgaggc

SEQ ID NO: 15190 - DNA, 23 bp, Artificial sequence
  Forward Primer
acatgaaactcttcttctgtaaa

SEQ ID NO: 15191 - DNA, 22 bp, Artificial sequence
  Forward Primer
ttttgagcacattgttctaagc

SEQ ID NO: 15192 - DNA, 26 bp, Artificial sequence
  Forward Primer
taatacttgtagcttcaggaaattga

SEQ ID NO: 15193 - DNA, 28 bp, Artificial sequence
  Forward Primer
tcgattattaatatttattcaccctcta

SEQ ID NO: 15194 - DNA, 26 bp, Artificial sequence
  Forward Primer
ttcagaatgtagagtgtttttgtgtt

SEQ ID NO: 15195 - DNA, 24 bp, Artificial sequence
  Forward Primer
aaaaaacacattgacaacagtttc

SEQ ID NO: 15196 - DNA, 28 bp, Artificial sequence
  Forward Primer
attatttcaatagaaaaatataggcagg

SEQ ID NO: 15197 - DNA, 21 bp, Artificial sequence
  Forward Primer
taaacaaggctgccaaatatt

SEQ ID NO: 15198 - DNA, 24 bp, Artificial sequence
  Forward Primer
aaatatatgtgaaaacacacaggg

SEQ ID NO: 15199 - DNA, 22 bp, Artificial sequence
  Forward Primer
tttttcgaggtccgattttata

SEQ ID NO: 15200 - DNA, 20 bp, Artificial sequence
  Forward Primer
tcagaagctaagcagggttg

SEQ ID NO: 15201 - DNA, 25 bp, Artificial sequence
  Forward Primer
agatttccaagtagcctttctatct

SEQ ID NO: 15202 - DNA, 19 bp, Artificial sequence
  Forward Primer
aaagcragcattgcgttaa

SEQ ID NO: 15203 - DNA, 20 bp, Artificial sequence
  Forward Primer
atccacccttttgtaggtgt

SEQ ID NO: 15204 - DNA, 19 bp, Artificial sequence
  Forward Primer
taaagccaatgcaaaagca

SEQ ID NO: 15205 - DNA, 25 bp, Artificial sequence
  Forward Primer
aaaccctgaatagaaaataagcttc

SEQ ID NO: 15206 - DNA, 30 bp, Artificial sequence
  Forward Primer
ttccctagtttagtagaaagtcttaattac

SEQ ID NO: 15207 - DNA, 24 bp, Artificial sequence
  Forward Primer
atgataaactttgcactctgtttt

SEQ ID NO: 15208 - DNA, 24 bp, Artificial sequence
  Forward Primer
aaaggggaaattagtggaaataat

SEQ ID NO: 15209 - DNA, 19 bp, Artificial sequence
  Forward Primer
atacccaagcccaaaatct

SEQ ID NO: 15210 - DNA, 19 bp, Artificial sequence
  Forward Primer
gctctgtgagtgtcttggt

SEQ ID NO: 15211 - DNA, 23 bp, Artificial sequence
  Forward Primer
tgcctactaatgatttctattct

SEQ ID NO: 15212 - DNA, 21 bp, Artificial sequence
  Forward Primer
cgaggtactccttagatgcta

SEQ ID NO: 15213 - DNA, 21 bp, Artificial sequence
  Forward Primer
ctttgtcatttaatccaaaca

SEQ ID NO: 15214 - DNA, 22 bp, Artificial sequence
  Forward Primer
attcagaagcaagttcacaacc

SEQ ID NO: 15215 - DNA, 19 bp, Artificial sequence
  Forward Primer
cctaggcacaccattgtct

SEQ ID NO: 15216 - DNA, 30 bp, Artificial sequence
  Forward Primer
agctttaagaaataataatagtaataactg

SEQ ID NO: 15217 - DNA, 23 bp, Artificial sequence
  Forward Primer
atcatcaaggcaaataatcaaat

SEQ ID NO: 15218 - DNA, 26 bp, Artificial sequence
  Forward Primer
aacattgtcttgtggttttattttac

SEQ ID NO: 15219 - DNA, 20 bp, Artificial sequence
  Forward Primer
tgcttcaatatctccaggca

SEQ ID NO: 15220 - DNA, 25 bp, Artificial sequence
  Forward Primer
tcttycttttgattaggcatattat

SEQ ID NO: 15221 - DNA, 24 bp, Artificial sequence
  Forward Primer
ttttctaatgaaaaaattctgtgc

SEQ ID NO: 15222 - DNA, 24 bp, Artificial sequence
  Forward Primer
ataggacacagaagaacaaaaaca

SEQ ID NO: 15223 - DNA, 21 bp, Artificial sequence
  Forward Primer
agaataagcagtcaaggaatg

SEQ ID NO: 15224 - DNA, 20 bp, Artificial sequence
  Forward Primer
cattgttccatgaaaggacc

SEQ ID NO: 15225 - DNA, 23 bp, Artificial sequence
  Forward Primer
aatcagtaaacaacaaaagccaa

SEQ ID NO: 15226 - DNA, 23 bp, Artificial sequence
  Forward Primer
attacaatggtcagtttagagcc

SEQ ID NO: 15227 - DNA, 19 bp, Artificial sequence
  Forward Primer
accccaggcatctgaaata

SEQ ID NO: 15228 - DNA, 19 bp, Artificial sequence
  Forward Primer
ggatctagtgtggggacac

SEQ ID NO: 15229 - DNA, 19 bp, Artificial sequence
  Forward Primer
aagctggggttggttactg

SEQ ID NO: 15230 - DNA, 19 bp, Artificial sequence
  Forward Primer
ttccactccaaacaccaga

SEQ ID NO: 15231 - DNA, 26 bp, Artificial sequence
  Forward Primer
aaaaattgttgatgaaactagggtag

SEQ ID NO: 15232 - DNA, 24 bp, Artificial sequence
  Forward Primer
attcamgtcttagtgaataatgga

SEQ ID NO: 15233 - DNA, 19 bp, Artificial sequence
  Forward Primer
ctaaattttggagcaggca

SEQ ID NO: 15234 - DNA, 26 bp, Artificial sequence
  Forward Primer
agtcaagagggttctttatgtcatag

SEQ ID NO: 15235 - DNA, 25 bp, Artificial sequence
  Forward Primer
attctatgggttttttggtaagaac

SEQ ID NO: 15236 - DNA, 26 bp, Artificial sequence
  Forward Primer
aaatgacacatatgtttaaaatggag

SEQ ID NO: 15237 - DNA, 24 bp, Artificial sequence
  Forward Primer
atctcagtcttcagagtggaattt

SEQ ID NO: 15238 - DNA, 21 bp, Artificial sequence
  Forward Primer
aatgcacccttaattctttcc

SEQ ID NO: 15239 - DNA, 18 bp, Artificial sequence
  Forward Primer
aaggtcggggtggctgca

SEQ ID NO: 15240 - DNA, 19 bp, Artificial sequence
  Forward Primer
acagccctgctcaaaagac

SEQ ID NO: 15241 - DNA, 18 bp, Artificial sequence
  Forward Primer
aattcctatttgccgcca

SEQ ID NO: 15242 - DNA, 25 bp, Artificial sequence
  Forward Primer
aagttattccattaggaaaaggaga

SEQ ID NO: 15243 - DNA, 18 bp, Artificial sequence
  Forward Primer
aaagctggaggggacagg

SEQ ID NO: 15244 - DNA, 27 bp, Artificial sequence
  Forward Primer
tttgaatctactaaagaaggaaattga

SEQ ID NO: 15245 - DNA, 22 bp, Artificial sequence
  Forward Primer
ttttcctgctaatgactgactc

SEQ ID NO: 15246 - DNA, 25 bp, Artificial sequence
  Forward Primer
aaactatgatcccataagatgtgtg

SEQ ID NO: 15247 - DNA, 26 bp, Artificial sequence
  Forward Primer
ttcttaaaaaatactggaacaatgag

SEQ ID NO: 15248 - DNA, 28 bp, Artificial sequence
  Forward Primer
aacttgatgtgaatatgtaaataccaag

SEQ ID NO: 15249 - DNA, 21 bp, Artificial sequence
  Forward Primer
tattttggtcgtttccataac

SEQ ID NO: 15250 - DNA, 20 bp, Artificial sequence
  Forward Primer
ccatttaggtcaccacagtt

SEQ ID NO: 15251 - DNA, 27 bp, Artificial sequence
  Forward Primer
atctatttgaaaagattaaatgagggt

SEQ ID NO: 15252 - DNA, 27 bp, Artificial sequence
  Forward Primer
ataattgctttacagaaaaccatagtg

SEQ ID NO: 15253 - DNA, 26 bp, Artificial sequence
  Forward Primer
taaatcaaggatttagatgcattagg

SEQ ID NO: 15254 - DNA, 26 bp, Artificial sequence
  Forward Primer
attgaacagtactgaaattgattcag

SEQ ID NO: 15255 - DNA, 29 bp, Artificial sequence
  Forward Primer
agaggtacattagatactaatagagtcat

SEQ ID NO: 15256 - DNA, 24 bp, Artificial sequence
  Forward Primer
atcttgaattgatttatttttgcc

SEQ ID NO: 15257 - DNA, 18 bp, Artificial sequence
  Forward Primer
ttccatgttgcccgtttt

SEQ ID NO: 15258 - DNA, 30 bp, Artificial sequence
  Forward Primer
taacagtatatcataggaaagtaccaatac

SEQ ID NO: 15259 - DNA, 22 bp, Artificial sequence
  Forward Primer
taacattcatgggaaggaaaag

SEQ ID NO: 15260 - DNA, 24 bp, Artificial sequence
  Forward Primer
acatgttctttgatccataagttt

SEQ ID NO: 15261 - DNA, 24 bp, Artificial sequence
  Forward Primer
atttaaggcttgcctatgttctaa

SEQ ID NO: 15262 - DNA, 19 bp, Artificial sequence
  Forward Primer
tggaaccattgcttctagg

SEQ ID NO: 15263 - DNA, 25 bp, Artificial sequence
  Forward Primer
atgtactaggacctgagagaattca

SEQ ID NO: 15264 - DNA, 30 bp, Artificial sequence
  Forward Primer
ttcctttcatatatctctttagtctttctc

SEQ ID NO: 15265 - DNA, 28 bp, Artificial sequence
  Forward Primer
tattagaaaagctacctactttcatgtg

SEQ ID NO: 15266 - DNA, 25 bp, Artificial sequence
  Forward Primer
tgacattttcttaatkttatggaga

SEQ ID NO: 15267 - DNA, 24 bp, Artificial sequence
  Forward Primer
aaaagattgctttaattttccatg

SEQ ID NO: 15268 - DNA, 30 bp, Artificial sequence
  Forward Primer
atatatagtaggtccttgttattaaatatc

SEQ ID NO: 15269 - DNA, 23 bp, Artificial sequence
  Forward Primer
aaaagatatgaagacaaaacacc

SEQ ID NO: 15270 - DNA, 30 bp, Artificial sequence
  Forward Primer
attggtcaattccagagtatatattaactt

SEQ ID NO: 15271 - DNA, 20 bp, Artificial sequence
  Forward Primer
acagattcatgtccgttgga

SEQ ID NO: 15272 - DNA, 24 bp, Artificial sequence
  Forward Primer
aaagaattatttgacccaaaatgt

SEQ ID NO: 15273 - DNA, 24 bp, Artificial sequence
  Forward Primer
atgcaccttttattgcatttataa

SEQ ID NO: 15274 - DNA, 29 bp, Artificial sequence
  Forward Primer
acttatatctatctgctcattcataaagc

SEQ ID NO: 15275 - DNA, 19 bp, Artificial sequence
  Forward Primer
acagcagatgcttggtcat

SEQ ID NO: 15276 - DNA, 28 bp, Artificial sequence
  Forward Primer
ctttaaattattccaaatttcactatgc

SEQ ID NO: 15277 - DNA, 24 bp, Artificial sequence
  Forward Primer
gattgaagcaaaatattcctaatt

SEQ ID NO: 15278 - DNA, 25 bp, Artificial sequence
  Forward Primer
ttaaataacaacattgcctgtacaa

SEQ ID NO: 15279 - DNA, 18 bp, Artificial sequence
  Forward Primer
agccttgtccaggcagac

SEQ ID NO: 15280 - DNA, 20 bp, Artificial sequence
  Forward Primer
atggatcttgagttgggact

SEQ ID NO: 15281 - DNA, 18 bp, Artificial sequence
  Forward Primer
ttgcaatgctcctctgga

SEQ ID NO: 15282 - DNA, 18 bp, Artificial sequence
  Forward Primer
tgtgtgtaaaggggccag

SEQ ID NO: 15283 - DNA, 18 bp, Artificial sequence
  Forward Primer
ttttccaaaggtggcagg

SEQ ID NO: 15284 - DNA, 18 bp, Artificial sequence
  Forward Primer
cagcttcaagcagaaccc

SEQ ID NO: 15285 - DNA, 18 bp, Artificial sequence
  Forward Primer
ttgcatgtgcttgcattc

SEQ ID NO: 15286 - DNA, 21 bp, Artificial sequence
  Forward Primer
tcgatttccatgtaaagaccc

SEQ ID NO: 15287 - DNA, 20 bp, Artificial sequence
  Forward Primer
aagggttaacagatttgggg

SEQ ID NO: 15288 - DNA, 19 bp, Artificial sequence
  Forward Primer
aacaatgaggggctggtag

SEQ ID NO: 15289 - DNA, 22 bp, Artificial sequence
  Forward Primer
gccttgttgagttcttttaatt

SEQ ID NO: 15290 - DNA, 23 bp, Artificial sequence
  Forward Primer
taggaggttacagatatgtgcgt

SEQ ID NO: 15291 - DNA, 25 bp, Artificial sequence
  Forward Primer
tatctaagcatctcacatgaacttg

SEQ ID NO: 15292 - DNA, 18 bp, Artificial sequence
  Forward Primer
tcgctgccttgacagaat

SEQ ID NO: 15293 - DNA, 19 bp, Artificial sequence
  Forward Primer
ctgagctcctgagaaggct

SEQ ID NO: 15294 - DNA, 19 bp, Artificial sequence
  Forward Primer
accaccttaaatttccgat

SEQ ID NO: 15295 - DNA, 22 bp, Artificial sequence
  Forward Primer
aatcaatccaggactgttcttg

SEQ ID NO: 15296 - DNA, 18 bp, Artificial sequence
  Forward Primer
aaagcacagacgcccgca

SEQ ID NO: 15297 - DNA, 19 bp, Artificial sequence
  Forward Primer
aaactgaagctgggtcttg

SEQ ID NO: 15298 - DNA, 24 bp, Artificial sequence
  Forward Primer
tattttttgctaatgattgctttg

SEQ ID NO: 15299 - DNA, 22 bp, Artificial sequence
  Forward Primer
atatttgatgcccagactacga

SEQ ID NO: 15300 - DNA, 20 bp, Artificial sequence
  Forward Primer
tgcatatgtaagcacaacgg

SEQ ID NO: 15301 - DNA, 26 bp, Artificial sequence
  Forward Primer
ggctgaaaaagtatttgaagaaataa

SEQ ID NO: 15302 - DNA, 26 bp, Artificial sequence
  Forward Primer
cagattctttaccatttgaactacaa

SEQ ID NO: 15303 - DNA, 26 bp, Artificial sequence
  Forward Primer
aggtcatataatatctggatgttgat

SEQ ID NO: 15304 - DNA, 24 bp, Artificial sequence
  Forward Primer
tggtggtaatgagatcatttaata

SEQ ID NO: 15305 - DNA, 23 bp, Artificial sequence
  Forward Primer
tttacaccatgtttatcaagaga

SEQ ID NO: 15306 - DNA, 23 bp, Artificial sequence
  Forward Primer
tgaatatctggatgctaacaacc

SEQ ID NO: 15307 - DNA, 30 bp, Artificial sequence
  Forward Primer
acaatcctgtagagaaatgtaagttactaa

SEQ ID NO: 15308 - DNA, 20 bp, Artificial sequence
  Forward Primer
ttactctcccaattcccctg

SEQ ID NO: 15309 - DNA, 28 bp, Artificial sequence
  Forward Primer
ttttagttctttaattttggagaagaag

SEQ ID NO: 15310 - DNA, 24 bp, Artificial sequence
  Forward Primer
acacactactctcttggaatctgg

SEQ ID NO: 15311 - DNA, 22 bp, Artificial sequence
  Forward Primer
taaaaggggtctacttcggttt

SEQ ID NO: 15312 - DNA, 23 bp, Artificial sequence
  Forward Primer
acaagtaaagtagacttccacag

SEQ ID NO: 15313 - DNA, 23 bp, Artificial sequence
  Forward Primer
aaaacttattactgggaggctca

SEQ ID NO: 15314 - DNA, 20 bp, Artificial sequence
  Forward Primer
ctccatctgtagccacttca

SEQ ID NO: 15315 - DNA, 25 bp, Artificial sequence
  Forward Primer
aaaattctggatctgaccttctagt

SEQ ID NO: 15316 - DNA, 19 bp, Artificial sequence
  Forward Primer
aggagaaagccacataacc

SEQ ID NO: 15317 - DNA, 21 bp, Artificial sequence
  Forward Primer
agcaaatttcaaaaccatgac

SEQ ID NO: 15318 - DNA, 24 bp, Artificial sequence
  Forward Primer
agtttgggtaaatgttatctattg

SEQ ID NO: 15319 - DNA, 25 bp, Artificial sequence
  Forward Primer
tatttctgctaccgctaactttact

SEQ ID NO: 15320 - DNA, 23 bp, Artificial sequence
  Forward Primer
cccaagatttattttcatttcct

SEQ ID NO: 15321 - DNA, 24 bp, Artificial sequence
  Forward Primer
tacagctatagggtagaaagggtg

SEQ ID NO: 15322 - DNA, 22 bp, Artificial sequence
  Forward Primer
ccaactgacatctgttttctga

SEQ ID NO: 15323 - DNA, 23 bp, Artificial sequence
  Forward Primer
aaaaggaaagatatacccatttg

SEQ ID NO: 15324 - DNA, 18 bp, Artificial sequence
  Forward Primer
aaaaatctgccattgcca

SEQ ID NO: 15325 - DNA, 25 bp, Artificial sequence
  Forward Primer
gcttctggaaatcattaatttcttt

SEQ ID NO: 15326 - DNA, 18 bp, Artificial sequence
  Forward Primer
atggcgtgtggtggggga

SEQ ID NO: 15327 - DNA, 24 bp, Artificial sequence
  Forward Primer
aactgtaattcaaaaacatacatg

SEQ ID NO: 15328 - DNA, 26 bp, Artificial sequence
  Forward Primer
tgtgtaaatctcagttctcaattacc

SEQ ID NO: 15329 - DNA, 25 bp, Artificial sequence
  Forward Primer
tatagatggctctataaaacattgg

SEQ ID NO: 15330 - DNA, 18 bp, Artificial sequence
  Forward Primer
aatgcaaacgaccagagg

SEQ ID NO: 15331 - DNA, 24 bp, Artificial sequence
  Forward Primer
gaacatcagaktcgtrattttata

SEQ ID NO: 15332 - DNA, 25 bp, Artificial sequence
  Forward Primer
agagatgaaattaaaactagagcac

SEQ ID NO: 15333 - DNA, 23 bp, Artificial sequence
  Forward Primer
gtattattcaggataggcaagat

SEQ ID NO: 15334 - DNA, 28 bp, Artificial sequence
  Forward Primer
gatgtgagtttatagcttttgtttaaaa

SEQ ID NO: 15335 - DNA, 23 bp, Artificial sequence
  Forward Primer
ataaacgctcattgatatgacct

SEQ ID NO: 15336 - DNA, 26 bp, Artificial sequence
  Forward Primer
aaactaattgatatggagatctggac

SEQ ID NO: 15337 - DNA, 20 bp, Artificial sequence
  Forward Primer
ttttctacctcgcagcaaac

SEQ ID NO: 15338 - DNA, 19 bp, Artificial sequence
  Forward Primer
actgtcatgccctgatttc

SEQ ID NO: 15339 - DNA, 19 bp, Artificial sequence
  Forward Primer
gcacatcatcttgaaaaaa

SEQ ID NO: 15340 - DNA, 23 bp, Artificial sequence
  Forward Primer
aatggggtattaaacagtgaaaa

SEQ ID NO: 15341 - DNA, 30 bp, Artificial sequence
  Forward Primer
tgataaagtaagaagtgtattaaagatgac

SEQ ID NO: 15342 - DNA, 27 bp, Artificial sequence
  Forward Primer
atatgagttttaattccgttaatcctc

SEQ ID NO: 15343 - DNA, 18 bp, Artificial sequence
  Forward Primer
agggtggctcgtggctct

SEQ ID NO: 15344 - DNA, 25 bp, Artificial sequence
  Forward Primer
tttatagtgtttgctttaatttgcc

SEQ ID NO: 15345 - DNA, 27 bp, Artificial sequence
  Forward Primer
ttaaaaaactcaccaagttaaaactgt

SEQ ID NO: 15346 - DNA, 20 bp, Artificial sequence
  Forward Primer
tgtgcrggattttcactagt

SEQ ID NO: 15347 - DNA, 18 bp, Artificial sequence
  Forward Primer
aggtcagtggggatgcaa

SEQ ID NO: 15348 - DNA, 18 bp, Artificial sequence
  Forward Primer
taacccacgccaatcctg

SEQ ID NO: 15349 - DNA, 18 bp, Artificial sequence
  Forward Primer
tggcagggagggactagt

SEQ ID NO: 15350 - DNA, 19 bp, Artificial sequence
  Forward Primer
aatgcactcacgagctgaa

SEQ ID NO: 15351 - DNA, 20 bp, Artificial sequence
  Forward Primer
tttgctttcaaggtttggac

SEQ ID NO: 15352 - DNA, 18 bp, Artificial sequence
  Forward Primer
tttggagggcaagcagct

SEQ ID NO: 15353 - DNA, 20 bp, Artificial sequence
  Forward Primer
aactgcttgaatgtgtgcac

SEQ ID NO: 15354 - DNA, 21 bp, Artificial sequence
  Forward Primer
aagacgtccatgtcctagatc

SEQ ID NO: 15355 - DNA, 28 bp, Artificial sequence
  Forward Primer
ataggtgaaaattgtagaaggaaaataa

SEQ ID NO: 15356 - DNA, 24 bp, Artificial sequence
  Forward Primer
ttgacttaaggatgcttctacaaa

SEQ ID NO: 15357 - DNA, 18 bp, Artificial sequence
  Forward Primer
tgtgtgtgttccccaacc

SEQ ID NO: 15358 - DNA, 19 bp, Artificial sequence
  Forward Primer
tggaacagtccatgagttc

SEQ ID NO: 15359 - DNA, 28 bp, Artificial sequence
  Forward Primer
cttcatttgtaagacctgagtttatcta

SEQ ID NO: 15360 - DNA, 26 bp, Artificial sequence
  Forward Primer
atatcatttctttacacaagaaccaa

SEQ ID NO: 15361 - DNA, 24 bp, Artificial sequence
  Forward Primer
aataatgtgattccaagtgtgaca

SEQ ID NO: 15362 - DNA, 22 bp, Artificial sequence
  Forward Primer
aaaccatcttctttagggaact

SEQ ID NO: 15363 - DNA, 20 bp, Artificial sequence
  Forward Primer
tggctcctctagattaagga

SEQ ID NO: 15364 - DNA, 26 bp, Artificial sequence
  Forward Primer
tttttaaagtgctgttacttcaagag

SEQ ID NO: 15365 - DNA, 25 bp, Artificial sequence
  Forward Primer
gacatactaaagacttggtagaaaa

SEQ ID NO: 15366 - DNA, 30 bp, Artificial sequence
  Forward Primer
tgacaacatagatgttcttataatattgtt

SEQ ID NO: 15367 - DNA, 20 bp, Artificial sequence
  Forward Primer
tcaggcaataaattttgtca

SEQ ID NO: 15368 - DNA, 24 bp, Artificial sequence
  Forward Primer
tccatggtctgataaaataagatt

SEQ ID NO: 15369 - DNA, 23 bp, Artificial sequence
  Forward Primer
agcttgagaagagtgatatcttg

SEQ ID NO: 15370 - DNA, 27 bp, Artificial sequence
  Forward Primer
ttataaattgcaagctgtacaaatcta

SEQ ID NO: 15371 - DNA, 24 bp, Artificial sequence
  Forward Primer
tgaaatcacagccatatcaactag

SEQ ID NO: 15372 - DNA, 28 bp, Artificial sequence
  Forward Primer
ggtatatttttcaaaatctttttctgtc

SEQ ID NO: 15373 - DNA, 24 bp, Artificial sequence
  Forward Primer
ttgtagttaggatgggtgttcttt

SEQ ID NO: 15374 - DNA, 20 bp, Artificial sequence
  Forward Primer
tgtactctgtggaagggctt

SEQ ID NO: 15375 - DNA, 28 bp, Artificial sequence
  Forward Primer
ttaaaagaattaaggaaatctgtatgtg

SEQ ID NO: 15376 - DNA, 20 bp, Artificial sequence
  Forward Primer
aatcagcttcatgcacagag

SEQ ID NO: 15377 - DNA, 27 bp, Artificial sequence
  Forward Primer
tatttaagaggggatttacaactctac

SEQ ID NO: 15378 - DNA, 27 bp, Artificial sequence
  Forward Primer
taaaattatctggggagtaataactgt

SEQ ID NO: 15379 - DNA, 25 bp, Artificial sequence
  Forward Primer
ttttaaccaccattttacagaagaa

SEQ ID NO: 15380 - DNA, 29 bp, Artificial sequence
  Forward Primer
tataaaactctctactcaataatggaagg

SEQ ID NO: 15381 - DNA, 23 bp, Artificial sequence
  Forward Primer
ttattaaatagcaagatggttca

SEQ ID NO: 15382 - DNA, 18 bp, Artificial sequence
  Forward Primer
tgcaagggagtcagagca

SEQ ID NO: 15383 - DNA, 30 bp, Artificial sequence
  Forward Primer
cagaaactaggtaagtagaaattatgaaat

SEQ ID NO: 15384 - DNA, 27 bp, Artificial sequence
  Forward Primer
ttaattagatccactaacttctggaaa

SEQ ID NO: 15385 - DNA, 25 bp, Artificial sequence
  Forward Primer
ccataaagtttttattttgtttccc

SEQ ID NO: 15386 - DNA, 24 bp, Artificial sequence
  Forward Primer
aattgttttcttttgtcttcattg

SEQ ID NO: 15387 - DNA, 28 bp, Artificial sequence
  Forward Primer
atattatcacaactgattccaaacataa

SEQ ID NO: 15388 - DNA, 30 bp, Artificial sequence
  Forward Primer
tgtacagttgatgtaagtataattaagtag

SEQ ID NO: 15389 - DNA, 25 bp, Artificial sequence
  Forward Primer
tggagaatgtggatacatgtctata

SEQ ID NO: 15390 - DNA, 20 bp, Artificial sequence
  Forward Primer
ttaagctccgagacaaatta

SEQ ID NO: 15391 - DNA, 20 bp, Artificial sequence
  Forward Primer
taacatggcagctggtttct

SEQ ID NO: 15392 - DNA, 20 bp, Artificial sequence
  Forward Primer
tcaccaagaatttgtcattt

SEQ ID NO: 15393 - DNA, 26 bp, Artificial sequence
  Forward Primer
tcatgtcagatttttcaaataagatg

SEQ ID NO: 15394 - DNA, 28 bp, Artificial sequence
  Forward Primer
atgaataactatttgaagaggtaaaaac

SEQ ID NO: 15395 - DNA, 24 bp, Artificial sequence
  Forward Primer
agaaagtgagtcaggatttctttg

SEQ ID NO: 15396 - DNA, 18 bp, Artificial sequence
  Forward Primer
aggagtgggaacaccctg

SEQ ID NO: 15397 - DNA, 18 bp, Artificial sequence
  Forward Primer
acgcctccatttcatcca

SEQ ID NO: 15398 - DNA, 22 bp, Artificial sequence
  Forward Primer
ttatttggggatcttaaatgca

SEQ ID NO: 15399 - DNA, 21 bp, Artificial sequence
  Forward Primer
atccttttgttcactgccttc

SEQ ID NO: 15400 - DNA, 18 bp, Artificial sequence
  Forward Primer
ttccactctgccagcagg

SEQ ID NO: 15401 - DNA, 18 bp, Artificial sequence
  Forward Primer
acccgctcctgcagcgat

SEQ ID NO: 15402 - DNA, 24 bp, Artificial sequence
  Forward Primer
tagattgtttaagaagcaggagct

SEQ ID NO: 15403 - DNA, 24 bp, Artificial sequence
  Forward Primer
ttataggaggctgtgataattaga

SEQ ID NO: 15404 - DNA, 28 bp, Artificial sequence
  Forward Primer
atcattttgaatattatttagacttgcc

SEQ ID NO: 15405 - DNA, 19 bp, Artificial sequence
  Forward Primer
tttgactcactggacccct

SEQ ID NO: 15406 - DNA, 20 bp, Artificial sequence
  Forward Primer
tatcaaggcggayataagtg

SEQ ID NO: 15407 - DNA, 21 bp, Artificial sequence
  Forward Primer
tagaagtctaggctccccacc

SEQ ID NO: 15408 - DNA, 20 bp, Artificial sequence
  Forward Primer
cggtttagtagaggtgggtc

SEQ ID NO: 15409 - DNA, 24 bp, Artificial sequence
  Forward Primer
attatgagcaaaactgggttattt

SEQ ID NO: 15410 - DNA, 27 bp, Artificial sequence
  Forward Primer
accacaatctcctttaataatgaagta

SEQ ID NO: 15411 - DNA, 25 bp, Artificial sequence
  Forward Primer
aattttgtattgggctgtactgtat

SEQ ID NO: 15412 - DNA, 30 bp, Artificial sequence
  Forward Primer
atgtcttagtttagttagcttgagactata

SEQ ID NO: 15413 - DNA, 24 bp, Artificial sequence
  Forward Primer
tttataaaaatccttgtgggaaat

SEQ ID NO: 15414 - DNA, 19 bp, Artificial sequence
  Forward Primer
atacgttttggycaatgca

SEQ ID NO: 15415 - DNA, 28 bp, Artificial sequence
  Forward Primer
aaatgatgagttcattaaaaagagatac

SEQ ID NO: 15416 - DNA, 22 bp, Artificial sequence
  Forward Primer
attaacttgttatccccatgca

SEQ ID NO: 15417 - DNA, 24 bp, Artificial sequence
  Forward Primer
taaagtagttcacccttcctgatc

SEQ ID NO: 15418 - DNA, 18 bp, Artificial sequence
  Forward Primer
tgggcgattcacagaaat

SEQ ID NO: 15419 - DNA, 21 bp, Artificial sequence
  Forward Primer
atgagatgccattgtctaaaa

SEQ ID NO: 15420 - DNA, 24 bp, Artificial sequence
  Forward Primer
attatttaccactgagtcacctgg

SEQ ID NO: 15421 - DNA, 25 bp, Artificial sequence
  Forward Primer
tcaaaatatttactgtctggtcctt

SEQ ID NO: 15422 - DNA, 24 bp, Artificial sequence
  Forward Primer
tcgttgtaaattaataaaatggcg

SEQ ID NO: 15423 - DNA, 22 bp, Artificial sequence
  Forward Primer
ttccacccagaaaatttaagtg

SEQ ID NO: 15424 - DNA, 22 bp, Artificial sequence
  Forward Primer
tgggaaaacaaagtgtgtgtaa

SEQ ID NO: 15425 - DNA, 30 bp, Artificial sequence
  Forward Primer
atgtgtataatctgtcaatattatttgtag

SEQ ID NO: 15426 - DNA, 24 bp, Artificial sequence
  Forward Primer
caacattacatggtcaataaaaaa

SEQ ID NO: 15427 - DNA, 24 bp, Artificial sequence
  Forward Primer
tggttgtttctctgtctagtagga

SEQ ID NO: 15428 - DNA, 26 bp, Artificial sequence
  Forward Primer
tttaaagtaaatatcttcatccccag

SEQ ID NO: 15429 - DNA, 20 bp, Artificial sequence
  Forward Primer
agaggaggcagaaaaggaaa

SEQ ID NO: 15430 - DNA, 25 bp, Artificial sequence
  Forward Primer
tatggagagagattctctaagtgag

SEQ ID NO: 15431 - DNA, 25 bp, Artificial sequence
  Forward Primer
ttaaatccccacttattgtgtaaat

SEQ ID NO: 15432 - DNA, 26 bp, Artificial sequence
  Forward Primer
ttgtatttatccaatacctgttaatg

SEQ ID NO: 15433 - DNA, 25 bp, Artificial sequence
  Forward Primer
ttccttaatttcatgtgacttaaca

SEQ ID NO: 15434 - DNA, 24 bp, Artificial sequence
  Forward Primer
tttaaaattcaggaaaccagctac

SEQ ID NO: 15435 - DNA, 22 bp, Artificial sequence
  Forward Primer
aaaggcagacaaacaccatagt

SEQ ID NO: 15436 - DNA, 30 bp, Artificial sequence
  Forward Primer
tcaagttctgagtatttgagtatagattat

SEQ ID NO: 15437 - DNA, 26 bp, Artificial sequence
  Forward Primer
tttcttacattttctacctctgttga

SEQ ID NO: 15438 - DNA, 20 bp, Artificial sequence
  Forward Primer
atctccatatgtgattggct

SEQ ID NO: 15439 - DNA, 28 bp, Artificial sequence
  Forward Primer
attaagtcctttataactttgacatctt

SEQ ID NO: 15440 - DNA, 22 bp, Artificial sequence
  Forward Primer
ctcctttgaaaaatcagagtac

SEQ ID NO: 15441 - DNA, 25 bp, Artificial sequence
  Forward Primer
ttttcctcactgatacagaagactg

SEQ ID NO: 15442 - DNA, 18 bp, Artificial sequence
  Forward Primer
tctgggctcagaaaatgc

SEQ ID NO: 15443 - DNA, 26 bp, Artificial sequence
  Forward Primer
cttaagcaaatcaattcatatctttg

SEQ ID NO: 15444 - DNA, 26 bp, Artificial sequence
  Forward Primer
aatgatgagagagacaagatatgtga

SEQ ID NO: 15445 - DNA, 26 bp, Artificial sequence
  Forward Primer
aatccagtactttatcacatcttcct

SEQ ID NO: 15446 - DNA, 21 bp, Artificial sequence
  Forward Primer
ttagaaagcttttagcgtgtt

SEQ ID NO: 15447 - DNA, 24 bp, Artificial sequence
  Forward Primer
atttcaagcctcttgattagatga

SEQ ID NO: 15448 - DNA, 24 bp, Artificial sequence
  Forward Primer
acatatggctagaaaacctagtct

SEQ ID NO: 15449 - DNA, 21 bp, Artificial sequence
  Forward Primer
ggtgtgattttaaggtcttga

SEQ ID NO: 15450 - DNA, 18 bp, Artificial sequence
  Forward Primer
ggcagggccagatcgatg

SEQ ID NO: 15451 - DNA, 18 bp, Artificial sequence
  Forward Primer
accctccccactggaagt

SEQ ID NO: 15452 - DNA, 19 bp, Artificial sequence
  Forward Primer
tgagtggtcaggctacacg

SEQ ID NO: 15453 - DNA, 24 bp, Artificial sequence
  Forward Primer
aaaagaaacagaaaccaatcaaca

SEQ ID NO: 15454 - DNA, 19 bp, Artificial sequence
  Forward Primer
ttcaatccctggttggaga

SEQ ID NO: 15455 - DNA, 23 bp, Artificial sequence
  Forward Primer
tctttgtttcttaatcacagatc

SEQ ID NO: 15456 - DNA, 20 bp, Artificial sequence
  Forward Primer
aggctcagtttgaaacagtt

SEQ ID NO: 15457 - DNA, 24 bp, Artificial sequence
  Forward Primer
aactacacaaacagaaaagaggga

SEQ ID NO: 15458 - DNA, 23 bp, Artificial sequence
  Forward Primer
tttttaagcacatagagttgttg

SEQ ID NO: 15459 - DNA, 23 bp, Artificial sequence
  Forward Primer
taaataatggcccctgaagatat

SEQ ID NO: 15460 - DNA, 26 bp, Artificial sequence
  Forward Primer
attttatccataataatctccttgca

SEQ ID NO: 15461 - DNA, 18 bp, Artificial sequence
  Forward Primer
ttgggcatcgggtgctgt

SEQ ID NO: 15462 - DNA, 18 bp, Artificial sequence
  Forward Primer
gactgcgctgggtcttca

SEQ ID NO: 15463 - DNA, 23 bp, Artificial sequence
  Forward Primer
tgattctgtttctgagtcataga

SEQ ID NO: 15464 - DNA, 26 bp, Artificial sequence
  Forward Primer
tgaagaatatctttctcaaatgttca

SEQ ID NO: 15465 - DNA, 30 bp, Artificial sequence
  Forward Primer
gtgacctctatgatttatattagttgaaat

SEQ ID NO: 15466 - DNA, 20 bp, Artificial sequence
  Forward Primer
aaagctaactctagagggcg

SEQ ID NO: 15467 - DNA, 24 bp, Artificial sequence
  Forward Primer
tgagcctttctatgagtaaaattt

SEQ ID NO: 15468 - DNA, 24 bp, Artificial sequence
  Forward Primer
ttttaaaaggagccacagaatatg

SEQ ID NO: 15469 - DNA, 21 bp, Artificial sequence
  Forward Primer
acaaaggcaatgaaacatact

SEQ ID NO: 15470 - DNA, 23 bp, Artificial sequence
  Forward Primer
tccaaatacatttgctttattgc

SEQ ID NO: 15471 - DNA, 29 bp, Artificial sequence
  Forward Primer
aaaaataacctataacgtcagtgtaattc

SEQ ID NO: 15472 - DNA, 19 bp, Artificial sequence
  Forward Primer
ccctttgtacagggtaggg

SEQ ID NO: 15473 - DNA, 26 bp, Artificial sequence
  Forward Primer
attcctgagagacgacaatagtatat

SEQ ID NO: 15474 - DNA, 27 bp, Artificial sequence
  Forward Primer
tccagagaactaaaatcatatcaaaat

SEQ ID NO: 15475 - DNA, 27 bp, Artificial sequence
  Forward Primer
tttggttcttagtaaacaagatttgat

SEQ ID NO: 15476 - DNA, 28 bp, Artificial sequence
  Forward Primer
taaatgaaattgtttacaagagtgagat

SEQ ID NO: 15477 - DNA, 27 bp, Artificial sequence
  Forward Primer
agttacttgttacaagacagaagcact

SEQ ID NO: 15478 - DNA, 23 bp, Artificial sequence
  Forward Primer
tcatacaatcacaagagtaaaca

SEQ ID NO: 15479 - DNA, 18 bp, Artificial sequence
  Forward Primer
gctggccattcatcacca

SEQ ID NO: 15480 - DNA, 21 bp, Artificial sequence
  Forward Primer
aagataacacccatgaggctg

SEQ ID NO: 15481 - DNA, 30 bp, Artificial sequence
  Forward Primer
ttcttggtatttattatttagagattctgt

SEQ ID NO: 15482 - DNA, 28 bp, Artificial sequence
  Forward Primer
tataattgactcaagaatttttgtgatg

SEQ ID NO: 15483 - DNA, 22 bp, Artificial sequence
  Forward Primer
atgaaataagtgcttcattggc

SEQ ID NO: 15484 - DNA, 26 bp, Artificial sequence
  Forward Primer
ttttatcaaactgatagcaargaagt

SEQ ID NO: 15485 - DNA, 20 bp, Artificial sequence
  Forward Primer
tggtttccatcaaccatttc

SEQ ID NO: 15486 - DNA, 19 bp, Artificial sequence
  Forward Primer
tcatgtctgagagcccctc

SEQ ID NO: 15487 - DNA, 22 bp, Artificial sequence
  Forward Primer
tagagtcacttctggacagtgg

SEQ ID NO: 15488 - DNA, 27 bp, Artificial sequence
  Forward Primer
atttattaatcacaaacttacagaccc

SEQ ID NO: 15489 - DNA, 21 bp, Artificial sequence
  Forward Primer
aaggtgctgatagatagcagg

SEQ ID NO: 15490 - DNA, 20 bp, Artificial sequence
  Forward Primer
aaatggctgagcactagctg

SEQ ID NO: 15491 - DNA, 20 bp, Artificial sequence
  Forward Primer
tctcctgctcctttttcaga

SEQ ID NO: 15492 - DNA, 22 bp, Artificial sequence
  Forward Primer
gctgaaactacctctcaggtaa

SEQ ID NO: 15493 - DNA, 18 bp, Artificial sequence
  Forward Primer
aagggctgctcaagggca

SEQ ID NO: 15494 - DNA, 24 bp, Artificial sequence
  Forward Primer
ttaatccaaacctctgaataaggt

SEQ ID NO: 15495 - DNA, 30 bp, Artificial sequence
  Forward Primer
catgatagtctgtatgtactagcatatatt

SEQ ID NO: 15496 - DNA, 27 bp, Artificial sequence
  Forward Primer
tatactatgtcctaaacacagttaaag

SEQ ID NO: 15497 - DNA, 19 bp, Artificial sequence
  Forward Primer
aacaaccaatccaaccttt

SEQ ID NO: 15498 - DNA, 21 bp, Artificial sequence
  Forward Primer
actgttttttcttctctctcc

SEQ ID NO: 15499 - DNA, 24 bp, Artificial sequence
  Forward Primer
aaaaagaaagactcaacgtcctag

SEQ ID NO: 15500 - DNA, 24 bp, Artificial sequence
  Forward Primer
aaagagagaaaggtgacacaaaat

SEQ ID NO: 15501 - DNA, 25 bp, Artificial sequence
  Forward Primer
ttactattctctctggttttacatc

SEQ ID NO: 15502 - DNA, 22 bp, Artificial sequence
  Forward Primer
agataattcattcatttctcca

SEQ ID NO: 15503 - DNA, 24 bp, Artificial sequence
  Forward Primer
tgctttggaaataagatcctaaaa

SEQ ID NO: 15504 - DNA, 23 bp, Artificial sequence
  Forward Primer
tttccagtgtttttagaaatgaa

SEQ ID NO: 15505 - DNA, 24 bp, Artificial sequence
  Forward Primer
aaaggtggaaatttattgaaattg

SEQ ID NO: 15506 - DNA, 23 bp, Artificial sequence
  Forward Primer
atacctgattctgttgagttcag

SEQ ID NO: 15507 - DNA, 28 bp, Artificial sequence
  Forward Primer
atgtccacatatgaaagaattaaagtag

SEQ ID NO: 15508 - DNA, 26 bp, Artificial sequence
  Forward Primer
tgcactctatcaaaatcttaattgtt

SEQ ID NO: 15509 - DNA, 24 bp, Artificial sequence
  Forward Primer
ttagtgcctatcatccacattaaa

SEQ ID NO: 15510 - DNA, 24 bp, Artificial sequence
  Forward Primer
ataattggaagttttggcttaacc

SEQ ID NO: 15511 - DNA, 30 bp, Artificial sequence
  Forward Primer
ttctaaacttcatatagatggttaatgatg

SEQ ID NO: 15512 - DNA, 27 bp, Artificial sequence
  Forward Primer
aattatagtagtagaagggtgcctgtt

SEQ ID NO: 15513 - DNA, 27 bp, Artificial sequence
  Forward Primer
atatcacattcatagttttgagatttc

SEQ ID NO: 15514 - DNA, 21 bp, Artificial sequence
  Forward Primer
attcattccacacacctcact

SEQ ID NO: 15515 - DNA, 26 bp, Artificial sequence
  Forward Primer
tacttgtacaaagtctcaaaactaac

SEQ ID NO: 15516 - DNA, 23 bp, Artificial sequence
  Forward Primer
aacaatagaagcagtgtgtctga

SEQ ID NO: 15517 - DNA, 29 bp, Artificial sequence
  Forward Primer
atatacataagcattgaagttctcatagg

SEQ ID NO: 15518 - DNA, 22 bp, Artificial sequence
  Forward Primer
tgccaaaaatatgtgaaacatt

SEQ ID NO: 15519 - DNA, 18 bp, Artificial sequence
  Forward Primer
aactcactgggagccacc

SEQ ID NO: 15520 - DNA, 24 bp, Artificial sequence
  Forward Primer
ccctttctgtatgtatttatgtca

SEQ ID NO: 15521 - DNA, 28 bp, Artificial sequence
  Forward Primer
ctattgtaattggtttaaaaagaatgtg

SEQ ID NO: 15522 - DNA, 25 bp, Artificial sequence
  Forward Primer
aaatcatgtgctatgcttttatttg

SEQ ID NO: 15523 - DNA, 28 bp, Artificial sequence
  Forward Primer
ttagataaactcacctcatcagaatatg

SEQ ID NO: 15524 - DNA, 24 bp, Artificial sequence
  Forward Primer
agaactttcagtctcgttgctatt

SEQ ID NO: 15525 - DNA, 21 bp, Artificial sequence
  Forward Primer
gttttattcagagrgttgacc

SEQ ID NO: 15526 - DNA, 24 bp, Artificial sequence
  Forward Primer
attacaaagcatcttttccttttt

SEQ ID NO: 15527 - DNA, 23 bp, Artificial sequence
  Forward Primer
tggttagccaaagtgtaagattg

SEQ ID NO: 15528 - DNA, 30 bp, Artificial sequence
  Forward Primer
ctttaaattaaaagttaacaagtatagcag

SEQ ID NO: 15529 - DNA, 28 bp, Artificial sequence
  Forward Primer
gttttgtgtcattagaatatgaactaat

SEQ ID NO: 15530 - DNA, 24 bp, Artificial sequence
  Forward Primer
aaaagtactggtgtgctttaagaa

SEQ ID NO: 15531 - DNA, 22 bp, Artificial sequence
  Forward Primer
tccaacctccataaatttcaat

SEQ ID NO: 15532 - DNA, 24 bp, Artificial sequence
  Forward Primer
ttgataatagccacaaagatcctt

SEQ ID NO: 15533 - DNA, 22 bp, Artificial sequence
  Forward Primer
actgagcagttcagtttctcca

SEQ ID NO: 15534 - DNA, 18 bp, Artificial sequence
  Forward Primer
catcctcaccttcgacca

SEQ ID NO: 15535 - DNA, 23 bp, Artificial sequence
  Forward Primer
aacattcttctaaagctctcaaa

SEQ ID NO: 15536 - DNA, 18 bp, Artificial sequence
  Forward Primer
tgcttccggcatctagag

SEQ ID NO: 15537 - DNA, 18 bp, Artificial sequence
  Forward Primer
atgcacatgcacccaggg

SEQ ID NO: 15538 - DNA, 19 bp, Artificial sequence
  Forward Primer
agaggagtttgggcagtta

SEQ ID NO: 15539 - DNA, 21 bp, Artificial sequence
  Forward Primer
aacaatggcaaaacctttttc

SEQ ID NO: 15540 - DNA, 25 bp, Artificial sequence
  Forward Primer
attgccctcatttgttaatataaga

SEQ ID NO: 15541 - DNA, 28 bp, Artificial sequence
  Forward Primer
taatattttgttacattctttgatggtg

SEQ ID NO: 15542 - DNA, 27 bp, Artificial sequence
  Forward Primer
aatgtataaatgatattggggagacta

SEQ ID NO: 15543 - DNA, 23 bp, Artificial sequence
  Forward Primer
tttatgtgaaagaaaaygtgcaa

SEQ ID NO: 15544 - DNA, 28 bp, Artificial sequence
  Forward Primer
tttaaaaagtaatcatcacattgatacc

SEQ ID NO: 15545 - DNA, 23 bp, Artificial sequence
  Forward Primer
aactcaaacattttgagcattca

SEQ ID NO: 15546 - DNA, 25 bp, Artificial sequence
  Forward Primer
tctaattaccagacactttttgctc

SEQ ID NO: 15547 - DNA, 22 bp, Artificial sequence
  Forward Primer
acaaaattgaggaacagtttaa

SEQ ID NO: 15548 - DNA, 23 bp, Artificial sequence
  Forward Primer
acagaaaagaggtaatgccactc

SEQ ID NO: 15549 - DNA, 25 bp, Artificial sequence
  Forward Primer
aagtttaattccatttcagaggatc

SEQ ID NO: 15550 - DNA, 25 bp, Artificial sequence
  Forward Primer
aaattcgaatatttctatgagggat

SEQ ID NO: 15551 - DNA, 26 bp, Artificial sequence
  Forward Primer
catttctcttaacaccatgattctaa

SEQ ID NO: 15552 - DNA, 18 bp, Artificial sequence
  Forward Primer
actccggcagcgtcgtca

SEQ ID NO: 15553 - DNA, 25 bp, Artificial sequence
  Forward Primer
taaacaacttatctgatgacactgc

SEQ ID NO: 15554 - DNA, 22 bp, Artificial sequence
  Forward Primer
ctataggctcagtaggacaaag

SEQ ID NO: 15555 - DNA, 27 bp, Artificial sequence
  Forward Primer
aggtttcagataatactttgtcaagaa

SEQ ID NO: 15556 - DNA, 22 bp, Artificial sequence
  Forward Primer
ttactcccacaaacacatcaaa

SEQ ID NO: 15557 - DNA, 24 bp, Artificial sequence
  Forward Primer
ataaaaactctacatgctttgaat

SEQ ID NO: 15558 - DNA, 21 bp, Artificial sequence
  Forward Primer
aatmaaccacgctatttgtgc

SEQ ID NO: 15559 - DNA, 23 bp, Artificial sequence
  Forward Primer
ttctaatattagggccatctcca

SEQ ID NO: 15560 - DNA, 21 bp, Artificial sequence
  Forward Primer
aattcaattcagtggggattt

SEQ ID NO: 15561 - DNA, 24 bp, Artificial sequence
  Forward Primer
aatccaaaactgtcacaaatacct

SEQ ID NO: 15562 - DNA, 26 bp, Artificial sequence
  Forward Primer
aacatccatacaaattttctaaaacc

SEQ ID NO: 15563 - DNA, 20 bp, Artificial sequence
  Forward Primer
tatcaatcctttgaagtgcc

SEQ ID NO: 15564 - DNA, 18 bp, Artificial sequence
  Forward Primer
tcctgaggcccctcctgt

SEQ ID NO: 15565 - DNA, 25 bp, Artificial sequence
  Forward Primer
tttgactgaactraaacacttccta

SEQ ID NO: 15566 - DNA, 23 bp, Artificial sequence
  Forward Primer
attcataacgtatcgtccaaacc

SEQ ID NO: 15567 - DNA, 25 bp, Artificial sequence
  Forward Primer
aaaagtgaacttttcaagcagtagc

SEQ ID NO: 15568 - DNA, 19 bp, Artificial sequence
  Forward Primer
acgtcctgaatatgggctg

SEQ ID NO: 15569 - DNA, 20 bp, Artificial sequence
  Forward Primer
agggtagatgcttctgctgt

SEQ ID NO: 15570 - DNA, 23 bp, Artificial sequence
  Forward Primer
actttgttgttcagatcctttgg

SEQ ID NO: 15571 - DNA, 25 bp, Artificial sequence
  Forward Primer
ctcatctaaggatatggtcatacca

SEQ ID NO: 15572 - DNA, 25 bp, Artificial sequence
  Forward Primer
tttttatttcaaagcacctgtaaag

SEQ ID NO: 15573 - DNA, 25 bp, Artificial sequence
  Forward Primer
actttattcaagaacacatctccaa

SEQ ID NO: 15574 - DNA, 24 bp, Artificial sequence
  Forward Primer
taagccctttacataaagttacat

SEQ ID NO: 15575 - DNA, 30 bp, Artificial sequence
  Forward Primer
ataaaaatacactattacactatagcccat

SEQ ID NO: 15576 - DNA, 26 bp, Artificial sequence
  Forward Primer
ggttcttttttgaccataagaatatt

SEQ ID NO: 15577 - DNA, 20 bp, Artificial sequence
  Forward Primer
ataatccaagtagcacaggg

SEQ ID NO: 15578 - DNA, 28 bp, Artificial sequence
  Forward Primer
acttttagatcacctcttaaatcatttt

SEQ ID NO: 15579 - DNA, 22 bp, Artificial sequence
  Forward Primer
acataaaattgcttccaggatg

SEQ ID NO: 15580 - DNA, 23 bp, Artificial sequence
  Forward Primer
tgtgtcagctaaaaaggagaaga

SEQ ID NO: 15581 - DNA, 20 bp, Artificial sequence
  Forward Primer
ataccttcgctggatcacag

SEQ ID NO: 15582 - DNA, 26 bp, Artificial sequence
  Forward Primer
ttttccacagactcatagatagaaac

SEQ ID NO: 15583 - DNA, 18 bp, Artificial sequence
  Forward Primer
atggaggcttgtygggat

SEQ ID NO: 15584 - DNA, 18 bp, Artificial sequence
  Forward Primer
tcagttggtccacggcag

SEQ ID NO: 15585 - DNA, 23 bp, Artificial sequence
  Forward Primer
atttaataaaggcaactgtgcaa

SEQ ID NO: 15586 - DNA, 19 bp, Artificial sequence
  Forward Primer
tggatcctctcaagcatgc

SEQ ID NO: 15587 - DNA, 22 bp, Artificial sequence
  Forward Primer
agagttctggtgagttacccat

SEQ ID NO: 15588 - DNA, 18 bp, Artificial sequence
  Forward Primer
atcagggtcttggggaca

SEQ ID NO: 15589 - DNA, 25 bp, Artificial sequence
  Forward Primer
tttcacctaaaatctctaccttcaa

SEQ ID NO: 15590 - DNA, 24 bp, Artificial sequence
  Forward Primer
taaaccaaggcatatttagaaagg

SEQ ID NO: 15591 - DNA, 20 bp, Artificial sequence
  Forward Primer
tgcaagacgactccagagtt

SEQ ID NO: 15592 - DNA, 22 bp, Artificial sequence
  Forward Primer
aaaccagagaaaaggttgcttt

SEQ ID NO: 15593 - DNA, 29 bp, Artificial sequence
  Forward Primer
atatttcagattctgtcttcttacagtct

SEQ ID NO: 15594 - DNA, 27 bp, Artificial sequence
  Forward Primer
tttctgaaatcctttagatacctcttt

SEQ ID NO: 15595 - DNA, 23 bp, Artificial sequence
  Forward Primer
agtaactcaagttggttgataga

SEQ ID NO: 15596 - DNA, 25 bp, Artificial sequence
  Forward Primer
aattctgtatttttggccttctaac

SEQ ID NO: 15597 - DNA, 27 bp, Artificial sequence
  Forward Primer
aaaatacagtcatgattctcattatcc

SEQ ID NO: 15598 - DNA, 26 bp, Artificial sequence
  Forward Primer
atatctstggctaattttaccttttc

SEQ ID NO: 15599 - DNA, 27 bp, Artificial sequence
  Forward Primer
tactgaaaggaggtgtatgagtaagtt

SEQ ID NO: 15600 - DNA, 23 bp, Artificial sequence
  Forward Primer
aaagaatcagccatgaatactga

SEQ ID NO: 15601 - DNA, 18 bp, Artificial sequence
  Forward Primer
ttagtgsaggagacggca

SEQ ID NO: 15602 - DNA, 19 bp, Artificial sequence
  Forward Primer
atgaagggctgatcctctc

SEQ ID NO: 15603 - DNA, 24 bp, Artificial sequence
  Forward Primer
atgaataaaacaagtcttccctaa

SEQ ID NO: 15604 - DNA, 25 bp, Artificial sequence
  Forward Primer
ctgttgaatcatttttytttctttg

SEQ ID NO: 15605 - DNA, 24 bp, Artificial sequence
  Forward Primer
tggttcttataaaaagcactgaaa

SEQ ID NO: 15606 - DNA, 27 bp, Artificial sequence
  Forward Primer
ctcaatctacatttttccaactttaag

SEQ ID NO: 15607 - DNA, 19 bp, Artificial sequence
  Forward Primer
atgcaaacgagagagtccc

SEQ ID NO: 15608 - DNA, 19 bp, Artificial sequence
  Forward Primer
gaagtagcacctggcacac

SEQ ID NO: 15609 - DNA, 24 bp, Artificial sequence
  Forward Primer
tgctctccattttacagatgataa

SEQ ID NO: 15610 - DNA, 18 bp, Artificial sequence
  Forward Primer
accactggaagggctgtg

SEQ ID NO: 15611 - DNA, 25 bp, Artificial sequence
  Forward Primer
attcttgtctgagcaataaagtgag

SEQ ID NO: 15612 - DNA, 20 bp, Artificial sequence
  Forward Primer
tcctgtcagccatagttgtc

SEQ ID NO: 15613 - DNA, 26 bp, Artificial sequence
  Forward Primer
aggtgagaattcctagaatcatctat

SEQ ID NO: 15614 - DNA, 22 bp, Artificial sequence
  Forward Primer
aaccctgcagtctctagacctt

SEQ ID NO: 15615 - DNA, 25 bp, Artificial sequence
  Forward Primer
ttctattcagccagttggtacttaa

SEQ ID NO: 15616 - DNA, 23 bp, Artificial sequence
  Forward Primer
tagaacctatgcttcctcacttg

SEQ ID NO: 15617 - DNA, 19 bp, Artificial sequence
  Forward Primer
tatacacatgccctcacgc

SEQ ID NO: 15618 - DNA, 23 bp, Artificial sequence
  Forward Primer
agactgctcatgttcttatccag

SEQ ID NO: 15619 - DNA, 25 bp, Artificial sequence
  Forward Primer
ttctagtttttactgtgtgtggtcc

SEQ ID NO: 15620 - DNA, 19 bp, Artificial sequence
  Forward Primer
aaagaccatagggatggcc

SEQ ID NO: 15621 - DNA, 18 bp, Artificial sequence
  Forward Primer
agcatgaacatgcctcgc

SEQ ID NO: 15622 - DNA, 20 bp, Artificial sequence
  Forward Primer
aatgaccccatttcagaagc

SEQ ID NO: 15623 - DNA, 18 bp, Artificial sequence
  Forward Primer
atctggccctgsagtgaa

SEQ ID NO: 15624 - DNA, 18 bp, Artificial sequence
  Forward Primer
tttgccttgttgcacttg

SEQ ID NO: 15625 - DNA, 18 bp, Artificial sequence
  Forward Primer
tccgaggtgacggggcta

SEQ ID NO: 15626 - DNA, 18 bp, Artificial sequence
  Forward Primer
cgcagccaataccacgtg

SEQ ID NO: 15627 - DNA, 18 bp, Artificial sequence
  Forward Primer
tgcgagggggtgtgttgc

SEQ ID NO: 15628 - DNA, 19 bp, Artificial sequence
  Forward Primer
tgtgtgagtggctgtggtt

SEQ ID NO: 15629 - DNA, 19 bp, Artificial sequence
  Forward Primer
tggggtaagaaggtgcagt

SEQ ID NO: 15630 - DNA, 19 bp, Artificial sequence
  Forward Primer
gggaaactcggaaattctc

SEQ ID NO: 15631 - DNA, 20 bp, Artificial sequence
  Forward Primer
aaagatggcagaagcacaac

SEQ ID NO: 15632 - DNA, 18 bp, Artificial sequence
  Forward Primer
acaaacccaaatgcccag

SEQ ID NO: 15633 - DNA, 28 bp, Artificial sequence
  Forward Primer
agactttaaggatcagaaggtaagtaag

SEQ ID NO: 15634 - DNA, 20 bp, Artificial sequence
  Forward Primer
gagcgtgtggtcttgagatg

SEQ ID NO: 15635 - DNA, 22 bp, Artificial sequence
  Forward Primer
ttctttgtccctgagtgacttc

SEQ ID NO: 15636 - DNA, 19 bp, Artificial sequence
  Forward Primer
ttgtgagatgcagctgtcc

SEQ ID NO: 15637 - DNA, 22 bp, Artificial sequence
  Forward Primer
aaagatgaaggttgctacttgc

SEQ ID NO: 15638 - DNA, 25 bp, Artificial sequence
  Forward Primer
ttcacaaggatttaactcaaaaact

SEQ ID NO: 15639 - DNA, 19 bp, Artificial sequence
  Forward Primer
tcagcaacctggtgtacca

SEQ ID NO: 15640 - DNA, 18 bp, Artificial sequence
  Forward Primer
agttgctgggacatggtg

SEQ ID NO: 15641 - DNA, 19 bp, Artificial sequence
  Forward Primer
atactttgcaaccccatgg

SEQ ID NO: 15642 - DNA, 21 bp, Artificial sequence
  Forward Primer
ttgagatacacgaggctgaac

SEQ ID NO: 15643 - DNA, 23 bp, Artificial sequence
  Forward Primer
atttttctagcctctgctcttct

SEQ ID NO: 15644 - DNA, 23 bp, Artificial sequence
  Forward Primer
atgagattgataactgaggtcaa

SEQ ID NO: 15645 - DNA, 24 bp, Artificial sequence
  Forward Primer
tcaggcagttactattaccaagag

SEQ ID NO: 15646 - DNA, 24 bp, Artificial sequence
  Forward Primer
tttgggactctaaaggaaattaag

SEQ ID NO: 15647 - DNA, 27 bp, Artificial sequence
  Forward Primer
aaacattagaaaaagtacaggtgaaca

SEQ ID NO: 15648 - DNA, 22 bp, Artificial sequence
  Forward Primer
tgaagggtaaagaatgaaagaa

SEQ ID NO: 15649 - DNA, 24 bp, Artificial sequence
  Forward Primer
atcatgatctttttttctgttagt

SEQ ID NO: 15650 - DNA, 20 bp, Artificial sequence
  Forward Primer
tgattgacctgtccattcaa

SEQ ID NO: 15651 - DNA, 28 bp, Artificial sequence
  Forward Primer
aaaactaaagatgcttctatagctcata

SEQ ID NO: 15652 - DNA, 26 bp, Artificial sequence
  Forward Primer
ttttctcagttgctattaatttttgc

SEQ ID NO: 15653 - DNA, 26 bp, Artificial sequence
  Forward Primer
aaatcctgagagcaatcttataaaag

SEQ ID NO: 15654 - DNA, 19 bp, Artificial sequence
  Forward Primer
araagcaatccaaagcctc

SEQ ID NO: 15655 - DNA, 26 bp, Artificial sequence
  Forward Primer
ttatggagagatgaatgtgaactaag

SEQ ID NO: 15656 - DNA, 23 bp, Artificial sequence
  Forward Primer
atggaatcaaagaccatgtgtac

SEQ ID NO: 15657 - DNA, 24 bp, Artificial sequence
  Forward Primer
aggaggatatccctgatctttaac

SEQ ID NO: 15658 - DNA, 22 bp, Artificial sequence
  Forward Primer
acasacagcaatgctagaaagc

SEQ ID NO: 15659 - DNA, 21 bp, Artificial sequence
  Forward Primer
aatttcaacaaagctcccatt

SEQ ID NO: 15660 - DNA, 26 bp, Artificial sequence
  Forward Primer
tttataaatgatttttcctccaagtc

SEQ ID NO: 15661 - DNA, 20 bp, Artificial sequence
  Forward Primer
taggcagtcaggaaggactg

SEQ ID NO: 15662 - DNA, 24 bp, Artificial sequence
  Forward Primer
atttaatgttggtcaggtaatcca

SEQ ID NO: 15663 - DNA, 24 bp, Artificial sequence
  Forward Primer
taatcctgacgatacatgaaaatc

SEQ ID NO: 15664 - DNA, 19 bp, Artificial sequence
  Forward Primer
atgcaaacccacagatttg

SEQ ID NO: 15665 - DNA, 24 bp, Artificial sequence
  Forward Primer
aaatgaaaacatggtacttccttg

SEQ ID NO: 15666 - DNA, 27 bp, Artificial sequence
  Forward Primer
ttaaaattaggatttggatacgtaatg

SEQ ID NO: 15667 - DNA, 30 bp, Artificial sequence
  Forward Primer
attatatattcaggattctaagctctgttt

SEQ ID NO: 15668 - DNA, 20 bp, Artificial sequence
  Forward Primer
ataggcaactaagaatgctg

SEQ ID NO: 15669 - DNA, 24 bp, Artificial sequence
  Forward Primer
ttatttcttagcagcctgaaagac

SEQ ID NO: 15670 - DNA, 20 bp, Artificial sequence
  Forward Primer
tgaatgacacctgtcccttc

SEQ ID NO: 15671 - DNA, 30 bp, Artificial sequence
  Forward Primer
ttaaaatatctcagtatcttccttttctac

SEQ ID NO: 15672 - DNA, 27 bp, Artificial sequence
  Forward Primer
taaagatttaggggaactcagtgtata

SEQ ID NO: 15673 - DNA, 25 bp, Artificial sequence
  Forward Primer
ataattttgttttcaaaagggagag

SEQ ID NO: 15674 - DNA, 27 bp, Artificial sequence
  Forward Primer
caggtgaaatttaaatgaagtaacatt

SEQ ID NO: 15675 - DNA, 28 bp, Artificial sequence
  Forward Primer
ccaatgcattagtaaaattaaatagtga

SEQ ID NO: 15676 - DNA, 24 bp, Artificial sequence
  Forward Primer
acagagaaaggaatatagtggcag

SEQ ID NO: 15677 - DNA, 25 bp, Artificial sequence
  Forward Primer
atgcagtgcaaatgtgtataaagta

SEQ ID NO: 15678 - DNA, 19 bp, Artificial sequence
  Forward Primer
ctctacatgggtgggatgt

SEQ ID NO: 15679 - DNA, 20 bp, Artificial sequence
  Forward Primer
tgtcttgatcatgaaaggcc

SEQ ID NO: 15680 - DNA, 23 bp, Artificial sequence
  Forward Primer
attccaataaaggacgaagaaat

SEQ ID NO: 15681 - DNA, 18 bp, Artificial sequence
  Forward Primer
agattttggaggcatggg

SEQ ID NO: 15682 - DNA, 25 bp, Artificial sequence
  Forward Primer
agtgagtagctaaatgtccttcatg

SEQ ID NO: 15683 - DNA, 28 bp, Artificial sequence
  Forward Primer
tatattcatatacaatttgattcacgtc

SEQ ID NO: 15684 - DNA, 20 bp, Artificial sequence
  Forward Primer
tacagatgagggcacattag

SEQ ID NO: 15685 - DNA, 21 bp, Artificial sequence
  Forward Primer
tacctatctgtggttgcgatc

SEQ ID NO: 15686 - DNA, 21 bp, Artificial sequence
  Forward Primer
atttgaacacagaatgtggcc

SEQ ID NO: 15687 - DNA, 27 bp, Artificial sequence
  Forward Primer
ttctggttcaagataagagtaatctag

SEQ ID NO: 15688 - DNA, 23 bp, Artificial sequence
  Forward Primer
tggctggatatctttagctctaa

SEQ ID NO: 15689 - DNA, 21 bp, Artificial sequence
  Forward Primer
tcggagtccataaaaataatg

SEQ ID NO: 15690 - DNA, 23 bp, Artificial sequence
  Forward Primer
aataagatgcgtggctagacttt

SEQ ID NO: 15691 - DNA, 28 bp, Artificial sequence
  Forward Primer
atatagtccggatttctatgttaactct

SEQ ID NO: 15692 - DNA, 25 bp, Artificial sequence
  Forward Primer
tatttcaaatgtgaagacagaaaag

SEQ ID NO: 15693 - DNA, 28 bp, Artificial sequence
  Forward Primer
accttattggtagaacaaaaactaaaac

SEQ ID NO: 15694 - DNA, 20 bp, Artificial sequence
  Forward Primer
ttcatttctcgacaccagtg

SEQ ID NO: 15695 - DNA, 24 bp, Artificial sequence
  Forward Primer
ttagtccttgtagagacacatggc

SEQ ID NO: 15696 - DNA, 27 bp, Artificial sequence
  Forward Primer
cagaagctacttcattagaatctagga

SEQ ID NO: 15697 - DNA, 20 bp, Artificial sequence
  Forward Primer
aaaaaactagcyccagggaa

SEQ ID NO: 15698 - DNA, 23 bp, Artificial sequence
  Forward Primer
ttattttcatgttcttaggggag

SEQ ID NO: 15699 - DNA, 27 bp, Artificial sequence
  Forward Primer
ttttatattgtccattactctgcacta

SEQ ID NO: 15700 - DNA, 26 bp, Artificial sequence
  Forward Primer
ctaggagatttattgcattatgaaca

SEQ ID NO: 15701 - DNA, 18 bp, Artificial sequence
  Forward Primer
aaggggtgggggtagaag

SEQ ID NO: 15702 - DNA, 19 bp, Artificial sequence
  Forward Primer
gccacaggaaaaatgatcc

SEQ ID NO: 15703 - DNA, 21 bp, Artificial sequence
  Forward Primer
tactgaacccatctgtcttgc

SEQ ID NO: 15704 - DNA, 24 bp, Artificial sequence
  Forward Primer
atgtacatgcagagtaacatcacc

SEQ ID NO: 15705 - DNA, 25 bp, Artificial sequence
  Forward Primer
ccagggaagctctagatttttataa

SEQ ID NO: 15706 - DNA, 23 bp, Artificial sequence
  Forward Primer
aacacttatcacatcctaggcac

SEQ ID NO: 15707 - DNA, 22 bp, Artificial sequence
  Forward Primer
attacttcccttcttacgggtc

SEQ ID NO: 15708 - DNA, 24 bp, Artificial sequence
  Forward Primer
attttggatggtctgaactttagt

SEQ ID NO: 15709 - DNA, 24 bp, Artificial sequence
  Forward Primer
aattcaatcaaatgtcaaaatgtg

SEQ ID NO: 15710 - DNA, 21 bp, Artificial sequence
  Forward Primer
aaaatgatcaccacatggaga

SEQ ID NO: 15711 - DNA, 24 bp, Artificial sequence
  Forward Primer
aacagcattaatggaagtgattag

SEQ ID NO: 15712 - DNA, 24 bp, Artificial sequence
  Forward Primer
agatttacgttattttaattggca

SEQ ID NO: 15713 - DNA, 29 bp, Artificial sequence
  Forward Primer
ttgtcatatgtattactgtttccataagt

SEQ ID NO: 15714 - DNA, 30 bp, Artificial sequence
  Forward Primer
caatattattaagcattatatgtacacaca

SEQ ID NO: 15715 - DNA, 20 bp, Artificial sequence
  Forward Primer
attggcttcatgttgttcat

SEQ ID NO: 15716 - DNA, 23 bp, Artificial sequence
  Forward Primer
attttcaagtgaaattgatgctc

SEQ ID NO: 15717 - DNA, 20 bp, Artificial sequence
  Forward Primer
agagacatactcccaaagcc

SEQ ID NO: 15718 - DNA, 29 bp, Artificial sequence
  Forward Primer
aataagatagaagcttatttctcttcctt

SEQ ID NO: 15719 - DNA, 18 bp, Artificial sequence
  Forward Primer
tggtctcccgaggcagag

SEQ ID NO: 15720 - DNA, 18 bp, Artificial sequence
  Forward Primer
cacacatgcgcagaaagg

SEQ ID NO: 15721 - DNA, 24 bp, Artificial sequence
  Forward Primer
aatttacctttgattcgtttcact

SEQ ID NO: 15722 - DNA, 25 bp, Artificial sequence
  Forward Primer
agtccatgtgctttcagtatacatt

SEQ ID NO: 15723 - DNA, 24 bp, Artificial sequence
  Forward Primer
aattactagttgtccctgttgagg

SEQ ID NO: 15724 - DNA, 28 bp, Artificial sequence
  Forward Primer
atagcaaggaagatattacaacatatca

SEQ ID NO: 15725 - DNA, 20 bp, Artificial sequence
  Forward Primer
aatccgagtccatcactcac

SEQ ID NO: 15726 - DNA, 20 bp, Artificial sequence
  Forward Primer
ataaaaggcacatgtgggtg

SEQ ID NO: 15727 - DNA, 21 bp, Artificial sequence
  Forward Primer
aagggaagaattcacagatcg

SEQ ID NO: 15728 - DNA, 23 bp, Artificial sequence
  Forward Primer
ttttctttctcccttgatgtctt

SEQ ID NO: 15729 - DNA, 19 bp, Artificial sequence
  Forward Primer
cttgggtgaagygtggtac

SEQ ID NO: 15730 - DNA, 18 bp, Artificial sequence
  Forward Primer
agccgacctggttcacac

SEQ ID NO: 15731 - DNA, 18 bp, Artificial sequence
  Forward Primer
aggctctgcacctggact

SEQ ID NO: 15732 - DNA, 19 bp, Artificial sequence
  Forward Primer
ttccagaggaggcagaaat

SEQ ID NO: 15733 - DNA, 18 bp, Artificial sequence
  Forward Primer
gggactgacgcaccctta

SEQ ID NO: 15734 - DNA, 27 bp, Artificial sequence
  Forward Primer
attagaaacactcaacacaaagaaatc

SEQ ID NO: 15735 - DNA, 18 bp, Artificial sequence
  Forward Primer
tggtctggccctgtgcat

SEQ ID NO: 15736 - DNA, 29 bp, Artificial sequence
  Forward Primer
aatactatgtccctagaaaatataaacgc

SEQ ID NO: 15737 - DNA, 22 bp, Artificial sequence
  Forward Primer
aaaattctgtgctgttccttcc

SEQ ID NO: 15738 - DNA, 27 bp, Artificial sequence
  Forward Primer
ttacagagctttctatacacagacagg

SEQ ID NO: 15739 - DNA, 18 bp, Artificial sequence
  Forward Primer
tctgggtgcagagacccg

SEQ ID NO: 15740 - DNA, 21 bp, Artificial sequence
  Forward Primer
ttctcacatgaggaactttgc

SEQ ID NO: 15741 - DNA, 25 bp, Artificial sequence
  Forward Primer
tgatcttgaaagtacataccctgtt

SEQ ID NO: 15742 - DNA, 25 bp, Artificial sequence
  Forward Primer
ttattggacctgagttgtaagatca

SEQ ID NO: 15743 - DNA, 18 bp, Artificial sequence
  Forward Primer
tccacagggcaaggctag

SEQ ID NO: 15744 - DNA, 25 bp, Artificial sequence
  Forward Primer
atttttcttgactcaacagactctc

SEQ ID NO: 15745 - DNA, 28 bp, Artificial sequence
  Forward Primer
atgtctttctaatacttgctaagtgagg

SEQ ID NO: 15746 - DNA, 18 bp, Artificial sequence
  Forward Primer
ctctcctggctcgccttg

SEQ ID NO: 15747 - DNA, 18 bp, Artificial sequence
  Forward Primer
ttgggtgctggggttgcc

SEQ ID NO: 15748 - DNA, 18 bp, Artificial sequence
  Forward Primer
ttgcctggtttcatggct

SEQ ID NO: 15749 - DNA, 30 bp, Artificial sequence
  Forward Primer
ataaaaatacattataaagtggttgagaga

SEQ ID NO: 15750 - DNA, 20 bp, Artificial sequence
  Forward Primer
taggagctgtgggaaaactg

SEQ ID NO: 15751 - DNA, 18 bp, Artificial sequence
  Forward Primer
aaccygcactccctgcat

SEQ ID NO: 15752 - DNA, 25 bp, Artificial sequence
  Forward Primer
tcttgttgtatgtcttaaccactgg

SEQ ID NO: 15753 - DNA, 20 bp, Artificial sequence
  Forward Primer
ttgaaattctgctttgcctc

SEQ ID NO: 15754 - DNA, 20 bp, Artificial sequence
  Forward Primer
acacatgtctcctcacagct

SEQ ID NO: 15755 - DNA, 18 bp, Artificial sequence
  Forward Primer
gcttggggtggattcagt

SEQ ID NO: 15756 - DNA, 26 bp, Artificial sequence
  Forward Primer
tttaaagtatagctgaaaccctacca

SEQ ID NO: 15757 - DNA, 18 bp, Artificial sequence
  Forward Primer
agttcgggcagctcaccg

SEQ ID NO: 15758 - DNA, 20 bp, Artificial sequence
  Forward Primer
tctgtgatggaccactgagc

SEQ ID NO: 15759 - DNA, 21 bp, Artificial sequence
  Forward Primer
tagttctgttttctgggcctt

SEQ ID NO: 15760 - DNA, 22 bp, Artificial sequence
  Forward Primer
agaaacacaagggtctgtatgc

SEQ ID NO: 15761 - DNA, 18 bp, Artificial sequence
  Forward Primer
actcagggacccgactgg

SEQ ID NO: 15762 - DNA, 30 bp, Artificial sequence
  Forward Primer
aaataatatactaaacagacawacagcacc

SEQ ID NO: 15763 - DNA, 23 bp, Artificial sequence
  Forward Primer
tttctataatagcyttggtccca

SEQ ID NO: 15764 - DNA, 20 bp, Artificial sequence
  Forward Primer
tcatccatgaaagaggaagg

SEQ ID NO: 15765 - DNA, 18 bp, Artificial sequence
  Forward Primer
gtggggggcagttccaag

SEQ ID NO: 15766 - DNA, 27 bp, Artificial sequence
  Forward Primer
atatattaggagtggagaatcagaatg

SEQ ID NO: 15767 - DNA, 18 bp, Artificial sequence
  Forward Primer
acgaacacggtcatacgc

SEQ ID NO: 15768 - DNA, 25 bp, Artificial sequence
  Forward Primer
ataatccaagttacatcatccttcc

SEQ ID NO: 15769 - DNA, 22 bp, Artificial sequence
  Forward Primer
tttcaatttatgaacgatctct

SEQ ID NO: 15770 - DNA, 19 bp, Artificial sequence
  Forward Primer
atttcaccattgcttcctg

SEQ ID NO: 15771 - DNA, 22 bp, Artificial sequence
  Forward Primer
aaaaaatacagcccactctgtg

SEQ ID NO: 15772 - DNA, 22 bp, Artificial sequence
  Forward Primer
caagtctccagctcactttctc

SEQ ID NO: 15773 - DNA, 18 bp, Artificial sequence
  Forward Primer
accgtgcatttccagtgc

SEQ ID NO: 15774 - DNA, 23 bp, Artificial sequence
  Forward Primer
tttgatgacaatccattcaactt

SEQ ID NO: 15775 - DNA, 18 bp, Artificial sequence
  Forward Primer
agcctctcctgcaattcc

SEQ ID NO: 15776 - DNA, 23 bp, Artificial sequence
  Forward Primer
aacaacttctgcctgtaattcct

SEQ ID NO: 15777 - DNA, 20 bp, Artificial sequence
  Forward Primer
tgttctgaggcccagatatg

SEQ ID NO: 15778 - DNA, 24 bp, Artificial sequence
  Forward Primer
aaaragtattcaaatcagtccagg

SEQ ID NO: 15779 - DNA, 18 bp, Artificial sequence
  Forward Primer
agcccctgatggcccttc

SEQ ID NO: 15780 - DNA, 25 bp, Artificial sequence
  Forward Primer
atgctcctcttaaaaaatmattgaa

SEQ ID NO: 15781 - DNA, 25 bp, Artificial sequence
  Forward Primer
cacttttctcttactgctttcaaga

SEQ ID NO: 15782 - DNA, 19 bp, Artificial sequence
  Forward Primer
aaaaccacacacacgcatt

SEQ ID NO: 15783 - DNA, 27 bp, Artificial sequence
  Forward Primer
atatttgtctttgtgactttctctctc

SEQ ID NO: 15784 - DNA, 20 bp, Artificial sequence
  Forward Primer
acacaggagaaaatgtccca

SEQ ID NO: 15785 - DNA, 24 bp, Artificial sequence
  Forward Primer
agaagcaaataattcatttccagt

SEQ ID NO: 15786 - DNA, 21 bp, Artificial sequence
  Forward Primer
agtttctaccagtggttacgt

SEQ ID NO: 15787 - DNA, 20 bp, Artificial sequence
  Forward Primer
tttgcagaagcctaaggagt

SEQ ID NO: 15788 - DNA, 21 bp, Artificial sequence
  Forward Primer
cggtcagaagctcttaagtcg

SEQ ID NO: 15789 - DNA, 21 bp, Artificial sequence
  Forward Primer
ttatagggtctttcccctgaa

SEQ ID NO: 15790 - DNA, 19 bp, Artificial sequence
  Forward Primer
ccaataagcaactcaggag

SEQ ID NO: 15791 - DNA, 21 bp, Artificial sequence
  Forward Primer
ttttctgggtcttctctgtcc

SEQ ID NO: 15792 - DNA, 23 bp, Artificial sequence
  Forward Primer
ttcagaaagctgaaactcacatt

SEQ ID NO: 15793 - DNA, 21 bp, Artificial sequence
  Forward Primer
ttcagactcaaatgctaagcc

SEQ ID NO: 15794 - DNA, 20 bp, Artificial sequence
  Forward Primer
gagctaggagaggaggaaga

SEQ ID NO: 15795 - DNA, 22 bp, Artificial sequence
  Forward Primer
agcccctagtacccactaatct

SEQ ID NO: 15796 - DNA, 18 bp, Artificial sequence
  Forward Primer
atccagggagtgtcggcc

SEQ ID NO: 15797 - DNA, 22 bp, Artificial sequence
  Forward Primer
taaagtcagagtagacacgggc

SEQ ID NO: 15798 - DNA, 25 bp, Artificial sequence
  Forward Primer
ataaattttaaaaaaccctccaagc

SEQ ID NO: 15799 - DNA, 20 bp, Artificial sequence
  Forward Primer
aaatttcagccaagcctaca

SEQ ID NO: 15800 - DNA, 29 bp, Artificial sequence
  Forward Primer
atacaacttatcaactagacaacaacaac

SEQ ID NO: 15801 - DNA, 23 bp, Artificial sequence
  Forward Primer
tgcattcctaagtgatgaatacc

SEQ ID NO: 15802 - DNA, 20 bp, Artificial sequence
  Forward Primer
gaaataagtcaggtgtgtgg

SEQ ID NO: 15803 - DNA, 29 bp, Artificial sequence
  Forward Primer
ccaaagacaataaagtaaatgaatatctg

SEQ ID NO: 15804 - DNA, 20 bp, Artificial sequence
  Forward Primer
atttccaaatccatgctcct

SEQ ID NO: 15805 - DNA, 18 bp, Artificial sequence
  Forward Primer
agcctaaggtggggaaca

SEQ ID NO: 15806 - DNA, 21 bp, Artificial sequence
  Forward Primer
atttgagcatttgaggattcc

SEQ ID NO: 15807 - DNA, 24 bp, Artificial sequence
  Forward Primer
cttggctgtattatactcaagcag

SEQ ID NO: 15808 - DNA, 24 bp, Artificial sequence
  Forward Primer
attttctatttgcttgactttttg

SEQ ID NO: 15809 - DNA, 24 bp, Artificial sequence
  Forward Primer
tttattgacaaaagccaaatatgg

SEQ ID NO: 15810 - DNA, 23 bp, Artificial sequence
  Forward Primer
ttaaaaagttgcttagatgcagc

SEQ ID NO: 15811 - DNA, 28 bp, Artificial sequence
  Forward Primer
tattaattgtggacagtttttaattgag

SEQ ID NO: 15812 - DNA, 28 bp, Artificial sequence
  Forward Primer
aaacgtaaaaatatctatcattgactga

SEQ ID NO: 15813 - DNA, 26 bp, Artificial sequence
  Forward Primer
cttcctaacatcaagttacctagagg

SEQ ID NO: 15814 - DNA, 20 bp, Artificial sequence
  Forward Primer
acaacacatcttgtggttgg

SEQ ID NO: 15815 - DNA, 20 bp, Artificial sequence
  Forward Primer
aaaaacaagtcctcacgctt

SEQ ID NO: 15816 - DNA, 30 bp, Artificial sequence
  Forward Primer
ggttattgttaattagttttacttttccta

SEQ ID NO: 15817 - DNA, 20 bp, Artificial sequence
  Forward Primer
tggttaatggcttctctgca

SEQ ID NO: 15818 - DNA, 30 bp, Artificial sequence
  Forward Primer
attattcaagatactataagaagcagttct

SEQ ID NO: 15819 - DNA, 28 bp, Artificial sequence
  Forward Primer
tgattagcagtaatgaaaagtttatagc

SEQ ID NO: 15820 - DNA, 30 bp, Artificial sequence
  Forward Primer
agaataatagtgttactgaataaaacaaga

SEQ ID NO: 15821 - DNA, 21 bp, Artificial sequence
  Forward Primer
cggtttttcagtactttgctc

SEQ ID NO: 15822 - DNA, 25 bp, Artificial sequence
  Forward Primer
attatcttggaacgaggtagtatgg

SEQ ID NO: 15823 - DNA, 25 bp, Artificial sequence
  Forward Primer
agtttacaaagtgcttttaattggg

SEQ ID NO: 15824 - DNA, 19 bp, Artificial sequence
  Forward Primer
attgggggaaatgaaggtt

SEQ ID NO: 15825 - DNA, 20 bp, Artificial sequence
  Forward Primer
atttctctccttcacccacg

SEQ ID NO: 15826 - DNA, 22 bp, Artificial sequence
  Forward Primer
taaagccctatttctggacttg

SEQ ID NO: 15827 - DNA, 19 bp, Artificial sequence
  Forward Primer
aaaattcctgctctgccac

SEQ ID NO: 15828 - DNA, 20 bp, Artificial sequence
  Forward Primer
ttgggctgattcaaacctag

SEQ ID NO: 15829 - DNA, 20 bp, Artificial sequence
  Forward Primer
ggtggaaagtgcatgattat

SEQ ID NO: 15830 - DNA, 28 bp, Artificial sequence
  Forward Primer
aatatgagctccagttctaaactttatg

SEQ ID NO: 15831 - DNA, 19 bp, Artificial sequence
  Forward Primer
ctctgcctcttttgacgtg

SEQ ID NO: 15832 - DNA, 23 bp, Artificial sequence
  Forward Primer
atgagatgccattgtctaaaatc

SEQ ID NO: 15833 - DNA, 30 bp, Artificial sequence
  Forward Primer
atttggtatacagcaatagataattaacac

SEQ ID NO: 15834 - DNA, 24 bp, Artificial sequence
  Forward Primer
aaagcacactgcaatgtataaatg

SEQ ID NO: 15835 - DNA, 22 bp, Artificial sequence
  Forward Primer
aaggtgtggtgatatccacagt

SEQ ID NO: 15836 - DNA, 26 bp, Artificial sequence
  Forward Primer
atgagttagctctcttgtcaaaattc

SEQ ID NO: 15837 - DNA, 20 bp, Artificial sequence
  Forward Primer
tgggacattctcaacctagc

SEQ ID NO: 15838 - DNA, 23 bp, Artificial sequence
  Forward Primer
attcatcagtagctttggtgaca

SEQ ID NO: 15839 - DNA, 22 bp, Artificial sequence
  Forward Primer
atgatgtatctgaaactgccct

SEQ ID NO: 15840 - DNA, 18 bp, Artificial sequence
  Forward Primer
gaaaacctgccctaccca

SEQ ID NO: 15841 - DNA, 24 bp, Artificial sequence
  Forward Primer
ttttaatgcaggtttgacatctta

SEQ ID NO: 15842 - DNA, 27 bp, Artificial sequence
  Forward Primer
aatttctgtaacacagtaactacaccc

SEQ ID NO: 15843 - DNA, 20 bp, Artificial sequence
  Forward Primer
tgtttctcgaattcagtctc

SEQ ID NO: 15844 - DNA, 23 bp, Artificial sequence
  Forward Primer
acagagtccctgtttctgtttag

SEQ ID NO: 15845 - DNA, 28 bp, Artificial sequence
  Forward Primer
ttggtaagcttaaataatcttaggatct

SEQ ID NO: 15846 - DNA, 27 bp, Artificial sequence
  Forward Primer
gctatttcaagctaacaaaaatctaca

SEQ ID NO: 15847 - DNA, 30 bp, Artificial sequence
  Forward Primer
tagttaccaatttgctactactgtattaaa

SEQ ID NO: 15848 - DNA, 26 bp, Artificial sequence
  Forward Primer
atatgaggatgattgtaatcacttgg

SEQ ID NO: 15849 - DNA, 21 bp, Artificial sequence
  Forward Primer
aaaatgtctgggatctatgcc

SEQ ID NO: 15850 - DNA, 26 bp, Artificial sequence
  Forward Primer
taatacttgtagcttcaggaaattga

SEQ ID NO: 15851 - DNA, 25 bp, Artificial sequence
  Forward Primer
tatttgtgaagaaataccaacctca

SEQ ID NO: 15852 - DNA, 24 bp, Artificial sequence
  Forward Primer
tacaaataccaattcatgctttcc

SEQ ID NO: 15853 - DNA, 21 bp, Artificial sequence
  Forward Primer
tatgtgaccttacrtggcaaa

SEQ ID NO: 15854 - DNA, 29 bp, Artificial sequence
  Forward Primer
tttgagacttaaatgatattagtttcctc

SEQ ID NO: 15855 - DNA, 27 bp, Artificial sequence
  Forward Primer
taacagaaggatgaggtaagtataagg

SEQ ID NO: 15856 - DNA, 26 bp, Artificial sequence
  Forward Primer
atacatttagctgattcactttgttg

SEQ ID NO: 15857 - DNA, 28 bp, Artificial sequence
  Forward Primer
tataacaatttaatgtttaacctttccc

SEQ ID NO: 15858 - DNA, 25 bp, Artificial sequence
  Forward Primer
aatgagacatttgaaactatctgga

SEQ ID NO: 15859 - DNA, 20 bp, Artificial sequence
  Forward Primer
atgattaacatcgcaatccc

SEQ ID NO: 15860 - DNA, 18 bp, Artificial sequence
  Forward Primer
tcaccccagctactgctg

SEQ ID NO: 15861 - DNA, 23 bp, Artificial sequence
  Forward Primer
atcccagaataagtttggacagt

SEQ ID NO: 15862 - DNA, 25 bp, Artificial sequence
  Forward Primer
aatcagactcagagcaagtagactc

SEQ ID NO: 15863 - DNA, 18 bp, Artificial sequence
  Forward Primer
tgggaaagccatcaaccc

SEQ ID NO: 15864 - DNA, 18 bp, Artificial sequence
  Forward Primer
aaaggcccgtctctgctc

SEQ ID NO: 15865 - DNA, 24 bp, Artificial sequence
  Forward Primer
aagagaggaagtgcttatctcatg

SEQ ID NO: 15866 - DNA, 26 bp, Artificial sequence
  Forward Primer
aaacagataatgagagagtgggatat

SEQ ID NO: 15867 - DNA, 24 bp, Artificial sequence
  Forward Primer
ctttccactcaagtgtgtcataaa

SEQ ID NO: 15868 - DNA, 24 bp, Artificial sequence
  Forward Primer
ttcagtatgagaatcgtactggtg

SEQ ID NO: 15869 - DNA, 23 bp, Artificial sequence
  Forward Primer
atactttggggatttttatggtg

SEQ ID NO: 15870 - DNA, 20 bp, Artificial sequence
  Forward Primer
tctacaatgattgggatgga

SEQ ID NO: 15871 - DNA, 24 bp, Artificial sequence
  Forward Primer
agaaatgaaagagtcatccttgat

SEQ ID NO: 15872 - DNA, 20 bp, Artificial sequence
  Forward Primer
aatgtcgagtttatgccgag

SEQ ID NO: 15873 - DNA, 23 bp, Artificial sequence
  Forward Primer
ttttattagcaatcaactctgcc

SEQ ID NO: 15874 - DNA, 25 bp, Artificial sequence
  Forward Primer
tactcagtccactatctgctttttt

SEQ ID NO: 15875 - DNA, 25 bp, Artificial sequence
  Forward Primer
aagaggaacactcacacatgttatt

SEQ ID NO: 15876 - DNA, 21 bp, Artificial sequence
  Forward Primer
tttaaatgcaaattccatcca

SEQ ID NO: 15877 - DNA, 19 bp, Artificial sequence
  Forward Primer
ataagaagtcattgcccgc

SEQ ID NO: 15878 - DNA, 21 bp, Artificial sequence
  Forward Primer
agtgaagggcttgckaactaa

SEQ ID NO: 15879 - DNA, 20 bp, Artificial sequence
  Forward Primer
ttcagatccgagaccaaaag

SEQ ID NO: 15880 - DNA, 25 bp, Artificial sequence
  Forward Primer
aaaatggtatgaagtgcttagatca

SEQ ID NO: 15881 - DNA, 22 bp, Artificial sequence
  Forward Primer
aagttctcaaacagtcctgagc

SEQ ID NO: 15882 - DNA, 21 bp, Artificial sequence
  Forward Primer
tatactgttggagcccagaaa

SEQ ID NO: 15883 - DNA, 20 bp, Artificial sequence
  Forward Primer
cagaactggatttgaaccca

SEQ ID NO: 15884 - DNA, 22 bp, Artificial sequence
  Forward Primer
tattgataaaatgcagacaggg

SEQ ID NO: 15885 - DNA, 25 bp, Artificial sequence
  Forward Primer
aacttaccttcttgagtttcttggt

SEQ ID NO: 15886 - DNA, 19 bp, Artificial sequence
  Forward Primer
tgagtgttcctgtggaagg

SEQ ID NO: 15887 - DNA, 19 bp, Artificial sequence
  Forward Primer
tcactcaggcttgaccatg

SEQ ID NO: 15888 - DNA, 19 bp, Artificial sequence
  Forward Primer
cctgcaagaggaagaaata

SEQ ID NO: 15889 - DNA, 18 bp, Artificial sequence
  Forward Primer
acctctgcagggccttcc

SEQ ID NO: 15890 - DNA, 18 bp, Artificial sequence
  Forward Primer
aacccagccaagggcaga

SEQ ID NO: 15891 - DNA, 18 bp, Artificial sequence
  Forward Primer
atgggcaggagtgagggg

SEQ ID NO: 15892 - DNA, 19 bp, Artificial sequence
  Forward Primer
gactgtgggtaaacacgca

SEQ ID NO: 15893 - DNA, 21 bp, Artificial sequence
  Forward Primer
tagggagctcttgtcctaaga

SEQ ID NO: 15894 - DNA, 18 bp, Artificial sequence
  Forward Primer
ctcccagacctctgatgg

SEQ ID NO: 15895 - DNA, 22 bp, Artificial sequence
  Forward Primer
attagtgtcagcatggaagctg

SEQ ID NO: 15896 - DNA, 18 bp, Artificial sequence
  Forward Primer
gctggctcctaacctcca

SEQ ID NO: 15897 - DNA, 28 bp, Artificial sequence
  Forward Primer
tttagagaccaaaataacatataaacca

SEQ ID NO: 15898 - DNA, 30 bp, Artificial sequence
  Forward Primer
cacagttttataggttaacacaatgtaata

SEQ ID NO: 15899 - DNA, 25 bp, Artificial sequence
  Forward Primer
tttcctgaagctcataaagttaaca

SEQ ID NO: 15900 - DNA, 29 bp, Artificial sequence
  Forward Primer
ataacactgttctctttatttcacttagc

SEQ ID NO: 15901 - DNA, 22 bp, Artificial sequence
  Forward Primer
taattgaatgttttgccgtttt

SEQ ID NO: 15902 - DNA, 28 bp, Artificial sequence
  Forward Primer
taaatacatgtaaccaaatcacttttct

SEQ ID NO: 15903 - DNA, 29 bp, Artificial sequence
  Forward Primer
tggagtaagattaataaatccttkaaagt

SEQ ID NO: 15904 - DNA, 22 bp, Artificial sequence
  Forward Primer
aggagtgacaaaactgctcttc

SEQ ID NO: 15905 - DNA, 23 bp, Artificial sequence
  Forward Primer
caactagctgcagaaaaacaagt

SEQ ID NO: 15906 - DNA, 30 bp, Artificial sequence
  Forward Primer
ttaccctcatatattatgtctttatatttc

SEQ ID NO: 15907 - DNA, 25 bp, Artificial sequence
  Forward Primer
aaacctgtactttgattactgatgg

SEQ ID NO: 15908 - DNA, 19 bp, Artificial sequence
  Forward Primer
ttggaagtcactgcctttg

SEQ ID NO: 15909 - DNA, 22 bp, Artificial sequence
  Forward Primer
agtgatgtcatccaaccatctc

SEQ ID NO: 15910 - DNA, 18 bp, Artificial sequence
  Forward Primer
atgaatcagatgccgcaa

SEQ ID NO: 15911 - DNA, 19 bp, Artificial sequence
  Forward Primer
aagcggtatctgaaggctg

SEQ ID NO: 15912 - DNA, 21 bp, Artificial sequence
  Forward Primer
aaacacacgagcagatttctc

SEQ ID NO: 15913 - DNA, 25 bp, Artificial sequence
  Forward Primer
ggtaagcagacagaaagataaacag

SEQ ID NO: 15914 - DNA, 30 bp, Artificial sequence
  Forward Primer
ctgttagttaatttatttctgttttagtca

SEQ ID NO: 15915 - DNA, 24 bp, Artificial sequence
  Forward Primer
attaaaatgtgttactggtttcaa

SEQ ID NO: 15916 - DNA, 22 bp, Artificial sequence
  Forward Primer
aaaggtaagaggggtcaaagtt

SEQ ID NO: 15917 - DNA, 22 bp, Artificial sequence
  Forward Primer
ggcctcaggacatttagaattt

SEQ ID NO: 15918 - DNA, 24 bp, Artificial sequence
  Forward Primer
tggatttttcttttcttttctttg

SEQ ID NO: 15919 - DNA, 30 bp, Artificial sequence
  Forward Primer
taatttacactgaataagaatacaagttac

SEQ ID NO: 15920 - DNA, 18 bp, Artificial sequence
  Forward Primer
attgtcagccacgctcag

SEQ ID NO: 15921 - DNA, 23 bp, Artificial sequence
  Forward Primer
tttaacacagaagctcagcagtt

SEQ ID NO: 15922 - DNA, 27 bp, Artificial sequence
  Forward Primer
tttttagccaggtttttatacagtaga

SEQ ID NO: 15923 - DNA, 25 bp, Artificial sequence
  Forward Primer
ttaaactttttttcccctattcact

SEQ ID NO: 15924 - DNA, 28 bp, Artificial sequence
  Forward Primer
catctatattttgttatcatcttcaacc

SEQ ID NO: 15925 - DNA, 18 bp, Artificial sequence
  Forward Primer
atggcttgtgtgaggctc

SEQ ID NO: 15926 - DNA, 25 bp, Artificial sequence
  Forward Primer
tttaaatggtctaagtgccttaaca

SEQ ID NO: 15927 - DNA, 22 bp, Artificial sequence
  Forward Primer
tcaagaccactgacttaaacaa

SEQ ID NO: 15928 - DNA, 25 bp, Artificial sequence
  Forward Primer
atatgactcaaagaaaatgctacct

SEQ ID NO: 15929 - DNA, 19 bp, Artificial sequence
  Forward Primer
ttccrgatgacaagttggg

SEQ ID NO: 15930 - DNA, 19 bp, Artificial sequence
  Forward Primer
agaggagagacgtggctga

SEQ ID NO: 15931 - DNA, 19 bp, Artificial sequence
  Forward Primer
accccattgagaatgagga

SEQ ID NO: 15932 - DNA, 19 bp, Artificial sequence
  Forward Primer
ttctccaaggcatccttct

SEQ ID NO: 15933 - DNA, 18 bp, Artificial sequence
  Forward Primer
tgattccctggcaggcag

SEQ ID NO: 15934 - DNA, 22 bp, Artificial sequence
  Forward Primer
ttamgtgtggggaagagttaca

SEQ ID NO: 15935 - DNA, 20 bp, Artificial sequence
  Forward Primer
tggagaaaccagaatccaag

SEQ ID NO: 15936 - DNA, 18 bp, Artificial sequence
  Forward Primer
tttgactgtggcctgagc

SEQ ID NO: 15937 - DNA, 22 bp, Artificial sequence
  Forward Primer
agagagattgagtggaaagagc

SEQ ID NO: 15938 - DNA, 18 bp, Artificial sequence
  Forward Primer
tagcaaagggggccatac

SEQ ID NO: 15939 - DNA, 18 bp, Artificial sequence
  Forward Primer
tgagcagattgccttccg

SEQ ID NO: 15940 - DNA, 27 bp, Artificial sequence
  Forward Primer
ataattagagcatcattcctcataatg

SEQ ID NO: 15941 - DNA, 22 bp, Artificial sequence
  Forward Primer
ttgacggaagagttttgtcata

SEQ ID NO: 15942 - DNA, 24 bp, Artificial sequence
  Forward Primer
actttactaccaactcagcatctg

SEQ ID NO: 15943 - DNA, 23 bp, Artificial sequence
  Forward Primer
agggcatgttatatgcttatagg

SEQ ID NO: 15944 - DNA, 20 bp, Artificial sequence
  Forward Primer
tacctcccttttccaactgc

SEQ ID NO: 15945 - DNA, 28 bp, Artificial sequence
  Forward Primer
tgcagattgtgaataactataaactttt

SEQ ID NO: 15946 - DNA, 18 bp, Artificial sequence
  Forward Primer
tttgggatcagcttccct

SEQ ID NO: 15947 - DNA, 27 bp, Artificial sequence
  Forward Primer
attgtctcaactttaagtaccactctt

SEQ ID NO: 15948 - DNA, 22 bp, Artificial sequence
  Forward Primer
attgtagtgtgcaccatttttg

SEQ ID NO: 15949 - DNA, 24 bp, Artificial sequence
  Forward Primer
tgttttatctccagaacaagatat

SEQ ID NO: 15950 - DNA, 25 bp, Artificial sequence
  Forward Primer
ttttaaattaaagcacaacagatgg

SEQ ID NO: 15951 - DNA, 27 bp, Artificial sequence
  Forward Primer
ttcagttattaagattaagctctgctc

SEQ ID NO: 15952 - DNA, 25 bp, Artificial sequence
  Forward Primer
ttaragaggatggtaggatattaaa

SEQ ID NO: 15953 - DNA, 25 bp, Artificial sequence
  Forward Primer
aggtggatatatgaaaatttgaaca

SEQ ID NO: 15954 - DNA, 25 bp, Artificial sequence
  Forward Primer
taacttctgttttgtaatttcctgg

SEQ ID NO: 15955 - DNA, 30 bp, Artificial sequence
  Forward Primer
aataatagttctttccctactaatagacat

SEQ ID NO: 15956 - DNA, 23 bp, Artificial sequence
  Forward Primer
tgctctctccatcaatttctaac

SEQ ID NO: 15957 - DNA, 21 bp, Artificial sequence
  Forward Primer
ctgcaaaacttttaccggtct

SEQ ID NO: 15958 - DNA, 24 bp, Artificial sequence
  Forward Primer
aaaatcagtgaaggtgatgttatg

SEQ ID NO: 15959 - DNA, 18 bp, Artificial sequence
  Forward Primer
ttgtcactccaggaccca

SEQ ID NO: 15960 - DNA, 30 bp, Artificial sequence
  Forward Primer
atcttattagagagctcactagctagaata

SEQ ID NO: 15961 - DNA, 20 bp, Artificial sequence
  Forward Primer
tgattccgaggtctctcaga

SEQ ID NO: 15962 - DNA, 19 bp, Artificial sequence
  Forward Primer
ctgatgggcagagtaggtc

SEQ ID NO: 15963 - DNA, 25 bp, Artificial sequence
  Forward Primer
actggttgacctctaagactacttc

SEQ ID NO: 15964 - DNA, 22 bp, Artificial sequence
  Forward Primer
actgtacatgtgttggtactga

SEQ ID NO: 15965 - DNA, 22 bp, Artificial sequence
  Forward Primer
attagtagggacctccctgttc

SEQ ID NO: 15966 - DNA, 23 bp, Artificial sequence
  Forward Primer
aaattaatggaaacacagagagg

SEQ ID NO: 15967 - DNA, 27 bp, Artificial sequence
  Forward Primer
attatggatcaacgtatgtaaggataa

SEQ ID NO: 15968 - DNA, 20 bp, Artificial sequence
  Forward Primer
tcaggagtcaacatgaccac

SEQ ID NO: 15969 - DNA, 19 bp, Artificial sequence
  Forward Primer
ttgaggatgctctgtttca

SEQ ID NO: 15970 - DNA, 20 bp, Artificial sequence
  Forward Primer
ttttctgcaagccacatagc

SEQ ID NO: 15971 - DNA, 19 bp, Artificial sequence
  Forward Primer
actcagtgaaggttggctg

SEQ ID NO: 15972 - DNA, 23 bp, Artificial sequence
  Forward Primer
aacagtaaaagcttcatcagctc

SEQ ID NO: 15973 - DNA, 24 bp, Artificial sequence
  Forward Primer
aatgaagaattatccagcaaaaat

SEQ ID NO: 15974 - DNA, 25 bp, Artificial sequence
  Forward Primer
aacttgtaaatggccaaagtataca

SEQ ID NO: 15975 - DNA, 27 bp, Artificial sequence
  Forward Primer
aatgattgtaaaagaaagaacacagtt

SEQ ID NO: 15976 - DNA, 25 bp, Artificial sequence
  Forward Primer
ttatttagtccctaagttgtctcca

SEQ ID NO: 15977 - DNA, 23 bp, Artificial sequence
  Forward Primer
actttgagtaagcagagcacact

SEQ ID NO: 15978 - DNA, 18 bp, Artificial sequence
  Forward Primer
acctgtcccaagttgcca

SEQ ID NO: 15979 - DNA, 24 bp, Artificial sequence
  Forward Primer
ttctaataccacagacaacccttc

SEQ ID NO: 15980 - DNA, 23 bp, Artificial sequence
  Forward Primer
tgaaaaagacacacttcatcaag

SEQ ID NO: 15981 - DNA, 18 bp, Artificial sequence
  Forward Primer
aaagttgtgcagagggcc

SEQ ID NO: 15982 - DNA, 18 bp, Artificial sequence
  Forward Primer
cgagacaaggagcgagag

SEQ ID NO: 15983 - DNA, 22 bp, Artificial sequence
  Forward Primer
aatgatcttataattctggcgg

SEQ ID NO: 15984 - DNA, 27 bp, Artificial sequence
  Forward Primer
agaaaattccctaaaactgactttaaa

SEQ ID NO: 15985 - DNA, 27 bp, Artificial sequence
  Forward Primer
tttcaatattcccattttatagatcag

SEQ ID NO: 15986 - DNA, 25 bp, Artificial sequence
  Forward Primer
aaataaactgcatttaaaacctgag

SEQ ID NO: 15987 - DNA, 20 bp, Artificial sequence
  Forward Primer
ataactcgttagaggctggg

SEQ ID NO: 15988 - DNA, 18 bp, Artificial sequence
  Forward Primer
ttcaagccagaccaggtg

SEQ ID NO: 15989 - DNA, 18 bp, Artificial sequence
  Forward Primer
gtcacagacacggtgccc

SEQ ID NO: 15990 - DNA, 23 bp, Artificial sequence
  Forward Primer
aagtgagtgatggctataatgga

SEQ ID NO: 15991 - DNA, 22 bp, Artificial sequence
  Forward Primer
ccctctggtctgtcttcttaga

SEQ ID NO: 15992 - DNA, 19 bp, Artificial sequence
  Forward Primer
tagatctccgttgctgtgc

SEQ ID NO: 15993 - DNA, 28 bp, Artificial sequence
  Forward Primer
aactatatcatgttcttggactgtaaga

SEQ ID NO: 15994 - DNA, 20 bp, Artificial sequence
  Forward Primer
aatccctgacagactttgaa

SEQ ID NO: 15995 - DNA, 29 bp, Artificial sequence
  Forward Primer
agtatttccatgtatgtgtgtaaatatga

SEQ ID NO: 15996 - DNA, 19 bp, Artificial sequence
  Forward Primer
ttttccttgtcacggaggt

SEQ ID NO: 15997 - DNA, 30 bp, Artificial sequence
  Forward Primer
tacttagtctcactaatgagtttgaaattt

SEQ ID NO: 15998 - DNA, 26 bp, Artificial sequence
  Forward Primer
tgcagataagagaatttcatgtaaaa

SEQ ID NO: 15999 - DNA, 18 bp, Artificial sequence
  Forward Primer
ctgctgacatgctggcag

SEQ ID NO: 16000 - DNA, 25 bp, Artificial sequence
  Forward Primer
aaagaatggctgtaattaccatatc

SEQ ID NO: 16001 - DNA, 20 bp, Artificial sequence
  Forward Primer
tttcttcccagcttgtgtgt

SEQ ID NO: 16002 - DNA, 19 bp, Artificial sequence
  Forward Primer
caccccatcctttccttaa

SEQ ID NO: 16003 - DNA, 18 bp, Artificial sequence
  Forward Primer
actaccgactgggggaaa

SEQ ID NO: 16004 - DNA, 18 bp, Artificial sequence
  Forward Primer
aaaatacggtgggcttgg

SEQ ID NO: 16005 - DNA, 23 bp, Artificial sequence
  Forward Primer
caggtctgatcagagaagtgatt

SEQ ID NO: 16006 - DNA, 25 bp, Artificial sequence
  Forward Primer
atatcatctggagaactttgctaca

SEQ ID NO: 16007 - DNA, 25 bp, Artificial sequence
  Forward Primer
aaatgagctctttcacagtagctag

SEQ ID NO: 16008 - DNA, 24 bp, Artificial sequence
  Forward Primer
tatttcttccattactgtggctct

SEQ ID NO: 16009 - DNA, 24 bp, Artificial sequence
  Forward Primer
aattactaatgaggggatgtctca

SEQ ID NO: 16010 - DNA, 23 bp, Artificial sequence
  Forward Primer
tgtcctagcttaatgatgagagg

SEQ ID NO: 16011 - DNA, 18 bp, Artificial sequence
  Forward Primer
attgagcctgggctgctc

SEQ ID NO: 16012 - DNA, 18 bp, Artificial sequence
  Forward Primer
acagaggtacccggcggt

SEQ ID NO: 16013 - DNA, 19 bp, Artificial sequence
  Forward Primer
tttctgtggccaaagatgc

SEQ ID NO: 16014 - DNA, 18 bp, Artificial sequence
  Forward Primer
aattctacccacccgtgg

SEQ ID NO: 16015 - DNA, 20 bp, Artificial sequence
  Forward Primer
tttgggtgatcctgagagat

SEQ ID NO: 16016 - DNA, 22 bp, Artificial sequence
  Forward Primer
tcaccgacatcaagactatttg

SEQ ID NO: 16017 - DNA, 19 bp, Artificial sequence
  Forward Primer
tggttggcattcaaacact

SEQ ID NO: 16018 - DNA, 24 bp, Artificial sequence
  Forward Primer
taacagttctcatggtttcaaatc

SEQ ID NO: 16019 - DNA, 20 bp, Artificial sequence
  Forward Primer
attctgcagtaaacggctcc

SEQ ID NO: 16020 - DNA, 18 bp, Artificial sequence
  Forward Primer
ttcctgtaggtggctccc

SEQ ID NO: 16021 - DNA, 23 bp, Artificial sequence
  Forward Primer
atttcagtcatgctttcatctga

SEQ ID NO: 16022 - DNA, 23 bp, Artificial sequence
  Forward Primer
ataaatcgcaggtacagaaaagc

SEQ ID NO: 16023 - DNA, 25 bp, Artificial sequence
  Forward Primer
ttatcagcaggatgatcactattct

SEQ ID NO: 16024 - DNA, 27 bp, Artificial sequence
  Forward Primer
aaagaaaatagacagagaatacatggg

SEQ ID NO: 16025 - DNA, 19 bp, Artificial sequence
  Forward Primer
atggcaatgcaggtagaca

SEQ ID NO: 16026 - DNA, 22 bp, Artificial sequence
  Forward Primer
aagttatccgatcttgctcttg

SEQ ID NO: 16027 - DNA, 25 bp, Artificial sequence
  Forward Primer
aaataaaataaggacctcgtaacca

SEQ ID NO: 16028 - DNA, 22 bp, Artificial sequence
  Forward Primer
tcrtctctcatttgaaaggtca

SEQ ID NO: 16029 - DNA, 23 bp, Artificial sequence
  Forward Primer
ttgtattcgactcctctcttcac

SEQ ID NO: 16030 - DNA, 20 bp, Artificial sequence
  Forward Primer
acatgaaatcctgaaaggca

SEQ ID NO: 16031 - DNA, 28 bp, Artificial sequence
  Forward Primer
cttagtaagaaaaatcaaaataacagca

SEQ ID NO: 16032 - DNA, 18 bp, Artificial sequence
  Forward Primer
tcgtgccataaggtgtgg

SEQ ID NO: 16033 - DNA, 21 bp, Artificial sequence
  Forward Primer
ggaagactcaaactggaattc

SEQ ID NO: 16034 - DNA, 18 bp, Artificial sequence
  Forward Primer
tgatacggatgtctgggc

SEQ ID NO: 16035 - DNA, 18 bp, Artificial sequence
  Forward Primer
tgacaggaggccaaccac

SEQ ID NO: 16036 - DNA, 20 bp, Artificial sequence
  Forward Primer
taacacgttccttgcactgt

SEQ ID NO: 16037 - DNA, 28 bp, Artificial sequence
  Forward Primer
ccagttctgtttttatatctgtaaatca

SEQ ID NO: 16038 - DNA, 23 bp, Artificial sequence
  Forward Primer
tgattaagtgaacaaggtgcttg

SEQ ID NO: 16039 - DNA, 19 bp, Artificial sequence
  Forward Primer
tatcccagcatgtgtcctc

SEQ ID NO: 16040 - DNA, 24 bp, Artificial sequence
  Forward Primer
ctacatgcctaagagaagacacag

SEQ ID NO: 16041 - DNA, 27 bp, Artificial sequence
  Forward Primer
tatctcttaagggggaaaataaataaa

SEQ ID NO: 16042 - DNA, 19 bp, Artificial sequence
  Forward Primer
tgggtgttccagtgtgtac

SEQ ID NO: 16043 - DNA, 25 bp, Artificial sequence
  Forward Primer
atttttaacatggaagacagctcta

SEQ ID NO: 16044 - DNA, 20 bp, Artificial sequence
  Forward Primer
gtttctctcactgcttgcca

SEQ ID NO: 16045 - DNA, 23 bp, Artificial sequence
  Forward Primer
aactctgactgcttcatcactgt

SEQ ID NO: 16046 - DNA, 24 bp, Artificial sequence
  Forward Primer
caaatgtctattcaatttttgaac

SEQ ID NO: 16047 - DNA, 29 bp, Artificial sequence
  Forward Primer
ataaataggggaagaagacttaaagtaca

SEQ ID NO: 16048 - DNA, 20 bp, Artificial sequence
  Forward Primer
gttaaacagaccaggccaca

SEQ ID NO: 16049 - DNA, 23 bp, Artificial sequence
  Forward Primer
atgcatagccataaaacattcac

SEQ ID NO: 16050 - DNA, 25 bp, Artificial sequence
  Forward Primer
tatctaccatttggggttaatacac

SEQ ID NO: 16051 - DNA, 22 bp, Artificial sequence
  Forward Primer
tttcaacttgagaggatgaaga

SEQ ID NO: 16052 - DNA, 24 bp, Artificial sequence
  Forward Primer
tagaagacatatgcttcagtagcg

SEQ ID NO: 16053 - DNA, 20 bp, Artificial sequence
  Forward Primer
tgccctctcatgtacattgc

SEQ ID NO: 16054 - DNA, 30 bp, Artificial sequence
  Forward Primer
aaaatctatataattgtcctcactttctat

SEQ ID NO: 16055 - DNA, 24 bp, Artificial sequence
  Forward Primer
accgctcaagttctgtattttaaa

SEQ ID NO: 16056 - DNA, 20 bp, Artificial sequence
  Forward Primer
gtcaaaaattcacagctgcc

SEQ ID NO: 16057 - DNA, 22 bp, Artificial sequence
  Forward Primer
aagcaattcctcatgtatggaa

SEQ ID NO: 16058 - DNA, 23 bp, Artificial sequence
  Forward Primer
aaactatctgtaggcattcggtt

SEQ ID NO: 16059 - DNA, 22 bp, Artificial sequence
  Forward Primer
atttctcacttgtttccagctg

SEQ ID NO: 16060 - DNA, 23 bp, Artificial sequence
  Forward Primer
aaaacttctttcattcagtcacc

SEQ ID NO: 16061 - DNA, 28 bp, Artificial sequence
  Forward Primer
taatagctttgatcatttctcttaacag

SEQ ID NO: 16062 - DNA, 28 bp, Artificial sequence
  Forward Primer
tgactcatatattaaccatttcaattct

SEQ ID NO: 16063 - DNA, 22 bp, Artificial sequence
  Forward Primer
ccattcctctttctaaattctt

SEQ ID NO: 16064 - DNA, 25 bp, Artificial sequence
  Forward Primer
aaaaatcctcctcagtacatatcct

SEQ ID NO: 16065 - DNA, 23 bp, Artificial sequence
  Forward Primer
atcacaacctgtcctgagttaac

SEQ ID NO: 16066 - DNA, 26 bp, Artificial sequence
  Forward Primer
attagtgtctaaatggccagagtact

SEQ ID NO: 16067 - DNA, 20 bp, Artificial sequence
  Forward Primer
accagggtaggaagattccc

SEQ ID NO: 16068 - DNA, 29 bp, Artificial sequence
  Forward Primer
gatataattgtaatgccactataaaatgc

SEQ ID NO: 16069 - DNA, 25 bp, Artificial sequence
  Forward Primer
aaattccttggtagcaaagtagaat

SEQ ID NO: 16070 - DNA, 20 bp, Artificial sequence
  Forward Primer
aataaagcaaagcacaaacg

SEQ ID NO: 16071 - DNA, 19 bp, Artificial sequence
  Forward Primer
tcactagttagccatgccg

SEQ ID NO: 16072 - DNA, 30 bp, Artificial sequence
  Forward Primer
atactatttacatagtgaaaagttaggagt

SEQ ID NO: 16073 - DNA, 28 bp, Artificial sequence
  Forward Primer
atcttacagtcaaactgaataagacaga

SEQ ID NO: 16074 - DNA, 26 bp, Artificial sequence
  Forward Primer
ttcatctctcttttctaggtcagact

SEQ ID NO: 16075 - DNA, 26 bp, Artificial sequence
  Forward Primer
tatgtaaacacaaacatcacaaatga

SEQ ID NO: 16076 - DNA, 27 bp, Artificial sequence
  Forward Primer
tatttgctacatcttattgctctacac

SEQ ID NO: 16077 - DNA, 30 bp, Artificial sequence
  Forward Primer
tcagacttcaatatattttaaagagagaag

SEQ ID NO: 16078 - DNA, 25 bp, Artificial sequence
  Forward Primer
tattccaaaaatcttagtgcagttt

SEQ ID NO: 16079 - DNA, 20 bp, Artificial sequence
  Forward Primer
cctttttgctatcccacttc

SEQ ID NO: 16080 - DNA, 29 bp, Artificial sequence
  Forward Primer
ttttatgaataagttgagtctaaagttgg

SEQ ID NO: 16081 - DNA, 20 bp, Artificial sequence
  Forward Primer
attttctggggtgtcctctg

SEQ ID NO: 16082 - DNA, 23 bp, Artificial sequence
  Forward Primer
tcctttaacattggttctgatcc

SEQ ID NO: 16083 - DNA, 20 bp, Artificial sequence
  Forward Primer
tggccattgctctaaagaac

SEQ ID NO: 16084 - DNA, 21 bp, Artificial sequence
  Forward Primer
aatgttattcggctatacccc

SEQ ID NO: 16085 - DNA, 24 bp, Artificial sequence
  Forward Primer
aaaattatttgcttctggaaatca

SEQ ID NO: 16086 - DNA, 22 bp, Artificial sequence
  Forward Primer
agaattgacggactttctgaca

SEQ ID NO: 16087 - DNA, 25 bp, Artificial sequence
  Forward Primer
aaaatggttcacagagtttaatgtg

SEQ ID NO: 16088 - DNA, 21 bp, Artificial sequence
  Forward Primer
agtcatttacaaagctgccag

SEQ ID NO: 16089 - DNA, 24 bp, Artificial sequence
  Forward Primer
ttgttcctgcctgaaatatttatc

SEQ ID NO: 16090 - DNA, 22 bp, Artificial sequence
  Forward Primer
aattcacacaaggatcctgaac

SEQ ID NO: 16091 - DNA, 27 bp, Artificial sequence
  Forward Primer
tattttkctgcctattaattttaggag

SEQ ID NO: 16092 - DNA, 24 bp, Artificial sequence
  Forward Primer
ttaaggtctatagtgggtgtgtca

SEQ ID NO: 16093 - DNA, 29 bp, Artificial sequence
  Forward Primer
ttctatctccctacctacaatcttagtta

SEQ ID NO: 16094 - DNA, 21 bp, Artificial sequence
  Forward Primer
acagagagaagcaaatgcaaa

SEQ ID NO: 16095 - DNA, 29 bp, Artificial sequence
  Forward Primer
atacagaggactaccacttagtcataaaa

SEQ ID NO: 16096 - DNA, 20 bp, Artificial sequence
  Forward Primer
aagactcacagccttctcca

SEQ ID NO: 16097 - DNA, 26 bp, Artificial sequence
  Forward Primer
tattggattatatgacaagcacttct

SEQ ID NO: 16098 - DNA, 21 bp, Artificial sequence
  Forward Primer
aatcaacttggcaagaaacaa

SEQ ID NO: 16099 - DNA, 21 bp, Artificial sequence
  Forward Primer
tgtgtatgtgtgtttccagca

SEQ ID NO: 16100 - DNA, 19 bp, Artificial sequence
  Forward Primer
aacatccatttgcctcacc

SEQ ID NO: 16101 - DNA, 24 bp, Artificial sequence
  Forward Primer
atgtcctgaagtcaaggtaagaaa

SEQ ID NO: 16102 - DNA, 18 bp, Artificial sequence
  Forward Primer
ttgtggggtctgggaagg

SEQ ID NO: 16103 - DNA, 18 bp, Artificial sequence
  Forward Primer
tcccacagagcctggatg

SEQ ID NO: 16104 - DNA, 30 bp, Artificial sequence
  Forward Primer
acatacatacatacatacataagtcactgt

SEQ ID NO: 16105 - DNA, 20 bp, Artificial sequence
  Forward Primer
tcaagcctcgtaggtagagc

SEQ ID NO: 16106 - DNA, 19 bp, Artificial sequence
  Forward Primer
ttggtagattgggctttgg

SEQ ID NO: 16107 - DNA, 26 bp, Artificial sequence
  Forward Primer
ataacacaaaatggaataggacattt

SEQ ID NO: 16108 - DNA, 21 bp, Artificial sequence
  Forward Primer
tcatggtcactgactgtcaac

SEQ ID NO: 16109 - DNA, 28 bp, Artificial sequence
  Forward Primer
cataaaaggagattattacaaagttcaa

SEQ ID NO: 16110 - DNA, 28 bp, Artificial sequence
  Forward Primer
tcaagtaaaaaattatagcagacaaaag

SEQ ID NO: 16111 - DNA, 21 bp, Artificial sequence
  Forward Primer
tgacttgtttcctgaaccatg

SEQ ID NO: 16112 - DNA, 18 bp, Artificial sequence
  Forward Primer
acaccaatccctgcccgg

SEQ ID NO: 16113 - DNA, 24 bp, Artificial sequence
  Forward Primer
acatagagagtccgaactgaagag

SEQ ID NO: 16114 - DNA, 21 bp, Artificial sequence
  Forward Primer
aagtctttggagctgaggatg

SEQ ID NO: 16115 - DNA, 24 bp, Artificial sequence
  Forward Primer
tttttctccattccaagaagtaaa

SEQ ID NO: 16116 - DNA, 26 bp, Artificial sequence
  Forward Primer
agttgtgtgtgtgtkttttttaaatc

SEQ ID NO: 16117 - DNA, 18 bp, Artificial sequence
  Forward Primer
gctggagtttagcctgca

SEQ ID NO: 16118 - DNA, 21 bp, Artificial sequence
  Forward Primer
ggaatcaaaaactcattgaaa

SEQ ID NO: 16119 - DNA, 23 bp, Artificial sequence
  Forward Primer
taatcctagctcaccttaatctc

SEQ ID NO: 16120 - DNA, 18 bp, Artificial sequence
  Forward Primer
aaaacccttggcccgaca

SEQ ID NO: 16121 - DNA, 29 bp, Artificial sequence
  Forward Primer
ttatctagtatatttgggatgattcttca

SEQ ID NO: 16122 - DNA, 20 bp, Artificial sequence
  Forward Primer
aaatgtgtagacgtcgccat

SEQ ID NO: 16123 - DNA, 28 bp, Artificial sequence
  Forward Primer
cacacatatattaatgatttgtttcaca

SEQ ID NO: 16124 - DNA, 27 bp, Artificial sequence
  Forward Primer
gatttaaagaaaataaaaagttgctcg

SEQ ID NO: 16125 - DNA, 23 bp, Artificial sequence
  Forward Primer
aaataatttgctttttgaaaccc

SEQ ID NO: 16126 - DNA, 28 bp, Artificial sequence
  Forward Primer
atagataagtctgtatcagagatggaat

SEQ ID NO: 16127 - DNA, 29 bp, Artificial sequence
  Forward Primer
ttagtgaataatattaaaagtggtgtgtg

SEQ ID NO: 16128 - DNA, 25 bp, Artificial sequence
  Forward Primer
taactattgggtttaggtactggag

SEQ ID NO: 16129 - DNA, 28 bp, Artificial sequence
  Forward Primer
accagcttcaataaataaagattctatg

SEQ ID NO: 16130 - DNA, 21 bp, Artificial sequence
  Forward Primer
tgtaaaaaaagccaatggaac

SEQ ID NO: 16131 - DNA, 25 bp, Artificial sequence
  Forward Primer
attgttcagtgccttaatataccaa

SEQ ID NO: 16132 - DNA, 22 bp, Artificial sequence
  Forward Primer
attgtctacccagctgaagttc

SEQ ID NO: 16133 - DNA, 20 bp, Artificial sequence
  Forward Primer
aaatgctgcttttgacttgc

SEQ ID NO: 16134 - DNA, 24 bp, Artificial sequence
  Forward Primer
aatgaatattgttagaactgtcac

SEQ ID NO: 16135 - DNA, 26 bp, Artificial sequence
  Forward Primer
aaaattgtagaaggaaaataaaccag

SEQ ID NO: 16136 - DNA, 20 bp, Artificial sequence
  Forward Primer
atcctgggcataattcacaa

SEQ ID NO: 16137 - DNA, 22 bp, Artificial sequence
  Forward Primer
ctttccttcagagccttacttc

SEQ ID NO: 16138 - DNA, 20 bp, Artificial sequence
  Forward Primer
acagattcatgtccgttgga

SEQ ID NO: 16139 - DNA, 19 bp, Artificial sequence
  Forward Primer
agaggagtcctggatgcat

SEQ ID NO: 16140 - DNA, 24 bp, Artificial sequence
  Forward Primer
tttcatatttaaatccattccctt

SEQ ID NO: 16141 - DNA, 30 bp, Artificial sequence
  Forward Primer
agttgaaaaaagttagaaagtatgtctaat

SEQ ID NO: 16142 - DNA, 22 bp, Artificial sequence
  Forward Primer
ttctgaagttgagaactgctgc

SEQ ID NO: 16143 - DNA, 21 bp, Artificial sequence
  Forward Primer
taaccctcagatggaagaaag

SEQ ID NO: 16144 - DNA, 24 bp, Artificial sequence
  Forward Primer
attatatctattttggggccattt

SEQ ID NO: 16145 - DNA, 19 bp, Artificial sequence
  Forward Primer
aggctgtcattgattggct

SEQ ID NO: 16146 - DNA, 26 bp, Artificial sequence
  Forward Primer
ttatttaaatagggaacagcaatttc

SEQ ID NO: 16147 - DNA, 19 bp, Artificial sequence
  Forward Primer
agcatcctgtggagaaaag

SEQ ID NO: 16148 - DNA, 22 bp, Artificial sequence
  Forward Primer
tgaaaaagagtggaaagagagg

SEQ ID NO: 16149 - DNA, 19 bp, Artificial sequence
  Forward Primer
ttgggctgtctttcaaacc

SEQ ID NO: 16150 - DNA, 19 bp, Artificial sequence
  Forward Primer
taagtcccggaactcaaga

SEQ ID NO: 16151 - DNA, 24 bp, Artificial sequence
  Forward Primer
agaatgggaataaaatttcaaaca

SEQ ID NO: 16152 - DNA, 20 bp, Artificial sequence
  Forward Primer
tgcaactccctttacagaaa

SEQ ID NO: 16153 - DNA, 22 bp, Artificial sequence
  Forward Primer
actgaacaacagcagaagatgt

SEQ ID NO: 16154 - DNA, 19 bp, Artificial sequence
  Forward Primer
aaaacccagcctctatggg

SEQ ID NO: 16155 - DNA, 28 bp, Artificial sequence
  Forward Primer
tattttacttaaccagatacatscaaaa

SEQ ID NO: 16156 - DNA, 26 bp, Artificial sequence
  Forward Primer
attgatagaaccattttctagttctg

SEQ ID NO: 16157 - DNA, 24 bp, Artificial sequence
  Forward Primer
tatgatctgaagattacttggtgc

SEQ ID NO: 16158 - DNA, 23 bp, Artificial sequence
  Forward Primer
ttataagaattcagctggcaaag

SEQ ID NO: 16159 - DNA, 28 bp, Artificial sequence
  Forward Primer
tcagattctgatttattatcaacaattg

SEQ ID NO: 16160 - DNA, 20 bp, Artificial sequence
  Forward Primer
ggaaggaagaaagacaggag

SEQ ID NO: 16161 - DNA, 27 bp, Artificial sequence
  Forward Primer
gactctattccaaatgcttaagtaaaa

SEQ ID NO: 16162 - DNA, 21 bp, Artificial sequence
  Forward Primer
aagatgtaaaggggtatcggc

SEQ ID NO: 16163 - DNA, 20 bp, Artificial sequence
  Forward Primer
tgctgtaattcttggcacag

SEQ ID NO: 16164 - DNA, 22 bp, Artificial sequence
  Forward Primer
ccaactgacatctgttttctga

SEQ ID NO: 16165 - DNA, 21 bp, Artificial sequence
  Forward Primer
gaagagaaaggctttccaagg

SEQ ID NO: 16166 - DNA, 24 bp, Artificial sequence
  Forward Primer
atttttagtactttattacgcggg

SEQ ID NO: 16167 - DNA, 19 bp, Artificial sequence
  Forward Primer
acaggagcgagcagtcatt

SEQ ID NO: 16168 - DNA, 22 bp, Artificial sequence
  Forward Primer
tttgtagtggcaagtgagttga

SEQ ID NO: 16169 - DNA, 20 bp, Artificial sequence
  Forward Primer
tttctggcgtgcctactatg

SEQ ID NO: 16170 - DNA, 19 bp, Artificial sequence
  Forward Primer
ccagagctgaatgaaaacc

SEQ ID NO: 16171 - DNA, 19 bp, Artificial sequence
  Forward Primer
acagcatctagggagcagc

SEQ ID NO: 16172 - DNA, 19 bp, Artificial sequence
  Forward Primer
tgcaagcagattctttgct

SEQ ID NO: 16173 - DNA, 24 bp, Artificial sequence
  Forward Primer
accgtaaagacaatttgaagaatc

SEQ ID NO: 16174 - DNA, 20 bp, Artificial sequence
  Forward Primer
aggccttcacctcgtatttg

SEQ ID NO: 16175 - DNA, 20 bp, Artificial sequence
  Forward Primer
tgtcacttgggttctccatc

SEQ ID NO: 16176 - DNA, 26 bp, Artificial sequence
  Forward Primer
taataatgtgaaaaaatacatcgagg

SEQ ID NO: 16177 - DNA, 26 bp, Artificial sequence
  Forward Primer
attttatctctcatccaggataggta

SEQ ID NO: 16178 - DNA, 21 bp, Artificial sequence
  Forward Primer
ctggcacataacactgggtag

SEQ ID NO: 16179 - DNA, 24 bp, Artificial sequence
  Forward Primer
aaatcacagaaattctactttgcc

SEQ ID NO: 16180 - DNA, 20 bp, Artificial sequence
  Forward Primer
aagccaaaactgattcacca

SEQ ID NO: 16181 - DNA, 20 bp, Artificial sequence
  Forward Primer
aggagttctcctgtgagatt

SEQ ID NO: 16182 - DNA, 21 bp, Artificial sequence
  Forward Primer
tggttcttgtcttcttgtttt

SEQ ID NO: 16183 - DNA, 21 bp, Artificial sequence
  Forward Primer
atgtgtggaacaggaaacaga

SEQ ID NO: 16184 - DNA, 18 bp, Artificial sequence
  Forward Primer
aagcgtcgtttgtgaccc

SEQ ID NO: 16185 - DNA, 21 bp, Artificial sequence
  Forward Primer
gattctgccaaaaaagacaca

SEQ ID NO: 16186 - DNA, 19 bp, Artificial sequence
  Forward Primer
aacagtttctggggctgac

SEQ ID NO: 16187 - DNA, 28 bp, Artificial sequence
  Forward Primer
ataatccatagtaggtaaggtacacaca

SEQ ID NO: 16188 - DNA, 19 bp, Artificial sequence
  Forward Primer
tttcccttccgtctacagg

SEQ ID NO: 16189 - DNA, 21 bp, Artificial sequence
  Forward Primer
agcagaatcagttaagggtgg

SEQ ID NO: 16190 - DNA, 20 bp, Artificial sequence
  Forward Primer
ctcaaagctcggtaaagtgg

SEQ ID NO: 16191 - DNA, 23 bp, Artificial sequence
  Forward Primer
tatgcagattcgtcattttatca

SEQ ID NO: 16192 - DNA, 24 bp, Artificial sequence
  Forward Primer
aaaaacctaaagaccatcattttc

SEQ ID NO: 16193 - DNA, 19 bp, Artificial sequence
  Forward Primer
tggcaagtkgtctcctctc

SEQ ID NO: 16194 - DNA, 23 bp, Artificial sequence
  Forward Primer
ctgtgagaatagctgatagccag

SEQ ID NO: 16195 - DNA, 23 bp, Artificial sequence
  Forward Primer
atcatacagtgtgttggcttctt

SEQ ID NO: 16196 - DNA, 20 bp, Artificial sequence
  Forward Primer
acaatctcagagacctgggc

SEQ ID NO: 16197 - DNA, 30 bp, Artificial sequence
  Forward Primer
gtttgatagtaatttgtaaaagttatctgc

SEQ ID NO: 16198 - DNA, 19 bp, Artificial sequence
  Forward Primer
atcagtgctgaatttccgg

SEQ ID NO: 16199 - DNA, 23 bp, Artificial sequence
  Forward Primer
ttttattagtcttggcctcagtg

SEQ ID NO: 16200 - DNA, 20 bp, Artificial sequence
  Forward Primer
ttaatcacagcatgcaatgg

SEQ ID NO: 16201 - DNA, 19 bp, Artificial sequence
  Forward Primer
agcacttggaggcgtttat

SEQ ID NO: 16202 - DNA, 18 bp, Artificial sequence
  Forward Primer
acttaaacccccgcccct

SEQ ID NO: 16203 - DNA, 22 bp, Artificial sequence
  Forward Primer
ctgtactggtttctggtagcaa

SEQ ID NO: 16204 - DNA, 26 bp, Artificial sequence
  Forward Primer
tatagagaacattcaattctcagcaa

SEQ ID NO: 16205 - DNA, 28 bp, Artificial sequence
  Forward Primer
agagagagatatagtctcttatcccaag

SEQ ID NO: 16206 - DNA, 24 bp, Artificial sequence
  Forward Primer
ctatctcttcctgggatttcataa

SEQ ID NO: 16207 - DNA, 27 bp, Artificial sequence
  Forward Primer
tattctaggagctgactatctctgatt

SEQ ID NO: 16208 - DNA, 21 bp, Artificial sequence
  Forward Primer
gcaccaaatgttcacygttaa

SEQ ID NO: 16209 - DNA, 19 bp, Artificial sequence
  Forward Primer
tcagacaccacttactggc

SEQ ID NO: 16210 - DNA, 21 bp, Artificial sequence
  Forward Primer
cccctaagttagaaaatgttg

SEQ ID NO: 16211 - DNA, 30 bp, Artificial sequence
  Forward Primer
tatggaattttaagacatagagtaggtaag

SEQ ID NO: 16212 - DNA, 23 bp, Artificial sequence
  Forward Primer
taaagcttcagctcttctgatgt

SEQ ID NO: 16213 - DNA, 25 bp, Artificial sequence
  Forward Primer
cattcctgagtagagttggaattta

SEQ ID NO: 16214 - DNA, 28 bp, Artificial sequence
  Forward Primer
atgttttatgagtgtatttctatttgca

SEQ ID NO: 16215 - DNA, 29 bp, Artificial sequence
  Forward Primer
tcttagattagcgataacatttgtatagg

SEQ ID NO: 16216 - DNA, 25 bp, Artificial sequence
  Forward Primer
ttaggtctaaattgaaagtaacacc

SEQ ID NO: 16217 - DNA, 24 bp, Artificial sequence
  Forward Primer
aaatccctgmaggtgatataaaat

SEQ ID NO: 16218 - DNA, 28 bp, Artificial sequence
  Forward Primer
taatatcaattcaaytccacacttagac

SEQ ID NO: 16219 - DNA, 25 bp, Artificial sequence
  Forward Primer
acatacatgcatataacagatggag

SEQ ID NO: 16220 - DNA, 28 bp, Artificial sequence
  Forward Primer
aaagtaaatgaatatctgtgtttgaatg

SEQ ID NO: 16221 - DNA, 20 bp, Artificial sequence
  Forward Primer
attcagaggactgcttacgg

SEQ ID NO: 16222 - DNA, 26 bp, Artificial sequence
  Forward Primer
aaatagaagatgaaggcaaataacat

SEQ ID NO: 16223 - DNA, 18 bp, Artificial sequence
  Forward Primer
atccccatgcagtttggt

SEQ ID NO: 16224 - DNA, 22 bp, Artificial sequence
  Forward Primer
atttaaaatacgaaccgcaaaa

SEQ ID NO: 16225 - DNA, 18 bp, Artificial sequence
  Forward Primer
tgttgttttccctccacc

SEQ ID NO: 16226 - DNA, 24 bp, Artificial sequence
  Forward Primer
ttttgtcactaaggggactttatg

SEQ ID NO: 16227 - DNA, 28 bp, Artificial sequence
  Forward Primer
acaaggggactatagcctatattttata

SEQ ID NO: 16228 - DNA, 21 bp, Artificial sequence
  Forward Primer
aggtctcgcctcttgatagac

SEQ ID NO: 16229 - DNA, 30 bp, Artificial sequence
  Forward Primer
ttatatcacttatatttcccagtgtaactt

SEQ ID NO: 16230 - DNA, 24 bp, Artificial sequence
  Forward Primer
gaaatagtggaagacagaggaacc

SEQ ID NO: 16231 - DNA, 24 bp, Artificial sequence
  Forward Primer
aaaggtctctgtacaaaaatcaca

SEQ ID NO: 16232 - DNA, 26 bp, Artificial sequence
  Forward Primer
taaaattacagagctgtacaaccatg

SEQ ID NO: 16233 - DNA, 25 bp, Artificial sequence
  Forward Primer
tattaccaatcaatttgggaatatg

SEQ ID NO: 16234 - DNA, 27 bp, Artificial sequence
  Forward Primer
attctttatttctcctcaaaaactagg

SEQ ID NO: 16235 - DNA, 26 bp, Artificial sequence
  Forward Primer
tatttacagagcggaaatagacatag

SEQ ID NO: 16236 - DNA, 30 bp, Artificial sequence
  Forward Primer
attctgaaacgagttagaatagtacattaa

SEQ ID NO: 16237 - DNA, 25 bp, Artificial sequence
  Forward Primer
aaattattttgaaatctcagggatc

SEQ ID NO: 16238 - DNA, 22 bp, Artificial sequence
  Forward Primer
aatatacccatgtggctgactc

SEQ ID NO: 16239 - DNA, 24 bp, Artificial sequence
  Forward Primer
aaaataccaaaattcaaggcatag

SEQ ID NO: 16240 - DNA, 22 bp, Artificial sequence
  Forward Primer
attaacttgggaggaagagatg

SEQ ID NO: 16241 - DNA, 20 bp, Artificial sequence
  Forward Primer
cttctttgccactggacttg

SEQ ID NO: 16242 - DNA, 20 bp, Artificial sequence
  Forward Primer
aatgccttcagcrtaaagga

SEQ ID NO: 16243 - DNA, 30 bp, Artificial sequence
  Forward Primer
ttacatgtagtacggaagaartaagactac

SEQ ID NO: 16244 - DNA, 24 bp, Artificial sequence
  Forward Primer
cctaaatgttccagcctttaaata

SEQ ID NO: 16245 - DNA, 23 bp, Artificial sequence
  Forward Primer
aaaaatgcttacattctcaaggc

SEQ ID NO: 16246 - DNA, 25 bp, Artificial sequence
  Forward Primer
aaaactataaggagctgtttgttgc

SEQ ID NO: 16247 - DNA, 25 bp, Artificial sequence
  Forward Primer
aataataacaggtcacctcttcagg

SEQ ID NO: 16248 - DNA, 21 bp, Artificial sequence
  Forward Primer
aaatagccaccacaaggaaaa

SEQ ID NO: 16249 - DNA, 23 bp, Artificial sequence
  Forward Primer
aaatcagtagagaaacagccagc

SEQ ID NO: 16250 - DNA, 18 bp, Artificial sequence
  Forward Primer
ctccggaccgattgccac

SEQ ID NO: 16251 - DNA, 30 bp, Artificial sequence
  Forward Primer
agagttcattayacaacttattgtcattat

SEQ ID NO: 16252 - DNA, 24 bp, Artificial sequence
  Forward Primer
aaagacctccataatcaakcattt

SEQ ID NO: 16253 - DNA, 19 bp, Artificial sequence
  Forward Primer
atccaccaccatttccaac

SEQ ID NO: 16254 - DNA, 20 bp, Artificial sequence
  Forward Primer
tgtgggtcaygtagagcatt

SEQ ID NO: 16255 - DNA, 26 bp, Artificial sequence
  Forward Primer
tattctgctgatgctttaagttctac

SEQ ID NO: 16256 - DNA, 24 bp, Artificial sequence
  Forward Primer
tatacattttcatgccatgtgttt

SEQ ID NO: 16257 - DNA, 22 bp, Artificial sequence
  Forward Primer
aaagataacactggcatcttgc

SEQ ID NO: 16258 - DNA, 18 bp, Artificial sequence
  Forward Primer
accctckctctttctggc

SEQ ID NO: 16259 - DNA, 24 bp, Artificial sequence
  Forward Primer
aaggtcttaacaagcaattctcaa

SEQ ID NO: 16260 - DNA, 18 bp, Artificial sequence
  Forward Primer
tgagcgggtatgtggagg

SEQ ID NO: 16261 - DNA, 19 bp, Artificial sequence
  Forward Primer
ttcctttcactgccctttt

SEQ ID NO: 16262 - DNA, 24 bp, Artificial sequence
  Forward Primer
aatgttttgggttaacacttcaat

SEQ ID NO: 16263 - DNA, 30 bp, Artificial sequence
  Forward Primer
aacaggttttttatacttacatatctatca

SEQ ID NO: 16264 - DNA, 25 bp, Artificial sequence
  Forward Primer
gcttactagagactcttcaaactat

SEQ ID NO: 16265 - DNA, 22 bp, Artificial sequence
  Forward Primer
aaaattaaccttggtgtggaca

SEQ ID NO: 16266 - DNA, 22 bp, Artificial sequence
  Forward Primer
gcttctaggagtaccagctatt

SEQ ID NO: 16267 - DNA, 24 bp, Artificial sequence
  Forward Primer
ccctcataatagtgatgacaatca

SEQ ID NO: 16268 - DNA, 23 bp, Artificial sequence
  Forward Primer
ttgaacaaaacatatgttgcaag

SEQ ID NO: 16269 - DNA, 23 bp, Artificial sequence
  Forward Primer
aagactcaatgcagcaaaataaa

SEQ ID NO: 16270 - DNA, 24 bp, Artificial sequence
  Forward Primer
agatgggataccaactaacagatg

SEQ ID NO: 16271 - DNA, 26 bp, Artificial sequence
  Forward Primer
cctgtactttagactttttcttctcc

SEQ ID NO: 16272 - DNA, 23 bp, Artificial sequence
  Forward Primer
tgcaaatcagtaactgtaaccaa

SEQ ID NO: 16273 - DNA, 29 bp, Artificial sequence
  Forward Primer
agtataaaggataaaactgtgaaaaaagg

SEQ ID NO: 16274 - DNA, 23 bp, Artificial sequence
  Forward Primer
tttctggtgaaatccaaagtatc

SEQ ID NO: 16275 - DNA, 20 bp, Artificial sequence
  Forward Primer
aacataggaagggtgattgc

SEQ ID NO: 16276 - DNA, 24 bp, Artificial sequence
  Forward Primer
ttatacaagaaacagctggattat

SEQ ID NO: 16277 - DNA, 24 bp, Artificial sequence
  Forward Primer
ttctccactttcttatgcacaata

SEQ ID NO: 16278 - DNA, 29 bp, Artificial sequence
  Forward Primer
taattactagaaatatgaaatgaaggctc

SEQ ID NO: 16279 - DNA, 25 bp, Artificial sequence
  Forward Primer
ttaaaagcttccacagtttcaatat

SEQ ID NO: 16280 - DNA, 20 bp, Artificial sequence
  Forward Primer
tatagtgggaggaggtaggg

SEQ ID NO: 16281 - DNA, 24 bp, Artificial sequence
  Forward Primer
taatatgggtctggattagacagg

SEQ ID NO: 16282 - DNA, 25 bp, Artificial sequence
  Forward Primer
ttggctcatttaactaaacaaagtg

SEQ ID NO: 16283 - DNA, 19 bp, Artificial sequence
  Forward Primer
taggggccaagaagattta

SEQ ID NO: 16284 - DNA, 20 bp, Artificial sequence
  Forward Primer
atttagggcctaacagggat

SEQ ID NO: 16285 - DNA, 27 bp, Artificial sequence
  Forward Primer
atttagggatacagtcataaaaacagc

SEQ ID NO: 16286 - DNA, 23 bp, Artificial sequence
  Forward Primer
aactgattcaaggtaacccactt

SEQ ID NO: 16287 - DNA, 19 bp, Artificial sequence
  Forward Primer
gagaaaagcacagattccg

SEQ ID NO: 16288 - DNA, 28 bp, Artificial sequence
  Forward Primer
tcctaatatgtacaaatcaaaaactgtt

SEQ ID NO: 16289 - DNA, 24 bp, Artificial sequence
  Forward Primer
ttctatctttcttctggracacac

SEQ ID NO: 16290 - DNA, 18 bp, Artificial sequence
  Forward Primer
aagtggcaacgtgtcccc

SEQ ID NO: 16291 - DNA, 18 bp, Artificial sequence
  Forward Primer
agcagttcctggaggcca

SEQ ID NO: 16292 - DNA, 18 bp, Artificial sequence
  Forward Primer
tcacggagcaggctcagg

SEQ ID NO: 16293 - DNA, 18 bp, Artificial sequence
  Forward Primer
acatggactccagcgcct

SEQ ID NO: 16294 - DNA, 19 bp, Artificial sequence
  Forward Primer
atagctcggaagcaagcag

SEQ ID NO: 16295 - DNA, 19 bp, Artificial sequence
  Forward Primer
taaaaccagaatggaccgc

SEQ ID NO: 16296 - DNA, 26 bp, Artificial sequence
  Forward Primer
atagaattggtgtttatggctcttac

SEQ ID NO: 16297 - DNA, 28 bp, Artificial sequence
  Forward Primer
ataaacacacaaagaagtaaataagcac

SEQ ID NO: 16298 - DNA, 20 bp, Artificial sequence
  Forward Primer
ttcaaagctctgctagtccc

SEQ ID NO: 16299 - DNA, 22 bp, Artificial sequence
  Forward Primer
aatgaatgcaggagagaagagt

SEQ ID NO: 16300 - DNA, 30 bp, Artificial sequence
  Forward Primer
cacactaaataagcaaaatatataatgtgt

SEQ ID NO: 16301 - DNA, 26 bp, Artificial sequence
  Forward Primer
aactaaaatcattgtactaacagggc

SEQ ID NO: 16302 - DNA, 22 bp, Artificial sequence
  Forward Primer
tatgtggtatggctttgttttg

SEQ ID NO: 16303 - DNA, 23 bp, Artificial sequence
  Forward Primer
gagggaaaaatgaagagatgaag

SEQ ID NO: 16304 - DNA, 23 bp, Artificial sequence
  Forward Primer
tttagattmtgcgattccataag

SEQ ID NO: 16305 - DNA, 19 bp, Artificial sequence
  Forward Primer
tgagtctccagcagctgtg

SEQ ID NO: 16306 - DNA, 23 bp, Artificial sequence
  Forward Primer
actgaagaacctaaagaagctgg

SEQ ID NO: 16307 - DNA, 23 bp, Artificial sequence
  Forward Primer
actcaaccttccttttgtctctc

SEQ ID NO: 16308 - DNA, 23 bp, Artificial sequence
  Forward Primer
aagttttccatcagactcatcct

SEQ ID NO: 16309 - DNA, 20 bp, Artificial sequence
  Forward Primer
gtcccacttgtatgatcaat

SEQ ID NO: 16310 - DNA, 21 bp, Artificial sequence
  Forward Primer
agtggtccctattttccagaa

SEQ ID NO: 16311 - DNA, 28 bp, Artificial sequence
  Forward Primer
gcatttcataaattatgtattctcatgt

SEQ ID NO: 16312 - DNA, 22 bp, Artificial sequence
  Forward Primer
ttgtcttctcaggaaattgagg

SEQ ID NO: 16313 - DNA, 27 bp, Artificial sequence
  Forward Primer
acagatgatagccacaataaaaataga

SEQ ID NO: 16314 - DNA, 24 bp, Artificial sequence
  Forward Primer
aataygaattttcctcatactgca

SEQ ID NO: 16315 - DNA, 21 bp, Artificial sequence
  Forward Primer
aacycttgaaagccatttgat

SEQ ID NO: 16316 - DNA, 22 bp, Artificial sequence
  Forward Primer
aagatttcatttctgatgttca

SEQ ID NO: 16317 - DNA, 26 bp, Artificial sequence
  Forward Primer
catttggattattaatacacagtgga

SEQ ID NO: 16318 - DNA, 30 bp, Artificial sequence
  Forward Primer
atttgtaattctattgttaaagagacttct

SEQ ID NO: 16319 - DNA, 25 bp, Artificial sequence
  Forward Primer
ttaatctgagamgtcctacaggttt

SEQ ID NO: 16320 - DNA, 20 bp, Artificial sequence
  Forward Primer
taattaattaactggccgcc

SEQ ID NO: 16321 - DNA, 29 bp, Artificial sequence
  Forward Primer
ttatatgcatatgtttatgctagtaacca

SEQ ID NO: 16322 - DNA, 18 bp, Artificial sequence
  Forward Primer
ctccatgatgaagccgtg

SEQ ID NO: 16323 - DNA, 23 bp, Artificial sequence
  Forward Primer
ttggmtacaacttagcaactgaa

SEQ ID NO: 16324 - DNA, 26 bp, Artificial sequence
  Forward Primer
tcatctagaaacttgtgagaaacatg

SEQ ID NO: 16325 - DNA, 27 bp, Artificial sequence
  Forward Primer
tcctagtaacctacttcacttttacca

SEQ ID NO: 16326 - DNA, 18 bp, Artificial sequence
  Forward Primer
tactgtgcacaagggctg

SEQ ID NO: 16327 - DNA, 27 bp, Artificial sequence
  Forward Primer
attaaaactagggaaagaagacacatc

SEQ ID NO: 16328 - DNA, 18 bp, Artificial sequence
  Forward Primer
tcagccaagccaccagac

SEQ ID NO: 16329 - DNA, 24 bp, Artificial sequence
  Forward Primer
aagaccaaataggaaactacagca

SEQ ID NO: 16330 - DNA, 29 bp, Artificial sequence
  Forward Primer
tatgtgacttgatacaaatacmgaataac

SEQ ID NO: 16331 - DNA, 27 bp, Artificial sequence
  Forward Primer
tttataattgaaggtttgtacctttca

SEQ ID NO: 16332 - DNA, 21 bp, Artificial sequence
  Forward Primer
atagtcacaaatgcctccacc

SEQ ID NO: 16333 - DNA, 19 bp, Artificial sequence
  Forward Primer
tagttcattctgcgggttg

SEQ ID NO: 16334 - DNA, 22 bp, Artificial sequence
  Forward Primer
acactttgtccattactcaggc

SEQ ID NO: 16335 - DNA, 19 bp, Artificial sequence
  Forward Primer
atgatgtgtgcagccttca

SEQ ID NO: 16336 - DNA, 29 bp, Artificial sequence
  Forward Primer
atagatacacagaggattagagaaagtga

SEQ ID NO: 16337 - DNA, 21 bp, Artificial sequence
  Forward Primer
ttaaccctcactctttggctg

SEQ ID NO: 16338 - DNA, 18 bp, Artificial sequence
  Forward Primer
cttgcaaggtggcaccgg

SEQ ID NO: 16339 - DNA, 21 bp, Artificial sequence
  Forward Primer
ttggttttcagtaggcttcac

SEQ ID NO: 16340 - DNA, 19 bp, Artificial sequence
  Forward Primer
aaawtaccagagggcctgg

SEQ ID NO: 16341 - DNA, 19 bp, Artificial sequence
  Forward Primer
tcttgtgctcttccaaccc

SEQ ID NO: 16342 - DNA, 23 bp, Artificial sequence
  Forward Primer
tattttcttgggtttcattcacc

SEQ ID NO: 16343 - DNA, 24 bp, Artificial sequence
  Forward Primer
aatatcttggatcctttgagaagg

SEQ ID NO: 16344 - DNA, 21 bp, Artificial sequence
  Forward Primer
aattgaggtgacrtttcagct

SEQ ID NO: 16345 - DNA, 19 bp, Artificial sequence
  Forward Primer
tgatctggccactgcttta

SEQ ID NO: 16346 - DNA, 20 bp, Artificial sequence
  Forward Primer
acccctctcaccatctgtct

SEQ ID NO: 16347 - DNA, 22 bp, Artificial sequence
  Forward Primer
taagagtgaccttggagatcca

SEQ ID NO: 16348 - DNA, 19 bp, Artificial sequence
  Forward Primer
aggaagattccccaggaaa

SEQ ID NO: 16349 - DNA, 23 bp, Artificial sequence
  Forward Primer
ttttcagctgcttattctgtgtc

SEQ ID NO: 16350 - DNA, 18 bp, Artificial sequence
  Forward Primer
aaagatgcggcccccgtg

SEQ ID NO: 16351 - DNA, 25 bp, Artificial sequence
  Forward Primer
taaatgagcactacagctaaaatga

SEQ ID NO: 16352 - DNA, 21 bp, Artificial sequence
  Forward Primer
aatcaactctgccaccttctg

SEQ ID NO: 16353 - DNA, 18 bp, Artificial sequence
  Forward Primer
acattgtcscctgcacag

SEQ ID NO: 16354 - DNA, 23 bp, Artificial sequence
  Forward Primer
tagaaacttgtgagaaacatggc

SEQ ID NO: 16355 - DNA, 18 bp, Artificial sequence
  Forward Primer
agcgccttccactgcagc

SEQ ID NO: 16356 - DNA, 26 bp, Artificial sequence
  Forward Primer
ttaactgaagttgatatttgactgtg

SEQ ID NO: 16357 - DNA, 22 bp, Artificial sequence
  Forward Primer
tttgttatttcaggcctcagtc

SEQ ID NO: 16358 - DNA, 23 bp, Artificial sequence
  Forward Primer
acatctgttcctcatgactagca

SEQ ID NO: 16359 - DNA, 21 bp, Artificial sequence
  Forward Primer
taatgtgccacgtctgtatga

SEQ ID NO: 16360 - DNA, 23 bp, Artificial sequence
  Forward Primer
aaacactacgtctaakgcacagc

SEQ ID NO: 16361 - DNA, 20 bp, Artificial sequence
  Forward Primer
tcatgaggagaagagatggc

SEQ ID NO: 16362 - DNA, 26 bp, Artificial sequence
  Forward Primer
agaatctttggttgaaacttttctaa

SEQ ID NO: 16363 - DNA, 28 bp, Artificial sequence
  Forward Primer
gaagttttgtttacagtgtatcctttta

SEQ ID NO: 16364 - DNA, 28 bp, Artificial sequence
  Forward Primer
tactggtttattacaccatttagtcaga

SEQ ID NO: 16365 - DNA, 27 bp, Artificial sequence
  Forward Primer
tcattgtaactcaatagcattttaaga

SEQ ID NO: 16366 - DNA, 24 bp, Artificial sequence
  Forward Primer
aacctgaatctttaagtgtctcca

SEQ ID NO: 16367 - DNA, 20 bp, Artificial sequence
  Forward Primer
atgccattctgatcatttgg

SEQ ID NO: 16368 - DNA, 23 bp, Artificial sequence
  Forward Primer
tgaagagtgatattctgaaggga

SEQ ID NO: 16369 - DNA, 23 bp, Artificial sequence
  Forward Primer
ttttatttcacatttggaggtga

SEQ ID NO: 16370 - DNA, 19 bp, Artificial sequence
  Forward Primer
agaattgaagcatcagcgc

SEQ ID NO: 16371 - DNA, 19 bp, Artificial sequence
  Forward Primer
agtctcacacagctggctc

SEQ ID NO: 16372 - DNA, 28 bp, Artificial sequence
  Forward Primer
tattaattttcatccagtcaagtaattc

SEQ ID NO: 16373 - DNA, 29 bp, Artificial sequence
  Forward Primer
tactgataatcaaagagagaaaataatcc

SEQ ID NO: 16374 - DNA, 24 bp, Artificial sequence
  Forward Primer
aaacgcractgtgtttaatgttac

SEQ ID NO: 16375 - DNA, 28 bp, Artificial sequence
  Forward Primer
ttcaagataagagtaatctagarcaggt

SEQ ID NO: 16376 - DNA, 23 bp, Artificial sequence
  Forward Primer
ttttaatgtgttmttccactccc

SEQ ID NO: 16377 - DNA, 24 bp, Artificial sequence
  Forward Primer
tgactctttaattgatttttgctt

SEQ ID NO: 16378 - DNA, 23 bp, Artificial sequence
  Forward Primer
aactagtctggaagcatgtacac

SEQ ID NO: 16379 - DNA, 19 bp, Artificial sequence
  Forward Primer
agaaagttccctctggtct

SEQ ID NO: 16380 - DNA, 25 bp, Artificial sequence
  Forward Primer
ctctttttgcttaatgttctctgat

SEQ ID NO: 16381 - DNA, 25 bp, Artificial sequence
  Forward Primer
attgtatgacctactctctggattg

SEQ ID NO: 16382 - DNA, 23 bp, Artificial sequence
  Forward Primer
tttaggtaagtccctaccctttc

SEQ ID NO: 16383 - DNA, 24 bp, Artificial sequence
  Forward Primer
aaattttaaaactcccaacaaaca

SEQ ID NO: 16384 - DNA, 26 bp, Artificial sequence
  Forward Primer
attgagtgttattcactttaaatgca

SEQ ID NO: 16385 - DNA, 28 bp, Artificial sequence
  Forward Primer
taaaaactaaatatagccacaaactcaa

SEQ ID NO: 16386 - DNA, 19 bp, Artificial sequence
  Forward Primer
atggccaagtacagtctgg

SEQ ID NO: 16387 - DNA, 30 bp, Artificial sequence
  Forward Primer
ttatagatagtgattctcctaaaataaatg

SEQ ID NO: 16388 - DNA, 28 bp, Artificial sequence
  Forward Primer
ccaatattagcgtttttattctagttaa

SEQ ID NO: 16389 - DNA, 25 bp, Artificial sequence
  Forward Primer
ttcatacatatacatttccaccata

SEQ ID NO: 16390 - DNA, 26 bp, Artificial sequence
  Forward Primer
ataagcaagtgtataattatctcccc

SEQ ID NO: 16391 - DNA, 24 bp, Artificial sequence
  Forward Primer
caagaggaattcagaaaagagaaa

SEQ ID NO: 16392 - DNA, 25 bp, Artificial sequence
  Forward Primer
ttattgcttagtgggtacagtttca

SEQ ID NO: 16393 - DNA, 22 bp, Artificial sequence
  Forward Primer
atttattcagggccatactgtg

SEQ ID NO: 16394 - DNA, 24 bp, Artificial sequence
  Forward Primer
tttagaaatcatatcccctggtat

SEQ ID NO: 16395 - DNA, 27 bp, Artificial sequence
  Forward Primer
tttacacaatgaccttagaatacactg

SEQ ID NO: 16396 - DNA, 30 bp, Artificial sequence
  Forward Primer
aaaaaaactaactacacatgtaatacacat

SEQ ID NO: 16397 - DNA, 19 bp, Artificial sequence
  Forward Primer
ctgtctctgagcctgctct

SEQ ID NO: 16398 - DNA, 26 bp, Artificial sequence
  Forward Primer
taaaccactatgtgaaagttgatagg

SEQ ID NO: 16399 - DNA, 24 bp, Artificial sequence
  Forward Primer
tttttctgtaaaccaaaatgttcc

SEQ ID NO: 16400 - DNA, 25 bp, Artificial sequence
  Forward Primer
tttaagcactaatgtttttcattgc

SEQ ID NO: 16401 - DNA, 19 bp, Artificial sequence
  Forward Primer
aaaatttggggaaattgcc

SEQ ID NO: 16402 - DNA, 28 bp, Artificial sequence
  Forward Primer
ttatcmttwttctctagtctctttccat

SEQ ID NO: 16403 - DNA, 28 bp, Artificial sequence
  Forward Primer
gataaaaatgcttgctcttatttatctt

SEQ ID NO: 16404 - DNA, 22 bp, Artificial sequence
  Forward Primer
atggggaaagagtacaggtttt

SEQ ID NO: 16405 - DNA, 26 bp, Artificial sequence
  Forward Primer
attctgtgagcttcaataattcatta

SEQ ID NO: 16406 - DNA, 20 bp, Artificial sequence
  Forward Primer
aggatcatcacagagcaggt

SEQ ID NO: 16407 - DNA, 22 bp, Artificial sequence
  Forward Primer
aaatcaaaaacaaacctgcaga

SEQ ID NO: 16408 - DNA, 28 bp, Artificial sequence
  Forward Primer
acatttctcatcagttccttaataaatc

SEQ ID NO: 16409 - DNA, 23 bp, Artificial sequence
  Forward Primer
taaatcttcattctccccttctc

SEQ ID NO: 16410 - DNA, 23 bp, Artificial sequence
  Forward Primer
agctcttgtcctaagagagtgtt

SEQ ID NO: 16411 - DNA, 25 bp, Artificial sequence
  Forward Primer
agataccctcatcccttttataatg

SEQ ID NO: 16412 - DNA, 23 bp, Artificial sequence
  Forward Primer
aaagagatggacatgactgaagg

SEQ ID NO: 16413 - DNA, 21 bp, Artificial sequence
  Forward Primer
acatgaaaagtgaatttcgcc

SEQ ID NO: 16414 - DNA, 23 bp, Artificial sequence
  Forward Primer
aataaagtcactgagtcagcagg

SEQ ID NO: 16415 - DNA, 18 bp, Artificial sequence
  Forward Primer
tctcaccaagtgggcaga

SEQ ID NO: 16416 - DNA, 20 bp, Artificial sequence
  Forward Primer
caggatttcagtggaggttg

SEQ ID NO: 16417 - DNA, 19 bp, Artificial sequence
  Forward Primer
gatatcaacctggggcaag

SEQ ID NO: 16418 - DNA, 20 bp, Artificial sequence
  Forward Primer
aaagaacgtttggtgagcaa

SEQ ID NO: 16419 - DNA, 20 bp, Artificial sequence
  Forward Primer
ttccctttttgatttgtgca

SEQ ID NO: 16420 - DNA, 19 bp, Artificial sequence
  Forward Primer
ttcacatcccctaacaagc

SEQ ID NO: 16421 - DNA, 25 bp, Artificial sequence
  Forward Primer
ttcagtaaatacctatccaagacca

SEQ ID NO: 16422 - DNA, 18 bp, Artificial sequence
  Forward Primer
acgtgccaggatgaacca

SEQ ID NO: 16423 - DNA, 28 bp, Artificial sequence
  Forward Primer
atatatacatgcttttatttacaggcaa

SEQ ID NO: 16424 - DNA, 19 bp, Artificial sequence
  Forward Primer
tagaaagaggcgtgtgtgc

SEQ ID NO: 16425 - DNA, 26 bp, Artificial sequence
  Forward Primer
tatttttattagccytttcactttcc

SEQ ID NO: 16426 - DNA, 23 bp, Artificial sequence
  Forward Primer
aaaagaaatgggttaagaccaca

SEQ ID NO: 16427 - DNA, 27 bp, Artificial sequence
  Forward Primer
tatatttcttcctttactctgatccaa

SEQ ID NO: 16428 - DNA, 22 bp, Artificial sequence
  Forward Primer
actgaacgatgtctggaagaga

SEQ ID NO: 16429 - DNA, 26 bp, Artificial sequence
  Forward Primer
aagactcagtagcaaagyrctagaag

SEQ ID NO: 16430 - DNA, 18 bp, Artificial sequence
  Forward Primer
ttgggacagtcgggctta

SEQ ID NO: 16431 - DNA, 18 bp, Artificial sequence
  Forward Primer
aaactgaggcagygagca

SEQ ID NO: 16432 - DNA, 20 bp, Artificial sequence
  Forward Primer
gccatgccatgtagcttatg

SEQ ID NO: 16433 - DNA, 25 bp, Artificial sequence
  Forward Primer
aacggtaataggaagaagatctgtt

SEQ ID NO: 16434 - DNA, 19 bp, Artificial sequence
  Forward Primer
tcatgcccctatagcatgc

SEQ ID NO: 16435 - DNA, 18 bp, Artificial sequence
  Forward Primer
gtgtttgcccagcgcctg

SEQ ID NO: 16436 - DNA, 18 bp, Artificial sequence
  Forward Primer
ttgcaacccctgggaggt

SEQ ID NO: 16437 - DNA, 24 bp, Artificial sequence
  Forward Primer
taaatacctatccaagaccaccat

SEQ ID NO: 16438 - DNA, 19 bp, Artificial sequence
  Forward Primer
cagyacctgtggctttctg

SEQ ID NO: 16439 - DNA, 18 bp, Artificial sequence
  Forward Primer
ccagtccttcatggggtc

SEQ ID NO: 16440 - DNA, 21 bp, Artificial sequence
  Forward Primer
tcttacaagatggaggtgagg

SEQ ID NO: 16441 - DNA, 19 bp, Artificial sequence
  Forward Primer
agtcctgccccaagtacag

SEQ ID NO: 16442 - DNA, 20 bp, Artificial sequence
  Forward Primer
tgttggctaaaacgactcca

SEQ ID NO: 16443 - DNA, 18 bp, Artificial sequence
  Forward Primer
ggaattcgggaattcagg

SEQ ID NO: 16444 - DNA, 20 bp, Artificial sequence
  Forward Primer
tttggttcagaaaggtctgc

SEQ ID NO: 16445 - DNA, 28 bp, Artificial sequence
  Forward Primer
ttaattttctgttgatttctaagctcta

SEQ ID NO: 16446 - DNA, 18 bp, Artificial sequence
  Forward Primer
tgagttcccgagacagca

SEQ ID NO: 16447 - DNA, 18 bp, Artificial sequence
  Forward Primer
tgttgctcggactgtctg

SEQ ID NO: 16448 - DNA, 20 bp, Artificial sequence
  Forward Primer
ataatgatgccaggcagaga

SEQ ID NO: 16449 - DNA, 18 bp, Artificial sequence
  Forward Primer
tcccaggctgagagcact

SEQ ID NO: 16450 - DNA, 19 bp, Artificial sequence
  Forward Primer
ctgcgatactgccagtctg

SEQ ID NO: 16451 - DNA, 19 bp, Artificial sequence
  Forward Primer
aggagcacctgaaacctcc

SEQ ID NO: 16452 - DNA, 30 bp, Artificial sequence
  Forward Primer
ttattgaatttatagtgtagaaagaaaggc

SEQ ID NO: 16453 - DNA, 23 bp, Artificial sequence
  Forward Primer
aatgaaagcaactacatccttgg

SEQ ID NO: 16454 - DNA, 19 bp, Artificial sequence
  Forward Primer
ttagggggtggagatgtca

SEQ ID NO: 16455 - DNA, 21 bp, Artificial sequence
  Forward Primer
aggaggaattaggaacatgca

SEQ ID NO: 16456 - DNA, 18 bp, Artificial sequence
  Forward Primer
aaggcggattttctggaa

SEQ ID NO: 16457 - DNA, 19 bp, Artificial sequence
  Forward Primer
agaaggcatgtgtgcttcc

SEQ ID NO: 16458 - DNA, 23 bp, Artificial sequence
  Forward Primer
tttgcttaagaycttgctaagga

SEQ ID NO: 16459 - DNA, 24 bp, Artificial sequence
  Forward Primer
attttaaggattttgtcctgaaag

SEQ ID NO: 16460 - DNA, 27 bp, Artificial sequence
  Forward Primer
tatattgctgaaaaatgtaaagttgtg

SEQ ID NO: 16461 - DNA, 22 bp, Artificial sequence
  Forward Primer
gtagcctcagctcagcatagtc

SEQ ID NO: 16462 - DNA, 23 bp, Artificial sequence
  Forward Primer
ttcttctttttgttctcgaagag

SEQ ID NO: 16463 - DNA, 19 bp, Artificial sequence
  Forward Primer
acaccaatgtcttggaccc

SEQ ID NO: 16464 - DNA, 24 bp, Artificial sequence
  Forward Primer
atatttccaaacagcacaccttat

SEQ ID NO: 16465 - DNA, 22 bp, Artificial sequence
  Forward Primer
aaattcatcttggtgatttcca

SEQ ID NO: 16466 - DNA, 24 bp, Artificial sequence
  Forward Primer
ttattttcatgttcttaggggaga

SEQ ID NO: 16467 - DNA, 21 bp, Artificial sequence
  Forward Primer
taaatgctgagatgtggatgc

SEQ ID NO: 16468 - DNA, 24 bp, Artificial sequence
  Forward Primer
tttctgtaaatatctggggaaaag

SEQ ID NO: 16469 - DNA, 19 bp, Artificial sequence
  Forward Primer
gacactcraggctgagatg

SEQ ID NO: 16470 - DNA, 20 bp, Artificial sequence
  Forward Primer
ttaaaagcatmccattcctg

SEQ ID NO: 16471 - DNA, 28 bp, Artificial sequence
  Forward Primer
gcatcttcttatttagactttctgaatt

SEQ ID NO: 16472 - DNA, 20 bp, Artificial sequence
  Forward Primer
cactttgacaacttttgcca

SEQ ID NO: 16473 - DNA, 26 bp, Artificial sequence
  Forward Primer
gttcaaattgatatcattcaaaacag

SEQ ID NO: 16474 - DNA, 26 bp, Artificial sequence
  Forward Primer
ccacaatccttttaaatttttaactc

SEQ ID NO: 16475 - DNA, 23 bp, Artificial sequence
  Forward Primer
aaacagcatgaatgactgtagta

SEQ ID NO: 16476 - DNA, 19 bp, Artificial sequence
  Forward Primer
atacagttcggtggcctca

SEQ ID NO: 16477 - DNA, 25 bp, Artificial sequence
  Forward Primer
tctggtagtggatacagactctagg

SEQ ID NO: 16478 - DNA, 27 bp, Artificial sequence
  Forward Primer
ttatttttagagagcacataaaggaat

SEQ ID NO: 16479 - DNA, 26 bp, Artificial sequence
  Forward Primer
tttttcagtaatgctgtttatgaact

SEQ ID NO: 16480 - DNA, 26 bp, Artificial sequence
  Forward Primer
atatgtatacctatagctgattgact

SEQ ID NO: 16481 - DNA, 22 bp, Artificial sequence
  Forward Primer
catgaataagggaacacatcac

SEQ ID NO: 16482 - DNA, 23 bp, Artificial sequence
  Forward Primer
tttttgctgtacatttttctcca

SEQ ID NO: 16483 - DNA, 22 bp, Artificial sequence
  Forward Primer
caaatgagtttttagggtctgg

SEQ ID NO: 16484 - DNA, 23 bp, Artificial sequence
  Forward Primer
tctgaggaaaggctaaaagagtt

SEQ ID NO: 16485 - DNA, 23 bp, Artificial sequence
  Forward Primer
accacttttattttaccccatgt

SEQ ID NO: 16486 - DNA, 20 bp, Artificial sequence
  Forward Primer
agattgtctagggcaactga

SEQ ID NO: 16487 - DNA, 23 bp, Artificial sequence
  Forward Primer
gcagtgtctggcacttagttagt

SEQ ID NO: 16488 - DNA, 28 bp, Artificial sequence
  Forward Primer
ctcatcattgatttaattaacatatcca

SEQ ID NO: 16489 - DNA, 29 bp, Artificial sequence
  Forward Primer
attaatatgatctgtgcctattatatgct

SEQ ID NO: 16490 - DNA, 21 bp, Artificial sequence
  Forward Primer
tggattttgtgtaatggcaat

SEQ ID NO: 16491 - DNA, 25 bp, Artificial sequence
  Forward Primer
tttgctttctcaatttcttctctaa

SEQ ID NO: 16492 - DNA, 24 bp, Artificial sequence
  Forward Primer
tgcaaaaatgctgattatmacata

SEQ ID NO: 16493 - DNA, 24 bp, Artificial sequence
  Forward Primer
cacacaaactcaagccatattaat

SEQ ID NO: 16494 - DNA, 25 bp, Artificial sequence
  Forward Primer
ttttatcatgaaaatgttcctctct

SEQ ID NO: 16495 - DNA, 27 bp, Artificial sequence
  Forward Primer
ttcttaagagatgtaattgaaaacacc

SEQ ID NO: 16496 - DNA, 26 bp, Artificial sequence
  Forward Primer
tacaagagcaataattcctacagtga

SEQ ID NO: 16497 - DNA, 24 bp, Artificial sequence
  Forward Primer
attgttcaggtaagataactggga

SEQ ID NO: 16498 - DNA, 27 bp, Artificial sequence
  Forward Primer
taaaaggtcaaagagcaataattaaga

SEQ ID NO: 16499 - DNA, 29 bp, Artificial sequence
  Forward Primer
acacgtaaagtatataagcaaaayaaaca

SEQ ID NO: 16500 - DNA, 28 bp, Artificial sequence
  Forward Primer
ataaccaggaaaaagtcataagatatgt

SEQ ID NO: 16501 - DNA, 24 bp, Artificial sequence
  Forward Primer
ctcatgataagcaaaagactatgg

SEQ ID NO: 16502 - DNA, 30 bp, Artificial sequence
  Forward Primer
atactataagaagcagttctaagctatttg

SEQ ID NO: 16503 - DNA, 28 bp, Artificial sequence
  Forward Primer
tcttgatggtaattttgttttagtaatg

SEQ ID NO: 16504 - DNA, 23 bp, Artificial sequence
  Forward Primer
atctatcttgatgtgggaactcc

SEQ ID NO: 16505 - DNA, 24 bp, Artificial sequence
  Forward Primer
atttttcattaaggcaacttgttt

SEQ ID NO: 16506 - DNA, 28 bp, Artificial sequence
  Forward Primer
aattctacaagtcataaataacactcaa

SEQ ID NO: 16507 - DNA, 18 bp, Artificial sequence
  Forward Primer
ttagaaggagggagggca

SEQ ID NO: 16508 - DNA, 28 bp, Artificial sequence
  Forward Primer
agataccatctttaagttgtttcatttt

SEQ ID NO: 16509 - DNA, 20 bp, Artificial sequence
  Forward Primer
ggaattctgaatctgggctt

SEQ ID NO: 16510 - DNA, 21 bp, Artificial sequence
  Forward Primer
ttctcaaaaatggacaggaca

SEQ ID NO: 16511 - DNA, 22 bp, Artificial sequence
  Forward Primer
atgggaaagaaggaaataatgg

SEQ ID NO: 16512 - DNA, 18 bp, Artificial sequence
  Forward Primer
taggaggctggtagctgc

SEQ ID NO: 16513 - DNA, 26 bp, Artificial sequence
  Forward Primer
gtagcttaataaaccacatcaaaagc

SEQ ID NO: 16514 - DNA, 23 bp, Artificial sequence
  Forward Primer
aaaaggtttcgatttttagtggt

SEQ ID NO: 16515 - DNA, 28 bp, Artificial sequence
  Forward Primer
atatatacatgcttttatttacaggcaa

SEQ ID NO: 16516 - DNA, 18 bp, Artificial sequence
  Forward Primer
catgagagaggacgggag

SEQ ID NO: 16517 - DNA, 22 bp, Artificial sequence
  Forward Primer
ttgcagacagcttcttaaatcc

SEQ ID NO: 16518 - DNA, 22 bp, Artificial sequence
  Forward Primer
tttgtccattgagatgactgat

SEQ ID NO: 16519 - DNA, 20 bp, Artificial sequence
  Forward Primer
actctcggatcttgcctttg

SEQ ID NO: 16520 - DNA, 22 bp, Artificial sequence
  Forward Primer
tcacagaagaagagatgcacaa

SEQ ID NO: 16521 - DNA, 24 bp, Artificial sequence
  Forward Primer
ttaaacacatcaagtgacctttcc

SEQ ID NO: 16522 - DNA, 21 bp, Artificial sequence
  Forward Primer
atccatgaaagaggaaggagg

SEQ ID NO: 16523 - DNA, 23 bp, Artificial sequence
  Forward Primer
agagtgcattttgtagacatgga

SEQ ID NO: 16524 - DNA, 25 bp, Artificial sequence
  Forward Primer
agartctgtatgatgagagatgtgc

SEQ ID NO: 16525 - DNA, 22 bp, Artificial sequence
  Forward Primer
agatcgtttgtttgtaggctga

SEQ ID NO: 16526 - DNA, 18 bp, Artificial sequence
  Forward Primer
aattttgcatccacgcaa

SEQ ID NO: 16527 - DNA, 18 bp, Artificial sequence
  Forward Primer
aaggacagctgccactcc

SEQ ID NO: 16528 - DNA, 21 bp, Artificial sequence
  Forward Primer
aggcacrgtctagagtggatc

SEQ ID NO: 16529 - DNA, 19 bp, Artificial sequence
  Forward Primer
gccaaaaccatgataactg

SEQ ID NO: 16530 - DNA, 21 bp, Artificial sequence
  Forward Primer
ctggtactcctgctcgttagc

SEQ ID NO: 16531 - DNA, 18 bp, Artificial sequence
  Forward Primer
tatccaggccaaaagcag

SEQ ID NO: 16532 - DNA, 24 bp, Artificial sequence
  Forward Primer
atctttgttcctattctttggacc

SEQ ID NO: 16533 - DNA, 27 bp, Artificial sequence
  Forward Primer
tttattactaagatgcaagtgaatgtc

SEQ ID NO: 16534 - DNA, 29 bp, Artificial sequence
  Forward Primer
tasttatcacagtctagatgactgcatat

SEQ ID NO: 16535 - DNA, 22 bp, Artificial sequence
  Forward Primer
acttgtgctgcttgtgtaggta

SEQ ID NO: 16536 - DNA, 25 bp, Artificial sequence
  Forward Primer
ctaaaaaattgtgggtcctatcttc

SEQ ID NO: 16537 - DNA, 25 bp, Artificial sequence
  Forward Primer
gagagattattactgaaatcctggg

SEQ ID NO: 16538 - DNA, 18 bp, Artificial sequence
  Forward Primer
tacaggtgccccgaagtc

SEQ ID NO: 16539 - DNA, 18 bp, Artificial sequence
  Forward Primer
atagggcttggcaaggtc

SEQ ID NO: 16540 - DNA, 18 bp, Artificial sequence
  Forward Primer
atgaaggagctgctggct

SEQ ID NO: 16541 - DNA, 19 bp, Artificial sequence
  Forward Primer
aatgaaattctctgccccc

SEQ ID NO: 16542 - DNA, 23 bp, Artificial sequence
  Forward Primer
agcagagtaaggrcagatctttg

SEQ ID NO: 16543 - DNA, 23 bp, Artificial sequence
  Forward Primer
atggtgtatctgaggcattatcc

SEQ ID NO: 16544 - DNA, 26 bp, Artificial sequence
  Forward Primer
tatctgaagagaattgaatagttgcc

SEQ ID NO: 16545 - DNA, 22 bp, Artificial sequence
  Forward Primer
agaacaaaaggagaagcaaaca

SEQ ID NO: 16546 - DNA, 22 bp, Artificial sequence
  Forward Primer
taaatggacatcagacmccttc

SEQ ID NO: 16547 - DNA, 22 bp, Artificial sequence
  Forward Primer
atcgagagtttagtttcaggca

SEQ ID NO: 16548 - DNA, 24 bp, Artificial sequence
  Forward Primer
atttcagaaaagtaagacagccag

SEQ ID NO: 16549 - DNA, 19 bp, Artificial sequence
  Forward Primer
ttttccactctcctcccac

SEQ ID NO: 16550 - DNA, 23 bp, Artificial sequence
  Forward Primer
atggttgtaaaggtgaaagaaca

SEQ ID NO: 16551 - DNA, 18 bp, Artificial sequence
  Forward Primer
agctgggcttctccccgt

SEQ ID NO: 16552 - DNA, 19 bp, Artificial sequence
  Forward Primer
tggaaagcacactgagtgg

SEQ ID NO: 16553 - DNA, 18 bp, Artificial sequence
  Forward Primer
aactgctgaagcccacga

SEQ ID NO: 16554 - DNA, 18 bp, Artificial sequence
  Forward Primer
aggttgttggggaaccag

SEQ ID NO: 16555 - DNA, 21 bp, Artificial sequence
  Forward Primer
taaagaatccacgtgaaaatg

SEQ ID NO: 16556 - DNA, 27 bp, Artificial sequence
  Forward Primer
agaaaagtccttagaactcyatcactt

SEQ ID NO: 16557 - DNA, 22 bp, Artificial sequence
  Forward Primer
tggacaagtcacctagyctctc

SEQ ID NO: 16558 - DNA, 21 bp, Artificial sequence
  Forward Primer
ttcttgcaacatgtgttcttg

SEQ ID NO: 16559 - DNA, 23 bp, Artificial sequence
  Forward Primer
tttaaaaaggtcgtgttgttgtt

SEQ ID NO: 16560 - DNA, 29 bp, Artificial sequence
  Forward Primer
atkctrtgcatatagataatgtctaagag

SEQ ID NO: 16561 - DNA, 22 bp, Artificial sequence
  Forward Primer
aatctccccttagttttatggc

SEQ ID NO: 16562 - DNA, 23 bp, Artificial sequence
  Forward Primer
tatgatgactttcattttcatgg

SEQ ID NO: 16563 - DNA, 27 bp, Artificial sequence
  Forward Primer
tttaaacagaccagcttcatataattt

SEQ ID NO: 16564 - DNA, 26 bp, Artificial sequence
  Forward Primer
aaagagaatctctgaaccttacatgt

SEQ ID NO: 16565 - DNA, 19 bp, Artificial sequence
  Forward Primer
tggtgtcccttttcttcag

SEQ ID NO: 16566 - DNA, 19 bp, Artificial sequence
  Forward Primer
gggtgggcattcagtagac

SEQ ID NO: 16567 - DNA, 29 bp, Artificial sequence
  Forward Primer
taacatattatcagtacaaaagacttccc

SEQ ID NO: 16568 - DNA, 26 bp, Artificial sequence
  Forward Primer
ttttaaaacgatgttaagtgtgtttc

SEQ ID NO: 16569 - DNA, 23 bp, Artificial sequence
  Forward Primer
atattgggcaaaaagaaatatgc

SEQ ID NO: 16570 - DNA, 23 bp, Artificial sequence
  Forward Primer
aaacccctctgaatagtatttat

SEQ ID NO: 16571 - DNA, 25 bp, Artificial sequence
  Forward Primer
attatataattttgtgtgctgctag

SEQ ID NO: 16572 - DNA, 26 bp, Artificial sequence
  Forward Primer
aatatcccatttcattatttcaagtc

SEQ ID NO: 16573 - DNA, 19 bp, Artificial sequence
  Forward Primer
gcttggtgaccaaacaaca

SEQ ID NO: 16574 - DNA, 27 bp, Artificial sequence
  Forward Primer
aaattaattctgttatttcacgaacac

SEQ ID NO: 16575 - DNA, 19 bp, Artificial sequence
  Forward Primer
aaaggcagacagggggcta

SEQ ID NO: 16576 - DNA, 22 bp, Artificial sequence
  Forward Primer
aacctaatggcctctcctagag

SEQ ID NO: 16577 - DNA, 24 bp, Artificial sequence
  Forward Primer
gatagattttgctcactctgaatg

SEQ ID NO: 16578 - DNA, 26 bp, Artificial sequence
  Forward Primer
attacaagtatagaatgctgggaaac

SEQ ID NO: 16579 - DNA, 26 bp, Artificial sequence
  Forward Primer
tttattgtggtttatcaagtggttac

SEQ ID NO: 16580 - DNA, 21 bp, Artificial sequence
  Forward Primer
cccagccacacttatgtttta

SEQ ID NO: 16581 - DNA, 25 bp, Artificial sequence
  Forward Primer
ggaataaagcaacaattcataatgt

SEQ ID NO: 16582 - DNA, 28 bp, Artificial sequence
  Forward Primer
gctttattttcttatttttagagagcac

SEQ ID NO: 16583 - DNA, 23 bp, Artificial sequence
  Forward Primer
taagtttgctgaagagattctgg

SEQ ID NO: 16584 - DNA, 20 bp, Artificial sequence
  Forward Primer
agaattattgcactgccatg

SEQ ID NO: 16585 - DNA, 20 bp, Artificial sequence
  Forward Primer
ttccttgaaggcagaaactg

SEQ ID NO: 16586 - DNA, 25 bp, Artificial sequence
  Forward Primer
aagatggyatctttgttcctattct

SEQ ID NO: 16587 - DNA, 27 bp, Artificial sequence
  Forward Primer
aaatcagtaactgtaaccaaaggaata

SEQ ID NO: 16588 - DNA, 28 bp, Artificial sequence
  Forward Primer
agttaagaaatagttgaacataatttgc

SEQ ID NO: 16589 - DNA, 25 bp, Artificial sequence
  Forward Primer
ttttcttccaatagttkgcttagtt

SEQ ID NO: 16590 - DNA, 20 bp, Artificial sequence
  Forward Primer
aaaggtagggatttgcttcc

SEQ ID NO: 16591 - DNA, 20 bp, Artificial sequence
  Forward Primer
ttgggcagctaacattactt

SEQ ID NO: 16592 - DNA, 23 bp, Artificial sequence
  Forward Primer
aagaaaatagttcctcctgaagg

SEQ ID NO: 16593 - DNA, 24 bp, Artificial sequence
  Forward Primer
tttttctgtaaaccaaaatgttcc

SEQ ID NO: 16594 - DNA, 18 bp, Artificial sequence
  Forward Primer
ccagcccaggaagcaata

SEQ ID NO: 16595 - DNA, 27 bp, Artificial sequence
  Forward Primer
aaaaactattccacctgtacttctaca

SEQ ID NO: 16596 - DNA, 20 bp, Artificial sequence
  Forward Primer
tcccaagagaccttgtgaag

SEQ ID NO: 16597 - DNA, 26 bp, Artificial sequence
  Forward Primer
aatttatatcatgcctttactgcttc

SEQ ID NO: 16598 - DNA, 29 bp, Artificial sequence
  Forward Primer
agcatatagtttgagataggaattaatca

SEQ ID NO: 16599 - DNA, 24 bp, Artificial sequence
  Forward Primer
aagaaagccacaaacaaaaataat

SEQ ID NO: 16600 - DNA, 19 bp, Artificial sequence
  Forward Primer
cgtctggctgtgtgtctgt

SEQ ID NO: 16601 - DNA, 26 bp, Artificial sequence
  Forward Primer
cgagtaaaatccaatgacttaattta

SEQ ID NO: 16602 - DNA, 23 bp, Artificial sequence
  Forward Primer
aatgataacagagaagagccttt

SEQ ID NO: 16603 - DNA, 25 bp, Artificial sequence
  Forward Primer
aatcattagcaatctgttgtttgtt

SEQ ID NO: 16604 - DNA, 28 bp, Artificial sequence
  Forward Primer
gaagagacaagaatatacaattgaaaaa

SEQ ID NO: 16605 - DNA, 18 bp, Artificial sequence
  Forward Primer
atggcacatggttctgcc

SEQ ID NO: 16606 - DNA, 26 bp, Artificial sequence
  Forward Primer
ccaatcctagataaaacactgaaatt

SEQ ID NO: 16607 - DNA, 29 bp, Artificial sequence
  Forward Primer
aaaaatgctgattatmacatagatctaga

SEQ ID NO: 16608 - DNA, 26 bp, Artificial sequence
  Forward Primer
attttttccayrttatttgtcacttg

SEQ ID NO: 16609 - DNA, 18 bp, Artificial sequence
  Forward Primer
atggccgccaaggtctgc

SEQ ID NO: 16610 - DNA, 18 bp, Artificial sequence
  Forward Primer
tctgttggcttgagtgca

SEQ ID NO: 16611 - DNA, 18 bp, Artificial sequence
  Forward Primer
tcatggagacccgaaaca

SEQ ID NO: 16612 - DNA, 24 bp, Artificial sequence
  Forward Primer
aaackaacttggttttcagtaggc

SEQ ID NO: 16613 - DNA, 23 bp, Artificial sequence
  Forward Primer
tcatagatagaaacgtggcaaag

SEQ ID NO: 16614 - DNA, 21 bp, Artificial sequence
  Forward Primer
atgcttgaaaactcaactggc

SEQ ID NO: 16615 - DNA, 24 bp, Artificial sequence
  Forward Primer
aaaatatgttgacacccttctctc

SEQ ID NO: 16616 - DNA, 24 bp, Artificial sequence
  Forward Primer
aatttaatgtcagagtcttctcgc

SEQ ID NO: 16617 - DNA, 24 bp, Artificial sequence
  Forward Primer
taagcaaacttacctctcacaatg

SEQ ID NO: 16618 - DNA, 23 bp, Artificial sequence
  Forward Primer
tttgtattcagaaaacygcagac

SEQ ID NO: 16619 - DNA, 24 bp, Artificial sequence
  Forward Primer
ayrtgcaaactctttagttacagc

SEQ ID NO: 16620 - DNA, 24 bp, Artificial sequence
  Forward Primer
tattcctgtaacaggcagactttt

SEQ ID NO: 16621 - DNA, 20 bp, Artificial sequence
  Forward Primer
tctgctcygtgtgtaacgtg

SEQ ID NO: 16622 - DNA, 21 bp, Artificial sequence
  Forward Primer
gagacacttaggcaggagtgc

SEQ ID NO: 16623 - DNA, 21 bp, Artificial sequence
  Forward Primer
ataaaactttggcgaatgagg

SEQ ID NO: 16624 - DNA, 25 bp, Artificial sequence
  Forward Primer
agtcgtctraagaaaagtgaagatt

SEQ ID NO: 16625 - DNA, 19 bp, Artificial sequence
  Forward Primer
aaatgaattcctggggtcc

SEQ ID NO: 16626 - DNA, 26 bp, Artificial sequence
  Forward Primer
tattcaataaccaagttctmaaacca

SEQ ID NO: 16627 - DNA, 22 bp, Artificial sequence
  Forward Primer
tttgcttccttctgagagtctg

SEQ ID NO: 16628 - DNA, 26 bp, Artificial sequence
  Forward Primer
agataaacaaaacaagcattcatagc

SEQ ID NO: 16629 - DNA, 24 bp, Artificial sequence
  Forward Primer
ttttatggatcacacaagttttca

SEQ ID NO: 16630 - DNA, 18 bp, Artificial sequence
  Forward Primer
gcgtcttttgttggaagg

SEQ ID NO: 16631 - DNA, 19 bp, Artificial sequence
  Forward Primer
taagcatactgcctgccac

SEQ ID NO: 16632 - DNA, 23 bp, Artificial sequence
  Forward Primer
atttctcagacagagaccaaagg

SEQ ID NO: 16633 - DNA, 21 bp, Artificial sequence
  Forward Primer
taatgagagtcaggacggagg

SEQ ID NO: 16634 - DNA, 20 bp, Artificial sequence
  Forward Primer
ttttttgcaaagccaaagtg

SEQ ID NO: 16635 - DNA, 22 bp, Artificial sequence
  Forward Primer
aggcttcctctctagtttcaat

SEQ ID NO: 16636 - DNA, 22 bp, Artificial sequence
  Forward Primer
actgtgtccaaacttatcgtgc

SEQ ID NO: 16637 - DNA, 22 bp, Artificial sequence
  Forward Primer
ctatctcttcctgggatttcat

SEQ ID NO: 16638 - DNA, 22 bp, Artificial sequence
  Forward Primer
aaagataacactggcatcttgc

SEQ ID NO: 16639 - DNA, 19 bp, Artificial sequence
  Forward Primer
tggttgagacaggtcaggt

SEQ ID NO: 16640 - DNA, 18 bp, Artificial sequence
  Forward Primer
ggcccagccagaaatcac

SEQ ID NO: 16641 - DNA, 19 bp, Artificial sequence
  Forward Primer
aagagtgaaggaggcaggc

SEQ ID NO: 16642 - DNA, 20 bp, Artificial sequence
  Forward Primer
tctcttggtgttgaccgtct

SEQ ID NO: 16643 - DNA, 22 bp, Artificial sequence
  Forward Primer
ttgaagtttggattttccagtt

SEQ ID NO: 16644 - DNA, 26 bp, Artificial sequence
  Forward Primer
atgttctacttcctccacgatatatg

SEQ ID NO: 16645 - DNA, 30 bp, Artificial sequence
  Forward Primer
taagacatcttatttcttttagaaactagc

SEQ ID NO: 16646 - DNA, 25 bp, Artificial sequence
  Forward Primer
attaaagaaattgcccataattctg

SEQ ID NO: 16647 - DNA, 28 bp, Artificial sequence
  Forward Primer
aaatatctcacacaaatatcaaatatgg

SEQ ID NO: 16648 - DNA, 20 bp, Artificial sequence
  Forward Primer
tttgatagcactgcttctgg

SEQ ID NO: 16649 - DNA, 20 bp, Artificial sequence
  Forward Primer
ccaatctgctatattctgct

SEQ ID NO: 16650 - DNA, 28 bp, Artificial sequence
  Forward Primer
tataaaaataaaacatgtactgcagttg

SEQ ID NO: 16651 - DNA, 26 bp, Artificial sequence
  Forward Primer
ggtgaaaaggtgagartaaaataatg

SEQ ID NO: 16652 - DNA, 20 bp, Artificial sequence
  Forward Primer
aattcttcctggaaaagccc

SEQ ID NO: 16653 - DNA, 18 bp, Artificial sequence
  Forward Primer
acaagaccaggatggctg

SEQ ID NO: 16654 - DNA, 24 bp, Artificial sequence
  Forward Primer
tgagtttagtgagcatctttacga

SEQ ID NO: 16655 - DNA, 22 bp, Artificial sequence
  Forward Primer
aaaagcatggtatagcagaaag

SEQ ID NO: 16656 - DNA, 26 bp, Artificial sequence
  Forward Primer
ttctaaaatatggtattcgactcctg

SEQ ID NO: 16657 - DNA, 19 bp, Artificial sequence
  Forward Primer
attgagcacagcgtctgac

SEQ ID NO: 16658 - DNA, 25 bp, Artificial sequence
  Forward Primer
ttaatttccttcttgtraaatatgc

SEQ ID NO: 16659 - DNA, 27 bp, Artificial sequence
  Forward Primer
aatagtcaccttgagcagtagagtatg

SEQ ID NO: 16660 - DNA, 25 bp, Artificial sequence
  Forward Primer
attaccatcatcaccatcaagatac

SEQ ID NO: 16661 - DNA, 26 bp, Artificial sequence
  Forward Primer
aaagatgacaacaataacagaactga

SEQ ID NO: 16662 - DNA, 22 bp, Artificial sequence
  Forward Primer
ttgcgaatcaggtagttagctt

SEQ ID NO: 16663 - DNA, 24 bp, Artificial sequence
  Forward Primer
taagggcatatggagtagaaaatg

SEQ ID NO: 16664 - DNA, 28 bp, Artificial sequence
  Forward Primer
ttgaatagaatttacaagttaaaggaca

SEQ ID NO: 16665 - DNA, 24 bp, Artificial sequence
  Forward Primer
taagggcatatggagtagaaaatg

SEQ ID NO: 16666 - DNA, 20 bp, Artificial sequence
  Forward Primer
attccagaacctgtcccttc

SEQ ID NO: 16667 - DNA, 25 bp, Artificial sequence
  Forward Primer
aaaatcgacagtattgtgtgtatgg

SEQ ID NO: 16668 - DNA, 19 bp, Artificial sequence
  Forward Primer
taatggccctgttccctaa

SEQ ID NO: 16669 - DNA, 21 bp, Artificial sequence
  Forward Primer
tttttagaatgaccgcacatg

SEQ ID NO: 16670 - DNA, 23 bp, Artificial sequence
  Forward Primer
atgaagtgtcatgactgctaatt

SEQ ID NO: 16671 - DNA, 30 bp, Artificial sequence
  Forward Primer
aaatatgtatgtctctctgttctatgctag

SEQ ID NO: 16672 - DNA, 24 bp, Artificial sequence
  Forward Primer
agaaagctccattcagatctacag

SEQ ID NO: 16673 - DNA, 28 bp, Artificial sequence
  Forward Primer
aatatggttttatttctcattgtattcc

SEQ ID NO: 16674 - DNA, 25 bp, Artificial sequence
  Forward Primer
atttcactttatggagatgatttga

SEQ ID NO: 16675 - DNA, 20 bp, Artificial sequence
  Forward Primer
ggcatccacaaaataaagat

SEQ ID NO: 16676 - DNA, 29 bp, Artificial sequence
  Forward Primer
attttctctgaataggtatcatttttacc

SEQ ID NO: 16677 - DNA, 24 bp, Artificial sequence
  Forward Primer
aacaaaatgagagtgttcatgagc

SEQ ID NO: 16678 - DNA, 26 bp, Artificial sequence
  Forward Primer
tgtttttaaattaaggtggatcatac

SEQ ID NO: 16679 - DNA, 25 bp, Artificial sequence
  Forward Primer
ttatagccaattagcaatgttgttc

SEQ ID NO: 16680 - DNA, 26 bp, Artificial sequence
  Forward Primer
ataagagatttagcatttcctcagac

SEQ ID NO: 16681 - DNA, 22 bp, Artificial sequence
  Forward Primer
aaaggagaaagaaaaaagcctt

SEQ ID NO: 16682 - DNA, 30 bp, Artificial sequence
  Forward Primer
gtcactgattatctatgttatatgacaatt

SEQ ID NO: 16683 - DNA, 21 bp, Artificial sequence
  Forward Primer
tttcttttgaaatttccccaa

SEQ ID NO: 16684 - DNA, 18 bp, Artificial sequence
  Forward Primer
catttgcgggctccttcg

SEQ ID NO: 16685 - DNA, 23 bp, Artificial sequence
  Forward Primer
aacagtgataaatggcagatcag

SEQ ID NO: 16686 - DNA, 19 bp, Artificial sequence
  Forward Primer
tggaattcagggctggtat

SEQ ID NO: 16687 - DNA, 23 bp, Artificial sequence
  Forward Primer
aatcaggaactaccgtaatgacc

SEQ ID NO: 16688 - DNA, 23 bp, Artificial sequence
  Forward Primer
tcagagggtgttagaggtagtga

SEQ ID NO: 16689 - DNA, 25 bp, Artificial sequence
  Forward Primer
ataaagaggacaaaggaaagaaaga

SEQ ID NO: 16690 - DNA, 30 bp, Artificial sequence
  Forward Primer
aggagatagacataaatagatacagatata

SEQ ID NO: 16691 - DNA, 23 bp, Artificial sequence
  Forward Primer
tttgaaccactttaagatgacca

SEQ ID NO: 16692 - DNA, 20 bp, Artificial sequence
  Forward Primer
attcagcatgtttgctttaa

SEQ ID NO: 16693 - DNA, 24 bp, Artificial sequence
  Forward Primer
catataataaaactagtggtccca

SEQ ID NO: 16694 - DNA, 26 bp, Artificial sequence
  Forward Primer
agctgatacamtgtrctatcacatct

SEQ ID NO: 16695 - DNA, 18 bp, Artificial sequence
  Forward Primer
gttcccctggcagtcaac

SEQ ID NO: 16696 - DNA, 26 bp, Artificial sequence
  Forward Primer
aagaaacattagcttgcagtattttt

SEQ ID NO: 16697 - DNA, 20 bp, Artificial sequence
  Forward Primer
agcctgtgaacctgaaatga

SEQ ID NO: 16698 - DNA, 27 bp, Artificial sequence
  Forward Primer
aatagtcaccttgagcagtagagtatg

SEQ ID NO: 16699 - DNA, 18 bp, Artificial sequence
  Forward Primer
aattcccaccaaaccagg

SEQ ID NO: 16700 - DNA, 23 bp, Artificial sequence
  Forward Primer
ttttatattggattcaatcggag

SEQ ID NO: 16701 - DNA, 25 bp, Artificial sequence
  Forward Primer
ttttaatgatggtggaattaactgt

SEQ ID NO: 16702 - DNA, 24 bp, Artificial sequence
  Forward Primer
catctctgcatgacatttagtgtt

SEQ ID NO: 16703 - DNA, 25 bp, Artificial sequence
  Forward Primer
tttatattttctggttgaggacagt

SEQ ID NO: 16704 - DNA, 18 bp, Artificial sequence
  Forward Primer
gactcgggttcagggtct

SEQ ID NO: 16705 - DNA, 18 bp, Artificial sequence
  Forward Primer
ggcatagccagcctgtcc

SEQ ID NO: 16706 - DNA, 19 bp, Artificial sequence
  Forward Primer
taaacagaccacrgagggg

SEQ ID NO: 16707 - DNA, 19 bp, Artificial sequence
  Forward Primer
tggtttacgcttcacacca

SEQ ID NO: 16708 - DNA, 18 bp, Artificial sequence
  Forward Primer
tctggaaccctcctgtgc

SEQ ID NO: 16709 - DNA, 18 bp, Artificial sequence
  Forward Primer
tgggagtttgggatgagc

SEQ ID NO: 16710 - DNA, 26 bp, Artificial sequence
  Forward Primer
atgtttttacaagcgctctatatttt

SEQ ID NO: 16711 - DNA, 24 bp, Artificial sequence
  Forward Primer
ccatcttttattttctcacctacc

SEQ ID NO: 16712 - DNA, 25 bp, Artificial sequence
  Forward Primer
aagaaatttcacaactccctaattc

SEQ ID NO: 16713 - DNA, 22 bp, Artificial sequence
  Forward Primer
tcagagaggccaagtaatcatc

SEQ ID NO: 16714 - DNA, 20 bp, Artificial sequence
  Forward Primer
tactgcaaagacagagcctt

SEQ ID NO: 16715 - DNA, 22 bp, Artificial sequence
  Forward Primer
ttccgtctacaggaaagtgagt

SEQ ID NO: 16716 - DNA, 25 bp, Artificial sequence
  Forward Primer
tatgacacagtgaactgtctagctc

SEQ ID NO: 16717 - DNA, 18 bp, Artificial sequence
  Forward Primer
aaacacggcagctcagga

SEQ ID NO: 16718 - DNA, 19 bp, Artificial sequence
  Forward Primer
tggagtgaagtttgcatgc

SEQ ID NO: 16719 - DNA, 29 bp, Artificial sequence
  Forward Primer
aagtatttatttatttcactgtgttggtc

SEQ ID NO: 16720 - DNA, 24 bp, Artificial sequence
  Forward Primer
ataatagggactcataatagtggt

SEQ ID NO: 16721 - DNA, 23 bp, Artificial sequence
  Forward Primer
agcagagtaaggrcagatctttg

SEQ ID NO: 16722 - DNA, 19 bp, Artificial sequence
  Forward Primer
cagcaatgggctcagtacc

SEQ ID NO: 16723 - DNA, 21 bp, Artificial sequence
  Forward Primer
atgaggaaagctaagagccag

SEQ ID NO: 16724 - DNA, 22 bp, Artificial sequence
  Forward Primer
tctttgcttccttctgagagtc

SEQ ID NO: 16725 - DNA, 22 bp, Artificial sequence
  Forward Primer
atgccttcttccattgtaaatg

SEQ ID NO: 16726 - DNA, 24 bp, Artificial sequence
  Forward Primer
taaaccaaggcatatttagaaagg

SEQ ID NO: 16727 - DNA, 18 bp, Artificial sequence
  Forward Primer
atactggtcctgggtggc

SEQ ID NO: 16728 - DNA, 18 bp, Artificial sequence
  Forward Primer
atctgtgggtgggtgtcc

SEQ ID NO: 16729 - DNA, 20 bp, Artificial sequence
  Forward Primer
tgctattgctggatttttcc

SEQ ID NO: 16730 - DNA, 27 bp, Artificial sequence
  Forward Primer
tcatcagtctagaacatttattaagca

SEQ ID NO: 16731 - DNA, 21 bp, Artificial sequence
  Forward Primer
agcagtgacctcagtgatcag

SEQ ID NO: 16732 - DNA, 18 bp, Artificial sequence
  Forward Primer
tcccggaactgcacagaa

SEQ ID NO: 16733 - DNA, 19 bp, Artificial sequence
  Forward Primer
tttcaagcactgctttccc

SEQ ID NO: 16734 - DNA, 20 bp, Artificial sequence
  Forward Primer
aygygtgttctgcacatctg

SEQ ID NO: 16735 - DNA, 22 bp, Artificial sequence
  Forward Primer
atatttctcctttcccatgaag

SEQ ID NO: 16736 - DNA, 20 bp, Artificial sequence
  Forward Primer
aggtgagtctgggtttgagg

SEQ ID NO: 16737 - DNA, 21 bp, Artificial sequence
  Forward Primer
tataaaaggcgtcagagggag

SEQ ID NO: 16738 - DNA, 18 bp, Artificial sequence
  Forward Primer
tgtctgcaccaccaggtt

SEQ ID NO: 16739 - DNA, 22 bp, Artificial sequence
  Forward Primer
attcatctgcaatttctatcgc

SEQ ID NO: 16740 - DNA, 28 bp, Artificial sequence
  Forward Primer
aactaagtaatctaagctaaaggcacat

SEQ ID NO: 16741 - DNA, 24 bp, Artificial sequence
  Forward Primer
tttggcaagtctttacttacagtg

SEQ ID NO: 16742 - DNA, 24 bp, Artificial sequence
  Forward Primer
aaaatagatacttgtccccacaaa

SEQ ID NO: 16743 - DNA, 28 bp, Artificial sequence
  Forward Primer
ttattatctgttcttagatcctaatgca

SEQ ID NO: 16744 - DNA, 23 bp, Artificial sequence
  Forward Primer
aaatttcaaggaattgctttgtc

SEQ ID NO: 16745 - DNA, 23 bp, Artificial sequence
  Forward Primer
acaagcaaaagcttcataccttt

SEQ ID NO: 16746 - DNA, 24 bp, Artificial sequence
  Forward Primer
caaatttgggaggttcttatattg

SEQ ID NO: 16747 - DNA, 28 bp, Artificial sequence
  Forward Primer
tttctaaattcttcattatgatctcttc

SEQ ID NO: 16748 - DNA, 24 bp, Artificial sequence
  Forward Primer
attaaagtacctcccttttccaac

SEQ ID NO: 16749 - DNA, 28 bp, Artificial sequence
  Forward Primer
ataaacctctaaatttctgatttcattc

SEQ ID NO: 16750 - DNA, 23 bp, Artificial sequence
  Forward Primer
ttttgacagggagtaagttgaaa

SEQ ID NO: 16751 - DNA, 30 bp, Artificial sequence
  Forward Primer
aatcatttactgttttattagtctacagca

SEQ ID NO: 16752 - DNA, 28 bp, Artificial sequence
  Forward Primer
aatgattattttctagaataggaggaaa

SEQ ID NO: 16753 - DNA, 21 bp, Artificial sequence
  Forward Primer
gtccatttgtgaatctttatg

SEQ ID NO: 16754 - DNA, 23 bp, Artificial sequence
  Forward Primer
ctcaaataaatatacgggaggat

SEQ ID NO: 16755 - DNA, 24 bp, Artificial sequence
  Forward Primer
aaaatacagacatgatcaaggatg

SEQ ID NO: 16756 - DNA, 24 bp, Artificial sequence
  Forward Primer
tattttaaggccaggtaaaaccta

SEQ ID NO: 16757 - DNA, 18 bp, Artificial sequence
  Forward Primer
cattcagtgttcgccagg

SEQ ID NO: 16758 - DNA, 25 bp, Artificial sequence
  Forward Primer
ttttctgcccaatatgtttactaat

SEQ ID NO: 16759 - DNA, 28 bp, Artificial sequence
  Forward Primer
gtatcaattgaaaatatcaaaatctctc

SEQ ID NO: 16760 - DNA, 27 bp, Artificial sequence
  Forward Primer
aggtatgattcagctaccttttaattt

SEQ ID NO: 16761 - DNA, 25 bp, Artificial sequence
  Forward Primer
tttacaaaatcatytgccaaagtat

SEQ ID NO: 16762 - DNA, 18 bp, Artificial sequence
  Forward Primer
gcctcmaaacaacaggct

SEQ ID NO: 16763 - DNA, 23 bp, Artificial sequence
  Forward Primer
aggacccatgaagatgaaaatat

SEQ ID NO: 16764 - DNA, 23 bp, Artificial sequence
  Forward Primer
ataatgggaggattatggaaatg

SEQ ID NO: 16765 - DNA, 27 bp, Artificial sequence
  Forward Primer
aattaaaaccaaattctacattcaagg

SEQ ID NO: 16766 - DNA, 24 bp, Artificial sequence
  Forward Primer
aattatgaaggcagatgtgatatg

SEQ ID NO: 16767 - DNA, 22 bp, Artificial sequence
  Forward Primer
tttgtggagtaaatgggaatca

SEQ ID NO: 16768 - DNA, 23 bp, Artificial sequence
  Forward Primer
ttaaatctaaccatcttcctggg

SEQ ID NO: 16769 - DNA, 20 bp, Artificial sequence
  Forward Primer
ttgaccaagccttgaacagt

SEQ ID NO: 16770 - DNA, 24 bp, Artificial sequence
  Forward Primer
aggtatctgttgacragactcaga

SEQ ID NO: 16771 - DNA, 24 bp, Artificial sequence
  Forward Primer
atttcggattgttgtgtattactc

SEQ ID NO: 16772 - DNA, 20 bp, Artificial sequence
  Forward Primer
atggttcctctcttgcaatg

SEQ ID NO: 16773 - DNA, 24 bp, Artificial sequence
  Forward Primer
aatctggacttaacagattccatc

SEQ ID NO: 16774 - DNA, 22 bp, Artificial sequence
  Forward Primer
tctttccctgaaatcctttttt

SEQ ID NO: 16775 - DNA, 21 bp, Artificial sequence
  Forward Primer
agaacactaagagtgggcaca

SEQ ID NO: 16776 - DNA, 18 bp, Artificial sequence
  Forward Primer
aacgggctgggaccctgt

SEQ ID NO: 16777 - DNA, 19 bp, Artificial sequence
  Forward Primer
agccacccttaaccctacc

SEQ ID NO: 16778 - DNA, 24 bp, Artificial sequence
  Forward Primer
aaccagaagttatcacagaagagc

SEQ ID NO: 16779 - DNA, 30 bp, Artificial sequence
  Forward Primer
tggtataatacactgataatctgatacttc

SEQ ID NO: 16780 - DNA, 20 bp, Artificial sequence
  Forward Primer
catctgaggaaggaaatttg

SEQ ID NO: 16781 - DNA, 18 bp, Artificial sequence
  Forward Primer
aacccccactgggacttc

SEQ ID NO: 16782 - DNA, 20 bp, Artificial sequence
  Forward Primer
aagctcgtgcagagatttcc

SEQ ID NO: 16783 - DNA, 24 bp, Artificial sequence
  Forward Primer
tgccctttttattatgaattttct

SEQ ID NO: 16784 - DNA, 23 bp, Artificial sequence
  Forward Primer
attcatctcttttgcagtgtctc

SEQ ID NO: 16785 - DNA, 26 bp, Artificial sequence
  Forward Primer
ttgaacagtatcaacagtaagagtgt

SEQ ID NO: 16786 - DNA, 28 bp, Artificial sequence
  Forward Primer
gttaggaggtaataagcaaagttatgat

SEQ ID NO: 16787 - DNA, 24 bp, Artificial sequence
  Forward Primer
acttcatactctttgttttcatta

SEQ ID NO: 16788 - DNA, 20 bp, Artificial sequence
  Forward Primer
aacccaggaaagaagaaagt

SEQ ID NO: 16789 - DNA, 27 bp, Artificial sequence
  Forward Primer
ttaaagtatgtctcattcatttcagaa

SEQ ID NO: 16790 - DNA, 18 bp, Artificial sequence
  Forward Primer
acgctgctgccaagccca

SEQ ID NO: 16791 - DNA, 30 bp, Artificial sequence
  Forward Primer
aataattaatatacaaagtctagaaacttc

SEQ ID NO: 16792 - DNA, 20 bp, Artificial sequence
  Forward Primer
tactgacttagcgatttgcc

SEQ ID NO: 16793 - DNA, 20 bp, Artificial sequence
  Forward Primer
tcatgacaactctgcctcct

SEQ ID NO: 16794 - DNA, 25 bp, Artificial sequence
  Forward Primer
tctaaaatgtgtatatccattaggt

SEQ ID NO: 16795 - DNA, 24 bp, Artificial sequence
  Forward Primer
aattaagtagatgccatgttctgc

SEQ ID NO: 16796 - DNA, 28 bp, Artificial sequence
  Forward Primer
tttttctagagaataactaatccaggag

SEQ ID NO: 16797 - DNA, 26 bp, Artificial sequence
  Forward Primer
catcttcacaaacttcattttatttg

SEQ ID NO: 16798 - DNA, 26 bp, Artificial sequence
  Forward Primer
atgatggttaggaagattaaatgagt

SEQ ID NO: 16799 - DNA, 22 bp, Artificial sequence
  Forward Primer
tgyacatttcttggttcatgat

SEQ ID NO: 16800 - DNA, 24 bp, Artificial sequence
  Forward Primer
acctaaaaattttacaaggaagaa

SEQ ID NO: 16801 - DNA, 19 bp, Artificial sequence
  Forward Primer
atactggccttaggactga

SEQ ID NO: 16802 - DNA, 18 bp, Artificial sequence
  Forward Primer
tgaaaccgatgcaagctg

SEQ ID NO: 16803 - DNA, 21 bp, Artificial sequence
  Forward Primer
agtgaggtgcttggtttataa

SEQ ID NO: 16804 - DNA, 24 bp, Artificial sequence
  Forward Primer
taatttttaacaagatgcatagcc

SEQ ID NO: 16805 - DNA, 28 bp, Artificial sequence
  Forward Primer
tagtatgttatttttagtacattcaggt

SEQ ID NO: 16806 - DNA, 20 bp, Artificial sequence
  Forward Primer
tttctgtttgggctgagtct

SEQ ID NO: 16807 - DNA, 22 bp, Artificial sequence
  Forward Primer
ttgagagcagaagatgtcagaa

SEQ ID NO: 16808 - DNA, 27 bp, Artificial sequence
  Forward Primer
tgcttcactttttaaatcttgtaattc

SEQ ID NO: 16809 - DNA, 27 bp, Artificial sequence
  Forward Primer
atatacatgtacattgtgaacatcgtt

SEQ ID NO: 16810 - DNA, 19 bp, Artificial sequence
  Forward Primer
tcagggtgggtttaagtgc

SEQ ID NO: 16811 - DNA, 23 bp, Artificial sequence
  Forward Primer
aagatgcttggataaacactgaa

SEQ ID NO: 16812 - DNA, 28 bp, Artificial sequence
  Forward Primer
taaagcatatatttctctcaatatttcc

SEQ ID NO: 16813 - DNA, 27 bp, Artificial sequence
  Forward Primer
taggattagcagaagtcattgttattt

SEQ ID NO: 16814 - DNA, 27 bp, Artificial sequence
  Forward Primer
aaaaaattcagtagtatctctggtttc

SEQ ID NO: 16815 - DNA, 27 bp, Artificial sequence
  Forward Primer
tgagatacttcacctgattataaatct

SEQ ID NO: 16816 - DNA, 19 bp, Artificial sequence
  Forward Primer
catatccttttgtggccta

SEQ ID NO: 16817 - DNA, 27 bp, Artificial sequence
  Forward Primer
tgttaaggcagtatttctaaaactata

SEQ ID NO: 16818 - DNA, 27 bp, Artificial sequence
  Forward Primer
tattctgagttctgaaccaaagatatt

SEQ ID NO: 16819 - DNA, 28 bp, Artificial sequence
  Forward Primer
taattccaagtcacttatttcattacat

SEQ ID NO: 16820 - DNA, 24 bp, Artificial sequence
  Forward Primer
attttttccaagtctcctatcttt

SEQ ID NO: 16821 - DNA, 19 bp, Artificial sequence
  Forward Primer
cttccacgagggaaaaaca

SEQ ID NO: 16822 - DNA, 28 bp, Artificial sequence
  Forward Primer
ttacagggctttaaacctattttataat

SEQ ID NO: 16823 - DNA, 25 bp, Artificial sequence
  Forward Primer
ttacataatcattcattttgctcct

SEQ ID NO: 16824 - DNA, 25 bp, Artificial sequence
  Forward Primer
aataatgagagatgaatctggaaaa

SEQ ID NO: 16825 - DNA, 23 bp, Artificial sequence
  Forward Primer
ttctcaccatcagatttatttgc

SEQ ID NO: 16826 - DNA, 24 bp, Artificial sequence
  Forward Primer
aagcagtaacatgaaggtattcac

SEQ ID NO: 16827 - DNA, 18 bp, Artificial sequence
  Forward Primer
tttgggcaccgaggaaat

SEQ ID NO: 16828 - DNA, 25 bp, Artificial sequence
  Forward Primer
agtagaaactgtaagtggccaataa

SEQ ID NO: 16829 - DNA, 20 bp, Artificial sequence
  Forward Primer
atgrtggaatctcaggatgg

SEQ ID NO: 16830 - DNA, 20 bp, Artificial sequence
  Forward Primer
tccrgtgactctcctcactg

SEQ ID NO: 16831 - DNA, 18 bp, Artificial sequence
  Forward Primer
taagcgctgaccctctcc

SEQ ID NO: 16832 - DNA, 25 bp, Artificial sequence
  Forward Primer
agttaaataccatgaacaagacagg

SEQ ID NO: 16833 - DNA, 19 bp, Artificial sequence
  Forward Primer
tccatctgactgtgctctc

SEQ ID NO: 16834 - DNA, 23 bp, Artificial sequence
  Forward Primer
attttgacaamtcatttgctgac

SEQ ID NO: 16835 - DNA, 27 bp, Artificial sequence
  Forward Primer
ataagtaaattgtttctgagtgtgaca

SEQ ID NO: 16836 - DNA, 23 bp, Artificial sequence
  Forward Primer
tcattctgtgagcttcaataatt

SEQ ID NO: 16837 - DNA, 28 bp, Artificial sequence
  Forward Primer
ttgagtaaaaagaaatcaaagatacatg

SEQ ID NO: 16838 - DNA, 18 bp, Artificial sequence
  Forward Primer
cttcccaatcctacccca

SEQ ID NO: 16839 - DNA, 19 bp, Artificial sequence
  Forward Primer
tttttcctccgttttcacc

SEQ ID NO: 16840 - DNA, 19 bp, Artificial sequence
  Forward Primer
ttgtcctgcaacaaagacc

SEQ ID NO: 16841 - DNA, 22 bp, Artificial sequence
  Forward Primer
atttgacgctataagcttccag

SEQ ID NO: 16842 - DNA, 21 bp, Artificial sequence
  Forward Primer
ttttcatacaaytggcttgga

SEQ ID NO: 16843 - DNA, 18 bp, Artificial sequence
  Forward Primer
ttcagccagtttcccctc

SEQ ID NO: 16844 - DNA, 25 bp, Artificial sequence
  Forward Primer
taacacagaaatcttcacaaacagg

SEQ ID NO: 16845 - DNA, 21 bp, Artificial sequence
  Forward Primer
yctcagcatgaacttggtttc

SEQ ID NO: 16846 - DNA, 30 bp, Artificial sequence
  Forward Primer
tatrccttatgtatatcactctatttttgc

SEQ ID NO: 16847 - DNA, 27 bp, Artificial sequence
  Forward Primer
cccaatacaaagtaaaagtttaaaaac

SEQ ID NO: 16848 - DNA, 23 bp, Artificial sequence
  Forward Primer
ttctctgttcgcatctacttagg

SEQ ID NO: 16849 - DNA, 19 bp, Artificial sequence
  Forward Primer
atttcgacacagctttgca

SEQ ID NO: 16850 - DNA, 24 bp, Artificial sequence
  Forward Primer
ggctctaggactcaataataccaa

SEQ ID NO: 16851 - DNA, 22 bp, Artificial sequence
  Forward Primer
tttattwwtttttttccagccc

SEQ ID NO: 16852 - DNA, 24 bp, Artificial sequence
  Forward Primer
agcatcatgacacagcaaatatac

SEQ ID NO: 16853 - DNA, 22 bp, Artificial sequence
  Forward Primer
ttcagaaattttggaagtggac

SEQ ID NO: 16854 - DNA, 25 bp, Artificial sequence
  Forward Primer
tccagaacctgacaaatctacttac

SEQ ID NO: 16855 - DNA, 24 bp, Artificial sequence
  Forward Primer
tcttaaaaaggctgycacttagtt

SEQ ID NO: 16856 - DNA, 19 bp, Artificial sequence
  Forward Primer
ctcctcctgagacctgagt

SEQ ID NO: 16857 - DNA, 26 bp, Artificial sequence
  Forward Primer
gcaaaagaaagcttttaagcatatat

SEQ ID NO: 16858 - DNA, 22 bp, Artificial sequence
  Forward Primer
aaatcctgaggttcagatttga

SEQ ID NO: 16859 - DNA, 24 bp, Artificial sequence
  Forward Primer
ccatttttcacagcttattttttt

SEQ ID NO: 16860 - DNA, 26 bp, Artificial sequence
  Forward Primer
atttttaaaagctgttttaggttcac

SEQ ID NO: 16861 - DNA, 23 bp, Artificial sequence
  Forward Primer
tattaggctgttattgcctgttg

SEQ ID NO: 16862 - DNA, 25 bp, Artificial sequence
  Forward Primer
tgcttatattacccaaatagaggat

SEQ ID NO: 16863 - DNA, 26 bp, Artificial sequence
  Forward Primer
ttatttttaatctgcaaaacgtaagc

SEQ ID NO: 16864 - DNA, 24 bp, Artificial sequence
  Forward Primer
ttcagtgtttattcataacctttt

SEQ ID NO: 16865 - DNA, 26 bp, Artificial sequence
  Forward Primer
agtgattcatacaaattaagtgcttg

SEQ ID NO: 16866 - DNA, 23 bp, Artificial sequence
  Forward Primer
caaattgaaagtcagcttcaaga

SEQ ID NO: 16867 - DNA, 18 bp, Artificial sequence
  Forward Primer
ctctcctggctacctggc

SEQ ID NO: 16868 - DNA, 26 bp, Artificial sequence
  Forward Primer
tccaatataatcatttttttctcctc

SEQ ID NO: 16869 - DNA, 19 bp, Artificial sequence
  Forward Primer
tgcasacacaaaagaacat

SEQ ID NO: 16870 - DNA, 18 bp, Artificial sequence
  Forward Primer
atggagaggggccagaag

SEQ ID NO: 16871 - DNA, 23 bp, Artificial sequence
  Forward Primer
taatgcttagaacatcatgtgga

SEQ ID NO: 16872 - DNA, 28 bp, Artificial sequence
  Forward Primer
gtttacaaagcaacattaaaaagttatg

SEQ ID NO: 16873 - DNA, 24 bp, Artificial sequence
  Forward Primer
aattttaaaagtcaacattgtgca

SEQ ID NO: 16874 - DNA, 21 bp, Artificial sequence
  Forward Primer
tttccagagcacaatctttga

SEQ ID NO: 16875 - DNA, 25 bp, Artificial sequence
  Forward Primer
agtcagtataccatgtttggcttat

SEQ ID NO: 16876 - DNA, 28 bp, Artificial sequence
  Forward Primer
ccacgatttattgactaaataacaatac

SEQ ID NO: 16877 - DNA, 26 bp, Artificial sequence
  Forward Primer
tatgtagaagttaaaactttggatga

SEQ ID NO: 16878 - DNA, 20 bp, Artificial sequence
  Forward Primer
tcatgaagctggacctagga

SEQ ID NO: 16879 - DNA, 30 bp, Artificial sequence
  Forward Primer
tagaaagtactggaactagacttttatctc

SEQ ID NO: 16880 - DNA, 22 bp, Artificial sequence
  Forward Primer
aaggttacaaggctctgagaca

SEQ ID NO: 16881 - DNA, 22 bp, Artificial sequence
  Forward Primer
tgattgagcccaagtctcttat

SEQ ID NO: 16882 - DNA, 25 bp, Artificial sequence
  Forward Primer
taaaacaagcttatacaaatgctcc

SEQ ID NO: 16883 - DNA, 27 bp, Artificial sequence
  Forward Primer
cctttggaaacatactttactgaataa

SEQ ID NO: 16884 - DNA, 23 bp, Artificial sequence
  Forward Primer
ttttcttttacagagccaacaac

SEQ ID NO: 16885 - DNA, 22 bp, Artificial sequence
  Forward Primer
atagtagccgatgttaactgac

SEQ ID NO: 16886 - DNA, 18 bp, Artificial sequence
  Forward Primer
tttggcgatgctgggagc

SEQ ID NO: 16887 - DNA, 22 bp, Artificial sequence
  Forward Primer
gctcaaagttaaaacaattcag

SEQ ID NO: 16888 - DNA, 20 bp, Artificial sequence
  Forward Primer
aattgctctgtgccagagat

SEQ ID NO: 16889 - DNA, 24 bp, Artificial sequence
  Forward Primer
ttaattttaagaaaacctccagga

SEQ ID NO: 16890 - DNA, 28 bp, Artificial sequence
  Forward Primer
tttgataaatacattctgagaaaacatc

SEQ ID NO: 16891 - DNA, 26 bp, Artificial sequence
  Forward Primer
aaactggaaaataagtacctgaacac

SEQ ID NO: 16892 - DNA, 26 bp, Artificial sequence
  Forward Primer
ctgattttaatgtttatctgttcatc

SEQ ID NO: 16893 - DNA, 21 bp, Artificial sequence
  Forward Primer
tcataaccatacaaatgaccg

SEQ ID NO: 16894 - DNA, 22 bp, Artificial sequence
  Forward Primer
taatacaacatgccaagctcag

SEQ ID NO: 16895 - DNA, 21 bp, Artificial sequence
  Forward Primer
gttggaaataggcatcagtgg

SEQ ID NO: 16896 - DNA, 26 bp, Artificial sequence
  Forward Primer
attaatactgagcagagttccatatg

SEQ ID NO: 16897 - DNA, 23 bp, Artificial sequence
  Forward Primer
aaaactccaaattttattttgcc

SEQ ID NO: 16898 - DNA, 26 bp, Artificial sequence
  Forward Primer
tatctcaatctacagaggtcataacc

SEQ ID NO: 16899 - DNA, 22 bp, Artificial sequence
  Forward Primer
tgtctaaggaccaaccctagtg

SEQ ID NO: 16900 - DNA, 30 bp, Artificial sequence
  Forward Primer
attatagtttccatatctataaacaaagct

SEQ ID NO: 16901 - DNA, 18 bp, Artificial sequence
  Forward Primer
ggccatcacccccacact

SEQ ID NO: 16902 - DNA, 25 bp, Artificial sequence
  Forward Primer
ttaaaacacrtttaaaatcagtgca

SEQ ID NO: 16903 - DNA, 26 bp, Artificial sequence
  Forward Primer
atgaaggatagaatgggtaatactct

SEQ ID NO: 16904 - DNA, 24 bp, Artificial sequence
  Forward Primer
tttgtagttttatcttttttgcgg

SEQ ID NO: 16905 - DNA, 24 bp, Artificial sequence
  Forward Primer
aagtaactatgaggttgtctagct

SEQ ID NO: 16906 - DNA, 27 bp, Artificial sequence
  Forward Primer
aacagactagtaagtacaagaggtttt

SEQ ID NO: 16907 - DNA, 18 bp, Artificial sequence
  Forward Primer
agaaaggccgggaacagg

SEQ ID NO: 16908 - DNA, 26 bp, Artificial sequence
  Forward Primer
tatatttacctggcaatatgttcttg

SEQ ID NO: 16909 - DNA, 19 bp, Artificial sequence
  Forward Primer
aaaaggtttgccatccatg

SEQ ID NO: 16910 - DNA, 19 bp, Artificial sequence
  Forward Primer
tgttcctctctcccttcga

SEQ ID NO: 16911 - DNA, 23 bp, Artificial sequence
  Forward Primer
ttactgcagaatgaatcttcaca

SEQ ID NO: 16912 - DNA, 23 bp, Artificial sequence
  Forward Primer
gatgagaaatgttgaaataaaca

SEQ ID NO: 16913 - DNA, 28 bp, Artificial sequence
  Forward Primer
tacgttaattatacttcaatgaaactgt

SEQ ID NO: 16914 - DNA, 26 bp, Artificial sequence
  Forward Primer
aattaaaaatctctttctgggtatcc

SEQ ID NO: 16915 - DNA, 20 bp, Artificial sequence
  Forward Primer
agtgggtggagagaaaataa

SEQ ID NO: 16916 - DNA, 24 bp, Artificial sequence
  Forward Primer
cattgatctaataagaccatccca

SEQ ID NO: 16917 - DNA, 19 bp, Artificial sequence
  Forward Primer
ctaagcagaaatcatgggt

SEQ ID NO: 16918 - DNA, 22 bp, Artificial sequence
  Forward Primer
atcaactaatgacatgaaggaa

SEQ ID NO: 16919 - DNA, 28 bp, Artificial sequence
  Forward Primer
ttctcgatagtgattagttcaataaaat

SEQ ID NO: 16920 - DNA, 22 bp, Artificial sequence
  Forward Primer
attaaacacaggcaagtctcca

SEQ ID NO: 16921 - DNA, 22 bp, Artificial sequence
  Forward Primer
ttaaaattcttcacatgtgcca

SEQ ID NO: 16922 - DNA, 22 bp, Artificial sequence
  Forward Primer
tcctttcctgagtctacctgag

SEQ ID NO: 16923 - DNA, 28 bp, Artificial sequence
  Forward Primer
ttaaggaaattagaggatattagacagc

SEQ ID NO: 16924 - DNA, 19 bp, Artificial sequence
  Forward Primer
aagtccgtcaaagctcctg

SEQ ID NO: 16925 - DNA, 27 bp, Artificial sequence
  Forward Primer
aagatttaacttctctgaacatccttt

SEQ ID NO: 16926 - DNA, 23 bp, Artificial sequence
  Forward Primer
tccttatgaggcatctatacagc

SEQ ID NO: 16927 - DNA, 20 bp, Artificial sequence
  Forward Primer
aagatcaagtttcacccaaa

SEQ ID NO: 16928 - DNA, 19 bp, Artificial sequence
  Forward Primer
tggcagagcagctaagtga

SEQ ID NO: 16929 - DNA, 21 bp, Artificial sequence
  Forward Primer
tgtaactgaagtttccttgtc

SEQ ID NO: 16930 - DNA, 28 bp, Artificial sequence
  Forward Primer
taaatggtagagttcagtagttgtagca

SEQ ID NO: 16931 - DNA, 28 bp, Artificial sequence
  Forward Primer
aataaaaatgtttaacacagagatgaga

SEQ ID NO: 16932 - DNA, 21 bp, Artificial sequence
  Forward Primer
agaacagaggaaaagggaaca

SEQ ID NO: 16933 - DNA, 27 bp, Artificial sequence
  Forward Primer
ttcacatagaaaagcaatcacttataa

SEQ ID NO: 16934 - DNA, 22 bp, Artificial sequence
  Forward Primer
aaaagattgcaacagaagcatc

SEQ ID NO: 16935 - DNA, 19 bp, Artificial sequence
  Forward Primer
atagaaggcacgctccact

SEQ ID NO: 16936 - DNA, 21 bp, Artificial sequence
  Forward Primer
ggataacgtgtcaacagtcga

SEQ ID NO: 16937 - DNA, 26 bp, Artificial sequence
  Forward Primer
agagtactcttaaggctcaaatcaag

SEQ ID NO: 16938 - DNA, 23 bp, Artificial sequence
  Forward Primer
tctagtagagggcaagagaaagg

SEQ ID NO: 16939 - DNA, 23 bp, Artificial sequence
  Forward Primer
atacagtctgtctgactggacca

SEQ ID NO: 16940 - DNA, 20 bp, Artificial sequence
  Forward Primer
agaagcagcaaagagtcttg

SEQ ID NO: 16941 - DNA, 30 bp, Artificial sequence
  Forward Primer
tgtagtgacacttcatttattacttttctt

SEQ ID NO: 16942 - DNA, 24 bp, Artificial sequence
  Forward Primer
agtggatgaagtaaatttcttgga

SEQ ID NO: 16943 - DNA, 21 bp, Artificial sequence
  Forward Primer
agatctctgctccattcttgg

SEQ ID NO: 16944 - DNA, 24 bp, Artificial sequence
  Forward Primer
cagcatcttgtgggtatttaataa

SEQ ID NO: 16945 - DNA, 24 bp, Artificial sequence
  Forward Primer
attttaaaaattattggcagttgc

SEQ ID NO: 16946 - DNA, 18 bp, Artificial sequence
  Forward Primer
tgcctcctgctcagacag

SEQ ID NO: 16947 - DNA, 24 bp, Artificial sequence
  Forward Primer
attttatttttcatgccaatagga

SEQ ID NO: 16948 - DNA, 28 bp, Artificial sequence
  Forward Primer
attagaaactttctgtccaaataaatca

SEQ ID NO: 16949 - DNA, 22 bp, Artificial sequence
  Forward Primer
aatttcatttycttgcaatgag

SEQ ID NO: 16950 - DNA, 22 bp, Artificial sequence
  Forward Primer
ttagttttgaagrttccaccag

SEQ ID NO: 16951 - DNA, 24 bp, Artificial sequence
  Forward Primer
aaaataatgaaactgccttcagaa

SEQ ID NO: 16952 - DNA, 26 bp, Artificial sequence
  Forward Primer
tacttcttttaatccccttttgtaga

SEQ ID NO: 16953 - DNA, 23 bp, Artificial sequence
  Forward Primer
aaactctggtaaacctcctgaaa

SEQ ID NO: 16954 - DNA, 22 bp, Artificial sequence
  Forward Primer
ttggttgaaaccattctaagag

SEQ ID NO: 16955 - DNA, 23 bp, Artificial sequence
  Forward Primer
ttatttagccccatgagctattt

SEQ ID NO: 16956 - DNA, 20 bp, Artificial sequence
  Forward Primer
ttagcaatgtycttctccca

SEQ ID NO: 16957 - DNA, 23 bp, Artificial sequence
  Forward Primer
ttcrgtcagaaaagaaccttaag

SEQ ID NO: 16958 - DNA, 23 bp, Artificial sequence
  Forward Primer
ataaagtgccccaatatgataca

SEQ ID NO: 16959 - DNA, 29 bp, Artificial sequence
  Forward Primer
tttatgtcattcagttctactaagatcaa

SEQ ID NO: 16960 - DNA, 24 bp, Artificial sequence
  Forward Primer
aagataaaattacaaaatcagctc

SEQ ID NO: 16961 - DNA, 28 bp, Artificial sequence
  Forward Primer
ataaatccaacttttctagatgaaattc

SEQ ID NO: 16962 - DNA, 26 bp, Artificial sequence
  Forward Primer
tttagtgtataagaaaaacgtggtgt

SEQ ID NO: 16963 - DNA, 19 bp, Artificial sequence
  Forward Primer
aaaagtcgaattggtttca

SEQ ID NO: 16964 - DNA, 18 bp, Artificial sequence
  Forward Primer
agtcttgaaatcagccgg

SEQ ID NO: 16965 - DNA, 18 bp, Artificial sequence
  Forward Primer
tggarcattcgtgcttca

SEQ ID NO: 16966 - DNA, 24 bp, Artificial sequence
  Forward Primer
gcccttattataaaatgcatcatt

SEQ ID NO: 16967 - DNA, 27 bp, Artificial sequence
  Forward Primer
atggagactttttttaaagtgctatag

SEQ ID NO: 16968 - DNA, 23 bp, Artificial sequence
  Forward Primer
caccaaaggaatgaatttcttaa

SEQ ID NO: 16969 - DNA, 26 bp, Artificial sequence
  Forward Primer
ttatttttttctgagtaatcctttcc

SEQ ID NO: 16970 - DNA, 22 bp, Artificial sequence
  Forward Primer
ttkaaatcagtcatttttggca

SEQ ID NO: 16971 - DNA, 28 bp, Artificial sequence
  Forward Primer
gtggtatgacagtttstctaaaatttaa

SEQ ID NO: 16972 - DNA, 25 bp, Artificial sequence
  Forward Primer
aagataattagcaatgtycttctcc

SEQ ID NO: 16973 - DNA, 24 bp, Artificial sequence
  Forward Primer
atytggaaatacagagtggaaaga

SEQ ID NO: 16974 - DNA, 28 bp, Artificial sequence
  Forward Primer
attgagagcttaccattatataaaaatg

SEQ ID NO: 16975 - DNA, 26 bp, Artificial sequence
  Forward Primer
aacactcaattttcctagcttttata

SEQ ID NO: 16976 - DNA, 25 bp, Artificial sequence
  Forward Primer
aattcactttcaattaatgtggttc

SEQ ID NO: 16977 - DNA, 19 bp, Artificial sequence
  Forward Primer
aagcagagatgggatggag

SEQ ID NO: 16978 - DNA, 19 bp, Artificial sequence
  Forward Primer
tcaccctcacctgtcctta

SEQ ID NO: 16979 - DNA, 28 bp, Artificial sequence
  Forward Primer
tatatttaacaggagaatagttgctcaa

SEQ ID NO: 16980 - DNA, 22 bp, Artificial sequence
  Forward Primer
ttacttttgaagcagttccctc

SEQ ID NO: 16981 - DNA, 18 bp, Artificial sequence
  Forward Primer
tttggcagggctgggtgt

SEQ ID NO: 16982 - DNA, 20 bp, Artificial sequence
  Forward Primer
ttttgtttttctttcccaag

SEQ ID NO: 16983 - DNA, 24 bp, Artificial sequence
  Forward Primer
aaaccatttatctttacaaaccga

SEQ ID NO: 16984 - DNA, 19 bp, Artificial sequence
  Forward Primer
caggtggacagacagacaa

SEQ ID NO: 16985 - DNA, 24 bp, Artificial sequence
  Forward Primer
aagtcaaatgtttatcataggtta

SEQ ID NO: 16986 - DNA, 23 bp, Artificial sequence
  Forward Primer
catctctataatgaggaagctgc

SEQ ID NO: 16987 - DNA, 26 bp, Artificial sequence
  Forward Primer
ttgtcaacagctctagtaagtgtgta

SEQ ID NO: 16988 - DNA, 18 bp, Artificial sequence
  Forward Primer
tacttccaggactcgggg

SEQ ID NO: 16989 - DNA, 20 bp, Artificial sequence
  Forward Primer
tcctggctatctcaagctcc

SEQ ID NO: 16990 - DNA, 23 bp, Artificial sequence
  Forward Primer
agggaatctttaattcacctgaa

SEQ ID NO: 16991 - DNA, 22 bp, Artificial sequence
  Forward Primer
ttagttacctcttggcttctcc

SEQ ID NO: 16992 - DNA, 28 bp, Artificial sequence
  Forward Primer
cagaatacccactaagtgacaatattaa

SEQ ID NO: 16993 - DNA, 20 bp, Artificial sequence
  Forward Primer
actgagatggggtttaggga

SEQ ID NO: 16994 - DNA, 22 bp, Artificial sequence
  Forward Primer
atgacaaaggagtcaggattaa

SEQ ID NO: 16995 - DNA, 20 bp, Artificial sequence
  Forward Primer
tcatgaaacatacgcaggtc

SEQ ID NO: 16996 - DNA, 25 bp, Artificial sequence
  Forward Primer
aaacttttcaatgaccaaattaagg

SEQ ID NO: 16997 - DNA, 18 bp, Artificial sequence
  Forward Primer
tgcttgcctgaagaagga

SEQ ID NO: 16998 - DNA, 20 bp, Artificial sequence
  Forward Primer
ttgattctgtgctcaggacc

SEQ ID NO: 16999 - DNA, 18 bp, Artificial sequence
  Forward Primer
tgygtgaccagaggctga

SEQ ID NO: 17000 - DNA, 25 bp, Artificial sequence
  Forward Primer
aaataaaaactaacactcttgcagc

SEQ ID NO: 17001 - DNA, 22 bp, Artificial sequence
  Forward Primer
tacaagtctttcccactttccc

SEQ ID NO: 17002 - DNA, 23 bp, Artificial sequence
  Forward Primer
ttatttatggaggtaggtacgcc

SEQ ID NO: 17003 - DNA, 25 bp, Artificial sequence
  Forward Primer
ttctgtttcatctctggatatacta

SEQ ID NO: 17004 - DNA, 23 bp, Artificial sequence
  Forward Primer
gaaaggcttataccaccactttc

SEQ ID NO: 17005 - DNA, 28 bp, Artificial sequence
  Forward Primer
ggataacagaaaaactttgaaaaatagt

SEQ ID NO: 17006 - DNA, 23 bp, Artificial sequence
  Forward Primer
aatttacttttgcgattaatgga

SEQ ID NO: 17007 - DNA, 21 bp, Artificial sequence
  Forward Primer
aatttatccccttgtggaatg

SEQ ID NO: 17008 - DNA, 22 bp, Artificial sequence
  Forward Primer
aagaaacttgaaacgtgtcctt

SEQ ID NO: 17009 - DNA, 23 bp, Artificial sequence
  Forward Primer
aaaatattcacagtgtaccaggg

SEQ ID NO: 17010 - DNA, 20 bp, Artificial sequence
  Forward Primer
ataatgtggatttggcacca

SEQ ID NO: 17011 - DNA, 29 bp, Artificial sequence
  Forward Primer
aaggatactagcatacagaagatacaatt

SEQ ID NO: 17012 - DNA, 23 bp, Artificial sequence
  Forward Primer
agatgcagttatttgtatgtgtg

SEQ ID NO: 17013 - DNA, 26 bp, Artificial sequence
  Forward Primer
atatattcctgaagacattcaaaagg

SEQ ID NO: 17014 - DNA, 23 bp, Artificial sequence
  Forward Primer
atgcaatttgtagaacaccctta

SEQ ID NO: 17015 - DNA, 26 bp, Artificial sequence
  Forward Primer
aaagtctttcattttacctaggaagt

SEQ ID NO: 17016 - DNA, 19 bp, Artificial sequence
  Forward Primer
tatggctcttccttcgtaa

SEQ ID NO: 17017 - DNA, 18 bp, Artificial sequence
  Forward Primer
tgtagcacagccccagct

SEQ ID NO: 17018 - DNA, 20 bp, Artificial sequence
  Forward Primer
aaatctgtacccccatgaca

SEQ ID NO: 17019 - DNA, 24 bp, Artificial sequence
  Forward Primer
aaaccatttatctttacaaaccga

SEQ ID NO: 17020 - DNA, 22 bp, Artificial sequence
  Forward Primer
cacttgagcaatgttgattgtt

SEQ ID NO: 17021 - DNA, 29 bp, Artificial sequence
  Forward Primer
ttgtctaataaatttccatatagacttgg

SEQ ID NO: 17022 - DNA, 30 bp, Artificial sequence
  Forward Primer
atacgtagagttaatactaagttataggag

SEQ ID NO: 17023 - DNA, 18 bp, Artificial sequence
  Forward Primer
agttcagaggccagtggg

SEQ ID NO: 17024 - DNA, 20 bp, Artificial sequence
  Forward Primer
aatgcatttttctagtcagg

SEQ ID NO: 17025 - DNA, 19 bp, Artificial sequence
  Forward Primer
acattgcagtagcagcaaa

SEQ ID NO: 17026 - DNA, 25 bp, Artificial sequence
  Forward Primer
aaaagctactatacagagctcctcc

SEQ ID NO: 17027 - DNA, 20 bp, Artificial sequence
  Forward Primer
tttactggaaagcctggaaa

SEQ ID NO: 17028 - DNA, 23 bp, Artificial sequence
  Forward Primer
tcatcactctggtggaaagttac

SEQ ID NO: 17029 - DNA, 22 bp, Artificial sequence
  Forward Primer
ttttcagagtttttccctttta

SEQ ID NO: 17030 - DNA, 19 bp, Artificial sequence
  Forward Primer
ggctgggacatggaataat

SEQ ID NO: 17031 - DNA, 20 bp, Artificial sequence
  Forward Primer
ggagaagagcctgtttgttc

SEQ ID NO: 17032 - DNA, 21 bp, Artificial sequence
  Forward Primer
ttgaggaaactctgaccttgg

SEQ ID NO: 17033 - DNA, 19 bp, Artificial sequence
  Forward Primer
ttcctgttgcatcacatca

SEQ ID NO: 17034 - DNA, 21 bp, Artificial sequence
  Forward Primer
tgttggtgtttctggattttg

SEQ ID NO: 17035 - DNA, 21 bp, Artificial sequence
  Forward Primer
aatgcatcagaggatttaggg

SEQ ID NO: 17036 - DNA, 22 bp, Artificial sequence
  Forward Primer
atttaggggttccaggragtat

SEQ ID NO: 17037 - DNA, 19 bp, Artificial sequence
  Forward Primer
atgtgccaagaatgctcct

SEQ ID NO: 17038 - DNA, 26 bp, Artificial sequence
  Forward Primer
acactttgctttatattttccttttc

SEQ ID NO: 17039 - DNA, 23 bp, Artificial sequence
  Forward Primer
acttgtcaaggatagyagtgcaa

SEQ ID NO: 17040 - DNA, 21 bp, Artificial sequence
  Forward Primer
ataccctaaagcctgyagtgg

SEQ ID NO: 17041 - DNA, 27 bp, Artificial sequence
  Forward Primer
aaaacatgtgttagaattaagtcgatc

SEQ ID NO: 17042 - DNA, 27 bp, Artificial sequence
  Forward Primer
caagagtgctgtattcactacactaga

SEQ ID NO: 17043 - DNA, 25 bp, Artificial sequence
  Forward Primer
atgttatgcatcatacaaaggaagt

SEQ ID NO: 17044 - DNA, 20 bp, Artificial sequence
  Forward Primer
agaggttacataagttgccc

SEQ ID NO: 17045 - DNA, 19 bp, Artificial sequence
  Forward Primer
ttgccagtgcatcctactt

SEQ ID NO: 17046 - DNA, 19 bp, Artificial sequence
  Forward Primer
cccggacagctttgattat

SEQ ID NO: 17047 - DNA, 21 bp, Artificial sequence
  Forward Primer
atggaatccacatctaataca

SEQ ID NO: 17048 - DNA, 18 bp, Artificial sequence
  Forward Primer
gagccctgcactgatccc

SEQ ID NO: 17049 - DNA, 26 bp, Artificial sequence
  Forward Primer
attattttccacattcaaattagagc

SEQ ID NO: 17050 - DNA, 19 bp, Artificial sequence
  Forward Primer
aggtcaggtggcttgaaaa

SEQ ID NO: 17051 - DNA, 19 bp, Artificial sequence
  Forward Primer
ttccagtgtgaaggaagcc

SEQ ID NO: 17052 - DNA, 20 bp, Artificial sequence
  Forward Primer
gtacagaggaacacagagga

SEQ ID NO: 17053 - DNA, 26 bp, Artificial sequence
  Forward Primer
tttcatttgatcttacacatttaagg

SEQ ID NO: 17054 - DNA, 20 bp, Artificial sequence
  Forward Primer
tttgtgcttgaattcatggg

SEQ ID NO: 17055 - DNA, 27 bp, Artificial sequence
  Forward Primer
ttaacaataaatcctactgaacaggag

SEQ ID NO: 17056 - DNA, 24 bp, Artificial sequence
  Forward Primer
aatgcattataaactgcaaagtca

SEQ ID NO: 17057 - DNA, 21 bp, Artificial sequence
  Forward Primer
tcccaactctttgctctattt

SEQ ID NO: 17058 - DNA, 28 bp, Artificial sequence
  Forward Primer
tctttgctcataaaactttagtattgat

SEQ ID NO: 17059 - DNA, 23 bp, Artificial sequence
  Forward Primer
aatttaatgacgagttcatgtgg

SEQ ID NO: 17060 - DNA, 24 bp, Artificial sequence
  Forward Primer
atgagtmcaatgaaggttagagga

SEQ ID NO: 17061 - DNA, 26 bp, Artificial sequence
  Forward Primer
aggtgtaagaatttcctatcatctat

SEQ ID NO: 17062 - DNA, 22 bp, Artificial sequence
  Forward Primer
attaatttggcacaaatggaca

SEQ ID NO: 17063 - DNA, 21 bp, Artificial sequence
  Forward Primer
tttctttttaggttttgggca

SEQ ID NO: 17064 - DNA, 20 bp, Artificial sequence
  Forward Primer
ttccttacctcttgagggct

SEQ ID NO: 17065 - DNA, 25 bp, Artificial sequence
  Forward Primer
attgccatttycctatatgtaatgt

SEQ ID NO: 17066 - DNA, 20 bp, Artificial sequence
  Forward Primer
catgtccctctctttcattt

SEQ ID NO: 17067 - DNA, 26 bp, Artificial sequence
  Forward Primer
taatacactggtgaattayttaggta

SEQ ID NO: 17068 - DNA, 19 bp, Artificial sequence
  Forward Primer
tatgctggcattttagctt

SEQ ID NO: 17069 - DNA, 23 bp, Artificial sequence
  Forward Primer
tgtcacaacagtcctagtatcct

SEQ ID NO: 17070 - DNA, 26 bp, Artificial sequence
  Forward Primer
aagtctcagaggaaaagttaaaaaca

SEQ ID NO: 17071 - DNA, 25 bp, Artificial sequence
  Forward Primer
agttgctgcataaaatgaggtatat

SEQ ID NO: 17072 - DNA, 24 bp, Artificial sequence
  Forward Primer
taatagcctaaagggaaaagaaat

SEQ ID NO: 17073 - DNA, 19 bp, Artificial sequence
  Forward Primer
acttttggaaatgcagttt

SEQ ID NO: 17074 - DNA, 20 bp, Artificial sequence
  Forward Primer
acggtacagctgtagttttc

SEQ ID NO: 17075 - DNA, 28 bp, Artificial sequence
  Forward Primer
tatatatcatgtattgtctttctctccc

SEQ ID NO: 17076 - DNA, 21 bp, Artificial sequence
  Forward Primer
tgatgacttttagaagtgggg

SEQ ID NO: 17077 - DNA, 19 bp, Artificial sequence
  Forward Primer
acctgcagccttctgtgtt

SEQ ID NO: 17078 - DNA, 19 bp, Artificial sequence
  Forward Primer
ccctgaaacctgactctgg

SEQ ID NO: 17079 - DNA, 30 bp, Artificial sequence
  Forward Primer
ttcataggaatacatatttctcatagaaca

SEQ ID NO: 17080 - DNA, 25 bp, Artificial sequence
  Forward Primer
cttacgtgtggatttttaaattttc

SEQ ID NO: 17081 - DNA, 25 bp, Artificial sequence
  Forward Primer
aataaatcacatttcgagttcagtg

SEQ ID NO: 17082 - DNA, 23 bp, Artificial sequence
  Forward Primer
aaggttttctgagcaagtaagtt

SEQ ID NO: 17083 - DNA, 19 bp, Artificial sequence
  Forward Primer
atggaccatgattgatgcc

SEQ ID NO: 17084 - DNA, 21 bp, Artificial sequence
  Forward Primer
gacagtgatcagaggtggaca

SEQ ID NO: 17085 - DNA, 23 bp, Artificial sequence
  Forward Primer
tttcatttccatgagagatgttg

SEQ ID NO: 17086 - DNA, 27 bp, Artificial sequence
  Forward Primer
attgtgcaaaatactgtgtataaatga

SEQ ID NO: 17087 - DNA, 29 bp, Artificial sequence
  Forward Primer
atttaagacctagtctcttagcaactttt

SEQ ID NO: 17088 - DNA, 21 bp, Artificial sequence
  Forward Primer
tgtgttacctgaagcctgaag

SEQ ID NO: 17089 - DNA, 19 bp, Artificial sequence
  Forward Primer
aaaaagattcccacccaac

SEQ ID NO: 17090 - DNA, 21 bp, Artificial sequence
  Forward Primer
atgagatacccacagagcagc

SEQ ID NO: 17091 - DNA, 24 bp, Artificial sequence
  Forward Primer
aattaggaaactaggaggttgaca

SEQ ID NO: 17092 - DNA, 24 bp, Artificial sequence
  Forward Primer
agagcaaggaaaaaactgtaaatt

SEQ ID NO: 17093 - DNA, 29 bp, Artificial sequence
  Forward Primer
ttaagattatacagtggaagacactaagc

SEQ ID NO: 17094 - DNA, 22 bp, Artificial sequence
  Forward Primer
attatgaaagagatttgaggtg

SEQ ID NO: 17095 - DNA, 21 bp, Artificial sequence
  Forward Primer
atggttattctatgtggcaag

SEQ ID NO: 17096 - DNA, 20 bp, Artificial sequence
  Forward Primer
ttttgccccaatctttcttt

SEQ ID NO: 17097 - DNA, 22 bp, Artificial sequence
  Forward Primer
ggctgcaaattattccaattaa

SEQ ID NO: 17098 - DNA, 27 bp, Artificial sequence
  Forward Primer
ttcttatgcttttatttctgtcagttt

SEQ ID NO: 17099 - DNA, 26 bp, Artificial sequence
  Forward Primer
ccaattccccatgatatatataaaaa

SEQ ID NO: 17100 - DNA, 20 bp, Artificial sequence
  Forward Primer
agtcaggcaagggatttttc

SEQ ID NO: 17101 - DNA, 20 bp, Artificial sequence
  Forward Primer
attctgacagcctgagctga

SEQ ID NO: 17102 - DNA, 19 bp, Artificial sequence
  Forward Primer
gcaaggagtctcagcctct

SEQ ID NO: 17103 - DNA, 18 bp, Artificial sequence
  Forward Primer
accccaccttccttcaaa

SEQ ID NO: 17104 - DNA, 29 bp, Artificial sequence
  Forward Primer
ataatttgctatataagaaagctctttgg

SEQ ID NO: 17105 - DNA, 22 bp, Artificial sequence
  Forward Primer
ctgatatttcctaaatcaggtc

SEQ ID NO: 17106 - DNA, 19 bp, Artificial sequence
  Forward Primer
ctaccttgtcccaaaggat

SEQ ID NO: 17107 - DNA, 30 bp, Artificial sequence
  Forward Primer
taaatgtaagagctacagttatgaaattct

SEQ ID NO: 17108 - DNA, 20 bp, Artificial sequence
  Forward Primer
atattgtcccttccttcctg

SEQ ID NO: 17109 - DNA, 21 bp, Artificial sequence
  Forward Primer
aatatggtagaaggccaatgc

SEQ ID NO: 17110 - DNA, 25 bp, Artificial sequence
  Forward Primer
attgctagttgtgaattttaggtct

SEQ ID NO: 17111 - DNA, 25 bp, Artificial sequence
  Forward Primer
agatgactggctcataagattaaaa

SEQ ID NO: 17112 - DNA, 21 bp, Artificial sequence
  Forward Primer
aagcaaagtgctaccatgtca

SEQ ID NO: 17113 - DNA, 20 bp, Artificial sequence
  Forward Primer
aaaggtgaaggtgtgacgat

SEQ ID NO: 17114 - DNA, 18 bp, Artificial sequence
  Forward Primer
tcaggcacccaggtaggt

SEQ ID NO: 17115 - DNA, 23 bp, Artificial sequence
  Forward Primer
tgaattttaaggatgaggtatag

SEQ ID NO: 17116 - DNA, 27 bp, Artificial sequence
  Forward Primer
aattaataatttaatacccagaaggca

SEQ ID NO: 17117 - DNA, 26 bp, Artificial sequence
  Forward Primer
aaaaaagagtctggaaagaaatatgt

SEQ ID NO: 17118 - DNA, 20 bp, Artificial sequence
  Forward Primer
tagatagccttggggagatc

SEQ ID NO: 17119 - DNA, 25 bp, Artificial sequence
  Forward Primer
caagtaagctataaacaggcgttat

SEQ ID NO: 17120 - DNA, 24 bp, Artificial sequence
  Forward Primer
gcaaaattctaaggaaaattacaa

SEQ ID NO: 17121 - DNA, 25 bp, Artificial sequence
  Forward Primer
aaccaagaataagaaaaactaactg

SEQ ID NO: 17122 - DNA, 20 bp, Artificial sequence
  Forward Primer
ttggaagagtttgctttgga

SEQ ID NO: 17123 - DNA, 19 bp, Artificial sequence
  Forward Primer
tgattttagggggtacact

SEQ ID NO: 17124 - DNA, 29 bp, Artificial sequence
  Forward Primer
taggtaacctgagttactttagttcttag

SEQ ID NO: 17125 - DNA, 22 bp, Artificial sequence
  Forward Primer
tttttaagcctccagaagatgt

SEQ ID NO: 17126 - DNA, 27 bp, Artificial sequence
  Forward Primer
agactatttccagaattagagctctct

SEQ ID NO: 17127 - DNA, 27 bp, Artificial sequence
  Forward Primer
attgttgctgagaaatttaatactgtt

SEQ ID NO: 17128 - DNA, 28 bp, Artificial sequence
  Forward Primer
gctgatgatcattttacatatatgattt

SEQ ID NO: 17129 - DNA, 19 bp, Artificial sequence
  Forward Primer
agcaaagaaggcagcagag

SEQ ID NO: 17130 - DNA, 26 bp, Artificial sequence
  Forward Primer
attcctagcttatttgtttatgcaat

SEQ ID NO: 17131 - DNA, 30 bp, Artificial sequence
  Forward Primer
aagtgatcttcatctatttgtatttgtact

SEQ ID NO: 17132 - DNA, 27 bp, Artificial sequence
  Forward Primer
atcaaggtttgtatcttcaataggtac

SEQ ID NO: 17133 - DNA, 23 bp, Artificial sequence
  Forward Primer
acatgtcactttacttttttgcc

SEQ ID NO: 17134 - DNA, 21 bp, Artificial sequence
  Forward Primer
tttggtgggaaagaaagaaag

SEQ ID NO: 17135 - DNA, 27 bp, Artificial sequence
  Forward Primer
atatttagttcagagggagaaaaatgt

SEQ ID NO: 17136 - DNA, 24 bp, Artificial sequence
  Forward Primer
tatttttagtttggagtctaaatg

SEQ ID NO: 17137 - DNA, 20 bp, Artificial sequence
  Forward Primer
tcggtacaggagatccattg

SEQ ID NO: 17138 - DNA, 28 bp, Artificial sequence
  Forward Primer
aagctaaaacaatgacattatgtatgat

SEQ ID NO: 17139 - DNA, 18 bp, Artificial sequence
  Forward Primer
atttggggtcagctccct

SEQ ID NO: 17140 - DNA, 25 bp, Artificial sequence
  Forward Primer
taaaattaggatgagagcttctagt

SEQ ID NO: 17141 - DNA, 24 bp, Artificial sequence
  Forward Primer
aaccataccactaacctcagaaaa

SEQ ID NO: 17142 - DNA, 20 bp, Artificial sequence
  Forward Primer
tgtcaattcctcccaaagag

SEQ ID NO: 17143 - DNA, 19 bp, Artificial sequence
  Forward Primer
accgtgtcaacaaaaccat

SEQ ID NO: 17144 - DNA, 24 bp, Artificial sequence
  Forward Primer
ttaaartggagacaaaatattggc

SEQ ID NO: 17145 - DNA, 19 bp, Artificial sequence
  Forward Primer
tattttgctgctctgcctc

SEQ ID NO: 17146 - DNA, 19 bp, Artificial sequence
  Forward Primer
caggctctctaggactggg

SEQ ID NO: 17147 - DNA, 23 bp, Artificial sequence
  Forward Primer
ttagcagaaagaggctaagaagc

SEQ ID NO: 17148 - DNA, 24 bp, Artificial sequence
  Forward Primer
taagtgattttctcacgcttagtg

SEQ ID NO: 17149 - DNA, 20 bp, Artificial sequence
  Forward Primer
atgtcccagacccaggttat

SEQ ID NO: 17150 - DNA, 20 bp, Artificial sequence
  Forward Primer
aaaagtttctcgaagctgca

SEQ ID NO: 17151 - DNA, 27 bp, Artificial sequence
  Forward Primer
tctctttagtcttccctaaatattgtg

SEQ ID NO: 17152 - DNA, 30 bp, Artificial sequence
  Forward Primer
aatatattaaacagtggtaactacaatcta

SEQ ID NO: 17153 - DNA, 22 bp, Artificial sequence
  Forward Primer
ttgytggtaggcctataaattg

SEQ ID NO: 17154 - DNA, 28 bp, Artificial sequence
  Forward Primer
ccccaaataaaacataacagatataatt

SEQ ID NO: 17155 - DNA, 23 bp, Artificial sequence
  Forward Primer
aaattgaagattcatgtccaaga

SEQ ID NO: 17156 - DNA, 30 bp, Artificial sequence
  Forward Primer
tttaatacttcttagagctttctattttcc

SEQ ID NO: 17157 - DNA, 22 bp, Artificial sequence
  Forward Primer
aaatcatatccctattgtctgg

SEQ ID NO: 17158 - DNA, 24 bp, Artificial sequence
  Forward Primer
taaataactkgccttgattctgtg

SEQ ID NO: 17159 - DNA, 25 bp, Artificial sequence
  Forward Primer
aacaaagacttatgaaagaggatgg

SEQ ID NO: 17160 - DNA, 26 bp, Artificial sequence
  Forward Primer
attcacattattaaccaaaaagacct

SEQ ID NO: 17161 - DNA, 24 bp, Artificial sequence
  Forward Primer
agatctcatcctgacctagtgaat

SEQ ID NO: 17162 - DNA, 23 bp, Artificial sequence
  Forward Primer
aattaggatcactagcaaatcgg

SEQ ID NO: 17163 - DNA, 19 bp, Artificial sequence
  Forward Primer
aaattgtgctggccttgat

SEQ ID NO: 17164 - DNA, 18 bp, Artificial sequence
  Forward Primer
tttgaggtccgttcctgg

SEQ ID NO: 17165 - DNA, 29 bp, Artificial sequence
  Forward Primer
ttctactcttggttttaaatattctctca

SEQ ID NO: 17166 - DNA, 23 bp, Artificial sequence
  Forward Primer
agaagggcgttaattcctataac

SEQ ID NO: 17167 - DNA, 26 bp, Artificial sequence
  Forward Primer
gaattaaaacaagagaacatgtgaca

SEQ ID NO: 17168 - DNA, 19 bp, Artificial sequence
  Forward Primer
ttaataatgtcaggcctcc

SEQ ID NO: 17169 - DNA, 20 bp, Artificial sequence
  Forward Primer
ttaccaagacctgtctcccc

SEQ ID NO: 17170 - DNA, 21 bp, Artificial sequence
  Forward Primer
aaaatctcaatgcagaagggt

SEQ ID NO: 17171 - DNA, 22 bp, Artificial sequence
  Forward Primer
ggatgaacccatgtcattaaac

SEQ ID NO: 17172 - DNA, 18 bp, Artificial sequence
  Forward Primer
tcacaaggcccgaatttg

SEQ ID NO: 17173 - DNA, 20 bp, Artificial sequence
  Forward Primer
tttctgccatacatcaacgt

SEQ ID NO: 17174 - DNA, 23 bp, Artificial sequence
  Forward Primer
atgactaagtgaggaaatccgtc

SEQ ID NO: 17175 - DNA, 18 bp, Artificial sequence
  Forward Primer
attgcaaaagcctccgtt

SEQ ID NO: 17176 - DNA, 19 bp, Artificial sequence
  Forward Primer
ccaacaggcacttcatctt

SEQ ID NO: 17177 - DNA, 20 bp, Artificial sequence
  Forward Primer
tctctaaataagggcttgct

SEQ ID NO: 17178 - DNA, 30 bp, Artificial sequence
  Forward Primer
atgaacctagagattatcatagtaactgaa

SEQ ID NO: 17179 - DNA, 23 bp, Artificial sequence
  Forward Primer
tgacctctataaactgcaactga

SEQ ID NO: 17180 - DNA, 18 bp, Artificial sequence
  Forward Primer
atcccttcggcactaccc

SEQ ID NO: 17181 - DNA, 19 bp, Artificial sequence
  Forward Primer
ccctaagggctgcactagt

SEQ ID NO: 17182 - DNA, 26 bp, Artificial sequence
  Forward Primer
ttaaatcaggaagaaactcctacaat

SEQ ID NO: 17183 - DNA, 21 bp, Artificial sequence
  Forward Primer
gtgtccctctaagggtcaact

SEQ ID NO: 17184 - DNA, 18 bp, Artificial sequence
  Forward Primer
ttcgtcagctctgggcac

SEQ ID NO: 17185 - DNA, 20 bp, Artificial sequence
  Forward Primer
ttaagctactcctcagtggc

SEQ ID NO: 17186 - DNA, 27 bp, Artificial sequence
  Forward Primer
tgttctgtaggtatgttttagaatttt

SEQ ID NO: 17187 - DNA, 21 bp, Artificial sequence
  Forward Primer
aaaggtcttgctggatttcat

SEQ ID NO: 17188 - DNA, 24 bp, Artificial sequence
  Forward Primer
taatattgacctcatctcctgacc

SEQ ID NO: 17189 - DNA, 18 bp, Artificial sequence
  Forward Primer
gagggcagggaccacctt

SEQ ID NO: 17190 - DNA, 18 bp, Artificial sequence
  Forward Primer
tggaggtaggtacgccca

SEQ ID NO: 17191 - DNA, 18 bp, Artificial sequence
  Forward Primer
agcaccagccctgtgttc

SEQ ID NO: 17192 - DNA, 18 bp, Artificial sequence
  Forward Primer
ttccagccaggtccaaat

SEQ ID NO: 17193 - DNA, 25 bp, Artificial sequence
  Forward Primer
ttggggttcataagataaaagttaa

SEQ ID NO: 17194 - DNA, 22 bp, Artificial sequence
  Forward Primer
attaacatagggctgtcattgc

SEQ ID NO: 17195 - DNA, 24 bp, Artificial sequence
  Forward Primer
acaggaaaaagaaatctgtcagaa

SEQ ID NO: 17196 - DNA, 27 bp, Artificial sequence
  Forward Primer
aaataaatttaagatggtttctaggct

SEQ ID NO: 17197 - DNA, 28 bp, Artificial sequence
  Forward Primer
aagaaagtatatattttgaagaaaagcc

SEQ ID NO: 17198 - DNA, 24 bp, Artificial sequence
  Forward Primer
tttgttaatgaagcaacaagaaaa

SEQ ID NO: 17199 - DNA, 24 bp, Artificial sequence
  Forward Primer
ctaggcatattgtatacacacttt

SEQ ID NO: 17200 - DNA, 26 bp, Artificial sequence
  Forward Primer
aaaragatkatgtgttatctttttcc

SEQ ID NO: 17201 - DNA, 25 bp, Artificial sequence
  Forward Primer
atttctagacccaaagtaagcattc

SEQ ID NO: 17202 - DNA, 18 bp, Artificial sequence
  Forward Primer
cctcaggcatggtgacac

SEQ ID NO: 17203 - DNA, 25 bp, Artificial sequence
  Forward Primer
ttgttgaatatgaactgaaaaaagc

SEQ ID NO: 17204 - DNA, 24 bp, Artificial sequence
  Forward Primer
taaatttcattgtttccatctgtg

SEQ ID NO: 17205 - DNA, 23 bp, Artificial sequence
  Forward Primer
ttaacaaatgttggccatttaag

SEQ ID NO: 17206 - DNA, 18 bp, Artificial sequence
  Forward Primer
aggaggcagtgctggcca

SEQ ID NO: 17207 - DNA, 23 bp, Artificial sequence
  Forward Primer
aaatttttcatctccaaatgtgc

SEQ ID NO: 17208 - DNA, 21 bp, Artificial sequence
  Forward Primer
tgtaaagcaattatcctccaa

SEQ ID NO: 17209 - DNA, 21 bp, Artificial sequence
  Forward Primer
ataatgccaatgtcccagact

SEQ ID NO: 17210 - DNA, 22 bp, Artificial sequence
  Forward Primer
ggctataaatcttccaaaattg

SEQ ID NO: 17211 - DNA, 18 bp, Artificial sequence
  Forward Primer
ttctttcaaagccgcaac

SEQ ID NO: 17212 - DNA, 19 bp, Artificial sequence
  Forward Primer
aaaagaactgcctccctga

SEQ ID NO: 17213 - DNA, 21 bp, Artificial sequence
  Forward Primer
ccctctttgagttgctagaat

SEQ ID NO: 17214 - DNA, 20 bp, Artificial sequence
  Forward Primer
gcattctcattcgtctgtgt

SEQ ID NO: 17215 - DNA, 25 bp, Artificial sequence
  Forward Primer
aaaaactttgtcctttataacactc

SEQ ID NO: 17216 - DNA, 22 bp, Artificial sequence
  Forward Primer
aaagtggaacaaacatttgagg

SEQ ID NO: 17217 - DNA, 24 bp, Artificial sequence
  Forward Primer
tatgagtaagtataaaatggcctt

SEQ ID NO: 17218 - DNA, 22 bp, Artificial sequence
  Forward Primer
atttgtctggaaatagtgactt

SEQ ID NO: 17219 - DNA, 27 bp, Artificial sequence
  Forward Primer
tgaaaagtatagatctgccttaatttc

SEQ ID NO: 17220 - DNA, 23 bp, Artificial sequence
  Forward Primer
ataatctgaatttccgaacagtc

SEQ ID NO: 17221 - DNA, 22 bp, Artificial sequence
  Forward Primer
ttttatctccctaattgtgtca

SEQ ID NO: 17222 - DNA, 18 bp, Artificial sequence
  Forward Primer
aggctttgagctcctggg

SEQ ID NO: 17223 - DNA, 19 bp, Artificial sequence
  Forward Primer
agacgaccccagaatcctt

SEQ ID NO: 17224 - DNA, 18 bp, Artificial sequence
  Forward Primer
catgggagccatgaattg

SEQ ID NO: 17225 - DNA, 24 bp, Artificial sequence
  Forward Primer
tttgtaatctagactgtcaaggcc

SEQ ID NO: 17226 - DNA, 25 bp, Artificial sequence
  Forward Primer
atgtcaactcataattttactggga

SEQ ID NO: 17227 - DNA, 22 bp, Artificial sequence
  Forward Primer
atagataatttttggagggggt

SEQ ID NO: 17228 - DNA, 27 bp, Artificial sequence
  Forward Primer
aattttctgtggatttctctatttttc

SEQ ID NO: 17229 - DNA, 27 bp, Artificial sequence
  Forward Primer
taaagagataacgtaggagattcatag

SEQ ID NO: 17230 - DNA, 18 bp, Artificial sequence
  Forward Primer
atgctgcaacggctgcgt

SEQ ID NO: 17231 - DNA, 18 bp, Artificial sequence
  Forward Primer
ctccctcctgattctccc

SEQ ID NO: 17232 - DNA, 23 bp, Artificial sequence
  Forward Primer
ttctcgaaactgtttaatgagca

SEQ ID NO: 17233 - DNA, 30 bp, Artificial sequence
  Forward Primer
atacaattagcttttatgctatatatgact

SEQ ID NO: 17234 - DNA, 24 bp, Artificial sequence
  Forward Primer
ttatcaagagattatcaaagaaga

SEQ ID NO: 17235 - DNA, 26 bp, Artificial sequence
  Forward Primer
aatgagaagtttcctatgaatgaaat

SEQ ID NO: 17236 - DNA, 23 bp, Artificial sequence
  Forward Primer
ttgcttcttaagatatctctcca

SEQ ID NO: 17237 - DNA, 20 bp, Artificial sequence
  Forward Primer
ggtaaccagaaatttgcttc

SEQ ID NO: 17238 - DNA, 24 bp, Artificial sequence
  Forward Primer
atgaaatagcacaaaacagaaagg

SEQ ID NO: 17239 - DNA, 25 bp, Artificial sequence
  Forward Primer
tttcctagctcctcttattatgttt

SEQ ID NO: 17240 - DNA, 25 bp, Artificial sequence
  Forward Primer
ctgggaagaagtctttatttagaga

SEQ ID NO: 17241 - DNA, 18 bp, Artificial sequence
  Forward Primer
ccaggcagtagcaccagg

SEQ ID NO: 17242 - DNA, 19 bp, Artificial sequence
  Forward Primer
aaccggrttaccaagacct

SEQ ID NO: 17243 - DNA, 28 bp, Artificial sequence
  Forward Primer
tgaattctaagtaaatactatgtaatgg

SEQ ID NO: 17244 - DNA, 19 bp, Artificial sequence
  Forward Primer
cgactcgaaggacatgaga

SEQ ID NO: 17245 - DNA, 24 bp, Artificial sequence
  Forward Primer
aatgtactgattgagacaaaacaa

SEQ ID NO: 17246 - DNA, 26 bp, Artificial sequence
  Forward Primer
ttttcatatcctaactgcttctctct

SEQ ID NO: 17247 - DNA, 27 bp, Artificial sequence
  Forward Primer
agagttaatcagacattttatagcatt

SEQ ID NO: 17248 - DNA, 24 bp, Artificial sequence
  Forward Primer
aaaatatatgaacaagccttgagc

SEQ ID NO: 17249 - DNA, 30 bp, Artificial sequence
  Forward Primer
gtctttaaaatgtagcatgtaaatacaatg

SEQ ID NO: 17250 - DNA, 19 bp, Artificial sequence
  Forward Primer
ctgccaatcaaaatgacaa

SEQ ID NO: 17251 - DNA, 24 bp, Artificial sequence
  Forward Primer
ataaagcatttttcacacacttgc

SEQ ID NO: 17252 - DNA, 28 bp, Artificial sequence
  Forward Primer
aaatacaatagtgttgaagcaaaataca

SEQ ID NO: 17253 - DNA, 30 bp, Artificial sequence
  Forward Primer
taaatattaatataagagttaggcaagcat

SEQ ID NO: 17254 - DNA, 22 bp, Artificial sequence
  Forward Primer
tagttggttgatttgttttctt

SEQ ID NO: 17255 - DNA, 24 bp, Artificial sequence
  Forward Primer
acttattagttgccttttcacagc

SEQ ID NO: 17256 - DNA, 23 bp, Artificial sequence
  Forward Primer
ttctggcctcatatactctgaaa

SEQ ID NO: 17257 - DNA, 21 bp, Artificial sequence
  Forward Primer
aaaagggaatacggacagtgt

SEQ ID NO: 17258 - DNA, 28 bp, Artificial sequence
  Forward Primer
taaggtcttaagaagaaagaaaaaagtt

SEQ ID NO: 17259 - DNA, 28 bp, Artificial sequence
  Forward Primer
agtgttcaaacactcattttcttattaa

SEQ ID NO: 17260 - DNA, 22 bp, Artificial sequence
  Forward Primer
agtaggctcaaaaataacaatt

SEQ ID NO: 17261 - DNA, 19 bp, Artificial sequence
  Forward Primer
caaacaatgatttctccct

SEQ ID NO: 17262 - DNA, 22 bp, Artificial sequence
  Forward Primer
gacagtaacttctaatcaggct

SEQ ID NO: 17263 - DNA, 27 bp, Artificial sequence
  Forward Primer
aagatggagttttgtatytgtttctta

SEQ ID NO: 17264 - DNA, 21 bp, Artificial sequence
  Forward Primer
ttcaggtatttcttgaacctc

SEQ ID NO: 17265 - DNA, 20 bp, Artificial sequence
  Forward Primer
caaagtgcatccattaacac

SEQ ID NO: 17266 - DNA, 19 bp, Artificial sequence
  Forward Primer
aactctgaccaccttcccg

SEQ ID NO: 17267 - DNA, 19 bp, Artificial sequence
  Forward Primer
ttttctctgaagcaccaca

SEQ ID NO: 17268 - DNA, 27 bp, Artificial sequence
  Forward Primer
tttcatattacagactcacagacctag

SEQ ID NO: 17269 - DNA, 25 bp, Artificial sequence
  Forward Primer
gaaaggttatttaaatgcttttgtg

SEQ ID NO: 17270 - DNA, 19 bp, Artificial sequence
  Forward Primer
tgcccgctctgcgcataat

SEQ ID NO: 17271 - DNA, 19 bp, Artificial sequence
  Forward Primer
acacaggccttgatattga

SEQ ID NO: 17272 - DNA, 20 bp, Artificial sequence
  Forward Primer
acaaattccccaagaacatt

SEQ ID NO: 17273 - DNA, 18 bp, Artificial sequence
  Forward Primer
cgcagaatgccagcacat

SEQ ID NO: 17274 - DNA, 24 bp, Artificial sequence
  Forward Primer
aacatagggatttttagagctgtg

SEQ ID NO: 17275 - DNA, 21 bp, Artificial sequence
  Forward Primer
aatcgattcatctcacaacct

SEQ ID NO: 17276 - DNA, 28 bp, Artificial sequence
  Forward Primer
tacacaatgtaattgaaaatcttaggat

SEQ ID NO: 17277 - DNA, 23 bp, Artificial sequence
  Forward Primer
actgtagaaccaagagcaaaaga

SEQ ID NO: 17278 - DNA, 18 bp, Artificial sequence
  Forward Primer
tgctgccggaggtaggac

SEQ ID NO: 17279 - DNA, 19 bp, Artificial sequence
  Forward Primer
tcagtctggcttctcaagg

SEQ ID NO: 17280 - DNA, 18 bp, Artificial sequence
  Forward Primer
ccagtggttctggtctcg

SEQ ID NO: 17281 - DNA, 30 bp, Artificial sequence
  Forward Primer
attattctaccttaaatcttctatktagta

SEQ ID NO: 17282 - DNA, 30 bp, Artificial sequence
  Forward Primer
atttattaccactagaataatgtataatcc

SEQ ID NO: 17283 - DNA, 22 bp, Artificial sequence
  Forward Primer
atttctgatttttgacctccag

SEQ ID NO: 17284 - DNA, 26 bp, Artificial sequence
  Forward Primer
attcttctgttttaaccacttacctt

SEQ ID NO: 17285 - DNA, 26 bp, Artificial sequence
  Forward Primer
attttgtgaaattaacatccactaca

SEQ ID NO: 17286 - DNA, 28 bp, Artificial sequence
  Forward Primer
aattctacaagtcataaataacactcaa

SEQ ID NO: 17287 - DNA, 24 bp, Artificial sequence
  Forward Primer
attagcctccaattaaaataaaca

SEQ ID NO: 17288 - DNA, 21 bp, Artificial sequence
  Forward Primer
ttcttggctacaccagaaaca

SEQ ID NO: 17289 - DNA, 19 bp, Artificial sequence
  Forward Primer
tctgctaaccccaacatca

SEQ ID NO: 17290 - DNA, 30 bp, Artificial sequence
  Forward Primer
cccttatttaactaataatcatatcctttt

SEQ ID NO: 17291 - DNA, 26 bp, Artificial sequence
  Forward Primer
ataacagtttcactttatggatcagc

SEQ ID NO: 17292 - DNA, 26 bp, Artificial sequence
  Forward Primer
aaagctttgaacaataactgactctt

SEQ ID NO: 17293 - DNA, 24 bp, Artificial sequence
  Forward Primer
aaattctggtttctgtaccatttg

SEQ ID NO: 17294 - DNA, 19 bp, Artificial sequence
  Forward Primer
tgtgtttgtgatcccttgc

SEQ ID NO: 17295 - DNA, 27 bp, Artificial sequence
  Forward Primer
aatcagtagataagggaaaggtatttt

SEQ ID NO: 17296 - DNA, 29 bp, Artificial sequence
  Forward Primer
ctaaatggactagatatataagaggcttc

SEQ ID NO: 17297 - DNA, 23 bp, Artificial sequence
  Forward Primer
tttttgaggaaacttccttctct

SEQ ID NO: 17298 - DNA, 25 bp, Artificial sequence
  Forward Primer
ytgaatggctaataaattcaaagaa

SEQ ID NO: 17299 - DNA, 24 bp, Artificial sequence
  Forward Primer
taaagggaaaagaaatgaaaaaga

SEQ ID NO: 17300 - DNA, 26 bp, Artificial sequence
  Forward Primer
taagaygttaattccttggtctaaga

SEQ ID NO: 17301 - DNA, 24 bp, Artificial sequence
  Forward Primer
tttacattacacagctcagtctgg

SEQ ID NO: 17302 - DNA, 21 bp, Artificial sequence
  Forward Primer
tgataagggtggagaaaggtc

SEQ ID NO: 17303 - DNA, 27 bp, Artificial sequence
  Forward Primer
gacatgttaaataactgtcaagaaacc

SEQ ID NO: 17304 - DNA, 23 bp, Artificial sequence
  Forward Primer
ttttataccttggagaggactga

SEQ ID NO: 17305 - DNA, 21 bp, Artificial sequence
  Forward Primer
tcagcatcacagagcaaattt

SEQ ID NO: 17306 - DNA, 19 bp, Artificial sequence
  Forward Primer
tttggcaaattcctttggt

SEQ ID NO: 17307 - DNA, 19 bp, Artificial sequence
  Forward Primer
tgtggccataatttttgca

SEQ ID NO: 17308 - DNA, 24 bp, Artificial sequence
  Forward Primer
atttctttgaaaggaaaaatcaga

SEQ ID NO: 17309 - DNA, 24 bp, Artificial sequence
  Forward Primer
aaaagaaaacacaggagtttctca

SEQ ID NO: 17310 - DNA, 19 bp, Artificial sequence
  Forward Primer
atcagtggggcttctctcc

SEQ ID NO: 17311 - DNA, 27 bp, Artificial sequence
  Forward Primer
aagaataggggtagtatatagggacat

SEQ ID NO: 17312 - DNA, 26 bp, Artificial sequence
  Forward Primer
taatggtatattccaggagagtaagg

SEQ ID NO: 17313 - DNA, 26 bp, Artificial sequence
  Forward Primer
aataaacacttgttgagggaattatg

SEQ ID NO: 17314 - DNA, 22 bp, Artificial sequence
  Forward Primer
tatgcaatttccattcttttcg

SEQ ID NO: 17315 - DNA, 18 bp, Artificial sequence
  Forward Primer
tttgaggggccagccggt

SEQ ID NO: 17316 - DNA, 22 bp, Artificial sequence
  Forward Primer
tttaaaatttggccatttgaga

SEQ ID NO: 17317 - DNA, 27 bp, Artificial sequence
  Forward Primer
caaaccaaactaatttaactgctaata

SEQ ID NO: 17318 - DNA, 24 bp, Artificial sequence
  Forward Primer
tgtcataaaatcaaaaaaggaaca

SEQ ID NO: 17319 - DNA, 20 bp, Artificial sequence
  Forward Primer
tccacccacatttaaagatg

SEQ ID NO: 17320 - DNA, 21 bp, Artificial sequence
  Forward Primer
atcacaaagggtcaaaccact

SEQ ID NO: 17321 - DNA, 19 bp, Artificial sequence
  Forward Primer
accctcaaggatccgagtt

SEQ ID NO: 17322 - DNA, 24 bp, Artificial sequence
  Forward Primer
aagatatgtatcaatgctgttgtc

SEQ ID NO: 17323 - DNA, 25 bp, Artificial sequence
  Forward Primer
trcattgctcaatgatatttcataa

SEQ ID NO: 17324 - DNA, 22 bp, Artificial sequence
  Forward Primer
tacctaatgttgtttctggagc

SEQ ID NO: 17325 - DNA, 18 bp, Artificial sequence
  Forward Primer
tgccagactgaggtccag

SEQ ID NO: 17326 - DNA, 28 bp, Artificial sequence
  Forward Primer
aaataaattatgttgtaggaggattgtt

SEQ ID NO: 17327 - DNA, 21 bp, Artificial sequence
  Forward Primer
tgaattctaaagggcaaaaca

SEQ ID NO: 17328 - DNA, 27 bp, Artificial sequence
  Forward Primer
aataaaaatagsttttagttgccactt

SEQ ID NO: 17329 - DNA, 23 bp, Artificial sequence
  Forward Primer
tgaaatttttgaaaacaaccaag

SEQ ID NO: 17330 - DNA, 21 bp, Artificial sequence
  Forward Primer
aaatgcttactgagcagttgg

SEQ ID NO: 17331 - DNA, 30 bp, Artificial sequence
  Forward Primer
taactgcttataacatttttacattctaca

SEQ ID NO: 17332 - DNA, 30 bp, Artificial sequence
  Forward Primer
aaattagttcacaatactgaaaatactgag

SEQ ID NO: 17333 - DNA, 21 bp, Artificial sequence
  Forward Primer
aaataaaataccggacctggg

SEQ ID NO: 17334 - DNA, 24 bp, Artificial sequence
  Forward Primer
ctttagytcmacttttgcattttt

SEQ ID NO: 17335 - DNA, 22 bp, Artificial sequence
  Forward Primer
gcctacgtagaagcttacattt

SEQ ID NO: 17336 - DNA, 20 bp, Artificial sequence
  Forward Primer
tcttgaatgaggaattctgg

SEQ ID NO: 17337 - DNA, 27 bp, Artificial sequence
  Forward Primer
agttatgagaggtgatattttagcatc

SEQ ID NO: 17338 - DNA, 23 bp, Artificial sequence
  Forward Primer
atcttgctttatgatgatctaac

SEQ ID NO: 17339 - DNA, 28 bp, Artificial sequence
  Forward Primer
tattttatcttccacatttagaaaagtc

SEQ ID NO: 17340 - DNA, 23 bp, Artificial sequence
  Forward Primer
tgacagacatgctctgtgataca

SEQ ID NO: 17341 - DNA, 29 bp, Artificial sequence
  Forward Primer
tttaaacagtactgacttgatattcaaag

SEQ ID NO: 17342 - DNA, 24 bp, Artificial sequence
  Forward Primer
ttatttgtacatgtgcctaacgtc

SEQ ID NO: 17343 - DNA, 19 bp, Artificial sequence
  Forward Primer
attcatagacttgccaacc

SEQ ID NO: 17344 - DNA, 18 bp, Artificial sequence
  Forward Primer
aggctttgagctcctggg

SEQ ID NO: 17345 - DNA, 24 bp, Artificial sequence
  Forward Primer
tgatgacaaaggagacaaagtaag

SEQ ID NO: 17346 - DNA, 18 bp, Artificial sequence
  Forward Primer
ttcttycccgacactgtg

SEQ ID NO: 17347 - DNA, 26 bp, Artificial sequence
  Forward Primer
atttctggtagtctctgcttttagag

SEQ ID NO: 17348 - DNA, 18 bp, Artificial sequence
  Forward Primer
atgaaacccaggccctcg

SEQ ID NO: 17349 - DNA, 24 bp, Artificial sequence
  Forward Primer
aaacctgtatcctctgcaatagaa

SEQ ID NO: 17350 - DNA, 21 bp, Artificial sequence
  Forward Primer
ttgctttttgaggaaacttcc

SEQ ID NO: 17351 - DNA, 24 bp, Artificial sequence
  Forward Primer
tataattatccccaaagaaatcct

SEQ ID NO: 17352 - DNA, 20 bp, Artificial sequence
  Forward Primer
ttgagtcaggaaagaaaaag

SEQ ID NO: 17353 - DNA, 26 bp, Artificial sequence
  Forward Primer
ttagtgaatcyaggaataaaggactt

SEQ ID NO: 17354 - DNA, 30 bp, Artificial sequence
  Forward Primer
gaacagaaaataagagaatatgtagataaa

SEQ ID NO: 17355 - DNA, 19 bp, Artificial sequence
  Forward Primer
atttgacgtggcagttatg

SEQ ID NO: 17356 - DNA, 23 bp, Artificial sequence
  Forward Primer
aaactaactcccttaggcttcag

SEQ ID NO: 17357 - DNA, 26 bp, Artificial sequence
  Forward Primer
aaaagagaaagccttaagtaatgaga

SEQ ID NO: 17358 - DNA, 27 bp, Artificial sequence
  Forward Primer
acttagaagacttcattataacaatgg

SEQ ID NO: 17359 - DNA, 28 bp, Artificial sequence
  Forward Primer
taacctaagttagcattctttctagctc

SEQ ID NO: 17360 - DNA, 21 bp, Artificial sequence
  Forward Primer
tttcagcgtcattacctttga

SEQ ID NO: 17361 - DNA, 22 bp, Artificial sequence
  Forward Primer
tttgttgtcgttcttgttcagt

SEQ ID NO: 17362 - DNA, 27 bp, Artificial sequence
  Forward Primer
agactgaaataagtcagaaacagaaaa

SEQ ID NO: 17363 - DNA, 18 bp, Artificial sequence
  Forward Primer
accaaggccaagtcctga

SEQ ID NO: 17364 - DNA, 21 bp, Artificial sequence
  Forward Primer
ttatttcttcccttgatggta

SEQ ID NO: 17365 - DNA, 23 bp, Artificial sequence
  Forward Primer
tatggaagtgcagtagaggagaa

SEQ ID NO: 17366 - DNA, 18 bp, Artificial sequence
  Forward Primer
tttgactcagcctggctt

SEQ ID NO: 17367 - DNA, 18 bp, Artificial sequence
  Forward Primer
tgccctcttccttacctg

SEQ ID NO: 17368 - DNA, 29 bp, Artificial sequence
  Forward Primer
aaaacttgatagtatgtgtgtatatttgc

SEQ ID NO: 17369 - DNA, 24 bp, Artificial sequence
  Forward Primer
ttttatatcctgaagcaaaatcca

SEQ ID NO: 17370 - DNA, 21 bp, Artificial sequence
  Forward Primer
acaggaagagagaacaaggtg

SEQ ID NO: 17371 - DNA, 27 bp, Artificial sequence
  Forward Primer
aatgagtgttttatatgtactggaaaa

SEQ ID NO: 17372 - DNA, 18 bp, Artificial sequence
  Forward Primer
tcaggagatttgcccagg

SEQ ID NO: 17373 - DNA, 22 bp, Artificial sequence
  Forward Primer
tttaattgttatgagcctggga

SEQ ID NO: 17374 - DNA, 26 bp, Artificial sequence
  Forward Primer
taaatcttgctaataagcttctctgg

SEQ ID NO: 17375 - DNA, 27 bp, Artificial sequence
  Forward Primer
gaaaatgtgaaatggatatgatttatc

SEQ ID NO: 17376 - DNA, 24 bp, Artificial sequence
  Forward Primer
atgaacatctgatctgtgactctg

SEQ ID NO: 17377 - DNA, 23 bp, Artificial sequence
  Forward Primer
tgtttgagacaactcaaaaatcc

SEQ ID NO: 17378 - DNA, 18 bp, Artificial sequence
  Forward Primer
atgcctccaagactgcag

SEQ ID NO: 17379 - DNA, 23 bp, Artificial sequence
  Forward Primer
attagctttggtcaggagaaaag

SEQ ID NO: 17380 - DNA, 26 bp, Artificial sequence
  Forward Primer
aaatatcatcaacattgtctttcatc

SEQ ID NO: 17381 - DNA, 23 bp, Artificial sequence
  Forward Primer
cttaagttgctcaccattgtgtt

SEQ ID NO: 17382 - DNA, 28 bp, Artificial sequence
  Forward Primer
aatatccttttggaagattaaaactaga

SEQ ID NO: 17383 - DNA, 27 bp, Artificial sequence
  Forward Primer
catttttctgatcctcatatgtaatct

SEQ ID NO: 17384 - DNA, 24 bp, Artificial sequence
  Forward Primer
ttatactgttacrgatcatggctg

SEQ ID NO: 17385 - DNA, 25 bp, Artificial sequence
  Forward Primer
aattgtcttgtgtttctcttcaaca

SEQ ID NO: 17386 - DNA, 18 bp, Artificial sequence
  Forward Primer
aaaatgaccaaaggccgc

SEQ ID NO: 17387 - DNA, 18 bp, Artificial sequence
  Forward Primer
cgtttctgggctgattca

SEQ ID NO: 17388 - DNA, 22 bp, Artificial sequence
  Forward Primer
tgtttactgaaaggatcttggg

SEQ ID NO: 17389 - DNA, 20 bp, Artificial sequence
  Forward Primer
aattgcttgggacaatcaaa

SEQ ID NO: 17390 - DNA, 23 bp, Artificial sequence
  Forward Primer
atttcagcactgagtctcaattt

SEQ ID NO: 17391 - DNA, 18 bp, Artificial sequence
  Forward Primer
gcaaacctgacccgcaac

SEQ ID NO: 17392 - DNA, 18 bp, Artificial sequence
  Forward Primer
attacccggtggaggtga

SEQ ID NO: 17393 - DNA, 23 bp, Artificial sequence
  Forward Primer
ttcgttagtagattttgtttttc

SEQ ID NO: 17394 - DNA, 20 bp, Artificial sequence
  Forward Primer
actgtagactggggtggtgt

SEQ ID NO: 17395 - DNA, 23 bp, Artificial sequence
  Forward Primer
tataagtagaagaaagactcgca

SEQ ID NO: 17396 - DNA, 18 bp, Artificial sequence
  Forward Primer
aagtcccatgcatgacgc

SEQ ID NO: 17397 - DNA, 19 bp, Artificial sequence
  Forward Primer
atgcaacttggctggtaat

SEQ ID NO: 17398 - DNA, 27 bp, Artificial sequence
  Forward Primer
taatctcttacacatcctaccatatcc

SEQ ID NO: 17399 - DNA, 24 bp, Artificial sequence
  Forward Primer
agtgtaatgaatctcacagtatgt

SEQ ID NO: 17400 - DNA, 25 bp, Artificial sequence
  Forward Primer
ttctattaaagagawagagagagca

SEQ ID NO: 17401 - DNA, 23 bp, Artificial sequence
  Forward Primer
taaatggactaaaactgctgctc

SEQ ID NO: 17402 - DNA, 19 bp, Artificial sequence
  Forward Primer
ccccatcactgatcaaatg

SEQ ID NO: 17403 - DNA, 21 bp, Artificial sequence
  Forward Primer
gggaaaatatgtgcattttga

SEQ ID NO: 17404 - DNA, 19 bp, Artificial sequence
  Forward Primer
atgacctccttcccagagg

SEQ ID NO: 17405 - DNA, 21 bp, Artificial sequence
  Forward Primer
atacagagcagacttgggata

SEQ ID NO: 17406 - DNA, 30 bp, Artificial sequence
  Forward Primer
aataatgaatgttattctaagtatttagcc

SEQ ID NO: 17407 - DNA, 24 bp, Artificial sequence
  Forward Primer
gttaacttttgtatcattctcaaa

SEQ ID NO: 17408 - DNA, 24 bp, Artificial sequence
  Forward Primer
aataatgaaacagaatactggaat

SEQ ID NO: 17409 - DNA, 24 bp, Artificial sequence
  Forward Primer
ttttcattgttttttaaatgaggg

SEQ ID NO: 17410 - DNA, 20 bp, Artificial sequence
  Forward Primer
aaaggcatttgtgagctaaa

SEQ ID NO: 17411 - DNA, 21 bp, Artificial sequence
  Forward Primer
aaaccatgtgtcagcttctga

SEQ ID NO: 17412 - DNA, 30 bp, Artificial sequence
  Forward Primer
ttatcttttattgctaataacacttcactc

SEQ ID NO: 17413 - DNA, 20 bp, Artificial sequence
  Forward Primer
acctggttcagtgaaggtcc

SEQ ID NO: 17414 - DNA, 26 bp, Artificial sequence
  Forward Primer
taattcctacttcaaatatttcccat

SEQ ID NO: 17415 - DNA, 24 bp, Artificial sequence
  Forward Primer
tatgaggaaatggaaataaaagga

SEQ ID NO: 17416 - DNA, 27 bp, Artificial sequence
  Forward Primer
ttaatgttctttgttctgacaagataa

SEQ ID NO: 17417 - DNA, 19 bp, Artificial sequence
  Forward Primer
attggcggaaagtttcttc

SEQ ID NO: 17418 - DNA, 22 bp, Artificial sequence
  Forward Primer
agaaaatcctgcaaggtaatgt

SEQ ID NO: 17419 - DNA, 27 bp, Artificial sequence
  Forward Primer
ttaattgcattttctgttacatacaca

SEQ ID NO: 17420 - DNA, 20 bp, Artificial sequence
  Forward Primer
aacagctgcactttccaaaa

SEQ ID NO: 17421 - DNA, 24 bp, Artificial sequence
  Forward Primer
taagttataaaatggttctcttcg

SEQ ID NO: 17422 - DNA, 22 bp, Artificial sequence
  Forward Primer
ctggaaatatttggttaatgaa

SEQ ID NO: 17423 - DNA, 22 bp, Artificial sequence
  Forward Primer
ataggcccatcttaacatcttg

SEQ ID NO: 17424 - DNA, 20 bp, Artificial sequence
  Forward Primer
tatgacaaggcatatcccat

SEQ ID NO: 17425 - DNA, 18 bp, Artificial sequence
  Forward Primer
tgggcaaagaggaatcgt

SEQ ID NO: 17426 - DNA, 27 bp, Artificial sequence
  Forward Primer
tttacaatctactacttgtaagccaag

SEQ ID NO: 17427 - DNA, 30 bp, Artificial sequence
  Forward Primer
actaaagcacagtaaatagaatacggtata

SEQ ID NO: 17428 - DNA, 21 bp, Artificial sequence
  Forward Primer
aaagtcagcacaaaggaaaca

SEQ ID NO: 17429 - DNA, 24 bp, Artificial sequence
  Forward Primer
taatactgaacttggctgaagatg

SEQ ID NO: 17430 - DNA, 21 bp, Artificial sequence
  Forward Primer
taaaaagttcacagggtggac

SEQ ID NO: 17431 - DNA, 24 bp, Artificial sequence
  Forward Primer
attgtgactttttattgtttgcag

SEQ ID NO: 17432 - DNA, 18 bp, Artificial sequence
  Forward Primer
aattccgttttttgccct

SEQ ID NO: 17433 - DNA, 19 bp, Artificial sequence
  Forward Primer
tagtgggtctatgagcaca

SEQ ID NO: 17434 - DNA, 28 bp, Artificial sequence
  Forward Primer
atttctataaggttatttcttctgaggg

SEQ ID NO: 17435 - DNA, 23 bp, Artificial sequence
  Forward Primer
ttcaggacagttgaggatctaag

SEQ ID NO: 17436 - DNA, 26 bp, Artificial sequence
  Forward Primer
ccacttattttctcaataatgaaatg

SEQ ID NO: 17437 - DNA, 26 bp, Artificial sequence
  Forward Primer
acttctaggaagtagatttcatctaa

SEQ ID NO: 17438 - DNA, 26 bp, Artificial sequence
  Forward Primer
aaaaggaataatatacacaagtgcaa

SEQ ID NO: 17439 - DNA, 29 bp, Artificial sequence
  Forward Primer
attactattaaaataagtgtcttgggaca

SEQ ID NO: 17440 - DNA, 26 bp, Artificial sequence
  Forward Primer
ttttaagttacacaaaaaggtatcca

SEQ ID NO: 17441 - DNA, 18 bp, Artificial sequence
  Forward Primer
tacaaggcaccctgctcg

SEQ ID NO: 17442 - DNA, 27 bp, Artificial sequence
  Forward Primer
aagtaattctagtgattttcttttagg

SEQ ID NO: 17443 - DNA, 26 bp, Artificial sequence
  Forward Primer
acaataaataacaagcattagcagtg

SEQ ID NO: 17444 - DNA, 18 bp, Artificial sequence
  Forward Primer
tgcagattccgctcctct

SEQ ID NO: 17445 - DNA, 23 bp, Artificial sequence
  Forward Primer
tactaaatggtgactcaggcatc

SEQ ID NO: 17446 - DNA, 28 bp, Artificial sequence
  Forward Primer
attttctcctgattaaacttctaaacat

SEQ ID NO: 17447 - DNA, 22 bp, Artificial sequence
  Forward Primer
tattgatgaacccggaagtaaa

SEQ ID NO: 17448 - DNA, 24 bp, Artificial sequence
  Forward Primer
ttgcacttatcaaaagatgacttc

SEQ ID NO: 17449 - DNA, 22 bp, Artificial sequence
  Forward Primer
aaaaagtaaggtttcacgcatg

SEQ ID NO: 17450 - DNA, 25 bp, Artificial sequence
  Forward Primer
aaagattttctttttcctgcttaac

SEQ ID NO: 17451 - DNA, 23 bp, Artificial sequence
  Forward Primer
aactactttgtccgttctactgg

SEQ ID NO: 17452 - DNA, 21 bp, Artificial sequence
  Forward Primer
tggattactcacagatgtggt

SEQ ID NO: 17453 - DNA, 21 bp, Artificial sequence
  Forward Primer
ataaaatggaaggaacaggca

SEQ ID NO: 17454 - DNA, 25 bp, Artificial sequence
  Forward Primer
tcttcagaatatactaactgggtgg

SEQ ID NO: 17455 - DNA, 26 bp, Artificial sequence
  Forward Primer
acctatttgttctgttctacaattca

SEQ ID NO: 17456 - DNA, 20 bp, Artificial sequence
  Forward Primer
atgagaacaatggtgtgacc

SEQ ID NO: 17457 - DNA, 27 bp, Artificial sequence
  Forward Primer
tttctcttgctaccagtttagtatttg

SEQ ID NO: 17458 - DNA, 26 bp, Artificial sequence
  Forward Primer
tattaagttggtaacagagagaaggg

SEQ ID NO: 17459 - DNA, 22 bp, Artificial sequence
  Forward Primer
aaaagtgtgatggactcaggag

SEQ ID NO: 17460 - DNA, 28 bp, Artificial sequence
  Forward Primer
aaaatctatggcttataaaagataagca

SEQ ID NO: 17461 - DNA, 28 bp, Artificial sequence
  Forward Primer
ctagcataaaactcagaaaacaataaaa

SEQ ID NO: 17462 - DNA, 24 bp, Artificial sequence
  Forward Primer
gcttagcagatgcaaactatgata

SEQ ID NO: 17463 - DNA, 21 bp, Artificial sequence
  Forward Primer
tatcagtgaggttgctccaga

SEQ ID NO: 17464 - DNA, 19 bp, Artificial sequence
  Forward Primer
ctttaggatgggcatctca

SEQ ID NO: 17465 - DNA, 19 bp, Artificial sequence
  Forward Primer
attgcctccttttccttcc

SEQ ID NO: 17466 - DNA, 25 bp, Artificial sequence
  Forward Primer
ttcccatctgtcttatatctacaag

SEQ ID NO: 17467 - DNA, 26 bp, Artificial sequence
  Forward Primer
atattaagatcatggatgttgagagc

SEQ ID NO: 17468 - DNA, 26 bp, Artificial sequence
  Forward Primer
tcaaagaacaaaatttgaacttacag

SEQ ID NO: 17469 - DNA, 22 bp, Artificial sequence
  Forward Primer
ataaatttcagctctgtctccg

SEQ ID NO: 17470 - DNA, 19 bp, Artificial sequence
  Forward Primer
cgaagattcgcttgaaaac

SEQ ID NO: 17471 - DNA, 27 bp, Artificial sequence
  Forward Primer
aatctatcattttctgttagagtagcc

SEQ ID NO: 17472 - DNA, 25 bp, Artificial sequence
  Forward Primer
attcaattttcctatcataagcaga

SEQ ID NO: 17473 - DNA, 23 bp, Artificial sequence
  Forward Primer
ttcacagttttcctgattctttg

SEQ ID NO: 17474 - DNA, 24 bp, Artificial sequence
  Forward Primer
ttattttaaacatttctgcagggt

SEQ ID NO: 17475 - DNA, 27 bp, Artificial sequence
  Forward Primer
aaaagaaatatatatgcttctagggac

SEQ ID NO: 17476 - DNA, 21 bp, Artificial sequence
  Forward Primer
agctacacaagttttttggcg

SEQ ID NO: 17477 - DNA, 20 bp, Artificial sequence
  Forward Primer
atgctgtatggagagacccc

SEQ ID NO: 17478 - DNA, 19 bp, Artificial sequence
  Forward Primer
acrgttcagaagcagcctc

SEQ ID NO: 17479 - DNA, 22 bp, Artificial sequence
  Forward Primer
tagttaatcgtgtgggacatgg

SEQ ID NO: 17480 - DNA, 23 bp, Artificial sequence
  Forward Primer
atcagtgttagatgcaggaacag

SEQ ID NO: 17481 - DNA, 20 bp, Artificial sequence
  Forward Primer
atggcatggaaatcatgttg

SEQ ID NO: 17482 - DNA, 26 bp, Artificial sequence
  Forward Primer
taaaagaacctagtcacatgaaaagg

SEQ ID NO: 17483 - DNA, 27 bp, Artificial sequence
  Forward Primer
tataaacagggtagaaaaaatacaccc

SEQ ID NO: 17484 - DNA, 28 bp, Artificial sequence
  Forward Primer
atatatactgaaacaagctgaacaaaat

SEQ ID NO: 17485 - DNA, 25 bp, Artificial sequence
  Forward Primer
ctgtaatctactcatccctgactca

SEQ ID NO: 17486 - DNA, 22 bp, Artificial sequence
  Forward Primer
attttgcttaaacacacctggt

SEQ ID NO: 17487 - DNA, 26 bp, Artificial sequence
  Forward Primer
caagactgtttttcacttttgttact

SEQ ID NO: 17488 - DNA, 25 bp, Artificial sequence
  Forward Primer
tttaaaagttaaaagggatttgagc

SEQ ID NO: 17489 - DNA, 20 bp, Artificial sequence
  Forward Primer
tggaatgaacataaatcctc

SEQ ID NO: 17490 - DNA, 20 bp, Artificial sequence
  Forward Primer
aacctattctgaggggactt

SEQ ID NO: 17491 - DNA, 23 bp, Artificial sequence
  Forward Primer
gaaattttgaaaaggaaaagagt

SEQ ID NO: 17492 - DNA, 20 bp, Artificial sequence
  Forward Primer
tttcatttccaaccctcagt

SEQ ID NO: 17493 - DNA, 27 bp, Artificial sequence
  Forward Primer
attgaaacctctaaggaaatgttaatt

SEQ ID NO: 17494 - DNA, 26 bp, Artificial sequence
  Forward Primer
gttatgacatcagtttatttgagtgc

SEQ ID NO: 17495 - DNA, 20 bp, Artificial sequence
  Forward Primer
acggatcgagatctggtatt

SEQ ID NO: 17496 - DNA, 28 bp, Artificial sequence
  Forward Primer
caagcatcaaatttatttaatatctcag

SEQ ID NO: 17497 - DNA, 20 bp, Artificial sequence
  Forward Primer
gctgtgtgagaagtccattt

SEQ ID NO: 17498 - DNA, 23 bp, Artificial sequence
  Forward Primer
atgctgttgttcctaaattgttt

SEQ ID NO: 17499 - DNA, 30 bp, Artificial sequence
  Forward Primer
taagaaaatacatagggttacttgattaga

SEQ ID NO: 17500 - DNA, 20 bp, Artificial sequence
  Forward Primer
atgaaattttttcccgttat

SEQ ID NO: 17501 - DNA, 23 bp, Artificial sequence
  Forward Primer
aattgaaaaaagcataatgaggg

SEQ ID NO: 17502 - DNA, 28 bp, Artificial sequence
  Forward Primer
aaccacttttagaagtcaaaaataaaac

SEQ ID NO: 17503 - DNA, 24 bp, Artificial sequence
  Forward Primer
ccaatcacagtgcttagattttaa

SEQ ID NO: 17504 - DNA, 28 bp, Artificial sequence
  Forward Primer
ttatgttatgatgtattcctgttttttg

SEQ ID NO: 17505 - DNA, 20 bp, Artificial sequence
  Forward Primer
aaccacctcaatcataccat

SEQ ID NO: 17506 - DNA, 18 bp, Artificial sequence
  Forward Primer
tcccttggaacccactca

SEQ ID NO: 17507 - DNA, 24 bp, Artificial sequence
  Forward Primer
acaaaataaaaatccagacttctt

SEQ ID NO: 17508 - DNA, 22 bp, Artificial sequence
  Forward Primer
acacttttgttttttgagaagt

SEQ ID NO: 17509 - DNA, 19 bp, Artificial sequence
  Forward Primer
tgaggccagtgacctgtta

SEQ ID NO: 17510 - DNA, 27 bp, Artificial sequence
  Forward Primer
ttttcattgttcttctatttgttatgg

SEQ ID NO: 17511 - DNA, 23 bp, Artificial sequence
  Forward Primer
acgtagctacccaagaagacatc

SEQ ID NO: 17512 - DNA, 19 bp, Artificial sequence
  Forward Primer
aggtagagcatgcagaatg

SEQ ID NO: 17513 - DNA, 23 bp, Artificial sequence
  Forward Primer
tgatacttccactttaggctttt

SEQ ID NO: 17514 - DNA, 21 bp, Artificial sequence
  Forward Primer
aaatggaatttgcttgaggaa

SEQ ID NO: 17515 - DNA, 25 bp, Artificial sequence
  Forward Primer
tcaaatctctctgttcttctgtttc

SEQ ID NO: 17516 - DNA, 22 bp, Artificial sequence
  Forward Primer
gaagcgtttgttattttcatcc

SEQ ID NO: 17517 - DNA, 23 bp, Artificial sequence
  Forward Primer
aggccaactaaaagaaactgatt

SEQ ID NO: 17518 - DNA, 25 bp, Artificial sequence
  Forward Primer
taaataacaagctagacagctggtg

SEQ ID NO: 17519 - DNA, 21 bp, Artificial sequence
  Forward Primer
atctggaaagtgggattatgg

SEQ ID NO: 17520 - DNA, 20 bp, Artificial sequence
  Forward Primer
tttttcttggcagatggatg

SEQ ID NO: 17521 - DNA, 18 bp, Artificial sequence
  Forward Primer
agcttcctgccacgttct

SEQ ID NO: 17522 - DNA, 23 bp, Artificial sequence
  Forward Primer
aaatgtttccacttttcgttttt

SEQ ID NO: 17523 - DNA, 20 bp, Artificial sequence
  Forward Primer
tgtgattcttcaacaggtgc

SEQ ID NO: 17524 - DNA, 27 bp, Artificial sequence
  Forward Primer
tatttcttaccttgttcgtacattttc

SEQ ID NO: 17525 - DNA, 20 bp, Artificial sequence
  Forward Primer
atagtgactctgsgttcctg

SEQ ID NO: 17526 - DNA, 30 bp, Artificial sequence
  Forward Primer
gtatgtatcacacttcaataaaaatttacc

SEQ ID NO: 17527 - DNA, 24 bp, Artificial sequence
  Forward Primer
ttgaattttctagaaggacagaaa

SEQ ID NO: 17528 - DNA, 22 bp, Artificial sequence
  Forward Primer
atctgctaaagaccaccaagaa

SEQ ID NO: 17529 - DNA, 21 bp, Artificial sequence
  Forward Primer
tattgtgaaagctgcttcagg

SEQ ID NO: 17530 - DNA, 26 bp, Artificial sequence
  Forward Primer
aaatttatttcctgtaattacgtggt

SEQ ID NO: 17531 - DNA, 20 bp, Artificial sequence
  Forward Primer
attcccattactcagcaccc

SEQ ID NO: 17532 - DNA, 20 bp, Artificial sequence
  Forward Primer
tatactggtggcctgaacct

SEQ ID NO: 17533 - DNA, 24 bp, Artificial sequence
  Forward Primer
ggtaatttgttggtgattcttttg

SEQ ID NO: 17534 - DNA, 28 bp, Artificial sequence
  Forward Primer
ataaattgaatcagctatatggatacat

SEQ ID NO: 17535 - DNA, 25 bp, Artificial sequence
  Forward Primer
attttcaaaagttctattctccctc

SEQ ID NO: 17536 - DNA, 20 bp, Artificial sequence
  Forward Primer
tctggrgcaatttctcagag

SEQ ID NO: 17537 - DNA, 28 bp, Artificial sequence
  Forward Primer
aactaactacggataactacgttagctt

SEQ ID NO: 17538 - DNA, 28 bp, Artificial sequence
  Forward Primer
taataaaaattcatctcaatcaagacac

SEQ ID NO: 17539 - DNA, 27 bp, Artificial sequence
  Forward Primer
aattatgtgtataagaaggatgaggag

SEQ ID NO: 17540 - DNA, 19 bp, Artificial sequence
  Forward Primer
tcacaccagagaggtgaaa

SEQ ID NO: 17541 - DNA, 19 bp, Artificial sequence
  Forward Primer
acgacactactgatgagcc

SEQ ID NO: 17542 - DNA, 22 bp, Artificial sequence
  Forward Primer
taagactaaccggctasagcaa

SEQ ID NO: 17543 - DNA, 24 bp, Artificial sequence
  Forward Primer
aaaagttaatcggcttaaagtgtg

SEQ ID NO: 17544 - DNA, 20 bp, Artificial sequence
  Forward Primer
gccctactaccagattcaac

SEQ ID NO: 17545 - DNA, 28 bp, Artificial sequence
  Forward Primer
agttaattctttatacagacctttgtcg

SEQ ID NO: 17546 - DNA, 19 bp, Artificial sequence
  Forward Primer
agaccagtttgggagaaaa

SEQ ID NO: 17547 - DNA, 24 bp, Artificial sequence
  Forward Primer
accatcctatatccaggtcttctt

SEQ ID NO: 17548 - DNA, 23 bp, Artificial sequence
  Forward Primer
ttcaacaaaaacaagttcacatg

SEQ ID NO: 17549 - DNA, 20 bp, Artificial sequence
  Forward Primer
gctgaatgaggactgaagcc

SEQ ID NO: 17550 - DNA, 22 bp, Artificial sequence
  Forward Primer
ctgcattaggagctcagagtct

SEQ ID NO: 17551 - DNA, 22 bp, Artificial sequence
  Forward Primer
aaacagaactgttttcaagacc

SEQ ID NO: 17552 - DNA, 22 bp, Artificial sequence
  Forward Primer
atgattgtctctcaccttacca

SEQ ID NO: 17553 - DNA, 25 bp, Artificial sequence
  Forward Primer
aattctgtagagcaattatccttca

SEQ ID NO: 17554 - DNA, 22 bp, Artificial sequence
  Forward Primer
taaatgggatgatgagttcaac

SEQ ID NO: 17555 - DNA, 25 bp, Artificial sequence
  Forward Primer
tttcctgactctcttatatcagttt

SEQ ID NO: 17556 - DNA, 25 bp, Artificial sequence
  Forward Primer
ataaaatgtgactgtacacatgcac

SEQ ID NO: 17557 - DNA, 21 bp, Artificial sequence
  Forward Primer
aaacagaagggagacgtttca

SEQ ID NO: 17558 - DNA, 24 bp, Artificial sequence
  Forward Primer
agagactctgattttctacacact

SEQ ID NO: 17559 - DNA, 21 bp, Artificial sequence
  Forward Primer
ataatggttaccaggtttagc

SEQ ID NO: 17560 - DNA, 25 bp, Artificial sequence
  Forward Primer
aacaaacttatggttgctaaaagag

SEQ ID NO: 17561 - DNA, 29 bp, Artificial sequence
  Forward Primer
taagttctaatgtttaaggttagatagag

SEQ ID NO: 17562 - DNA, 20 bp, Artificial sequence
  Forward Primer
atcgcagttccagtttcttt

SEQ ID NO: 17563 - DNA, 23 bp, Artificial sequence
  Forward Primer
aaaagcattttacagatttttcc

SEQ ID NO: 17564 - DNA, 30 bp, Artificial sequence
  Forward Primer
atagtaagtattttagttactcttctacct

SEQ ID NO: 17565 - DNA, 29 bp, Artificial sequence
  Forward Primer
aaacctactaagtttataaacagtttcct

SEQ ID NO: 17566 - DNA, 22 bp, Artificial sequence
  Forward Primer
aaaagtatgcctcctgactaca

SEQ ID NO: 17567 - DNA, 28 bp, Artificial sequence
  Forward Primer
attattatttaatattcaccaagcaacc

SEQ ID NO: 17568 - DNA, 18 bp, Artificial sequence
  Forward Primer
aaaacaggctgactgggg

SEQ ID NO: 17569 - DNA, 19 bp, Artificial sequence
  Forward Primer
aacagacccctcagcaaag

SEQ ID NO: 17570 - DNA, 22 bp, Artificial sequence
  Forward Primer
tgcagctaagcagtaaagatga

SEQ ID NO: 17571 - DNA, 19 bp, Artificial sequence
  Forward Primer
atttataaacaggccccca

SEQ ID NO: 17572 - DNA, 22 bp, Artificial sequence
  Forward Primer
aaatgtgggcagtaactgtttc

SEQ ID NO: 17573 - DNA, 21 bp, Artificial sequence
  Forward Primer
ttttgtagttccacgccataa

SEQ ID NO: 17574 - DNA, 21 bp, Artificial sequence
  Forward Primer
aaaaagaaaaggcaggttgaa

SEQ ID NO: 17575 - DNA, 24 bp, Artificial sequence
  Forward Primer
tcaaaataaagtgagaatgtaaag

SEQ ID NO: 17576 - DNA, 27 bp, Artificial sequence
  Forward Primer
tatctacccaaagaaaaaaatgagtaa

SEQ ID NO: 17577 - DNA, 30 bp, Artificial sequence
  Forward Primer
tttaacacctattacttcaaaatacactaa

SEQ ID NO: 17578 - DNA, 30 bp, Artificial sequence
  Forward Primer
tctgtacagtatatrcttgtagcttattta

SEQ ID NO: 17579 - DNA, 23 bp, Artificial sequence
  Forward Primer
tagataacactgaaactcagcag

SEQ ID NO: 17580 - DNA, 20 bp, Artificial sequence
  Forward Primer
agcatggaatcaataaatgt

SEQ ID NO: 17581 - DNA, 27 bp, Artificial sequence
  Forward Primer
cagtagtttaactatacagactgcttt

SEQ ID NO: 17582 - DNA, 19 bp, Artificial sequence
  Forward Primer
tggctggggacttaagatc

SEQ ID NO: 17583 - DNA, 23 bp, Artificial sequence
  Forward Primer
taaatgcttaatscaagtctcca

SEQ ID NO: 17584 - DNA, 29 bp, Artificial sequence
  Forward Primer
atcttaaaccagttaagtatcaaaggtaa

SEQ ID NO: 17585 - DNA, 29 bp, Artificial sequence
  Forward Primer
ttaccaacatatacaagtgtaagtttcat

SEQ ID NO: 17586 - DNA, 27 bp, Artificial sequence
  Forward Primer
tttctctatcctacaatgacattaaaa

SEQ ID NO: 17587 - DNA, 22 bp, Artificial sequence
  Forward Primer
atttcacagcctcttgatcaga

SEQ ID NO: 17588 - DNA, 26 bp, Artificial sequence
  Forward Primer
tattttctcyagattcttagcacctt

SEQ ID NO: 17589 - DNA, 20 bp, Artificial sequence
  Forward Primer
aaaggaatgatttcagggag

SEQ ID NO: 17590 - DNA, 19 bp, Artificial sequence
  Forward Primer
tgaccacctgaagggaaat

SEQ ID NO: 17591 - DNA, 20 bp, Artificial sequence
  Forward Primer
tgaatctgggaaggtggtta

SEQ ID NO: 17592 - DNA, 22 bp, Artificial sequence
  Forward Primer
aaaacagatacagtgyggatgc

SEQ ID NO: 17593 - DNA, 27 bp, Artificial sequence
  Forward Primer
cccttactttgattgtatttttcttta

SEQ ID NO: 17594 - DNA, 21 bp, Artificial sequence
  Forward Primer
acaggctggtgttcagtaaac

SEQ ID NO: 17595 - DNA, 18 bp, Artificial sequence
  Forward Primer
atcccctccagcctccta

SEQ ID NO: 17596 - DNA, 30 bp, Artificial sequence
  Forward Primer
aaataatcactgctttatgtaatcaagtac

SEQ ID NO: 17597 - DNA, 24 bp, Artificial sequence
  Forward Primer
tgttaatttcaggcttaagaaaaa

SEQ ID NO: 17598 - DNA, 19 bp, Artificial sequence
  Forward Primer
aactgctstcctctgtgtc

SEQ ID NO: 17599 - DNA, 26 bp, Artificial sequence
  Forward Primer
ctgtttcttatttcagttctaaaaga

SEQ ID NO: 17600 - DNA, 23 bp, Artificial sequence
  Forward Primer
aatataagcagatggctgtgatg

SEQ ID NO: 17601 - DNA, 23 bp, Artificial sequence
  Forward Primer
attttatacgacttccccatcat

SEQ ID NO: 17602 - DNA, 28 bp, Artificial sequence
  Forward Primer
gtttaaacatttttctcctcttagaaaa

SEQ ID NO: 17603 - DNA, 22 bp, Artificial sequence
  Forward Primer
ttgattaagtttcattgcatgc

SEQ ID NO: 17604 - DNA, 26 bp, Artificial sequence
  Forward Primer
atttaataaaccaactctgtgatgtg

SEQ ID NO: 17605 - DNA, 24 bp, Artificial sequence
  Forward Primer
ttataaaacctggtctcaaggtct

SEQ ID NO: 17606 - DNA, 25 bp, Artificial sequence
  Forward Primer
aagccttatctcrtaggtatttaaa

SEQ ID NO: 17607 - DNA, 30 bp, Artificial sequence
  Forward Primer
agtatgtataaaatatagctattgcacaga

SEQ ID NO: 17608 - DNA, 21 bp, Artificial sequence
  Forward Primer
aaatagtgtggagagtggggt

SEQ ID NO: 17609 - DNA, 25 bp, Artificial sequence
  Forward Primer
tgtcatattcaaagcatcttaattg

SEQ ID NO: 17610 - DNA, 24 bp, Artificial sequence
  Forward Primer
ttcaccagagcatattaagatcat

SEQ ID NO: 17611 - DNA, 18 bp, Artificial sequence
  Forward Primer
acggatgaaggcaggtct

SEQ ID NO: 17612 - DNA, 20 bp, Artificial sequence
  Forward Primer
aaagtggagcaaagagcagg

SEQ ID NO: 17613 - DNA, 30 bp, Artificial sequence
  Forward Primer
aagagttagttctagttagcattctttttc

SEQ ID NO: 17614 - DNA, 25 bp, Artificial sequence
  Forward Primer
tattaaagagawagagagagcagaa

SEQ ID NO: 17615 - DNA, 23 bp, Artificial sequence
  Forward Primer
ataattcccaccatgtaacatca

SEQ ID NO: 17616 - DNA, 21 bp, Artificial sequence
  Forward Primer
tttctgagaggcaggaatagg

SEQ ID NO: 17617 - DNA, 22 bp, Artificial sequence
  Forward Primer
acttagctccatgaaaactgtg

SEQ ID NO: 17618 - DNA, 20 bp, Artificial sequence
  Forward Primer
aaaaacacatcttgcccaga

SEQ ID NO: 17619 - DNA, 18 bp, Artificial sequence
  Forward Primer
tttggacgtgctactgcc

SEQ ID NO: 17620 - DNA, 20 bp, Artificial sequence
  Forward Primer
aaggcacatttccttaagca

SEQ ID NO: 17621 - DNA, 25 bp, Artificial sequence
  Forward Primer
aagtatgactcagaatggactgaga

SEQ ID NO: 17622 - DNA, 18 bp, Artificial sequence
  Forward Primer
aagtgcccactggatgcc

SEQ ID NO: 17623 - DNA, 20 bp, Artificial sequence
  Forward Primer
tctcctggttttgaccagtc

SEQ ID NO: 17624 - DNA, 27 bp, Artificial sequence
  Forward Primer
aacatatttacattaaatgtgaggctc

SEQ ID NO: 17625 - DNA, 18 bp, Artificial sequence
  Forward Primer
atgcctcckacattggca

SEQ ID NO: 17626 - DNA, 18 bp, Artificial sequence
  Forward Primer
taactttgccccagggac

SEQ ID NO: 17627 - DNA, 23 bp, Artificial sequence
  Forward Primer
atacttccactttaggcttttgc

SEQ ID NO: 17628 - DNA, 19 bp, Artificial sequence
  Forward Primer
catgagatccatgagacct

SEQ ID NO: 17629 - DNA, 22 bp, Artificial sequence
  Forward Primer
tggaaggatagagagaagcaaa

SEQ ID NO: 17630 - DNA, 19 bp, Artificial sequence
  Forward Primer
agaggagtcagcagaagcg

SEQ ID NO: 17631 - DNA, 22 bp, Artificial sequence
  Forward Primer
gaaataaaccactttgtcccct

SEQ ID NO: 17632 - DNA, 23 bp, Artificial sequence
  Forward Primer
ttcatgatcattgaatcaaattg

SEQ ID NO: 17633 - DNA, 20 bp, Artificial sequence
  Forward Primer
tggttaatggggaacgttta

SEQ ID NO: 17634 - DNA, 20 bp, Artificial sequence
  Forward Primer
cgtaccacatgatgctgaca

SEQ ID NO: 17635 - DNA, 23 bp, Artificial sequence
  Forward Primer
tcagtttggttcgttattagact

SEQ ID NO: 17636 - DNA, 29 bp, Artificial sequence
  Forward Primer
tatagtcagtcaacaagttaagcactaag

SEQ ID NO: 17637 - DNA, 24 bp, Artificial sequence
  Forward Primer
aatacaaccctgattcatgctaat

SEQ ID NO: 17638 - DNA, 19 bp, Artificial sequence
  Forward Primer
tgaatgtggatcaatggca

SEQ ID NO: 17639 - DNA, 18 bp, Artificial sequence
  Forward Primer
aaccaaccgtccaggggc

SEQ ID NO: 17640 - DNA, 25 bp, Artificial sequence
  Forward Primer
aattatttgtgggtattgacagatt

SEQ ID NO: 17641 - DNA, 25 bp, Artificial sequence
  Forward Primer
aattcctagtaaactttaagcctgg

SEQ ID NO: 17642 - DNA, 23 bp, Artificial sequence
  Forward Primer
ataaggttttaagactgaaatgg

SEQ ID NO: 17643 - DNA, 24 bp, Artificial sequence
  Forward Primer
atttcacggatatgacagtaaaag

SEQ ID NO: 17644 - DNA, 29 bp, Artificial sequence
  Forward Primer
agtttatrtagattacctaagatgctaaa

SEQ ID NO: 17645 - DNA, 19 bp, Artificial sequence
  Forward Primer
tgagaagacccaggaaccc

SEQ ID NO: 17646 - DNA, 30 bp, Artificial sequence
  Forward Primer
ccaataatatgagaatgactaataatacta

SEQ ID NO: 17647 - DNA, 23 bp, Artificial sequence
  Forward Primer
ttaaagagctgaatcttcttggg

SEQ ID NO: 17648 - DNA, 20 bp, Artificial sequence
  Forward Primer
tcagagtgcaaacaccttcc

SEQ ID NO: 17649 - DNA, 19 bp, Artificial sequence
  Forward Primer
cagagtggagagaagcagg

SEQ ID NO: 17650 - DNA, 23 bp, Artificial sequence
  Forward Primer
cagaagaattttcagagaaacta

SEQ ID NO: 17651 - DNA, 25 bp, Artificial sequence
  Forward Primer
aatcttgaaaacactgctatgaaag

SEQ ID NO: 17652 - DNA, 20 bp, Artificial sequence
  Forward Primer
ttgttcattcatgcatccaa

SEQ ID NO: 17653 - DNA, 27 bp, Artificial sequence
  Forward Primer
ataagccacaactaattatcttaacca

SEQ ID NO: 17654 - DNA, 21 bp, Artificial sequence
  Forward Primer
aaaatcccacatcccagtaaa

SEQ ID NO: 17655 - DNA, 27 bp, Artificial sequence
  Forward Primer
attgacttaccatctcttagagttctg

SEQ ID NO: 17656 - DNA, 19 bp, Artificial sequence
  Forward Primer
atgacaccactgagctccg

SEQ ID NO: 17657 - DNA, 22 bp, Artificial sequence
  Forward Primer
aactgagatcccagaagctaca

SEQ ID NO: 17658 - DNA, 28 bp, Artificial sequence
  Forward Primer
aaaacatccagagactatttaatttagg

SEQ ID NO: 17659 - DNA, 19 bp, Artificial sequence
  Forward Primer
aagaaattcccagagggga

SEQ ID NO: 17660 - DNA, 21 bp, Artificial sequence
  Forward Primer
tttcgtttattcgctgagacc

SEQ ID NO: 17661 - DNA, 26 bp, Artificial sequence
  Forward Primer
attaaactgttccaaaagctattttg

SEQ ID NO: 17662 - DNA, 21 bp, Artificial sequence
  Forward Primer
tttgattctgcctcacaaaac

SEQ ID NO: 17663 - DNA, 21 bp, Artificial sequence
  Forward Primer
aagtttctaacagcagggcat

SEQ ID NO: 17664 - DNA, 20 bp, Artificial sequence
  Forward Primer
gagaagatagccacctacaa

SEQ ID NO: 17665 - DNA, 23 bp, Artificial sequence
  Forward Primer
tttaggtttctccaccattgtta

SEQ ID NO: 17666 - DNA, 25 bp, Artificial sequence
  Forward Primer
taaaacatgttatctcatgcactga

SEQ ID NO: 17667 - DNA, 23 bp, Artificial sequence
  Forward Primer
agattcagagttgcctcaaattt

SEQ ID NO: 17668 - DNA, 19 bp, Artificial sequence
  Forward Primer
aagctagggccttctcagc

SEQ ID NO: 17669 - DNA, 25 bp, Artificial sequence
  Forward Primer
agaattctttctgaactaatttagc

SEQ ID NO: 17670 - DNA, 25 bp, Artificial sequence
  Forward Primer
tatttttggttctggattatttgac

SEQ ID NO: 17671 - DNA, 29 bp, Artificial sequence
  Forward Primer
ttccagatcttagtaactgtaagaaagtc

SEQ ID NO: 17672 - DNA, 19 bp, Artificial sequence
  Forward Primer
atgtgcaaacacagacagg

SEQ ID NO: 17673 - DNA, 29 bp, Artificial sequence
  Forward Primer
acatatgaaagaaatacactcttaaaagg

SEQ ID NO: 17674 - DNA, 24 bp, Artificial sequence
  Forward Primer
taagtttcatcatggaaagagtca

SEQ ID NO: 17675 - DNA, 18 bp, Artificial sequence
  Forward Primer
ggagccctgtgagcaagc

SEQ ID NO: 17676 - DNA, 20 bp, Artificial sequence
  Forward Primer
atgcagaaaacaaacagctc

SEQ ID NO: 17677 - DNA, 23 bp, Artificial sequence
  Forward Primer
atctgaaattctcagaatggagc

SEQ ID NO: 17678 - DNA, 18 bp, Artificial sequence
  Forward Primer
gctctggagcgtaggacg

SEQ ID NO: 17679 - DNA, 24 bp, Artificial sequence
  Forward Primer
ttatgaagtctatgtgctcctgag

SEQ ID NO: 17680 - DNA, 21 bp, Artificial sequence
  Forward Primer
acatgtctgactccaaactgg

SEQ ID NO: 17681 - DNA, 27 bp, Artificial sequence
  Forward Primer
ctctaattaatgattttttggaacttg

SEQ ID NO: 17682 - DNA, 18 bp, Artificial sequence
  Forward Primer
ttcttgaaagcgcctgca

SEQ ID NO: 17683 - DNA, 22 bp, Artificial sequence
  Forward Primer
aacaatggamcttttgcctaac

SEQ ID NO: 17684 - DNA, 26 bp, Artificial sequence
  Forward Primer
tttaagatcttatttccaaaatcagg

SEQ ID NO: 17685 - DNA, 30 bp, Artificial sequence
  Forward Primer
atattcactattgtaaggtatacmaaacta

SEQ ID NO: 17686 - DNA, 20 bp, Artificial sequence
  Forward Primer
tacacctcaccctgtctcac

SEQ ID NO: 17687 - DNA, 21 bp, Artificial sequence
  Forward Primer
taaatgatggaaactgggatg

SEQ ID NO: 17688 - DNA, 23 bp, Artificial sequence
  Forward Primer
agtgtacacacagacctcacctg

SEQ ID NO: 17689 - DNA, 23 bp, Artificial sequence
  Forward Primer
aaacattagcctgagaaccattt

SEQ ID NO: 17690 - DNA, 20 bp, Artificial sequence
  Forward Primer
agtttcccctactttcggaa

SEQ ID NO: 17691 - DNA, 24 bp, Artificial sequence
  Forward Primer
aactgttttctcaaaaggaatctg

SEQ ID NO: 17692 - DNA, 18 bp, Artificial sequence
  Forward Primer
attgggacagaggcggcg

SEQ ID NO: 17693 - DNA, 26 bp, Artificial sequence
  Forward Primer
attatggttctccatatctttattct

SEQ ID NO: 17694 - DNA, 27 bp, Artificial sequence
  Forward Primer
attaaagctgttatccttagaggaact

SEQ ID NO: 17695 - DNA, 25 bp, Artificial sequence
  Forward Primer
attacctttgagatcagatttgcta

SEQ ID NO: 17696 - DNA, 21 bp, Artificial sequence
  Forward Primer
cgcttaatttctctgggtctt

SEQ ID NO: 17697 - DNA, 20 bp, Artificial sequence
  Forward Primer
aagtggatgaagtgttcggt

SEQ ID NO: 17698 - DNA, 28 bp, Artificial sequence
  Forward Primer
agacactgaaatgtctttttcttttatt

SEQ ID NO: 17699 - DNA, 23 bp, Artificial sequence
  Forward Primer
tcctggtgcctactcagtaaata

SEQ ID NO: 17700 - DNA, 21 bp, Artificial sequence
  Forward Primer
atcgctttgttgtacagctga

SEQ ID NO: 17701 - DNA, 18 bp, Artificial sequence
  Forward Primer
tggacgacgagctggagg

SEQ ID NO: 17702 - DNA, 27 bp, Artificial sequence
  Forward Primer
agattttaaaagtctctatggaacacc

SEQ ID NO: 17703 - DNA, 18 bp, Artificial sequence
  Forward Primer
cctttgctgcttcggaaa

SEQ ID NO: 17704 - DNA, 19 bp, Artificial sequence
  Forward Primer
ccgacacgctatttcttac

SEQ ID NO: 17705 - DNA, 26 bp, Artificial sequence
  Forward Primer
aataattttgatcaactttagcaagc

SEQ ID NO: 17706 - DNA, 22 bp, Artificial sequence
  Forward Primer
ccatctgttatgaactaccaag

SEQ ID NO: 17707 - DNA, 28 bp, Artificial sequence
  Forward Primer
ttatgcctatagtgttactgctttaatt

SEQ ID NO: 17708 - DNA, 21 bp, Artificial sequence
  Forward Primer
tcttgaatggggaagagaaga

SEQ ID NO: 17709 - DNA, 25 bp, Artificial sequence
  Forward Primer
taatcctctcactgatgtttcaatc

SEQ ID NO: 17710 - DNA, 25 bp, Artificial sequence
  Forward Primer
tttgcttcacttctcttcaattatt

SEQ ID NO: 17711 - DNA, 25 bp, Artificial sequence
  Forward Primer
attgacgtattcagggtaaagttaa

SEQ ID NO: 17712 - DNA, 21 bp, Artificial sequence
  Forward Primer
atgcatgacaaaaaagtcagg

SEQ ID NO: 17713 - DNA, 23 bp, Artificial sequence
  Forward Primer
tgtcctttcaggtttgtaaaaga

SEQ ID NO: 17714 - DNA, 24 bp, Artificial sequence
  Forward Primer
catctgatggttaatgacattctc

SEQ ID NO: 17715 - DNA, 23 bp, Artificial sequence
  Forward Primer
tttttttgatgctctcagttttc

SEQ ID NO: 17716 - DNA, 18 bp, Artificial sequence
  Forward Primer
ctgaggagtgggaacacc

SEQ ID NO: 17717 - DNA, 28 bp, Artificial sequence
  Forward Primer
taggaattatgtattatgaaaagtttcg

SEQ ID NO: 17718 - DNA, 24 bp, Artificial sequence
  Forward Primer
tgagtcaagatgaaaacagagtgt

SEQ ID NO: 17719 - DNA, 18 bp, Artificial sequence
  Forward Primer
ttaagaggggcctctgct

SEQ ID NO: 17720 - DNA, 24 bp, Artificial sequence
  Forward Primer
aagggacaactgtactagtatctc

SEQ ID NO: 17721 - DNA, 24 bp, Artificial sequence
  Forward Primer
aatatggctatttacgtctcctgt

SEQ ID NO: 17722 - DNA, 18 bp, Artificial sequence
  Forward Primer
tggtcttctctgggatcg

SEQ ID NO: 17723 - DNA, 30 bp, Artificial sequence
  Forward Primer
taaaattgctaagagagctagagataaata

SEQ ID NO: 17724 - DNA, 26 bp, Artificial sequence
  Forward Primer
tatgtttgtaacaacacaaaatgagg

SEQ ID NO: 17725 - DNA, 25 bp, Artificial sequence
  Forward Primer
ttttccctattacgtaccatgtaac

SEQ ID NO: 17726 - DNA, 23 bp, Artificial sequence
  Forward Primer
acagagaagcagcatctgataac

SEQ ID NO: 17727 - DNA, 18 bp, Artificial sequence
  Forward Primer
acgcctcacagaccacaa

SEQ ID NO: 17728 - DNA, 19 bp, Artificial sequence
  Forward Primer
ttgggggagccccggctta

SEQ ID NO: 17729 - DNA, 23 bp, Artificial sequence
  Forward Primer
aaatacaaaacctctcaccatga

SEQ ID NO: 17730 - DNA, 30 bp, Artificial sequence
  Forward Primer
ttcagatgttagtayatatcaaataagtgt

SEQ ID NO: 17731 - DNA, 23 bp, Artificial sequence
  Forward Primer
cctccattaaataatcttcatca

SEQ ID NO: 17732 - DNA, 19 bp, Artificial sequence
  Forward Primer
tggaaaatgttggagctgg

SEQ ID NO: 17733 - DNA, 19 bp, Artificial sequence
  Forward Primer
aaaatgacatggcagcctt

SEQ ID NO: 17734 - DNA, 30 bp, Artificial sequence
  Forward Primer
aattctcatttcttagtatgacaaatacag

SEQ ID NO: 17735 - DNA, 26 bp, Artificial sequence
  Forward Primer
taaaacaaacctaaatatgcctagtg

SEQ ID NO: 17736 - DNA, 20 bp, Artificial sequence
  Forward Primer
aagaacatggtgctttccat

SEQ ID NO: 17737 - DNA, 19 bp, Artificial sequence
  Forward Primer
ctgccccatgatctagaga

SEQ ID NO: 17738 - DNA, 24 bp, Artificial sequence
  Forward Primer
tgttattcatcccaaatctttttt

SEQ ID NO: 17739 - DNA, 24 bp, Artificial sequence
  Forward Primer
aagttaggtgggaaagaaaaattt

SEQ ID NO: 17740 - DNA, 26 bp, Artificial sequence
  Forward Primer
attaaatgctttctcagattttatgg

SEQ ID NO: 17741 - DNA, 21 bp, Artificial sequence
  Forward Primer
atttggcagaggatcaaaagt

SEQ ID NO: 17742 - DNA, 24 bp, Artificial sequence
  Forward Primer
aaattactctgtgtgrtcttggaa

SEQ ID NO: 17743 - DNA, 19 bp, Artificial sequence
  Forward Primer
acagggaytaggtcgtgcc

SEQ ID NO: 17744 - DNA, 19 bp, Artificial sequence
  Forward Primer
ttcaggttgctatgctatg

SEQ ID NO: 17745 - DNA, 21 bp, Artificial sequence
  Forward Primer
actggcagatctttgaggatg

SEQ ID NO: 17746 - DNA, 27 bp, Artificial sequence
  Forward Primer
ctggtaataaaatcttcattctgtttt

SEQ ID NO: 17747 - DNA, 21 bp, Artificial sequence
  Forward Primer
taggggtgagtctggagtagg

SEQ ID NO: 17748 - DNA, 18 bp, Artificial sequence
  Forward Primer
ctggcggtcaatgaggtg

SEQ ID NO: 17749 - DNA, 18 bp, Artificial sequence
  Forward Primer
acgtacgcgacgccttaa

SEQ ID NO: 17750 - DNA, 18 bp, Artificial sequence
  Forward Primer
gaacacagccttgagccc

SEQ ID NO: 17751 - DNA, 19 bp, Artificial sequence
  Forward Primer
gtcctggagtgtcagagag

SEQ ID NO: 17752 - DNA, 23 bp, Artificial sequence
  Forward Primer
aaataacagtttgagggcagagt

SEQ ID NO: 17753 - DNA, 30 bp, Artificial sequence
  Forward Primer
ttgtattgaagagttgacataaattatagc

SEQ ID NO: 17754 - DNA, 22 bp, Artificial sequence
  Forward Primer
gcaaatatgacctagagagctt

SEQ ID NO: 17755 - DNA, 27 bp, Artificial sequence
  Forward Primer
atatatccagtaatgtttatccaacca

SEQ ID NO: 17756 - DNA, 29 bp, Artificial sequence
  Forward Primer
tagtttggcttagagatatttttttaacc

SEQ ID NO: 17757 - DNA, 25 bp, Artificial sequence
  Forward Primer
tttcctactgttccttgtattgaac

SEQ ID NO: 17758 - DNA, 24 bp, Artificial sequence
  Forward Primer
tatttctttaatttgaggggaaat

SEQ ID NO: 17759 - DNA, 27 bp, Artificial sequence
  Forward Primer
ttaaactgtagacaaaacacaagaatg

SEQ ID NO: 17760 - DNA, 22 bp, Artificial sequence
  Forward Primer
ctttaactacgtccaaagattt

SEQ ID NO: 17761 - DNA, 19 bp, Artificial sequence
  Forward Primer
tgagtggacactcaccttg

SEQ ID NO: 17762 - DNA, 26 bp, Artificial sequence
  Forward Primer
tattaatcaatttttcctactcccat

SEQ ID NO: 17763 - DNA, 24 bp, Artificial sequence
  Forward Primer
tttaacaaaatgccacagactagg

SEQ ID NO: 17764 - DNA, 25 bp, Artificial sequence
  Forward Primer
atgaagagatagacatgagacaggt

SEQ ID NO: 17765 - DNA, 26 bp, Artificial sequence
  Forward Primer
aatctttataagtactagggacatct

SEQ ID NO: 17766 - DNA, 23 bp, Artificial sequence
  Forward Primer
aaaatgagtctcagagtggtgaa

SEQ ID NO: 17767 - DNA, 19 bp, Artificial sequence
  Forward Primer
caattctctctcccctcac

SEQ ID NO: 17768 - DNA, 27 bp, Artificial sequence
  Forward Primer
agaaaactgaatagcaacaaacaatat

SEQ ID NO: 17769 - DNA, 26 bp, Artificial sequence
  Forward Primer
agtggaaaatggtaagatattattac

SEQ ID NO: 17770 - DNA, 19 bp, Artificial sequence
  Forward Primer
aggttgtcaagcagaggct

SEQ ID NO: 17771 - DNA, 24 bp, Artificial sequence
  Forward Primer
taatattagccccgttttacagat

SEQ ID NO: 17772 - DNA, 27 bp, Artificial sequence
  Forward Primer
aaaaagacaaattttacacctatgtcc

SEQ ID NO: 17773 - DNA, 25 bp, Artificial sequence
  Forward Primer
atttccaagtgaaggtaggtattct

SEQ ID NO: 17774 - DNA, 23 bp, Artificial sequence
  Forward Primer
actggatacaatttcctgtaact

SEQ ID NO: 17775 - DNA, 19 bp, Artificial sequence
  Forward Primer
ttccattgtgaacgcaagt

SEQ ID NO: 17776 - DNA, 26 bp, Artificial sequence
  Forward Primer
atgaggatttgataaacctgtaattt

SEQ ID NO: 17777 - DNA, 26 bp, Artificial sequence
  Forward Primer
aatatcatttgtaaatgtgtccagtt

SEQ ID NO: 17778 - DNA, 20 bp, Artificial sequence
  Forward Primer
acgtgctcaaattaacaaat

SEQ ID NO: 17779 - DNA, 28 bp, Artificial sequence
  Forward Primer
aatggaatataaatattcagtcagaagg

SEQ ID NO: 17780 - DNA, 20 bp, Artificial sequence
  Forward Primer
ttggctacaagtagggtagg

SEQ ID NO: 17781 - DNA, 24 bp, Artificial sequence
  Forward Primer
cttcatttgataatctctaaacac

SEQ ID NO: 17782 - DNA, 21 bp, Artificial sequence
  Forward Primer
aacctttggctctcttattgc

SEQ ID NO: 17783 - DNA, 19 bp, Artificial sequence
  Forward Primer
atgccttctgcagtggtag

SEQ ID NO: 17784 - DNA, 24 bp, Artificial sequence
  Forward Primer
tgtgaatacaagtgttggaatttt

SEQ ID NO: 17785 - DNA, 22 bp, Artificial sequence
  Forward Primer
tgaattaagcaatgatgctcag

SEQ ID NO: 17786 - DNA, 23 bp, Artificial sequence
  Forward Primer
tttcackttcaccatttatgagg

SEQ ID NO: 17787 - DNA, 22 bp, Artificial sequence
  Forward Primer
tgatatgtgtacgcagttctta

SEQ ID NO: 17788 - DNA, 24 bp, Artificial sequence
  Forward Primer
tttatttttctttattgcacttgc

SEQ ID NO: 17789 - DNA, 19 bp, Artificial sequence
  Forward Primer
tgcattaaagccccttagg

SEQ ID NO: 17790 - DNA, 21 bp, Artificial sequence
  Forward Primer
aaatttctgtccccttccttt

SEQ ID NO: 17791 - DNA, 19 bp, Artificial sequence
  Forward Primer
accacaccaccctgtttta

SEQ ID NO: 17792 - DNA, 24 bp, Artificial sequence
  Forward Primer
aaaaacaataaaccaaaaaagcac

SEQ ID NO: 17793 - DNA, 25 bp, Artificial sequence
  Forward Primer
atagtgaagcaaagagagaatgaga

SEQ ID NO: 17794 - DNA, 27 bp, Artificial sequence
  Forward Primer
gggaaaaaatcagaagaataatatttg

SEQ ID NO: 17795 - DNA, 28 bp, Artificial sequence
  Forward Primer
agtgaattgagttggtatcatagtacag

SEQ ID NO: 17796 - DNA, 21 bp, Artificial sequence
  Forward Primer
aaggaagagatgtcctcttaa

SEQ ID NO: 17797 - DNA, 24 bp, Artificial sequence
  Forward Primer
aaatttgctttaatccaattcttc

SEQ ID NO: 17798 - DNA, 22 bp, Artificial sequence
  Forward Primer
aattctttctgtgctatcactg

SEQ ID NO: 17799 - DNA, 25 bp, Artificial sequence
  Forward Primer
ttacgttcaaacttagcattacagt

SEQ ID NO: 17800 - DNA, 18 bp, Artificial sequence
  Forward Primer
agcaccaggcacatagga

SEQ ID NO: 17801 - DNA, 18 bp, Artificial sequence
  Forward Primer
agggtctcgatcacgtgg

SEQ ID NO: 17802 - DNA, 27 bp, Artificial sequence
  Forward Primer
acagtgaaataaaacatatagcttaac

SEQ ID NO: 17803 - DNA, 26 bp, Artificial sequence
  Forward Primer
tattttataagtgaggaaatggtgac

SEQ ID NO: 17804 - DNA, 25 bp, Artificial sequence
  Forward Primer
cctatttaacaaacaatagggatat

SEQ ID NO: 17805 - DNA, 20 bp, Artificial sequence
  Forward Primer
acagaggaggtcaaggaatt

SEQ ID NO: 17806 - DNA, 20 bp, Artificial sequence
  Forward Primer
atcaactacccaactgtccc

SEQ ID NO: 17807 - DNA, 22 bp, Artificial sequence
  Forward Primer
aaaattggaatgagctgtgaag

SEQ ID NO: 17808 - DNA, 23 bp, Artificial sequence
  Forward Primer
ttgtttattacagcagcaacaga

SEQ ID NO: 17809 - DNA, 20 bp, Artificial sequence
  Forward Primer
taattgaaaaggattggcca

SEQ ID NO: 17810 - DNA, 18 bp, Artificial sequence
  Forward Primer
agggaattgggggcttgg

SEQ ID NO: 17811 - DNA, 20 bp, Artificial sequence
  Forward Primer
tcatgatgaggtcgatgacc

SEQ ID NO: 17812 - DNA, 22 bp, Artificial sequence
  Forward Primer
tgccaaatgctaaggataactt

SEQ ID NO: 17813 - DNA, 23 bp, Artificial sequence
  Forward Primer
tttaggtgtggctcttgttttaa

SEQ ID NO: 17814 - DNA, 25 bp, Artificial sequence
  Forward Primer
agttatatttatggtggcacattca

SEQ ID NO: 17815 - DNA, 25 bp, Artificial sequence
  Forward Primer
tcactgaaatggagtaccatactct

SEQ ID NO: 17816 - DNA, 24 bp, Artificial sequence
  Forward Primer
ttaatcactcaggcttgatgtaaa

SEQ ID NO: 17817 - DNA, 18 bp, Artificial sequence
  Forward Primer
tgagatgcaaaggcagca

SEQ ID NO: 17818 - DNA, 19 bp, Artificial sequence
  Forward Primer
tgtaagggcacagtaacgg

SEQ ID NO: 17819 - DNA, 28 bp, Artificial sequence
  Forward Primer
gttgrtattaaaaaaccaattacagatg

SEQ ID NO: 17820 - DNA, 18 bp, Artificial sequence
  Forward Primer
tgggcatagccagcctgt

SEQ ID NO: 17821 - DNA, 29 bp, Artificial sequence
  Forward Primer
aaaaagtgagacttgtcaaagtaattatc

SEQ ID NO: 17822 - DNA, 19 bp, Artificial sequence
  Forward Primer
aaacggaggcacagagagt

SEQ ID NO: 17823 - DNA, 23 bp, Artificial sequence
  Forward Primer
atacataattcattgccaaatgg

SEQ ID NO: 17824 - DNA, 21 bp, Artificial sequence
  Forward Primer
atgtgtgagatgggtctgaac

SEQ ID NO: 17825 - DNA, 27 bp, Artificial sequence
  Forward Primer
taaataacaacatgcacataaaaagtg

SEQ ID NO: 17826 - DNA, 19 bp, Artificial sequence
  Forward Primer
aaacccctggactagcacc

SEQ ID NO: 17827 - DNA, 24 bp, Artificial sequence
  Forward Primer
tttaactctggtggttggttagtt

SEQ ID NO: 17828 - DNA, 28 bp, Artificial sequence
  Forward Primer
atagacaaaatctcttttgtatctttcc

SEQ ID NO: 17829 - DNA, 25 bp, Artificial sequence
  Forward Primer
aatgagggggactgtattattagtt

SEQ ID NO: 17830 - DNA, 20 bp, Artificial sequence
  Forward Primer
acaatgcttctgtgtccctc

SEQ ID NO: 17831 - DNA, 26 bp, Artificial sequence
  Forward Primer
ttaataatgtatttctttgccactcg

SEQ ID NO: 17832 - DNA, 28 bp, Artificial sequence
  Forward Primer
attctatattggaagttaatgaaagtca

SEQ ID NO: 17833 - DNA, 22 bp, Artificial sequence
  Forward Primer
tgcaaccttgattgtgaataca

SEQ ID NO: 17834 - DNA, 26 bp, Artificial sequence
  Forward Primer
tattttatcagagataaatgtgccaa

SEQ ID NO: 17835 - DNA, 28 bp, Artificial sequence
  Forward Primer
gagatggactaaaataagtcactctctt

SEQ ID NO: 17836 - DNA, 21 bp, Artificial sequence
  Forward Primer
attttcacagaccctgacctc

SEQ ID NO: 17837 - DNA, 23 bp, Artificial sequence
  Forward Primer
aggaggctatcattatatttgcc

SEQ ID NO: 17838 - DNA, 24 bp, Artificial sequence
  Forward Primer
ttgggttatgatttcttaatttgc

SEQ ID NO: 17839 - DNA, 29 bp, Artificial sequence
  Forward Primer
tacacgataaatagaactcagatttatga

SEQ ID NO: 17840 - DNA, 30 bp, Artificial sequence
  Forward Primer
gtatttatcaggtttctatttttcagtaca

SEQ ID NO: 17841 - DNA, 23 bp, Artificial sequence
  Forward Primer
taaaaagttaaatgccttgcaga

SEQ ID NO: 17842 - DNA, 23 bp, Artificial sequence
  Forward Primer
attgtggctttcttttgtttctt

SEQ ID NO: 17843 - DNA, 20 bp, Artificial sequence
  Forward Primer
tctacaaatctcccatggca

SEQ ID NO: 17844 - DNA, 20 bp, Artificial sequence
  Forward Primer
agggttaaaaycatcgtagc

SEQ ID NO: 17845 - DNA, 22 bp, Artificial sequence
  Forward Primer
atttgtgtgtcttggaaagctg

SEQ ID NO: 17846 - DNA, 18 bp, Artificial sequence
  Forward Primer
tatggccctttggcatga

SEQ ID NO: 17847 - DNA, 22 bp, Artificial sequence
  Forward Primer
aaccacagtcatgaagaagagg

SEQ ID NO: 17848 - DNA, 27 bp, Artificial sequence
  Forward Primer
attaatttgttacaggagcataaccta

SEQ ID NO: 17849 - DNA, 22 bp, Artificial sequence
  Forward Primer
aagaactggaatctgtgttcca

SEQ ID NO: 17850 - DNA, 27 bp, Artificial sequence
  Forward Primer
aatgaaacagaaataagtcatgttttg

SEQ ID NO: 17851 - DNA, 19 bp, Artificial sequence
  Forward Primer
tgccccgatgaagataatc

SEQ ID NO: 17852 - DNA, 18 bp, Artificial sequence
  Forward Primer
tttgcaaccccattgact

SEQ ID NO: 17853 - DNA, 24 bp, Artificial sequence
  Forward Primer
ttgctatttattgatcctactgca

SEQ ID NO: 17854 - DNA, 24 bp, Artificial sequence
  Forward Primer
tttcttgagtcttccaaggtatct

SEQ ID NO: 17855 - DNA, 18 bp, Artificial sequence
  Forward Primer
atggttcctgccatccag

SEQ ID NO: 17856 - DNA, 26 bp, Artificial sequence
  Forward Primer
attctaacatgagaactaagggtagg

SEQ ID NO: 17857 - DNA, 19 bp, Artificial sequence
  Forward Primer
agtttggcaggcaaaaatt

SEQ ID NO: 17858 - DNA, 30 bp, Artificial sequence
  Forward Primer
aagtggttcattagtacatacttrgactac

SEQ ID NO: 17859 - DNA, 19 bp, Artificial sequence
  Forward Primer
gcaggaaaaaggaagtgag

SEQ ID NO: 17860 - DNA, 23 bp, Artificial sequence
  Forward Primer
tctctgaaagaaaacacacacaa

SEQ ID NO: 17861 - DNA, 18 bp, Artificial sequence
  Forward Primer
tgcagacttggcaaccat

SEQ ID NO: 17862 - DNA, 23 bp, Artificial sequence
  Forward Primer
aaccttgtagttacatttctggt

SEQ ID NO: 17863 - DNA, 18 bp, Artificial sequence
  Forward Primer
aggacgcagatgacgaaa

SEQ ID NO: 17864 - DNA, 22 bp, Artificial sequence
  Forward Primer
atcttccctgatctgatttcac

SEQ ID NO: 17865 - DNA, 21 bp, Artificial sequence
  Forward Primer
atgcaggttgtaaaacccttt

SEQ ID NO: 17866 - DNA, 21 bp, Artificial sequence
  Forward Primer
tttatcaaagaaaccctccca

SEQ ID NO: 17867 - DNA, 26 bp, Artificial sequence
  Forward Primer
aagatcatatcctaaagatgaagctg

SEQ ID NO: 17868 - DNA, 21 bp, Artificial sequence
  Forward Primer
aagttatctcccacaggcttc

SEQ ID NO: 17869 - DNA, 21 bp, Artificial sequence
  Forward Primer
aagatcaacaggatgcagagg

SEQ ID NO: 17870 - DNA, 19 bp, Artificial sequence
  Forward Primer
aagacttggggccaataac

SEQ ID NO: 17871 - DNA, 19 bp, Artificial sequence
  Forward Primer
aagcaggtctagaaggcga

SEQ ID NO: 17872 - DNA, 20 bp, Artificial sequence
  Forward Primer
ttgacactcctaagccatga

SEQ ID NO: 17873 - DNA, 23 bp, Artificial sequence
  Forward Primer
tagaagacaggtgacaaaggaaa

SEQ ID NO: 17874 - DNA, 28 bp, Artificial sequence
  Forward Primer
tgatggaaaatatacttcaaaataagag

SEQ ID NO: 17875 - DNA, 18 bp, Artificial sequence
  Forward Primer
actcctgccgtgttccca

SEQ ID NO: 17876 - DNA, 22 bp, Artificial sequence
  Forward Primer
atggaaaaggagtgagttttaa

SEQ ID NO: 17877 - DNA, 27 bp, Artificial sequence
  Forward Primer
atttatgtccttcacatacaaagaaat

SEQ ID NO: 17878 - DNA, 24 bp, Artificial sequence
  Forward Primer
attttctactcccaaattccttct

SEQ ID NO: 17879 - DNA, 27 bp, Artificial sequence
  Forward Primer
atgttaactgacctttgtagatgaatt

SEQ ID NO: 17880 - DNA, 27 bp, Artificial sequence
  Forward Primer
aaatatttagtttgacgaaatacagtc

SEQ ID NO: 17881 - DNA, 23 bp, Artificial sequence
  Forward Primer
ataatcctgtgtgaaaccagaca

SEQ ID NO: 17882 - DNA, 30 bp, Artificial sequence
  Forward Primer
aattatattcacattgtaagatctatgtag

SEQ ID NO: 17883 - DNA, 23 bp, Artificial sequence
  Forward Primer
attggatttttaaatacaagggc

SEQ ID NO: 17884 - DNA, 18 bp, Artificial sequence
  Forward Primer
aggatgcccaggtgggag

SEQ ID NO: 17885 - DNA, 20 bp, Artificial sequence
  Forward Primer
ttcttgccacggttttatca

SEQ ID NO: 17886 - DNA, 24 bp, Artificial sequence
  Forward Primer
agtttgcattagagttttactgac

SEQ ID NO: 17887 - DNA, 21 bp, Artificial sequence
  Forward Primer
taattgtgcctgcttcatagg

SEQ ID NO: 17888 - DNA, 18 bp, Artificial sequence
  Forward Primer
agggcggcttgtcttggg

SEQ ID NO: 17889 - DNA, 22 bp, Artificial sequence
  Forward Primer
accttttaatcccctaagtcta

SEQ ID NO: 17890 - DNA, 25 bp, Artificial sequence
  Forward Primer
ttaccgataaacagtgtatttcttt

SEQ ID NO: 17891 - DNA, 20 bp, Artificial sequence
  Forward Primer
tgtggtagtggcagaaaagg

SEQ ID NO: 17892 - DNA, 18 bp, Artificial sequence
  Forward Primer
gtcacgtggggtcagaaa

SEQ ID NO: 17893 - DNA, 28 bp, Artificial sequence
  Forward Primer
aagtcagtctaaaagttgattgttatga

SEQ ID NO: 17894 - DNA, 18 bp, Artificial sequence
  Forward Primer
ccccactcccttctggtt

SEQ ID NO: 17895 - DNA, 22 bp, Artificial sequence
  Forward Primer
tatttctccgggtttaagttca

SEQ ID NO: 17896 - DNA, 24 bp, Artificial sequence
  Forward Primer
aattgctttttatgaatccttttg

SEQ ID NO: 17897 - DNA, 25 bp, Artificial sequence
  Forward Primer
ttggttgactctcaaaatcatattt

SEQ ID NO: 17898 - DNA, 26 bp, Artificial sequence
  Forward Primer
taatgtcctctcagtgtgtttaaaat

SEQ ID NO: 17899 - DNA, 25 bp, Artificial sequence
  Forward Primer
atttgtaatttgttcgtctaagctg

SEQ ID NO: 17900 - DNA, 26 bp, Artificial sequence
  Forward Primer
tattaaaaaaccaattacagatgcac

SEQ ID NO: 17901 - DNA, 30 bp, Artificial sequence
  Forward Primer
atagatgatagtctaatcagatttactctt

SEQ ID NO: 17902 - DNA, 20 bp, Artificial sequence
  Forward Primer
ttcttttttggcattgcttt

SEQ ID NO: 17903 - DNA, 28 bp, Artificial sequence
  Forward Primer
tttctgttttctttctaattattgctag

SEQ ID NO: 17904 - DNA, 23 bp, Artificial sequence
  Forward Primer
gaactgcattgcattttaagtgt

SEQ ID NO: 17905 - DNA, 18 bp, Artificial sequence
  Forward Primer
ttgggcagagcaacaggc

SEQ ID NO: 17906 - DNA, 21 bp, Artificial sequence
  Forward Primer
aaaagtccagaattttagccc

SEQ ID NO: 17907 - DNA, 27 bp, Artificial sequence
  Forward Primer
tacttctgatgaaatgtctaagctctt

SEQ ID NO: 17908 - DNA, 25 bp, Artificial sequence
  Forward Primer
taacaagaaccttttttgtttttcc

SEQ ID NO: 17909 - DNA, 18 bp, Artificial sequence
  Forward Primer
tccaaacgaccttggttc

SEQ ID NO: 17910 - DNA, 24 bp, Artificial sequence
  Forward Primer
atttctgattgagattgttacaag

SEQ ID NO: 17911 - DNA, 28 bp, Artificial sequence
  Forward Primer
tttcatatagttcataaaaagcactgat

SEQ ID NO: 17912 - DNA, 26 bp, Artificial sequence
  Forward Primer
atttatttcaaaatgtactgagatgc

SEQ ID NO: 17913 - DNA, 23 bp, Artificial sequence
  Forward Primer
agaacagagcagtgagaagatcc

SEQ ID NO: 17914 - DNA, 27 bp, Artificial sequence
  Forward Primer
ttttatcttaacatggaaataaaccac

SEQ ID NO: 17915 - DNA, 25 bp, Artificial sequence
  Forward Primer
tgtgtgtgtgtkttttttaaatcta

SEQ ID NO: 17916 - DNA, 23 bp, Artificial sequence
  Forward Primer
tcattttgtttgaataaggtcca

SEQ ID NO: 17917 - DNA, 20 bp, Artificial sequence
  Forward Primer
aaatggaaatcttccacagg

SEQ ID NO: 17918 - DNA, 19 bp, Artificial sequence
  Forward Primer
agggtgacatcgctttacc

SEQ ID NO: 17919 - DNA, 21 bp, Artificial sequence
  Forward Primer
tgcagtatagcacggagatag

SEQ ID NO: 17920 - DNA, 19 bp, Artificial sequence
  Forward Primer
cagtgatacctgagaggga

SEQ ID NO: 17921 - DNA, 23 bp, Artificial sequence
  Forward Primer
ccaaatattcatatttcaacagt

SEQ ID NO: 17922 - DNA, 28 bp, Artificial sequence
  Forward Primer
tccacaagaagcttttatataatatcag

SEQ ID NO: 17923 - DNA, 21 bp, Artificial sequence
  Forward Primer
tgtgaactcaaaccactatgc

SEQ ID NO: 17924 - DNA, 20 bp, Artificial sequence
  Forward Primer
agaaaggagatggggaacat

SEQ ID NO: 17925 - DNA, 18 bp, Artificial sequence
  Forward Primer
attcatggctccgttttg

SEQ ID NO: 17926 - DNA, 20 bp, Artificial sequence
  Forward Primer
agaaggtcaaagagtcatgg

SEQ ID NO: 17927 - DNA, 23 bp, Artificial sequence
  Forward Primer
attgcctctctcattttgtgtac

SEQ ID NO: 17928 - DNA, 24 bp, Artificial sequence
  Forward Primer
tggttgacctctaagactacttcc

SEQ ID NO: 17929 - DNA, 25 bp, Artificial sequence
  Forward Primer
atgcaacttttttctaaaaactagg

SEQ ID NO: 17930 - DNA, 23 bp, Artificial sequence
  Forward Primer
agtaaatactaaagagacgcctg

SEQ ID NO: 17931 - DNA, 24 bp, Artificial sequence
  Forward Primer
tttagtgtaaatcctgacagtgga

SEQ ID NO: 17932 - DNA, 20 bp, Artificial sequence
  Forward Primer
ttgtttggctggtatcatta

SEQ ID NO: 17933 - DNA, 18 bp, Artificial sequence
  Forward Primer
taccatgcagcttgcagg

SEQ ID NO: 17934 - DNA, 21 bp, Artificial sequence
  Forward Primer
tttgtgcttaggtatgcacgt

SEQ ID NO: 17935 - DNA, 19 bp, Artificial sequence
  Forward Primer
gtgggggtggtctccgcat

SEQ ID NO: 17936 - DNA, 28 bp, Artificial sequence
  Forward Primer
acatatagaaggtgaagaaaggtttaaa

SEQ ID NO: 17937 - DNA, 21 bp, Artificial sequence
  Forward Primer
gcttattatgtgctaaatcca

SEQ ID NO: 17938 - DNA, 29 bp, Artificial sequence
  Forward Primer
tttcatcaatattacttactgtgaacttg

SEQ ID NO: 17939 - DNA, 18 bp, Artificial sequence
  Forward Primer
aagcttgccctctggttt

SEQ ID NO: 17940 - DNA, 22 bp, Artificial sequence
  Forward Primer
attgggatgtttttagtggaga

SEQ ID NO: 17941 - DNA, 27 bp, Artificial sequence
  Forward Primer
tttaatcttcctaaaacatatccctac

SEQ ID NO: 17942 - DNA, 23 bp, Artificial sequence
  Forward Primer
tgagcctctatcattttctttaa

SEQ ID NO: 17943 - DNA, 26 bp, Artificial sequence
  Forward Primer
tttccaataataataccttgaaaagc

SEQ ID NO: 17944 - DNA, 20 bp, Artificial sequence
  Forward Primer
tagcactcatgcagagctcc

SEQ ID NO: 17945 - DNA, 18 bp, Artificial sequence
  Forward Primer
tcacttgggactccatgg

SEQ ID NO: 17946 - DNA, 25 bp, Artificial sequence
  Forward Primer
atatggcagaactctgtaaatttcc

SEQ ID NO: 17947 - DNA, 30 bp, Artificial sequence
  Forward Primer
atgtgatacacagttaatgytaactataaa

SEQ ID NO: 17948 - DNA, 21 bp, Artificial sequence
  Forward Primer
aaaaactctagagccactgaa

SEQ ID NO: 17949 - DNA, 20 bp, Artificial sequence
  Forward Primer
attggcacagacctctaaag

SEQ ID NO: 17950 - DNA, 22 bp, Artificial sequence
  Forward Primer
tacatgactaaccaaggagtct

SEQ ID NO: 17951 - DNA, 20 bp, Artificial sequence
  Forward Primer
tccctttaccttcagaagcc

SEQ ID NO: 17952 - DNA, 18 bp, Artificial sequence
  Forward Primer
tttgctggtggtccaatg

SEQ ID NO: 17953 - DNA, 22 bp, Artificial sequence
  Forward Primer
taaaaaatgttgagcacgttca

SEQ ID NO: 17954 - DNA, 28 bp, Artificial sequence
  Forward Primer
ataaagtagtgtcacttataatgccttg

SEQ ID NO: 17955 - DNA, 23 bp, Artificial sequence
  Forward Primer
attggttttcttaacacacagca

SEQ ID NO: 17956 - DNA, 25 bp, Artificial sequence
  Forward Primer
taataaaaacacgagagctttatgg

SEQ ID NO: 17957 - DNA, 23 bp, Artificial sequence
  Forward Primer
attcagtgattggtgtccttatg

SEQ ID NO: 17958 - DNA, 23 bp, Artificial sequence
  Forward Primer
atatgacatgaggtaagtgttgg

SEQ ID NO: 17959 - DNA, 18 bp, Artificial sequence
  Forward Primer
agctaaatgtcgggggag

SEQ ID NO: 17960 - DNA, 20 bp, Artificial sequence
  Forward Primer
aaacatccagtcctctgtgg

SEQ ID NO: 17961 - DNA, 18 bp, Artificial sequence
  Forward Primer
taatgagccccgctgttt

SEQ ID NO: 17962 - DNA, 27 bp, Artificial sequence
  Forward Primer
aaatattttagagaagaaaggtctggt

SEQ ID NO: 17963 - DNA, 24 bp, Artificial sequence
  Forward Primer
taaattatagcaagggtccacatt

SEQ ID NO: 17964 - DNA, 22 bp, Artificial sequence
  Forward Primer
tggttatcatcacatactcccc

SEQ ID NO: 17965 - DNA, 27 bp, Artificial sequence
  Forward Primer
aacatagtttcactgtgaatagttcaa

SEQ ID NO: 17966 - DNA, 25 bp, Artificial sequence
  Forward Primer
attggatggactaagtacagtgaac

SEQ ID NO: 17967 - DNA, 23 bp, Artificial sequence
  Forward Primer
aggaatggaaaacaggagtaaga

SEQ ID NO: 17968 - DNA, 20 bp, Artificial sequence
  Forward Primer
atgagaggaacaggcagagc

SEQ ID NO: 17969 - DNA, 28 bp, Artificial sequence
  Forward Primer
aactgaataacattttcactttacaaca

SEQ ID NO: 17970 - DNA, 19 bp, Artificial sequence
  Forward Primer
atgcttgggaattgacacc

SEQ ID NO: 17971 - DNA, 20 bp, Artificial sequence
  Forward Primer
gagagggagtagatggtggg

SEQ ID NO: 17972 - DNA, 25 bp, Artificial sequence
  Forward Primer
tgaaaaggataaagataactggaca

SEQ ID NO: 17973 - DNA, 26 bp, Artificial sequence
  Forward Primer
tactgatttcttaattatgccagtgt

SEQ ID NO: 17974 - DNA, 30 bp, Artificial sequence
  Forward Primer
tttaaatgaagcttagtaagtaatcctaca

SEQ ID NO: 17975 - DNA, 28 bp, Artificial sequence
  Forward Primer
tttaatcasaactcaactcttactcaac

SEQ ID NO: 17976 - DNA, 28 bp, Artificial sequence
  Forward Primer
taaatgtctgataatgattttaaacagc

SEQ ID NO: 17977 - DNA, 23 bp, Artificial sequence
  Forward Primer
aggctaaaagaacaaaaccaatt

SEQ ID NO: 17978 - DNA, 26 bp, Artificial sequence
  Forward Primer
ctgtttttaattgtgtttttttctcc

SEQ ID NO: 17979 - DNA, 20 bp, Artificial sequence
  Forward Primer
aactaagtctgagcgccaca

SEQ ID NO: 17980 - DNA, 19 bp, Artificial sequence
  Forward Primer
tcagatgcgtcacttcgtt

SEQ ID NO: 17981 - DNA, 28 bp, Artificial sequence
  Forward Primer
gagtgttttaggctttattttttaaaca

SEQ ID NO: 17982 - DNA, 21 bp, Artificial sequence
  Forward Primer
taagacagaaccaggagtggc

SEQ ID NO: 17983 - DNA, 20 bp, Artificial sequence
  Forward Primer
atgacagaggatcctggtgg

SEQ ID NO: 17984 - DNA, 21 bp, Artificial sequence
  Forward Primer
tggttttccctcactgagttt

SEQ ID NO: 17985 - DNA, 30 bp, Artificial sequence
  Forward Primer
taatrtagaaatatatctccttacattggg

SEQ ID NO: 17986 - DNA, 18 bp, Artificial sequence
  Forward Primer
actggccctcaggtgacc

SEQ ID NO: 17987 - DNA, 19 bp, Artificial sequence
  Forward Primer
tggaagtggtttcaggagc

SEQ ID NO: 17988 - DNA, 21 bp, Artificial sequence
  Forward Primer
tttctttaggttgctgctcct

SEQ ID NO: 17989 - DNA, 27 bp, Artificial sequence
  Forward Primer
acagtgaaataaaacatatagcttaac

SEQ ID NO: 17990 - DNA, 18 bp, Artificial sequence
  Forward Primer
tcacacctgagccctggg

SEQ ID NO: 17991 - DNA, 19 bp, Artificial sequence
  Forward Primer
tacggcaagagctgattga

SEQ ID NO: 17992 - DNA, 18 bp, Artificial sequence
  Forward Primer
agggattgggattggatg

SEQ ID NO: 17993 - DNA, 26 bp, Artificial sequence
  Forward Primer
aaagtaaaagtaaaacttgacactgc

SEQ ID NO: 17994 - DNA, 27 bp, Artificial sequence
  Forward Primer
atttataagaaggaagcataaaggaag

SEQ ID NO: 17995 - DNA, 22 bp, Artificial sequence
  Forward Primer
gttggcaaatgatagttgatgc

SEQ ID NO: 17996 - DNA, 22 bp, Artificial sequence
  Forward Primer
tttggtcaggagaaaagattcc

SEQ ID NO: 17997 - DNA, 22 bp, Artificial sequence
  Forward Primer
taggctggtaagaaagggattt

SEQ ID NO: 17998 - DNA, 30 bp, Artificial sequence
  Forward Primer
ttgtatttactgagagaaatcattgtaata

SEQ ID NO: 17999 - DNA, 19 bp, Artificial sequence
  Forward Primer
aggtcaagcaatggggata

SEQ ID NO: 18000 - DNA, 29 bp, Artificial sequence
  Forward Primer
tttaatattagaggagcaaaaactacaag

SEQ ID NO: 18001 - DNA, 22 bp, Artificial sequence
  Forward Primer
agcagagttttttgtctaggca

SEQ ID NO: 18002 - DNA, 22 bp, Artificial sequence
  Forward Primer
tgcattttatcttgtccaggta

SEQ ID NO: 18003 - DNA, 18 bp, Artificial sequence
  Forward Primer
agcctgaggatggaggtg

SEQ ID NO: 18004 - DNA, 26 bp, Artificial sequence
  Forward Primer
ttattctgtctcctcttctactttgc

SEQ ID NO: 18005 - DNA, 22 bp, Artificial sequence
  Forward Primer
actttgaggggtaagtcaagat

SEQ ID NO: 18006 - DNA, 20 bp, Artificial sequence
  Forward Primer
acaagaacccaaaacatggc

SEQ ID NO: 18007 - DNA, 20 bp, Artificial sequence
  Forward Primer
aggtgagctccttaagggaa

SEQ ID NO: 18008 - DNA, 20 bp, Artificial sequence
  Forward Primer
ttgtaatctcgttcggcatc

SEQ ID NO: 18009 - DNA, 25 bp, Artificial sequence
  Forward Primer
aaaaacactggcttttaaaataagg

SEQ ID NO: 18010 - DNA, 22 bp, Artificial sequence
  Forward Primer
atttcagtgaggccttagacaa

SEQ ID NO: 18011 - DNA, 22 bp, Artificial sequence
  Forward Primer
taagatcatgcaagtcttgtgg

SEQ ID NO: 18012 - DNA, 18 bp, Artificial sequence
  Forward Primer
aaagtgctcagccagggc

SEQ ID NO: 18013 - DNA, 26 bp, Artificial sequence
  Forward Primer
ataaggataggtgaaagaacttcaag

SEQ ID NO: 18014 - DNA, 24 bp, Artificial sequence
  Forward Primer
aggccttagtaataatgacctgtc

SEQ ID NO: 18015 - DNA, 20 bp, Artificial sequence
  Forward Primer
ttaagttacacatgggcctg

SEQ ID NO: 18016 - DNA, 29 bp, Artificial sequence
  Forward Primer
actctttatcaaactgattaaaataccag

SEQ ID NO: 18017 - DNA, 27 bp, Artificial sequence
  Forward Primer
aaatcataacattatggacttcagttg

SEQ ID NO: 18018 - DNA, 18 bp, Artificial sequence
  Forward Primer
agaaagttgggctctggc

SEQ ID NO: 18019 - DNA, 19 bp, Artificial sequence
  Forward Primer
tcacagcaccagtcaggac

SEQ ID NO: 18020 - DNA, 25 bp, Artificial sequence
  Forward Primer
accatcaacaaattttaagtaccac

SEQ ID NO: 18021 - DNA, 22 bp, Artificial sequence
  Forward Primer
aagacagcagatgtaaaaagct

SEQ ID NO: 18022 - DNA, 18 bp, Artificial sequence
  Forward Primer
agatgtgcctggaccatg

SEQ ID NO: 18023 - DNA, 28 bp, Artificial sequence
  Forward Primer
ggtttagaagatagttttacaaatgttt

SEQ ID NO: 18024 - DNA, 18 bp, Artificial sequence
  Forward Primer
gctctgtttgggggtacc

SEQ ID NO: 18025 - DNA, 18 bp, Artificial sequence
  Forward Primer
tcacccccaggacgcaga

SEQ ID NO: 18026 - DNA, 23 bp, Artificial sequence
  Forward Primer
taacgtacaggagaaaacgagat

SEQ ID NO: 18027 - DNA, 25 bp, Artificial sequence
  Forward Primer
caagtcttataatttcatcacctta

SEQ ID NO: 18028 - DNA, 20 bp, Artificial sequence
  Forward Primer
aggtgaccagaagttacacg

SEQ ID NO: 18029 - DNA, 30 bp, Artificial sequence
  Forward Primer
ctaactagattttaccatcagaatttattt

SEQ ID NO: 18030 - DNA, 27 bp, Artificial sequence
  Forward Primer
ttatcatatttcagaatgtggagtagg

SEQ ID NO: 18031 - DNA, 23 bp, Artificial sequence
  Forward Primer
tatgtacctgctcctttttgtga

SEQ ID NO: 18032 - DNA, 22 bp, Artificial sequence
  Forward Primer
ttttttggtttcttgtcctctg

SEQ ID NO: 18033 - DNA, 21 bp, Artificial sequence
  Forward Primer
atggcttcttggagttacaca

SEQ ID NO: 18034 - DNA, 26 bp, Artificial sequence
  Forward Primer
taatacctaaactcaatttacatcca

SEQ ID NO: 18035 - DNA, 19 bp, Artificial sequence
  Forward Primer
tggatttcagagagacggg

SEQ ID NO: 18036 - DNA, 19 bp, Artificial sequence
  Forward Primer
tgcatctgtgagyactcct

SEQ ID NO: 18037 - DNA, 26 bp, Artificial sequence
  Forward Primer
actccttgtcatatttctttccatac

SEQ ID NO: 18038 - DNA, 22 bp, Artificial sequence
  Forward Primer
caaactcagtaagaggtccagc

SEQ ID NO: 18039 - DNA, 28 bp, Artificial sequence
  Forward Primer
ctttatatattttggatataagttcctc

SEQ ID NO: 18040 - DNA, 19 bp, Artificial sequence
  Forward Primer
aagagtttggcagacccag

SEQ ID NO: 18041 - DNA, 27 bp, Artificial sequence
  Forward Primer
gaaagataygtcatgaaataatcacaa

SEQ ID NO: 18042 - DNA, 27 bp, Artificial sequence
  Forward Primer
tctcagttctcctatggacttaaataa

SEQ ID NO: 18043 - DNA, 24 bp, Artificial sequence
  Forward Primer
gctactactcactcaagtctcaaa

SEQ ID NO: 18044 - DNA, 22 bp, Artificial sequence
  Forward Primer
atactgtctttacaaggctggg

SEQ ID NO: 18045 - DNA, 26 bp, Artificial sequence
  Forward Primer
aatatttatgcaaatagtctcccact

SEQ ID NO: 18046 - DNA, 20 bp, Artificial sequence
  Forward Primer
aacttgatggctccagtctg

SEQ ID NO: 18047 - DNA, 24 bp, Artificial sequence
  Forward Primer
ttctagttgttgaggtttttgagg

SEQ ID NO: 18048 - DNA, 22 bp, Artificial sequence
  Forward Primer
attccaagaagaaacgagacaa

SEQ ID NO: 18049 - DNA, 18 bp, Artificial sequence
  Forward Primer
tccatgggggctctggag

SEQ ID NO: 18050 - DNA, 25 bp, Artificial sequence
  Forward Primer
ataatggatataacctgtctgcaaa

SEQ ID NO: 18051 - DNA, 19 bp, Artificial sequence
  Forward Primer
agcttgtcacctggctagc

SEQ ID NO: 18052 - DNA, 25 bp, Artificial sequence
  Forward Primer
tttacataaatgacaaacttggctt

SEQ ID NO: 18053 - DNA, 30 bp, Artificial sequence
  Forward Primer
aatattcttctagacatctcttcctatatg

SEQ ID NO: 18054 - DNA, 18 bp, Artificial sequence
  Forward Primer
gccagagcctgtgacaga

SEQ ID NO: 18055 - DNA, 19 bp, Artificial sequence
  Forward Primer
tatttccctccaaaaggca

SEQ ID NO: 18056 - DNA, 26 bp, Artificial sequence
  Forward Primer
atacaattggtcgtattagtgctcta

SEQ ID NO: 18057 - DNA, 26 bp, Artificial sequence
  Forward Primer
attttaaattgctatttcccactcta

SEQ ID NO: 18058 - DNA, 23 bp, Artificial sequence
  Forward Primer
ttaattacaggtttagggggagt

SEQ ID NO: 18059 - DNA, 24 bp, Artificial sequence
  Forward Primer
ttaagattatgcagcaaaaacaac

SEQ ID NO: 18060 - DNA, 19 bp, Artificial sequence
  Forward Primer
tttgaggacacacacagca

SEQ ID NO: 18061 - DNA, 29 bp, Artificial sequence
  Forward Primer
tggaaagagtagagctgtatattctagat

SEQ ID NO: 18062 - DNA, 30 bp, Artificial sequence
  Forward Primer
ctagatataaayaagatcactgaataaaca

SEQ ID NO: 18063 - DNA, 21 bp, Artificial sequence
  Forward Primer
tagaagcagagccttcatctc

SEQ ID NO: 18064 - DNA, 22 bp, Artificial sequence
  Forward Primer
aagtgaagcttctagtcccaca

SEQ ID NO: 18065 - DNA, 23 bp, Artificial sequence
  Forward Primer
taaatcgaggagcctgtatacct

SEQ ID NO: 18066 - DNA, 22 bp, Artificial sequence
  Forward Primer
agaagcagagtcattttccctt

SEQ ID NO: 18067 - DNA, 20 bp, Artificial sequence
  Forward Primer
tcctgccagctataaacagg

SEQ ID NO: 18068 - DNA, 28 bp, Artificial sequence
  Forward Primer
actagggaaagaaaaattatgtgaatag

SEQ ID NO: 18069 - DNA, 19 bp, Artificial sequence
  Forward Primer
tgtgcagccttgtttctga

SEQ ID NO: 18070 - DNA, 20 bp, Artificial sequence
  Forward Primer
atcagtcgtctggactaggc

SEQ ID NO: 18071 - DNA, 23 bp, Artificial sequence
  Forward Primer
taatgtcagcttaacccagaaag

SEQ ID NO: 18072 - DNA, 26 bp, Artificial sequence
  Forward Primer
tagctaatggctttccataaagtaat

SEQ ID NO: 18073 - DNA, 23 bp, Artificial sequence
  Forward Primer
aaacaagcataggagtgagacct

SEQ ID NO: 18074 - DNA, 19 bp, Artificial sequence
  Forward Primer
cccaccacagaaggaaaag

SEQ ID NO: 18075 - DNA, 26 bp, Artificial sequence
  Forward Primer
tttcacaataaatgagatagcacata

SEQ ID NO: 18076 - DNA, 30 bp, Artificial sequence
  Forward Primer
tggacaaacttagagactattacatagaat

SEQ ID NO: 18077 - DNA, 19 bp, Artificial sequence
  Forward Primer
aaaagcacaggtcctcagc

SEQ ID NO: 18078 - DNA, 24 bp, Artificial sequence
  Forward Primer
aggttttgttcttcataattaatg

SEQ ID NO: 18079 - DNA, 29 bp, Artificial sequence
  Forward Primer
agctagataccctagttctcatttatttt

SEQ ID NO: 18080 - DNA, 20 bp, Artificial sequence
  Forward Primer
aaaggatgctgccataaaag

SEQ ID NO: 18081 - DNA, 23 bp, Artificial sequence
  Forward Primer
tttcaaaacagaactaaaatctg

SEQ ID NO: 18082 - DNA, 20 bp, Artificial sequence
  Forward Primer
ttgtccattgttcaaaacag

SEQ ID NO: 18083 - DNA, 22 bp, Artificial sequence
  Forward Primer
agattcttgaactctgcatgag

SEQ ID NO: 18084 - DNA, 18 bp, Artificial sequence
  Forward Primer
aaaagtcacagcagccca

SEQ ID NO: 18085 - DNA, 27 bp, Artificial sequence
  Forward Primer
tttcaaaagtttaagagaatagcaatg

SEQ ID NO: 18086 - DNA, 23 bp, Artificial sequence
  Forward Primer
aaaataacctcttaggccaaaaa

SEQ ID NO: 18087 - DNA, 25 bp, Artificial sequence
  Forward Primer
gccatatggtgttgaatataggtaa

SEQ ID NO: 18088 - DNA, 26 bp, Artificial sequence
  Forward Primer
tgtaagaactaggaagtttcaaataa

SEQ ID NO: 18089 - DNA, 21 bp, Artificial sequence
  Forward Primer
caatcttatgcagcaataaag

SEQ ID NO: 18090 - DNA, 20 bp, Artificial sequence
  Forward Primer
gctatccgtgtagcatctct

SEQ ID NO: 18091 - DNA, 22 bp, Artificial sequence
  Forward Primer
atgaaagcctataacaccagca

SEQ ID NO: 18092 - DNA, 18 bp, Artificial sequence
  Forward Primer
catgcatgtgtgggagtg

SEQ ID NO: 18093 - DNA, 25 bp, Artificial sequence
  Forward Primer
agttttaagaacgctgttatagcaa

SEQ ID NO: 18094 - DNA, 24 bp, Artificial sequence
  Forward Primer
aattaatttccacttgaactaagc

SEQ ID NO: 18095 - DNA, 26 bp, Artificial sequence
  Forward Primer
ttttgtattttcttcctactcaggtc

SEQ ID NO: 18096 - DNA, 28 bp, Artificial sequence
  Forward Primer
acataaaccaaatatttcatacttgtga

SEQ ID NO: 18097 - DNA, 28 bp, Artificial sequence
  Forward Primer
attctgaaagtaatccctctaagaatac

SEQ ID NO: 18098 - DNA, 26 bp, Artificial sequence
  Forward Primer
atttggagagaatatctagtttaatg

SEQ ID NO: 18099 - DNA, 26 bp, Artificial sequence
  Forward Primer
acacctctctgagtataggcttagaa

SEQ ID NO: 18100 - DNA, 26 bp, Artificial sequence
  Forward Primer
ttttagttacatttacttcaagctgc

SEQ ID NO: 18101 - DNA, 21 bp, Artificial sequence
  Forward Primer
atcctggaaccattttttatt

SEQ ID NO: 18102 - DNA, 20 bp, Artificial sequence
  Forward Primer
ttaaaggcccaaggtcactt

SEQ ID NO: 18103 - DNA, 19 bp, Artificial sequence
  Forward Primer
agtctctgggtctctgctg

SEQ ID NO: 18104 - DNA, 22 bp, Artificial sequence
  Forward Primer
ataaacgaggaacttcaacgtg

SEQ ID NO: 18105 - DNA, 24 bp, Artificial sequence
  Forward Primer
aaacaaagtctgtcaacacaatct

SEQ ID NO: 18106 - DNA, 25 bp, Artificial sequence
  Forward Primer
atttggaactaagcttcctttaatc

SEQ ID NO: 18107 - DNA, 25 bp, Artificial sequence
  Forward Primer
ataatttgttcattctcctgtgaaa

SEQ ID NO: 18108 - DNA, 21 bp, Artificial sequence
  Forward Primer
atttcccctatcaagcaactg

SEQ ID NO: 18109 - DNA, 19 bp, Artificial sequence
  Forward Primer
ctcagcaccttgtattcga

SEQ ID NO: 18110 - DNA, 19 bp, Artificial sequence
  Forward Primer
tgattgccatcttctcagg

SEQ ID NO: 18111 - DNA, 26 bp, Artificial sequence
  Forward Primer
tttatgttaccttactctcaccttca

SEQ ID NO: 18112 - DNA, 18 bp, Artificial sequence
  Forward Primer
tggagcagtgactggcac

SEQ ID NO: 18113 - DNA, 24 bp, Artificial sequence
  Forward Primer
atttgaatcagttctaatgaggca

SEQ ID NO: 18114 - DNA, 19 bp, Artificial sequence
  Forward Primer
tccctcaagacatcctgct

SEQ ID NO: 18115 - DNA, 20 bp, Artificial sequence
  Forward Primer
tcaagattgctcttgtcgtg

SEQ ID NO: 18116 - DNA, 23 bp, Artificial sequence
  Forward Primer
tacctgacaagctttattgaaaa

SEQ ID NO: 18117 - DNA, 20 bp, Artificial sequence
  Forward Primer
atgagatcctcctgcctttt

SEQ ID NO: 18118 - DNA, 20 bp, Artificial sequence
  Forward Primer
ttggggggtaatttttgttt

SEQ ID NO: 18119 - DNA, 25 bp, Artificial sequence
  Forward Primer
ttttttcctcaatggtatatgtctt

SEQ ID NO: 18120 - DNA, 21 bp, Artificial sequence
  Forward Primer
aaaacctaacagccactgagg

SEQ ID NO: 18121 - DNA, 30 bp, Artificial sequence
  Forward Primer
taattcttttctgttctattagaattagat

SEQ ID NO: 18122 - DNA, 28 bp, Artificial sequence
  Forward Primer
taaatgatctagttgattgtctctactg

SEQ ID NO: 18123 - DNA, 24 bp, Artificial sequence
  Forward Primer
aagttcacgaacttctacagacag

SEQ ID NO: 18124 - DNA, 20 bp, Artificial sequence
  Forward Primer
acacrccrctcacttgattt

SEQ ID NO: 18125 - DNA, 19 bp, Artificial sequence
  Forward Primer
ctggtatttacaacagggg

SEQ ID NO: 18126 - DNA, 24 bp, Artificial sequence
  Forward Primer
ttttttggatacaactcctgtttt

SEQ ID NO: 18127 - DNA, 30 bp, Artificial sequence
  Forward Primer
tttttcattactttatcccttttagtactc

SEQ ID NO: 18128 - DNA, 25 bp, Artificial sequence
  Forward Primer
acagcgtctaatgttgttagaaaag

SEQ ID NO: 18129 - DNA, 30 bp, Artificial sequence
  Forward Primer
atttatagaatatctactatgcacaataag

SEQ ID NO: 18130 - DNA, 23 bp, Artificial sequence
  Forward Primer
attttggcaagaaaatctaacca

SEQ ID NO: 18131 - DNA, 25 bp, Artificial sequence
  Forward Primer
tgcttattagaagatgactgactag

SEQ ID NO: 18132 - DNA, 26 bp, Artificial sequence
  Forward Primer
tatctcttgacttcatttctcagagg

SEQ ID NO: 18133 - DNA, 24 bp, Artificial sequence
  Forward Primer
aattttactcaaagattattgtgg

SEQ ID NO: 18134 - DNA, 20 bp, Artificial sequence
  Forward Primer
agcagaatttctgggaatga

SEQ ID NO: 18135 - DNA, 22 bp, Artificial sequence
  Forward Primer
atctgggagaggaacagtctct

SEQ ID NO: 18136 - DNA, 30 bp, Artificial sequence
  Forward Primer
aaatgtctgtatagttttaagtaaaatggc

SEQ ID NO: 18137 - DNA, 22 bp, Artificial sequence
  Forward Primer
gaaatcctctttttaaaagtca

SEQ ID NO: 18138 - DNA, 18 bp, Artificial sequence
  Forward Primer
atgctgttcccgaggcat

SEQ ID NO: 18139 - DNA, 21 bp, Artificial sequence
  Forward Primer
cagagttcgttaggctcagag

SEQ ID NO: 18140 - DNA, 25 bp, Artificial sequence
  Forward Primer
tctggtactcttgacataaaaggtt

SEQ ID NO: 18141 - DNA, 23 bp, Artificial sequence
  Forward Primer
ttagttaactccacccaagcttt

SEQ ID NO: 18142 - DNA, 25 bp, Artificial sequence
  Forward Primer
tgaagcagatatagtgtaaacctcg

SEQ ID NO: 18143 - DNA, 18 bp, Artificial sequence
  Forward Primer
tcctctggagccctgctt

SEQ ID NO: 18144 - DNA, 21 bp, Artificial sequence
  Forward Primer
atgtgctaaagtgaatgtcac

SEQ ID NO: 18145 - DNA, 22 bp, Artificial sequence
  Forward Primer
aatctctctgaagaggcaaaag

SEQ ID NO: 18146 - DNA, 23 bp, Artificial sequence
  Forward Primer
ttaatcccatcttaccatcttgc

SEQ ID NO: 18147 - DNA, 28 bp, Artificial sequence
  Forward Primer
atctataacactgactaaatgttgtttt

SEQ ID NO: 18148 - DNA, 26 bp, Artificial sequence
  Forward Primer
tattttaaccttgaacagtctgtcag

SEQ ID NO: 18149 - DNA, 27 bp, Artificial sequence
  Forward Primer
taaagaaatagacatgggctatagaca

SEQ ID NO: 18150 - DNA, 22 bp, Artificial sequence
  Forward Primer
cctcatttaatccagacacaat

SEQ ID NO: 18151 - DNA, 23 bp, Artificial sequence
  Forward Primer
aaagttctatcctccagcatgtt

SEQ ID NO: 18152 - DNA, 23 bp, Artificial sequence
  Forward Primer
ttatgtatttgtttggctgtgtg

SEQ ID NO: 18153 - DNA, 20 bp, Artificial sequence
  Forward Primer
tttctcactccccacctctt

SEQ ID NO: 18154 - DNA, 18 bp, Artificial sequence
  Forward Primer
tgtccctgagctgggatg

SEQ ID NO: 18155 - DNA, 21 bp, Artificial sequence
  Forward Primer
tamcacgaaggttttccaaag

SEQ ID NO: 18156 - DNA, 22 bp, Artificial sequence
  Forward Primer
agccattttataagcactctga

SEQ ID NO: 18157 - DNA, 26 bp, Artificial sequence
  Forward Primer
aatcttcctgaaagttttacatgttt

SEQ ID NO: 18158 - DNA, 28 bp, Artificial sequence
  Forward Primer
gagatgttttgaaatagaactcatttaa

SEQ ID NO: 18159 - DNA, 30 bp, Artificial sequence
  Forward Primer
tttcttattagagtggttttaggatatata

SEQ ID NO: 18160 - DNA, 23 bp, Artificial sequence
  Forward Primer
ttaattgctttttgattcttgtg

SEQ ID NO: 18161 - DNA, 20 bp, Artificial sequence
  Forward Primer
tgacagggacaagttcagtc

SEQ ID NO: 18162 - DNA, 27 bp, Artificial sequence
  Forward Primer
tacaatgagactcaagtacagagctag

SEQ ID NO: 18163 - DNA, 24 bp, Artificial sequence
  Forward Primer
atgaaaactgaatgaaaaactcag

SEQ ID NO: 18164 - DNA, 20 bp, Artificial sequence
  Forward Primer
ttgctttcaatggtggatac

SEQ ID NO: 18165 - DNA, 25 bp, Artificial sequence
  Forward Primer
tgataaataaaggagataaatggca

SEQ ID NO: 18166 - DNA, 25 bp, Artificial sequence
  Forward Primer
ataaaatattcagctaaactggctg

SEQ ID NO: 18167 - DNA, 23 bp, Artificial sequence
  Forward Primer
tgccaacatttattttttcctaa

SEQ ID NO: 18168 - DNA, 22 bp, Artificial sequence
  Forward Primer
agaaagagagaacagccctctt

SEQ ID NO: 18169 - DNA, 20 bp, Artificial sequence
  Forward Primer
tttagctggcactttggagt

SEQ ID NO: 18170 - DNA, 22 bp, Artificial sequence
  Forward Primer
tatgtgtaaggagtggaggtgg

SEQ ID NO: 18171 - DNA, 22 bp, Artificial sequence
  Forward Primer
aattacccgaaccgttttaagt

SEQ ID NO: 18172 - DNA, 18 bp, Artificial sequence
  Forward Primer
ccagagatactggggcct

SEQ ID NO: 18173 - DNA, 22 bp, Artificial sequence
  Forward Primer
tttgaatactggtgcacttacg

SEQ ID NO: 18174 - DNA, 19 bp, Artificial sequence
  Forward Primer
atttccagattctttgcgc

SEQ ID NO: 18175 - DNA, 18 bp, Artificial sequence
  Forward Primer
tctgccaatagccgcatt

SEQ ID NO: 18176 - DNA, 23 bp, Artificial sequence
  Forward Primer
taaatggaataatgcacgtaaag

SEQ ID NO: 18177 - DNA, 22 bp, Artificial sequence
  Forward Primer
tgaattcaggatagaccactgg

SEQ ID NO: 18178 - DNA, 27 bp, Artificial sequence
  Forward Primer
cttttacaaaagatgactctttaaact

SEQ ID NO: 18179 - DNA, 23 bp, Artificial sequence
  Forward Primer
aatcataggtgaatgcaaaacaa

SEQ ID NO: 18180 - DNA, 22 bp, Artificial sequence
  Forward Primer
tgccaatcctaacaacatattg

SEQ ID NO: 18181 - DNA, 29 bp, Artificial sequence
  Forward Primer
aaagagtcctcatttgttaaactatgtac

SEQ ID NO: 18182 - DNA, 27 bp, Artificial sequence
  Forward Primer
aaaaaagaagctacaaaagtgataaca

SEQ ID NO: 18183 - DNA, 18 bp, Artificial sequence
  Forward Primer
ggcaggggtttctttccc

SEQ ID NO: 18184 - DNA, 24 bp, Artificial sequence
  Forward Primer
aaagtcttccagraaaaaagtcag

SEQ ID NO: 18185 - DNA, 26 bp, Artificial sequence
  Forward Primer
tagtgaataaataaacgttgtttgca

SEQ ID NO: 18186 - DNA, 20 bp, Artificial sequence
  Forward Primer
aatgccagccaatctaaatt

SEQ ID NO: 18187 - DNA, 19 bp, Artificial sequence
  Forward Primer
tcctcagtgtttgcggtat

SEQ ID NO: 18188 - DNA, 29 bp, Artificial sequence
  Forward Primer
taaaaaggagctatttatttatacctgtg

SEQ ID NO: 18189 - DNA, 27 bp, Artificial sequence
  Forward Primer
aactaacttttgaaaagaaagaaaagc

SEQ ID NO: 18190 - DNA, 27 bp, Artificial sequence
  Forward Primer
aatatctaaagaacaagyagagtttca

SEQ ID NO: 18191 - DNA, 23 bp, Artificial sequence
  Forward Primer
tgcttcttaaacctgtcagacat

SEQ ID NO: 18192 - DNA, 21 bp, Artificial sequence
  Forward Primer
tatgagatgttcacacgtgga

SEQ ID NO: 18193 - DNA, 23 bp, Artificial sequence
  Forward Primer
attcattcaggtgggtttatctc

SEQ ID NO: 18194 - DNA, 20 bp, Artificial sequence
  Forward Primer
ccaattgttgctcaaactgg

SEQ ID NO: 18195 - DNA, 23 bp, Artificial sequence
  Forward Primer
atctaagcagtgacgtgaactca

SEQ ID NO: 18196 - DNA, 19 bp, Artificial sequence
  Forward Primer
agcagtacttcctgggcat

SEQ ID NO: 18197 - DNA, 21 bp, Artificial sequence
  Forward Primer
gcaaattctaaacacctgcag

SEQ ID NO: 18198 - DNA, 24 bp, Artificial sequence
  Forward Primer
taactagaaatcttggcaccatct

SEQ ID NO: 18199 - DNA, 24 bp, Artificial sequence
  Forward Primer
tacctttaattccacacctcactt

SEQ ID NO: 18200 - DNA, 30 bp, Artificial sequence
  Forward Primer
tcagcttgtattctatttagcattaatata

SEQ ID NO: 18201 - DNA, 25 bp, Artificial sequence
  Forward Primer
tctgatctcttcttataatggcact

SEQ ID NO: 18202 - DNA, 26 bp, Artificial sequence
  Forward Primer
aaagaggcagtatctatttgaacata

SEQ ID NO: 18203 - DNA, 19 bp, Artificial sequence
  Forward Primer
ttcaagccatgctcaaatt

SEQ ID NO: 18204 - DNA, 24 bp, Artificial sequence
  Forward Primer
aaaacaccaaaraactgaatctca

SEQ ID NO: 18205 - DNA, 21 bp, Artificial sequence
  Forward Primer
atgatgagaatcaccctcctt

SEQ ID NO: 18206 - DNA, 24 bp, Artificial sequence
  Forward Primer
gaaaaacaaaacaaaatagaatgc

SEQ ID NO: 18207 - DNA, 22 bp, Artificial sequence
  Forward Primer
ttcttagcaatatgctacctgt

SEQ ID NO: 18208 - DNA, 25 bp, Artificial sequence
  Forward Primer
tatttgaaagttgagattaggttgc

SEQ ID NO: 18209 - DNA, 26 bp, Artificial sequence
  Forward Primer
wgtggtgtacatgtttgtttaaaact

SEQ ID NO: 18210 - DNA, 21 bp, Artificial sequence
  Forward Primer
taatagcaccactcaagcagc

SEQ ID NO: 18211 - DNA, 21 bp, Artificial sequence
  Forward Primer
tggaccccagaatctttaaaa

SEQ ID NO: 18212 - DNA, 24 bp, Artificial sequence
  Forward Primer
taactaggtgaatggattaaagaa

SEQ ID NO: 18213 - DNA, 19 bp, Artificial sequence
  Forward Primer
agacccagatgggactcct

SEQ ID NO: 18214 - DNA, 29 bp, Artificial sequence
  Forward Primer
acccataatgtctaacttaatgattagta

SEQ ID NO: 18215 - DNA, 19 bp, Artificial sequence
  Forward Primer
cagagatctcgtcaccacg

SEQ ID NO: 18216 - DNA, 19 bp, Artificial sequence
  Forward Primer
agagatctcgtcaccacgt

SEQ ID NO: 18217 - DNA, 20 bp, Artificial sequence
  Forward Primer
cctgtccttaggcaattcaa

SEQ ID NO: 18218 - DNA, 19 bp, Artificial sequence
  Forward Primer
gtgaatgctttggctctcc

SEQ ID NO: 18219 - DNA, 27 bp, Artificial sequence
  Forward Primer
ttaataaatttcatgcattatctcagg

SEQ ID NO: 18220 - DNA, 30 bp, Artificial sequence
  Forward Primer
aattacttacatttcttatctatactttgt

SEQ ID NO: 18221 - DNA, 20 bp, Artificial sequence
  Forward Primer
tgctccattgtatgcttctt

SEQ ID NO: 18222 - DNA, 20 bp, Artificial sequence
  Forward Primer
tgaaagaccccaaatcacac

SEQ ID NO: 18223 - DNA, 28 bp, Artificial sequence
  Forward Primer
aaatatatagaacacccagctaaagaaa

SEQ ID NO: 18224 - DNA, 22 bp, Artificial sequence
  Forward Primer
tttacattgccatcckaaaatc

SEQ ID NO: 18225 - DNA, 18 bp, Artificial sequence
  Forward Primer
caccagctccctccaaga

SEQ ID NO: 18226 - DNA, 27 bp, Artificial sequence
  Forward Primer
attgtattatcytcttcctctgaactc

SEQ ID NO: 18227 - DNA, 28 bp, Artificial sequence
  Forward Primer
ttatcttttaagcatcttatcacttgtc

SEQ ID NO: 18228 - DNA, 28 bp, Artificial sequence
  Forward Primer
ttatcttttaagcatcttatcacttgtc

SEQ ID NO: 18229 - DNA, 25 bp, Artificial sequence
  Forward Primer
atttgatgacacttgatgttatctg

SEQ ID NO: 18230 - DNA, 21 bp, Artificial sequence
  Forward Primer
agttctccaagtgaaagacgg

SEQ ID NO: 18231 - DNA, 20 bp, Artificial sequence
  Forward Primer
tgcttttcacacgtctcatg

SEQ ID NO: 18232 - DNA, 20 bp, Artificial sequence
  Forward Primer
aacttgatggctccagtctg

SEQ ID NO: 18233 - DNA, 22 bp, Artificial sequence
  Forward Primer
aattctctttaagggcctgaga

SEQ ID NO: 18234 - DNA, 18 bp, Artificial sequence
  Forward Primer
gactggcccctcctttgt

SEQ ID NO: 18235 - DNA, 25 bp, Artificial sequence
  Forward Primer
tttactgctaactggaaaaaagatg

SEQ ID NO: 18236 - DNA, 19 bp, Artificial sequence
  Forward Primer
tctggagaagctcctaagg

SEQ ID NO: 18237 - DNA, 20 bp, Artificial sequence
  Forward Primer
aggggaaactctgggagata

SEQ ID NO: 18238 - DNA, 30 bp, Artificial sequence
  Forward Primer
atagtgaatgtattgaaatatactctttcc

SEQ ID NO: 18239 - DNA, 27 bp, Artificial sequence
  Forward Primer
agagattcagataactcayscaaagtc

SEQ ID NO: 18240 - DNA, 18 bp, Artificial sequence
  Forward Primer
ccaggagccccacagaca

SEQ ID NO: 18241 - DNA, 21 bp, Artificial sequence
  Forward Primer
tctgcataaattctttgacat

SEQ ID NO: 18242 - DNA, 19 bp, Artificial sequence
  Forward Primer
tagaccgtcaaccactgcc

SEQ ID NO: 18243 - DNA, 21 bp, Artificial sequence
  Forward Primer
tcattagtcttcagggtggtt

SEQ ID NO: 18244 - DNA, 19 bp, Artificial sequence
  Forward Primer
agcacaatgccccagatat

SEQ ID NO: 18245 - DNA, 21 bp, Artificial sequence
  Forward Primer
tggtgaagaaaggacaaaacc

SEQ ID NO: 18246 - DNA, 20 bp, Artificial sequence
  Forward Primer
tagttagatccggtttgggg

SEQ ID NO: 18247 - DNA, 25 bp, Artificial sequence
  Forward Primer
ttttgaacacactatttcctttctc

SEQ ID NO: 18248 - DNA, 18 bp, Artificial sequence
  Forward Primer
ccttacttcagcccaacg

SEQ ID NO: 18249 - DNA, 21 bp, Artificial sequence
  Forward Primer
ttgtctttctgacatcccatc

SEQ ID NO: 18250 - DNA, 27 bp, Artificial sequence
  Forward Primer
aatatgaagacatatttgacacagtcc

SEQ ID NO: 18251 - DNA, 23 bp, Artificial sequence
  Forward Primer
atcattacaaaccaccaaaaagc

SEQ ID NO: 18252 - DNA, 22 bp, Artificial sequence
  Forward Primer
ttatcagcaattaccctcctga

SEQ ID NO: 18253 - DNA, 22 bp, Artificial sequence
  Forward Primer
tgtacracaaagatcaaagaac

SEQ ID NO: 18254 - DNA, 23 bp, Artificial sequence
  Forward Primer
taggtcaaaaaccactatgccta

SEQ ID NO: 18255 - DNA, 27 bp, Artificial sequence
  Forward Primer
agagccatgatgagaattaaataataa

SEQ ID NO: 18256 - DNA, 22 bp, Artificial sequence
  Forward Primer
atttggagaccactttacatcc

SEQ ID NO: 18257 - DNA, 25 bp, Artificial sequence
  Forward Primer
atcacacatagaaataggtgtcagc

SEQ ID NO: 18258 - DNA, 19 bp, Artificial sequence
  Forward Primer
cagagttcccagagccatg

SEQ ID NO: 18259 - DNA, 18 bp, Artificial sequence
  Forward Primer
cagctcagcagcctgaaa

SEQ ID NO: 18260 - DNA, 19 bp, Artificial sequence
  Forward Primer
acactttccctgcacagct

SEQ ID NO: 18261 - DNA, 23 bp, Artificial sequence
  Forward Primer
aattgaaagtgagtgaaatctta

SEQ ID NO: 18262 - DNA, 18 bp, Artificial sequence
  Forward Primer
ttggaaccatggaccctc

SEQ ID NO: 18263 - DNA, 24 bp, Artificial sequence
  Forward Primer
actgttgtggtttcttttttgttc

SEQ ID NO: 18264 - DNA, 18 bp, Artificial sequence
  Forward Primer
tatggaatcacggggctt

SEQ ID NO: 18265 - DNA, 22 bp, Artificial sequence
  Forward Primer
aaaaggggatttgctttagatg

SEQ ID NO: 18266 - DNA, 18 bp, Artificial sequence
  Forward Primer
acagcatagctttcccgg

SEQ ID NO: 18267 - DNA, 26 bp, Artificial sequence
  Forward Primer
ttaaaatcctgtgctttagagctatt

SEQ ID NO: 18268 - DNA, 21 bp, Artificial sequence
  Forward Primer
gaaacatacggctgtaagtaa

SEQ ID NO: 18269 - DNA, 21 bp, Artificial sequence
  Forward Primer
gcttaatttcctcatctggca

SEQ ID NO: 18270 - DNA, 20 bp, Artificial sequence
  Forward Primer
tatctaacacagcctggcaa

SEQ ID NO: 18271 - DNA, 19 bp, Artificial sequence
  Forward Primer
aaagaggcagtttccatgg

SEQ ID NO: 18272 - DNA, 28 bp, Artificial sequence
  Forward Primer
aagtttataatacctgcttcatagattt

SEQ ID NO: 18273 - DNA, 23 bp, Artificial sequence
  Forward Primer
ttctttttgcattcttcattttg

SEQ ID NO: 18274 - DNA, 21 bp, Artificial sequence
  Forward Primer
aaaaaagaatttgcatcagcc

SEQ ID NO: 18275 - DNA, 27 bp, Artificial sequence
  Forward Primer
atcataaattgtatcatcaccaactct

SEQ ID NO: 18276 - DNA, 26 bp, Artificial sequence
  Forward Primer
atggggttatatgtgactttattttt

SEQ ID NO: 18277 - DNA, 24 bp, Artificial sequence
  Forward Primer
ataaaaagtcaaacgtgattgaac

SEQ ID NO: 18278 - DNA, 18 bp, Artificial sequence
  Forward Primer
ttgccattcctgtctcca

SEQ ID NO: 18279 - DNA, 30 bp, Artificial sequence
  Forward Primer
tatctatttatcatacaaatattctaggtc

SEQ ID NO: 18280 - DNA, 24 bp, Artificial sequence
  Forward Primer
agagctcttatttatgacactttg

SEQ ID NO: 18281 - DNA, 23 bp, Artificial sequence
  Forward Primer
tacctttttgttcaaaggaatga

SEQ ID NO: 18282 - DNA, 27 bp, Artificial sequence
  Forward Primer
aaattgctgttagtagatttaaggaaa

SEQ ID NO: 18283 - DNA, 28 bp, Artificial sequence
  Forward Primer
attttatccaaagtcatgtatatgaaag

SEQ ID NO: 18284 - DNA, 30 bp, Artificial sequence
  Forward Primer
agtatatacattgtgatttaacacttctgt

SEQ ID NO: 18285 - DNA, 18 bp, Artificial sequence
  Forward Primer
ttgaccttcagcccagag

SEQ ID NO: 18286 - DNA, 19 bp, Artificial sequence
  Forward Primer
actcatgataacttggggg

SEQ ID NO: 18287 - DNA, 19 bp, Artificial sequence
  Forward Primer
atagacctccctgtcgtgg

SEQ ID NO: 18288 - DNA, 23 bp, Artificial sequence
  Forward Primer
ttgacatgccatagtgtctactg

SEQ ID NO: 18289 - DNA, 28 bp, Artificial sequence
  Forward Primer
ttctctgttaatgaatatttcttatgga

SEQ ID NO: 18290 - DNA, 20 bp, Artificial sequence
  Forward Primer
agatggaaagggtcaagctt

SEQ ID NO: 18291 - DNA, 24 bp, Artificial sequence
  Forward Primer
tacaacaaattgaacatctaaaac

SEQ ID NO: 18292 - DNA, 19 bp, Artificial sequence
  Forward Primer
attgagtagccctggggtt

SEQ ID NO: 18293 - DNA, 25 bp, Artificial sequence
  Forward Primer
tataactatttctcactccaccagg

SEQ ID NO: 18294 - DNA, 26 bp, Artificial sequence
  Forward Primer
aaaaaattactcccagaactcagtaa

SEQ ID NO: 18295 - DNA, 18 bp, Artificial sequence
  Forward Primer
actgcaggaggagaccgc

SEQ ID NO: 18296 - DNA, 18 bp, Artificial sequence
  Forward Primer
gggcactgggatgagctg

SEQ ID NO: 18297 - DNA, 21 bp, Artificial sequence
  Forward Primer
ttaagggaactgagttgtcat

SEQ ID NO: 18298 - DNA, 18 bp, Artificial sequence
  Forward Primer
atcaggaagccaagaccc

SEQ ID NO: 18299 - DNA, 28 bp, Artificial sequence
  Forward Primer
ataattaaagtaggaaatgtacatgcaa

SEQ ID NO: 18300 - DNA, 18 bp, Artificial sequence
  Forward Primer
aagtcccctctcccttcc

SEQ ID NO: 18301 - DNA, 25 bp, Artificial sequence
  Forward Primer
atatcagtgattgtactgaccacaa

SEQ ID NO: 18302 - DNA, 19 bp, Artificial sequence
  Forward Primer
tctgggaggagtgagacat

SEQ ID NO: 18303 - DNA, 22 bp, Artificial sequence
  Forward Primer
caggacattaccttaaactctg

SEQ ID NO: 18304 - DNA, 24 bp, Artificial sequence
  Forward Primer
agttactttgtakagctatcatgc

SEQ ID NO: 18305 - DNA, 19 bp, Artificial sequence
  Forward Primer
aggtgatcacagaggaggt

SEQ ID NO: 18306 - DNA, 23 bp, Artificial sequence
  Forward Primer
tatgtgacccaayaaatctcctc

SEQ ID NO: 18307 - DNA, 20 bp, Artificial sequence
  Forward Primer
atctccccagcctactgagt

SEQ ID NO: 18308 - DNA, 19 bp, Artificial sequence
  Forward Primer
taatttcgcatggctctga

SEQ ID NO: 18309 - DNA, 22 bp, Artificial sequence
  Forward Primer
attatgtgggcattttcttgtt

SEQ ID NO: 18310 - DNA, 21 bp, Artificial sequence
  Forward Primer
tcagtcgctaagcactgtctt

SEQ ID NO: 18311 - DNA, 27 bp, Artificial sequence
  Forward Primer
tatccagtaaattagtctctagcactc

SEQ ID NO: 18312 - DNA, 27 bp, Artificial sequence
  Forward Primer
atatttaaagcttttaagaggtcttcc

SEQ ID NO: 18313 - DNA, 18 bp, Artificial sequence
  Forward Primer
ttgcagaagtgctcccag

SEQ ID NO: 18314 - DNA, 21 bp, Artificial sequence
  Forward Primer
aaatgcaaaaargctgtgatg

SEQ ID NO: 18315 - DNA, 25 bp, Artificial sequence
  Forward Primer
tgtctcaattaatgtgatatctctg

SEQ ID NO: 18316 - DNA, 21 bp, Artificial sequence
  Forward Primer
tttcattcactcagcatcaca

SEQ ID NO: 18317 - DNA, 20 bp, Artificial sequence
  Forward Primer
tctactggctggtttttaac

SEQ ID NO: 18318 - DNA, 23 bp, Artificial sequence
  Forward Primer
taaccctaagtctcagttccagc

SEQ ID NO: 18319 - DNA, 25 bp, Artificial sequence
  Forward Primer
aatgaataaggacaactcttcaaca

SEQ ID NO: 18320 - DNA, 21 bp, Artificial sequence
  Forward Primer
ccaggcagaattagrtcaaaa

SEQ ID NO: 18321 - DNA, 19 bp, Artificial sequence
  Forward Primer
gagactggggcaaagattt

SEQ ID NO: 18322 - DNA, 18 bp, Artificial sequence
  Forward Primer
gaccaccagggaggtacc

SEQ ID NO: 18323 - DNA, 23 bp, Artificial sequence
  Forward Primer
aataaattagtcttcccagctgc

SEQ ID NO: 18324 - DNA, 19 bp, Artificial sequence
  Forward Primer
gttgctggaggaactccaa

SEQ ID NO: 18325 - DNA, 22 bp, Artificial sequence
  Forward Primer
aaaagtgctgtgcagtgataca

SEQ ID NO: 18326 - DNA, 27 bp, Artificial sequence
  Forward Primer
atggttattttactagattcaaccaga

SEQ ID NO: 18327 - DNA, 23 bp, Artificial sequence
  Forward Primer
aaatgcagatttgctactgttct

SEQ ID NO: 18328 - DNA, 26 bp, Artificial sequence
  Forward Primer
attttaaatattatcagccagcttca

SEQ ID NO: 18329 - DNA, 18 bp, Artificial sequence
  Forward Primer
tcactgctcaccttgcca

SEQ ID NO: 18330 - DNA, 24 bp, Artificial sequence
  Forward Primer
agatgagataatgtgaaggttggt

SEQ ID NO: 18331 - DNA, 18 bp, Artificial sequence
  Forward Primer
ccagaccaagagggctct

SEQ ID NO: 18332 - DNA, 26 bp, Artificial sequence
  Forward Primer
aaggtacaaacacttgagaataagag

SEQ ID NO: 18333 - DNA, 25 bp, Artificial sequence
  Forward Primer
attactgttgcatttacctagagct

SEQ ID NO: 18334 - DNA, 25 bp, Artificial sequence
  Forward Primer
aatactgatggagtcatagaaccag

SEQ ID NO: 18335 - DNA, 18 bp, Artificial sequence
  Forward Primer
agacaggaggccttctcc

SEQ ID NO: 18336 - DNA, 18 bp, Artificial sequence
  Forward Primer
agagggagggcaagggca

SEQ ID NO: 18337 - DNA, 22 bp, Artificial sequence
  Forward Primer
ttaaatgatggttggcattttt

SEQ ID NO: 18338 - DNA, 28 bp, Artificial sequence
  Forward Primer
cttttttcaaatgttatgataaacactc

SEQ ID NO: 18339 - DNA, 22 bp, Artificial sequence
  Forward Primer
aaaagtgaygtgtcattccaaa

SEQ ID NO: 18340 - DNA, 27 bp, Artificial sequence
  Forward Primer
acatattaccaaaattgactcaaaaac

SEQ ID NO: 18341 - DNA, 19 bp, Artificial sequence
  Forward Primer
aggtgggacctgatcatat

SEQ ID NO: 18342 - DNA, 19 bp, Artificial sequence
  Forward Primer
tgcacaagaatccttcgaa

SEQ ID NO: 18343 - DNA, 18 bp, Artificial sequence
  Forward Primer
aaatgggggaagggagtc

SEQ ID NO: 18344 - DNA, 27 bp, Artificial sequence
  Forward Primer
atatttgaaacaagggtaatatgtcag

SEQ ID NO: 18345 - DNA, 25 bp, Artificial sequence
  Forward Primer
aaagtagactaaagaaaaaatgccc

SEQ ID NO: 18346 - DNA, 19 bp, Artificial sequence
  Forward Primer
tctcatgcattggcagatg

SEQ ID NO: 18347 - DNA, 25 bp, Artificial sequence
  Forward Primer
tctacactatgatcatgaatggacc

SEQ ID NO: 18348 - DNA, 18 bp, Artificial sequence
  Forward Primer
tttccttggtttcaggcg

SEQ ID NO: 18349 - DNA, 23 bp, Artificial sequence
  Forward Primer
tttaacacacccttttagctcac

SEQ ID NO: 18350 - DNA, 26 bp, Artificial sequence
  Forward Primer
aaagtcctcaaagtagaagactaggg

SEQ ID NO: 18351 - DNA, 20 bp, Artificial sequence
  Forward Primer
tgaatgcagacggagatttt

SEQ ID NO: 18352 - DNA, 23 bp, Artificial sequence
  Forward Primer
ttttgtttaaaaactcagggctt

SEQ ID NO: 18353 - DNA, 22 bp, Artificial sequence
  Forward Primer
tatttcccctgatacctgagaa

SEQ ID NO: 18354 - DNA, 23 bp, Artificial sequence
  Forward Primer
tatatattgcaaagcaatgtgcg

SEQ ID NO: 18355 - DNA, 24 bp, Artificial sequence
  Forward Primer
ttaaaagtaaactggattcatgat

SEQ ID NO: 18356 - DNA, 19 bp, Artificial sequence
  Forward Primer
agggaagggtactsattgg

SEQ ID NO: 18357 - DNA, 27 bp, Artificial sequence
  Forward Primer
tgccttgaaacttataaaaatgttact

SEQ ID NO: 18358 - DNA, 18 bp, Artificial sequence
  Forward Primer
aaagtgggggatggaaag

SEQ ID NO: 18359 - DNA, 27 bp, Artificial sequence
  Forward Primer
tccacactcaactttctagattttaat

SEQ ID NO: 18360 - DNA, 21 bp, Artificial sequence
  Forward Primer
agctgacagaagagggatagg

SEQ ID NO: 18361 - DNA, 22 bp, Artificial sequence
  Forward Primer
ttgcttagttctaccaggaagg

SEQ ID NO: 18362 - DNA, 20 bp, Artificial sequence
  Forward Primer
aaatggtggctcagagtttg

SEQ ID NO: 18363 - DNA, 23 bp, Artificial sequence
  Forward Primer
tagaatgctacctaaagcatgca

SEQ ID NO: 18364 - DNA, 21 bp, Artificial sequence
  Forward Primer
atagaaggaggtcggtatgga

SEQ ID NO: 18365 - DNA, 21 bp, Artificial sequence
  Forward Primer
ttaggaactgagagcaggaat

SEQ ID NO: 18366 - DNA, 20 bp, Artificial sequence
  Forward Primer
accaaatgatgagtcagcta

SEQ ID NO: 18367 - DNA, 23 bp, Artificial sequence
  Forward Primer
taaaagcaagacttaccctgttg

SEQ ID NO: 18368 - DNA, 28 bp, Artificial sequence
  Forward Primer
ttttgaaattattagagattcttaggtg

SEQ ID NO: 18369 - DNA, 29 bp, Artificial sequence
  Forward Primer
tagatatcacgatgtctaaatacatagga

SEQ ID NO: 18370 - DNA, 23 bp, Artificial sequence
  Forward Primer
ggaaaaagagtcacattggattt

SEQ ID NO: 18371 - DNA, 22 bp, Artificial sequence
  Forward Primer
ctaggagtaagatcaaagcact

SEQ ID NO: 18372 - DNA, 19 bp, Artificial sequence
  Forward Primer
gtccaggcatgtggatttc

SEQ ID NO: 18373 - DNA, 18 bp, Artificial sequence
  Forward Primer
aaacctgggcttggaaaa

SEQ ID NO: 18374 - DNA, 29 bp, Artificial sequence
  Forward Primer
ttatatactcactcctgttttagtccatc

SEQ ID NO: 18375 - DNA, 20 bp, Artificial sequence
  Forward Primer
tagctgtggagggaataatc

SEQ ID NO: 18376 - DNA, 20 bp, Artificial sequence
  Forward Primer
aagcactgtctccagagtaa

SEQ ID NO: 18377 - DNA, 21 bp, Artificial sequence
  Forward Primer
ataatatcaggggctttggag

SEQ ID NO: 18378 - DNA, 22 bp, Artificial sequence
  Forward Primer
agagttcccattgctagagtat

SEQ ID NO: 18379 - DNA, 19 bp, Artificial sequence
  Forward Primer
tgatgtacttgcccaggtc

SEQ ID NO: 18380 - DNA, 20 bp, Artificial sequence
  Forward Primer
tcgacactttcattcatccc

SEQ ID NO: 18381 - DNA, 25 bp, Artificial sequence
  Forward Primer
aaaagcccacttataattgattgta

SEQ ID NO: 18382 - DNA, 22 bp, Artificial sequence
  Forward Primer
tccctattttcagaggagaact

SEQ ID NO: 18383 - DNA, 25 bp, Artificial sequence
  Forward Primer
atgattagcaaattgatagatggag

SEQ ID NO: 18384 - DNA, 18 bp, Artificial sequence
  Forward Primer
tgcggcagaggcttcaca

SEQ ID NO: 18385 - DNA, 25 bp, Artificial sequence
  Forward Primer
aggaacgatagagataaactaaaag

SEQ ID NO: 18386 - DNA, 22 bp, Artificial sequence
  Forward Primer
aaaaaatttgcagtagcctgtt

SEQ ID NO: 18387 - DNA, 20 bp, Artificial sequence
  Forward Primer
agaccttgctctcctctctg

SEQ ID NO: 18388 - DNA, 21 bp, Artificial sequence
  Forward Primer
agttctgccaggatctcactt

SEQ ID NO: 18389 - DNA, 20 bp, Artificial sequence
  Forward Primer
aaactgtacagcgaggtcca

SEQ ID NO: 18390 - DNA, 20 bp, Artificial sequence
  Forward Primer
attcctttrctgagcttggg

SEQ ID NO: 18391 - DNA, 19 bp, Artificial sequence
  Forward Primer
tccaktcgcctttcttctc

SEQ ID NO: 18392 - DNA, 18 bp, Artificial sequence
  Forward Primer
taggtttccccaggcagg

SEQ ID NO: 18393 - DNA, 28 bp, Artificial sequence
  Forward Primer
aatagatggttcttatcctaatgttctt

SEQ ID NO: 18394 - DNA, 18 bp, Artificial sequence
  Forward Primer
ttctccttggggattggt

SEQ ID NO: 18395 - DNA, 27 bp, Artificial sequence
  Forward Primer
aaactaaaactgttttctttcacattc

SEQ ID NO: 18396 - DNA, 20 bp, Artificial sequence
  Forward Primer
acaaagttcgacttgctgct

SEQ ID NO: 18397 - DNA, 28 bp, Artificial sequence
  Forward Primer
aaaacaaaagcagtacagtatagttaaa

SEQ ID NO: 18398 - DNA, 25 bp, Artificial sequence
  Forward Primer
acattcagctacaggaaaaataaaa

SEQ ID NO: 18399 - DNA, 19 bp, Artificial sequence
  Forward Primer
caaatcacactttcccctc

SEQ ID NO: 18400 - DNA, 28 bp, Artificial sequence
  Forward Primer
ctatgttagaaaagaatgaatttgaaac

SEQ ID NO: 18401 - DNA, 22 bp, Artificial sequence
  Forward Primer
cagtttcagctacacatttaaa

SEQ ID NO: 18402 - DNA, 18 bp, Artificial sequence
  Forward Primer
gtcccctccccacctttg

SEQ ID NO: 18403 - DNA, 21 bp, Artificial sequence
  Forward Primer
acagcaagcttgaatactcag

SEQ ID NO: 18404 - DNA, 24 bp, Artificial sequence
  Forward Primer
ataaatgggattaattgcatagca

SEQ ID NO: 18405 - DNA, 25 bp, Artificial sequence
  Forward Primer
tcatgagtttgcaaatttaataacg

SEQ ID NO: 18406 - DNA, 26 bp, Artificial sequence
  Forward Primer
tagagaaaaccacagctaaatgataa

SEQ ID NO: 18407 - DNA, 24 bp, Artificial sequence
  Forward Primer
aaagatccacaattgttcaagagt

SEQ ID NO: 18408 - DNA, 25 bp, Artificial sequence
  Forward Primer
ttttactaataagcagcaatcttcc

SEQ ID NO: 18409 - DNA, 18 bp, Artificial sequence
  Forward Primer
ttccagcccccactgagg

SEQ ID NO: 18410 - DNA, 22 bp, Artificial sequence
  Forward Primer
aataatcacagcctggatttcc

SEQ ID NO: 18411 - DNA, 22 bp, Artificial sequence
  Forward Primer
atactgaggaagcgcaaataga

SEQ ID NO: 18412 - DNA, 28 bp, Artificial sequence
  Forward Primer
aaatgacacatgagattctgtagataag

SEQ ID NO: 18413 - DNA, 25 bp, Artificial sequence
  Forward Primer
tatcattggatcaaggtaataaagg

SEQ ID NO: 18414 - DNA, 26 bp, Artificial sequence
  Forward Primer
aaataaaagattcttcgatgtcactt

SEQ ID NO: 18415 - DNA, 20 bp, Artificial sequence
  Forward Primer
atggactcatttgggtgttg

SEQ ID NO: 18416 - DNA, 25 bp, Artificial sequence
  Forward Primer
ttgtatactgtgtacttcatgggtg

SEQ ID NO: 18417 - DNA, 28 bp, Artificial sequence
  Forward Primer
gggataataaaccawtattatascatca

SEQ ID NO: 18418 - DNA, 28 bp, Artificial sequence
  Forward Primer
gtgtttggatactttgtcttgttatatt

SEQ ID NO: 18419 - DNA, 27 bp, Artificial sequence
  Forward Primer
taaaatcccagaggtttagttctagtt

SEQ ID NO: 18420 - DNA, 21 bp, Artificial sequence
  Forward Primer
tgatttcaggatgatgcaaat

SEQ ID NO: 18421 - DNA, 25 bp, Artificial sequence
  Forward Primer
ataaaaaatcaaccattgcatagac

SEQ ID NO: 18422 - DNA, 19 bp, Artificial sequence
  Forward Primer
aggaaggcacaaccaagaa

SEQ ID NO: 18423 - DNA, 24 bp, Artificial sequence
  Forward Primer
ttagagaaatgaaggaacttgtcc

SEQ ID NO: 18424 - DNA, 22 bp, Artificial sequence
  Forward Primer
tgatggagactgaatttaaagt

SEQ ID NO: 18425 - DNA, 26 bp, Artificial sequence
  Forward Primer
atatgccctaatctctgttactgatt

SEQ ID NO: 18426 - DNA, 30 bp, Artificial sequence
  Forward Primer
taattatctctattgtagagggctattatg

SEQ ID NO: 18427 - DNA, 23 bp, Artificial sequence
  Forward Primer
ttagataagggaatggctgaatt

SEQ ID NO: 18428 - DNA, 30 bp, Artificial sequence
  Forward Primer
tgggatactatacacctataaaatgaataa

SEQ ID NO: 18429 - DNA, 27 bp, Artificial sequence
  Forward Primer
taacatttctatcttgctaaagcatct

SEQ ID NO: 18430 - DNA, 28 bp, Artificial sequence
  Forward Primer
ataattttaaagaataagccttgaaagg

SEQ ID NO: 18431 - DNA, 22 bp, Artificial sequence
  Forward Primer
tttgagtggagactgagaactg

SEQ ID NO: 18432 - DNA, 30 bp, Artificial sequence
  Forward Primer
atattgtgatatacagatgttttctacttc

SEQ ID NO: 18433 - DNA, 18 bp, Artificial sequence
  Forward Primer
aaagtcccctgggaggtg

SEQ ID NO: 18434 - DNA, 25 bp, Artificial sequence
  Forward Primer
tgttcttgagacttcatatagaaaa

SEQ ID NO: 18435 - DNA, 30 bp, Artificial sequence
  Forward Primer
ttataatgcagtaatatttcactagtattc

SEQ ID NO: 18436 - DNA, 18 bp, Artificial sequence
  Forward Primer
tctttccagacccaggag

SEQ ID NO: 18437 - DNA, 24 bp, Artificial sequence
  Forward Primer
ataatgaatgcttccatttcaact

SEQ ID NO: 18438 - DNA, 18 bp, Artificial sequence
  Forward Primer
gtgggtgggctcccttag

SEQ ID NO: 18439 - DNA, 25 bp, Artificial sequence
  Forward Primer
ccttaagttccagctttacattttt

SEQ ID NO: 18440 - DNA, 19 bp, Artificial sequence
  Forward Primer
ttggctgaagtcctttgat

SEQ ID NO: 18441 - DNA, 20 bp, Artificial sequence
  Forward Primer
acmggaagtgttcaggtttc

SEQ ID NO: 18442 - DNA, 18 bp, Artificial sequence
  Forward Primer
agccgtggtgtyatcagg

SEQ ID NO: 18443 - DNA, 20 bp, Artificial sequence
  Forward Primer
tttgatctccttgctgtcca

SEQ ID NO: 18444 - DNA, 19 bp, Artificial sequence
  Forward Primer
tgcctttttcaggagttgc

SEQ ID NO: 18445 - DNA, 20 bp, Artificial sequence
  Forward Primer
tacacgctgatggatgatta

SEQ ID NO: 18446 - DNA, 19 bp, Artificial sequence
  Forward Primer
atgtcgcccttctattgga

SEQ ID NO: 18447 - DNA, 19 bp, Artificial sequence
  Forward Primer
attggtctccctcgtcctc

SEQ ID NO: 18448 - DNA, 23 bp, Artificial sequence
  Forward Primer
agccatcattgtcttgaaaatta

SEQ ID NO: 18449 - DNA, 23 bp, Artificial sequence
  Forward Primer
aacgtgtagaacaatttgcctag

SEQ ID NO: 18450 - DNA, 18 bp, Artificial sequence
  Forward Primer
tggaatctcaggatggca

SEQ ID NO: 18451 - DNA, 24 bp, Artificial sequence
  Forward Primer
aatggttgtaccttgtgaagaact

SEQ ID NO: 18452 - DNA, 23 bp, Artificial sequence
  Forward Primer
ttttatctccaacccaagacttt

SEQ ID NO: 18453 - DNA, 18 bp, Artificial sequence
  Forward Primer
cctcccagtggcctcttt

SEQ ID NO: 18454 - DNA, 24 bp, Artificial sequence
  Forward Primer
tatttatgcatgtgtgtgttcaaa

SEQ ID NO: 18455 - DNA, 24 bp, Artificial sequence
  Forward Primer
agcagacactttaacacacataaa

SEQ ID NO: 18456 - DNA, 19 bp, Artificial sequence
  Forward Primer
tcagcatcagagcgtttgt

SEQ ID NO: 18457 - DNA, 26 bp, Artificial sequence
  Forward Primer
acagagctattacagaattacatgca

SEQ ID NO: 18458 - DNA, 19 bp, Artificial sequence
  Forward Primer
tcctaggttcaagcgttcc

SEQ ID NO: 18459 - DNA, 23 bp, Artificial sequence
  Forward Primer
tggctaaacactaactttaacaa

SEQ ID NO: 18460 - DNA, 30 bp, Artificial sequence
  Forward Primer
agattatataggctttagaaaacaaagttc

SEQ ID NO: 18461 - DNA, 27 bp, Artificial sequence
  Forward Primer
aagcatgaaaagaataacagaaattac

SEQ ID NO: 18462 - DNA, 21 bp, Artificial sequence
  Forward Primer
ttttttgcaagcttctctcag

SEQ ID NO: 18463 - DNA, 20 bp, Artificial sequence
  Forward Primer
aggaacttggctggtttctg

SEQ ID NO: 18464 - DNA, 19 bp, Artificial sequence
  Forward Primer
tggagcagtagcatcgtca

SEQ ID NO: 18465 - DNA, 28 bp, Artificial sequence
  Forward Primer
attatcttttagctgagaatagctatca

SEQ ID NO: 18466 - DNA, 26 bp, Artificial sequence
  Forward Primer
tccctaaagaaaaacatacttttgat

SEQ ID NO: 18467 - DNA, 24 bp, Artificial sequence
  Forward Primer
agagccagggagaaatactatagg

SEQ ID NO: 18468 - DNA, 23 bp, Artificial sequence
  Forward Primer
tatatcaccagagaacctccaga

SEQ ID NO: 18469 - DNA, 24 bp, Artificial sequence
  Forward Primer
ttaaaatgtgcaagttctatggac

SEQ ID NO: 18470 - DNA, 24 bp, Artificial sequence
  Forward Primer
aaatttgtttcaagattcttttcc

SEQ ID NO: 18471 - DNA, 26 bp, Artificial sequence
  Forward Primer
aattaatttctcgcctatatgagatg

SEQ ID NO: 18472 - DNA, 24 bp, Artificial sequence
  Forward Primer
aaaaacttttgttttgaaatgtgc

SEQ ID NO: 18473 - DNA, 20 bp, Artificial sequence
  Forward Primer
taggccagactagggatctg

SEQ ID NO: 18474 - DNA, 23 bp, Artificial sequence
  Forward Primer
ttaaagaacagaaggctcctttg

SEQ ID NO: 18475 - DNA, 19 bp, Artificial sequence
  Forward Primer
aggagcaaatccaagttcc

SEQ ID NO: 18476 - DNA, 21 bp, Artificial sequence
  Forward Primer
ataatacattcctgtggccct

SEQ ID NO: 18477 - DNA, 26 bp, Artificial sequence
  Forward Primer
aaatacctgaatgcagatttaatgtt

SEQ ID NO: 18478 - DNA, 19 bp, Artificial sequence
  Forward Primer
tatgtggaagtgacaggaa

SEQ ID NO: 18479 - DNA, 19 bp, Artificial sequence
  Forward Primer
tcattggaaagtgtccagg

SEQ ID NO: 18480 - DNA, 26 bp, Artificial sequence
  Forward Primer
tatgatagcatacttcttaaacctgg

SEQ ID NO: 18481 - DNA, 22 bp, Artificial sequence
  Forward Primer
tagcraatgtaatttctctggc

SEQ ID NO: 18482 - DNA, 20 bp, Artificial sequence
  Forward Primer
tactcctgctcgttagccaa

SEQ ID NO: 18483 - DNA, 26 bp, Artificial sequence
  Forward Primer
ttaacagaaattatcagcatcctatc

SEQ ID NO: 18484 - DNA, 26 bp, Artificial sequence
  Forward Primer
ccatatgaataatactatttgttcca

SEQ ID NO: 18485 - DNA, 18 bp, Artificial sequence
  Forward Primer
ccggagaagagcgtcctt

SEQ ID NO: 18486 - DNA, 19 bp, Artificial sequence
  Forward Primer
aagaattgaaagggcttct

SEQ ID NO: 18487 - DNA, 28 bp, Artificial sequence
  Forward Primer
attcctgagtagagttggaatttattaa

SEQ ID NO: 18488 - DNA, 30 bp, Artificial sequence
  Forward Primer
aaagtttaattatacactaaatggtaacca

SEQ ID NO: 18489 - DNA, 19 bp, Artificial sequence
  Forward Primer
taaggcagtgacaggcaga

SEQ ID NO: 18490 - DNA, 24 bp, Artificial sequence
  Forward Primer
ttatttcatgccctaagtatggat

SEQ ID NO: 18491 - DNA, 26 bp, Artificial sequence
  Forward Primer
aattgcaaagctataaccataatgta

SEQ ID NO: 18492 - DNA, 21 bp, Artificial sequence
  Forward Primer
atatacggccagaccaaaaca

SEQ ID NO: 18493 - DNA, 30 bp, Artificial sequence
  Forward Primer
ataaataaagttctattgaaacacagtcac

SEQ ID NO: 18494 - DNA, 21 bp, Artificial sequence
  Forward Primer
ttgatttttctgtttcgctgt

SEQ ID NO: 18495 - DNA, 20 bp, Artificial sequence
  Forward Primer
agtagcacccctgttcattc

SEQ ID NO: 18496 - DNA, 24 bp, Artificial sequence
  Forward Primer
atttaacagagggcgttactaatg

SEQ ID NO: 18497 - DNA, 25 bp, Artificial sequence
  Forward Primer
aaacaaggagcacagtttaaagata

SEQ ID NO: 18498 - DNA, 26 bp, Artificial sequence
  Forward Primer
atcagtattaggaatatgggttttga

SEQ ID NO: 18499 - DNA, 24 bp, Artificial sequence
  Forward Primer
atatcattgtcgtttcagagtgtg

SEQ ID NO: 18500 - DNA, 19 bp, Artificial sequence
  Forward Primer
tactcatggaagctggcag

SEQ ID NO: 18501 - DNA, 24 bp, Artificial sequence
  Forward Primer
ataggtaggtgatggatactgctt

SEQ ID NO: 18502 - DNA, 19 bp, Artificial sequence
  Forward Primer
tttttcacytgtctgatgg

SEQ ID NO: 18503 - DNA, 18 bp, Artificial sequence
  Forward Primer
atggcctgggtggggctt

SEQ ID NO: 18504 - DNA, 20 bp, Artificial sequence
  Forward Primer
gacaagtctgaatattgcca

SEQ ID NO: 18505 - DNA, 26 bp, Artificial sequence
  Forward Primer
ctataaatgtcctctctgacatctgt

SEQ ID NO: 18506 - DNA, 19 bp, Artificial sequence
  Forward Primer
tcggtcctcatgtcatgtt

SEQ ID NO: 18507 - DNA, 25 bp, Artificial sequence
  Forward Primer
atgaaggtagaatcttcacttaaca

SEQ ID NO: 18508 - DNA, 26 bp, Artificial sequence
  Forward Primer
tgtgtaatggacatttaaactgtttc

SEQ ID NO: 18509 - DNA, 23 bp, Artificial sequence
  Forward Primer
aagctgtttaatctcttgtgtgc

SEQ ID NO: 18510 - DNA, 25 bp, Artificial sequence
  Forward Primer
attcattgctgagtcatatctcatt

SEQ ID NO: 18511 - DNA, 29 bp, Artificial sequence
  Forward Primer
tctctactgaaagtgttattrtaaaggaa

SEQ ID NO: 18512 - DNA, 19 bp, Artificial sequence
  Forward Primer
ccacagagcaagaggtatc

SEQ ID NO: 18513 - DNA, 25 bp, Artificial sequence
  Forward Primer
ataagaaatgacacacacagttgac

SEQ ID NO: 18514 - DNA, 23 bp, Artificial sequence
  Forward Primer
ccagagtactaaacagagaggtt

SEQ ID NO: 18515 - DNA, 21 bp, Artificial sequence
  Forward Primer
attgggtttagttgttttctc

SEQ ID NO: 18516 - DNA, 23 bp, Artificial sequence
  Forward Primer
aaaaatagccttgggtcttatca

SEQ ID NO: 18517 - DNA, 22 bp, Artificial sequence
  Forward Primer
aaaactaatgcatcaacttgca

SEQ ID NO: 18518 - DNA, 26 bp, Artificial sequence
  Forward Primer
aaaaatgctttctcttaaaaacagtc

SEQ ID NO: 18519 - DNA, 19 bp, Artificial sequence
  Forward Primer
ggagactgggaaggagact

SEQ ID NO: 18520 - DNA, 19 bp, Artificial sequence
  Forward Primer
tttgaaggagccacaggtc

SEQ ID NO: 18521 - DNA, 18 bp, Artificial sequence
  Forward Primer
ttcratcaccaggcaagg

SEQ ID NO: 18522 - DNA, 21 bp, Artificial sequence
  Forward Primer
atttttccctttcctctcctg

SEQ ID NO: 18523 - DNA, 25 bp, Artificial sequence
  Forward Primer
agtcgtctraagaaaagtgaagatt

SEQ ID NO: 18524 - DNA, 30 bp, Artificial sequence
  Forward Primer
actcacaaagcttattactattattgaaga

SEQ ID NO: 18525 - DNA, 26 bp, Artificial sequence
  Forward Primer
aaatttctctttgctattttcacatc

SEQ ID NO: 18526 - DNA, 20 bp, Artificial sequence
  Forward Primer
aaacaaaggcctgagtcacc

SEQ ID NO: 18527 - DNA, 23 bp, Artificial sequence
  Forward Primer
tagatgggaagagcattaataca

SEQ ID NO: 18528 - DNA, 20 bp, Artificial sequence
  Forward Primer
tggtggacactaagggaaga

SEQ ID NO: 18529 - DNA, 19 bp, Artificial sequence
  Forward Primer
ttccctggtgatcaaatgg

SEQ ID NO: 18530 - DNA, 18 bp, Artificial sequence
  Forward Primer
ttcatcatggcctcctcc

SEQ ID NO: 18531 - DNA, 28 bp, Artificial sequence
  Forward Primer
ttttattatgtaagatgtgagttcatga

SEQ ID NO: 18532 - DNA, 21 bp, Artificial sequence
  Forward Primer
tgaagaactcggatgacatct

SEQ ID NO: 18533 - DNA, 23 bp, Artificial sequence
  Forward Primer
ttttgatacatgagactttggct

SEQ ID NO: 18534 - DNA, 25 bp, Artificial sequence
  Forward Primer
tttattttcctctttctcatctgaa

SEQ ID NO: 18535 - DNA, 27 bp, Artificial sequence
  Forward Primer
cttcaatraagttacattgttttcatc

SEQ ID NO: 18536 - DNA, 23 bp, Artificial sequence
  Forward Primer
aaaatttgtcgatgaaaactgtc

SEQ ID NO: 18537 - DNA, 26 bp, Artificial sequence
  Forward Primer
agataaacaaaacaagcattcatagc

SEQ ID NO: 18538 - DNA, 23 bp, Artificial sequence
  Forward Primer
taggcagaattgttattttacat

SEQ ID NO: 18539 - DNA, 20 bp, Artificial sequence
  Forward Primer
tgaccaaagtatggcagctt

SEQ ID NO: 18540 - DNA, 20 bp, Artificial sequence
  Forward Primer
ttagaaaaccgctggtgttg

SEQ ID NO: 18541 - DNA, 19 bp, Artificial sequence
  Forward Primer
aaatccagagcctggtatg

SEQ ID NO: 18542 - DNA, 27 bp, Artificial sequence
  Forward Primer
caagtgtatcttaagaatatcctagtg

SEQ ID NO: 18543 - DNA, 30 bp, Artificial sequence
  Forward Primer
ttattctacagttgttcttatttatttagg

SEQ ID NO: 18544 - DNA, 21 bp, Artificial sequence
  Forward Primer
aacagctgaacaacaagagag

SEQ ID NO: 18545 - DNA, 22 bp, Artificial sequence
  Forward Primer
tttattgctgtatccacaaggg

SEQ ID NO: 18546 - DNA, 28 bp, Artificial sequence
  Forward Primer
gtataattgccaaagtaactatcaaaca

SEQ ID NO: 18547 - DNA, 27 bp, Artificial sequence
  Forward Primer
attcttgacaaaaaataatgaggtatg

SEQ ID NO: 18548 - DNA, 25 bp, Artificial sequence
  Forward Primer
aaaaatcatgtgtaacattcaggtt

SEQ ID NO: 18549 - DNA, 29 bp, Artificial sequence
  Forward Primer
tttctttctataggtattttgactcagag

SEQ ID NO: 18550 - DNA, 19 bp, Artificial sequence
  Forward Primer
tactgtcctgtgatgccgt

SEQ ID NO: 18551 - DNA, 18 bp, Artificial sequence
  Forward Primer
atctggtggccaaggccg

SEQ ID NO: 18552 - DNA, 21 bp, Artificial sequence
  Forward Primer
aacagtgaaggaatcatccca

SEQ ID NO: 18553 - DNA, 19 bp, Artificial sequence
  Forward Primer
gatcacaggaagtggacga

SEQ ID NO: 18554 - DNA, 22 bp, Artificial sequence
  Forward Primer
ttaaattctccaggtcacacag

SEQ ID NO: 18555 - DNA, 18 bp, Artificial sequence
  Forward Primer
gcggacacagtggttttc

SEQ ID NO: 18556 - DNA, 22 bp, Artificial sequence
  Forward Primer
ctgatcagatctggttaaaggc

SEQ ID NO: 18557 - DNA, 20 bp, Artificial sequence
  Forward Primer
atgtctgaagcagtgaagaa

SEQ ID NO: 18558 - DNA, 26 bp, Artificial sequence
  Forward Primer
tttaaaatcatgttatttaacccacc

SEQ ID NO: 18559 - DNA, 24 bp, Artificial sequence
  Forward Primer
ttttcgttcttgctgaagtataac

SEQ ID NO: 18560 - DNA, 21 bp, Artificial sequence
  Forward Primer
aaaagaacctctctccccttt

SEQ ID NO: 18561 - DNA, 23 bp, Artificial sequence
  Forward Primer
ttatttaacccaccaatcaaatg

SEQ ID NO: 18562 - DNA, 24 bp, Artificial sequence
  Forward Primer
tctaattttcaacagatgaaagcc

SEQ ID NO: 18563 - DNA, 18 bp, Artificial sequence
  Forward Primer
tgctcctggaatgacagc

SEQ ID NO: 18564 - DNA, 24 bp, Artificial sequence
  Forward Primer
tgggtgaaatttgttttttagaat

SEQ ID NO: 18565 - DNA, 22 bp, Artificial sequence
  Forward Primer
actcgtccatcctgaataaaaa

SEQ ID NO: 18566 - DNA, 18 bp, Artificial sequence
  Forward Primer
gtgggaggactaggaggc

SEQ ID NO: 18567 - DNA, 23 bp, Artificial sequence
  Forward Primer
ataggcaggaaatatcctcttca

SEQ ID NO: 18568 - DNA, 18 bp, Artificial sequence
  Forward Primer
ttcgcctgctgttagctt

SEQ ID NO: 18569 - DNA, 23 bp, Artificial sequence
  Forward Primer
cagctcttagttgtgattaagtg

SEQ ID NO: 18570 - DNA, 19 bp, Artificial sequence
  Forward Primer
cagtacaaatgctggcacc

SEQ ID NO: 18571 - DNA, 28 bp, Artificial sequence
  Forward Primer
ttttaatttcctgaatcatttatctagc

SEQ ID NO: 18572 - DNA, 27 bp, Artificial sequence
  Forward Primer
tattattttcaaggggttaatagcata

SEQ ID NO: 18573 - DNA, 22 bp, Artificial sequence
  Forward Primer
tcagaggagagaatcacacacc

SEQ ID NO: 18574 - DNA, 21 bp, Artificial sequence
  Forward Primer
aaaagactcaaggtcagggac

SEQ ID NO: 18575 - DNA, 27 bp, Artificial sequence
  Forward Primer
tttaatttataagagaagcagaacgac

SEQ ID NO: 18576 - DNA, 18 bp, Artificial sequence
  Forward Primer
ttccctgtcaatgccagc

SEQ ID NO: 18577 - DNA, 24 bp, Artificial sequence
  Forward Primer
tttgagtaaaatttccaaaacagc

SEQ ID NO: 18578 - DNA, 24 bp, Artificial sequence
  Forward Primer
aagaaatgctaagattttccaaaa

SEQ ID NO: 18579 - DNA, 22 bp, Artificial sequence
  Forward Primer
accatcaagactcagctttctg

SEQ ID NO: 18580 - DNA, 19 bp, Artificial sequence
  Forward Primer
ctctcccacctcccataga

SEQ ID NO: 18581 - DNA, 19 bp, Artificial sequence
  Forward Primer
aacttagacccgaagcagc

SEQ ID NO: 18582 - DNA, 23 bp, Artificial sequence
  Forward Primer
tttaaaattttgccttcttttgg

SEQ ID NO: 18583 - DNA, 19 bp, Artificial sequence
  Forward Primer
tgcagttaattttgctgcg

SEQ ID NO: 18584 - DNA, 23 bp, Artificial sequence
  Forward Primer
ttgctgaattgtctctcttttca

SEQ ID NO: 18585 - DNA, 19 bp, Artificial sequence
  Forward Primer
aatcgaaccagggtctcct

SEQ ID NO: 18586 - DNA, 21 bp, Artificial sequence
  Forward Primer
ttgggaagaggtcttaggaaa

SEQ ID NO: 18587 - DNA, 18 bp, Artificial sequence
  Forward Primer
agtgccccctccttcctc

SEQ ID NO: 18588 - DNA, 28 bp, Artificial sequence
  Forward Primer
tttgcttacatttttagtagttctgaag

SEQ ID NO: 18589 - DNA, 19 bp, Artificial sequence
  Forward Primer
tgaggggaggctgtaaact

SEQ ID NO: 18590 - DNA, 28 bp, Artificial sequence
  Forward Primer
attcatagctctttagagaaaaagagaa

SEQ ID NO: 18591 - DNA, 27 bp, Artificial sequence
  Forward Primer
catactgcagaaattmttttcttaatg

SEQ ID NO: 18592 - DNA, 19 bp, Artificial sequence
  Forward Primer
tcagcacgtccacaaagtg

SEQ ID NO: 18593 - DNA, 23 bp, Artificial sequence
  Forward Primer
aatcaagacaatcaatcctttgt

SEQ ID NO: 18594 - DNA, 21 bp, Artificial sequence
  Forward Primer
aaattgcaggttaagaggagg

SEQ ID NO: 18595 - DNA, 20 bp, Artificial sequence
  Forward Primer
agtgagtgtcttggcatctg

SEQ ID NO: 18596 - DNA, 18 bp, Artificial sequence
  Forward Primer
caggatcacagcccccag

SEQ ID NO: 18597 - DNA, 20 bp, Artificial sequence
  Forward Primer
aatagtgtttgacggtgcct

SEQ ID NO: 18598 - DNA, 22 bp, Artificial sequence
  Forward Primer
agacatgactttgcaaatgaac

SEQ ID NO: 18599 - DNA, 27 bp, Artificial sequence
  Forward Primer
taaattataaatattaccagacgtccc

SEQ ID NO: 18600 - DNA, 18 bp, Artificial sequence
  Forward Primer
agatggctgaggcaccac

SEQ ID NO: 18601 - DNA, 18 bp, Artificial sequence
  Forward Primer
ccacttctcccagcccca

SEQ ID NO: 18602 - DNA, 27 bp, Artificial sequence
  Forward Primer
attatagagaaagtagaattcctgcac

SEQ ID NO: 18603 - DNA, 24 bp, Artificial sequence
  Forward Primer
agtgactgaacaacaacataaatt

SEQ ID NO: 18604 - DNA, 18 bp, Artificial sequence
  Forward Primer
agggctcaaaatcaggcc

SEQ ID NO: 18605 - DNA, 23 bp, Artificial sequence
  Forward Primer
aatgtaagcttaatgaaggcagg

SEQ ID NO: 18606 - DNA, 23 bp, Artificial sequence
  Forward Primer
agttaacattattagcgcagtgg

SEQ ID NO: 18607 - DNA, 23 bp, Artificial sequence
  Forward Primer
agttaagtgagaatcaatggctg

SEQ ID NO: 18608 - DNA, 24 bp, Artificial sequence
  Forward Primer
atataygcataatggatggatgtg

SEQ ID NO: 18609 - DNA, 30 bp, Artificial sequence
  Forward Primer
aataataatgaccaattttagaactgtact

SEQ ID NO: 18610 - DNA, 25 bp, Artificial sequence
  Forward Primer
aataaatactaggtcccacatctcc

SEQ ID NO: 18611 - DNA, 18 bp, Artificial sequence
  Forward Primer
ctgggtttgcagtttggc

SEQ ID NO: 18612 - DNA, 25 bp, Artificial sequence
  Forward Primer
taacaagttacaggaaaaatttggt

SEQ ID NO: 18613 - DNA, 30 bp, Artificial sequence
  Forward Primer
tacagaacaattaatcttttcttacgtatg

SEQ ID NO: 18614 - DNA, 23 bp, Artificial sequence
  Forward Primer
agctgaattgtaggcacttttta

SEQ ID NO: 18615 - DNA, 25 bp, Artificial sequence
  Forward Primer
ttgcccagaagaatattagtctcta

SEQ ID NO: 18616 - DNA, 30 bp, Artificial sequence
  Forward Primer
taagatatactgcattagcactattttagc

SEQ ID NO: 18617 - DNA, 25 bp, Artificial sequence
  Forward Primer
aaatttctccttttccttacacact

SEQ ID NO: 18618 - DNA, 24 bp, Artificial sequence
  Forward Primer
ttgacattattttttacctttgtg

SEQ ID NO: 18619 - DNA, 25 bp, Artificial sequence
  Forward Primer
tttttctctttactttgttttggtc

SEQ ID NO: 18620 - DNA, 27 bp, Artificial sequence
  Forward Primer
actctctgccagtatagtgaatactgt

SEQ ID NO: 18621 - DNA, 18 bp, Artificial sequence
  Forward Primer
aaggcccgcagtggacta

SEQ ID NO: 18622 - DNA, 27 bp, Artificial sequence
  Forward Primer
tttctcattcctttagtgtgaatatag

SEQ ID NO: 18623 - DNA, 25 bp, Artificial sequence
  Forward Primer
aaatgagctctttcacagtagctag

SEQ ID NO: 18624 - DNA, 28 bp, Artificial sequence
  Forward Primer
acctataaaatgaataagaaatgctttg

SEQ ID NO: 18625 - DNA, 27 bp, Artificial sequence
  Forward Primer
aaactaagtatttattaggagcccatt

SEQ ID NO: 18626 - DNA, 22 bp, Artificial sequence
  Forward Primer
taaagtaagcaggcttttgttg

SEQ ID NO: 18627 - DNA, 25 bp, Artificial sequence
  Forward Primer
cccaaaggacaaaaaagatattatt

SEQ ID NO: 18628 - DNA, 26 bp, Artificial sequence
  Forward Primer
tttatcctgatcagagagtcaattaa

SEQ ID NO: 18629 - DNA, 22 bp, Artificial sequence
  Forward Primer
tacagtgacacactcatccatg

SEQ ID NO: 18630 - DNA, 25 bp, Artificial sequence
  Forward Primer
aatttcaaacaatcatataggtcca

SEQ ID NO: 18631 - DNA, 27 bp, Artificial sequence
  Forward Primer
gctcttaacatcattcttgataatagg

SEQ ID NO: 18632 - DNA, 21 bp, Artificial sequence
  Forward Primer
agttagacagctgagggtaat

SEQ ID NO: 18633 - DNA, 27 bp, Artificial sequence
  Forward Primer
aaagctttttctctttatattccttgt

SEQ ID NO: 18634 - DNA, 23 bp, Artificial sequence
  Forward Primer
ttaagccaagaagaatctttacc

SEQ ID NO: 18635 - DNA, 27 bp, Artificial sequence
  Forward Primer
ttagtgatacctgaatagaactggatg

SEQ ID NO: 18636 - DNA, 24 bp, Artificial sequence
  Forward Primer
aaacatttgtctcattttgctata

SEQ ID NO: 18637 - DNA, 25 bp, Artificial sequence
  Forward Primer
gtagagatgtcctgaaaataattgc

SEQ ID NO: 18638 - DNA, 28 bp, Artificial sequence
  Forward Primer
ataaaaattagtaagatttacatgctgc

SEQ ID NO: 18639 - DNA, 23 bp, Artificial sequence
  Forward Primer
tggcaataaagatggatgattaa

SEQ ID NO: 18640 - DNA, 18 bp, Artificial sequence
  Forward Primer
mtttccccctccttctgg

SEQ ID NO: 18641 - DNA, 27 bp, Artificial sequence
  Forward Primer
ataagagcatgtgagatttataggata

SEQ ID NO: 18642 - DNA, 20 bp, Artificial sequence
  Forward Primer
aattcatttggtgtgcaaaa

SEQ ID NO: 18643 - DNA, 29 bp, Artificial sequence
  Forward Primer
aataaaaaaggtgtctactaaatgtgttg

SEQ ID NO: 18644 - DNA, 23 bp, Artificial sequence
  Forward Primer
tattttagagaacatgatgggga

SEQ ID NO: 18645 - DNA, 26 bp, Artificial sequence
  Forward Primer
acctctgatgttatgaagttcctagt

SEQ ID NO: 18646 - DNA, 25 bp, Artificial sequence
  Forward Primer
tatcttcaaagtagctgattcttct

SEQ ID NO: 18647 - DNA, 28 bp, Artificial sequence
  Forward Primer
taattgtgtaattttctgcaactactct

SEQ ID NO: 18648 - DNA, 25 bp, Artificial sequence
  Forward Primer
aagagaacagtgagtgatttttgaa

SEQ ID NO: 18649 - DNA, 24 bp, Artificial sequence
  Forward Primer
aaacatttagagccatttaaaccc

SEQ ID NO: 18650 - DNA, 25 bp, Artificial sequence
  Forward Primer
atatagagcacctactgacatcttt

SEQ ID NO: 18651 - DNA, 28 bp, Artificial sequence
  Forward Primer
ttttaagatttctctttcactctcataa

SEQ ID NO: 18652 - DNA, 21 bp, Artificial sequence
  Forward Primer
aaggggaaaaaacaaaacaaa

SEQ ID NO: 18653 - DNA, 19 bp, Artificial sequence
  Forward Primer
tttagggaatgttcagggg

SEQ ID NO: 18654 - DNA, 26 bp, Artificial sequence
  Forward Primer
gttaaaagagtattgaaggtcctcac

SEQ ID NO: 18655 - DNA, 18 bp, Artificial sequence
  Forward Primer
agcagtgaaccacagccc

SEQ ID NO: 18656 - DNA, 19 bp, Artificial sequence
  Forward Primer
aaatgtacccatgcctccc

SEQ ID NO: 18657 - DNA, 23 bp, Artificial sequence
  Forward Primer
tttaaatagtgaaaggccatgaa

SEQ ID NO: 18658 - DNA, 19 bp, Artificial sequence
  Forward Primer
tgtccttccaagctcacct

SEQ ID NO: 18659 - DNA, 26 bp, Artificial sequence
  Forward Primer
actttggaatagctgcttaaaaataa

SEQ ID NO: 18660 - DNA, 23 bp, Artificial sequence
  Forward Primer
tttttaatgtttccttgtggtcc

SEQ ID NO: 18661 - DNA, 20 bp, Artificial sequence
  Forward Primer
tttaaaagggaagctgctgg

SEQ ID NO: 18662 - DNA, 24 bp, Artificial sequence
  Forward Primer
ttgtgagaatgacttacaaggaga

SEQ ID NO: 18663 - DNA, 23 bp, Artificial sequence
  Forward Primer
tcagtttttaaagyagaggtgca

SEQ ID NO: 18664 - DNA, 23 bp, Artificial sequence
  Forward Primer
aagtttaaaggtgagaaagtgcc

SEQ ID NO: 18665 - DNA, 22 bp, Artificial sequence
  Forward Primer
acaattgttgagctgaaatttt

SEQ ID NO: 18666 - DNA, 23 bp, Artificial sequence
  Forward Primer
aaaagcacttgaaatgattcaaa

SEQ ID NO: 18667 - DNA, 23 bp, Artificial sequence
  Forward Primer
ttcatcccagagtaaaaatatca

SEQ ID NO: 18668 - DNA, 22 bp, Artificial sequence
  Forward Primer
atcatctccttgtctgtgttag

SEQ ID NO: 18669 - DNA, 19 bp, Artificial sequence
  Forward Primer
actgcccctgcacagtaat

SEQ ID NO: 18670 - DNA, 19 bp, Artificial sequence
  Forward Primer
aatgcaccttgaccctcac

SEQ ID NO: 18671 - DNA, 18 bp, Artificial sequence
  Forward Primer
tgctgcaggagagcccac

SEQ ID NO: 18672 - DNA, 21 bp, Artificial sequence
  Forward Primer
ttaccagagaggaaaagacct

SEQ ID NO: 18673 - DNA, 23 bp, Artificial sequence
  Forward Primer
ttttaaaaattcatgtgcaaacc

SEQ ID NO: 18674 - DNA, 18 bp, Artificial sequence
  Forward Primer
gcaagggactctactgcg

SEQ ID NO: 18675 - DNA, 20 bp, Artificial sequence
  Forward Primer
attatggtgatggttgcaca

SEQ ID NO: 18676 - DNA, 30 bp, Artificial sequence
  Forward Primer
gattttcatagtattgctcttcagtatatc

SEQ ID NO: 18677 - DNA, 26 bp, Artificial sequence
  Forward Primer
ttatctaaagcatatggctctctctt

SEQ ID NO: 18678 - DNA, 18 bp, Artificial sequence
  Forward Primer
acccagacttggattggg

SEQ ID NO: 18679 - DNA, 18 bp, Artificial sequence
  Forward Primer
tgggtttggcctggagta

SEQ ID NO: 18680 - DNA, 25 bp, Artificial sequence
  Forward Primer
aattggatgctttagtcacagttat

SEQ ID NO: 18681 - DNA, 27 bp, Artificial sequence
  Forward Primer
aaatctaaataattaaaccatatgcgc

SEQ ID NO: 18682 - DNA, 20 bp, Artificial sequence
  Forward Primer
aaccaatcacagtgggaaca

SEQ ID NO: 18683 - DNA, 28 bp, Artificial sequence
  Forward Primer
ataattctgaagctgtactagtttcctt

SEQ ID NO: 18684 - DNA, 20 bp, Artificial sequence
  Forward Primer
tgaagaagttcgtccagagt

SEQ ID NO: 18685 - DNA, 27 bp, Artificial sequence
  Forward Primer
gttagttattattccatcttccagaag

SEQ ID NO: 18686 - DNA, 21 bp, Artificial sequence
  Forward Primer
tttgtcagcttcatcaagtcc

SEQ ID NO: 18687 - DNA, 18 bp, Artificial sequence
  Forward Primer
ctcctcagctgtggacca

SEQ ID NO: 18688 - DNA, 23 bp, Artificial sequence
  Forward Primer
cccagtttcctacttggatttat

SEQ ID NO: 18689 - DNA, 21 bp, Artificial sequence
  Forward Primer
tttcttgcattgatctttctc

SEQ ID NO: 18690 - DNA, 25 bp, Artificial sequence
  Forward Primer
aaaatgtgagagagaagatgaagag

SEQ ID NO: 18691 - DNA, 18 bp, Artificial sequence
  Forward Primer
gccttctgttgaccccag

SEQ ID NO: 18692 - DNA, 26 bp, Artificial sequence
  Forward Primer
cttacatttaaccaaagttttatggc

SEQ ID NO: 18693 - DNA, 22 bp, Artificial sequence
  Forward Primer
aaaagcaattggcttatcagtt

SEQ ID NO: 18694 - DNA, 23 bp, Artificial sequence
  Forward Primer
atttttccctccctaacctttaa

SEQ ID NO: 18695 - DNA, 20 bp, Artificial sequence
  Forward Primer
aaaaagaggtggtggtcatg

SEQ ID NO: 18696 - DNA, 19 bp, Artificial sequence
  Forward Primer
tgagaaaccctttgactgt

SEQ ID NO: 18697 - DNA, 18 bp, Artificial sequence
  Forward Primer
tggcagaagagccatcgg

SEQ ID NO: 18698 - DNA, 24 bp, Artificial sequence
  Forward Primer
ttacaggtgatcaagctctacaga

SEQ ID NO: 18699 - DNA, 20 bp, Artificial sequence
  Forward Primer
accccataatgctcagttcc

SEQ ID NO: 18700 - DNA, 19 bp, Artificial sequence
  Forward Primer
taggatctgcgtgrgagtg

SEQ ID NO: 18701 - DNA, 24 bp, Artificial sequence
  Forward Primer
tacaagtttgtaggttcaccacac

SEQ ID NO: 18702 - DNA, 25 bp, Artificial sequence
  Forward Primer
acagtttgaaaattctttctctaga

SEQ ID NO: 18703 - DNA, 30 bp, Artificial sequence
  Forward Primer
agtttgaaaattctttctctagattaagtc

SEQ ID NO: 18704 - DNA, 23 bp, Artificial sequence
  Forward Primer
atccaacgctctgaaatagagtt

SEQ ID NO: 18705 - DNA, 28 bp, Artificial sequence
  Forward Primer
atcagatataaatgagtgaacatagctg

SEQ ID NO: 18706 - DNA, 30 bp, Artificial sequence
  Forward Primer
attagcagatgcaaagtactacatatagat

SEQ ID NO: 18707 - DNA, 24 bp, Artificial sequence
  Forward Primer
aaagaaaatacaattccaaggtga

SEQ ID NO: 18708 - DNA, 23 bp, Artificial sequence
  Forward Primer
tcactaggggaagaaaatggtat

SEQ ID NO: 18709 - DNA, 23 bp, Artificial sequence
  Forward Primer
aaacagatagaaccatttgtcca

SEQ ID NO: 18710 - DNA, 27 bp, Artificial sequence
  Forward Primer
aaaaacaagatgattaatttcagagtc

SEQ ID NO: 18711 - DNA, 26 bp, Artificial sequence
  Forward Primer
cccttgatatttctaacatgtcatta

SEQ ID NO: 18712 - DNA, 20 bp, Artificial sequence
  Forward Primer
actgcccactttttggtctt

SEQ ID NO: 18713 - DNA, 20 bp, Artificial sequence
  Forward Primer
atggtcccttcagagtgacg

SEQ ID NO: 18714 - DNA, 28 bp, Artificial sequence
  Forward Primer
aaatatgtgaattctcactactttctga

SEQ ID NO: 18715 - DNA, 18 bp, Artificial sequence
  Forward Primer
ccccaggacgaggaggaa

SEQ ID NO: 18716 - DNA, 27 bp, Artificial sequence
  Forward Primer
atatgagagatgaagttgttatcttgg

SEQ ID NO: 18717 - DNA, 19 bp, Artificial sequence
  Forward Primer
atccttcaccatgacagcc

SEQ ID NO: 18718 - DNA, 23 bp, Artificial sequence
  Forward Primer
cttagctgctctgtctttgaaat

SEQ ID NO: 18719 - DNA, 22 bp, Artificial sequence
  Forward Primer
acagtaagagctcaacaatcac

SEQ ID NO: 18720 - DNA, 23 bp, Artificial sequence
  Forward Primer
agggtgggatatattagttttag

SEQ ID NO: 18721 - DNA, 21 bp, Artificial sequence
  Forward Primer
tcttctttgacatcaccagca

SEQ ID NO: 18722 - DNA, 27 bp, Artificial sequence
  Forward Primer
aaagttgagacttaactcttctttcct

SEQ ID NO: 18723 - DNA, 23 bp, Artificial sequence
  Forward Primer
ataattcagaaggcagttggagt

SEQ ID NO: 18724 - DNA, 18 bp, Artificial sequence
  Forward Primer
atgttgaagctgcttggc

SEQ ID NO: 18725 - DNA, 19 bp, Artificial sequence
  Forward Primer
gaatccactcagggaagga

SEQ ID NO: 18726 - DNA, 21 bp, Artificial sequence
  Forward Primer
taaaaatggagtcgggttttg

SEQ ID NO: 18727 - DNA, 19 bp, Artificial sequence
  Forward Primer
ccacaacaaaagatccaca

SEQ ID NO: 18728 - DNA, 19 bp, Artificial sequence
  Forward Primer
attatgcagtgttggtgtg

SEQ ID NO: 18729 - DNA, 23 bp, Artificial sequence
  Forward Primer
tttttcagagaagaaatcaagcc

SEQ ID NO: 18730 - DNA, 18 bp, Artificial sequence
  Forward Primer
agcgggtgagctygccta

SEQ ID NO: 18731 - DNA, 22 bp, Artificial sequence
  Forward Primer
atgcctggaatttttttattgg

SEQ ID NO: 18732 - DNA, 21 bp, Artificial sequence
  Forward Primer
tgagtaagcagcagaggaagc

SEQ ID NO: 18733 - DNA, 22 bp, Artificial sequence
  Forward Primer
agcctgatgtaaccttgtgtac

SEQ ID NO: 18734 - DNA, 20 bp, Artificial sequence
  Forward Primer
agactgactaagctgagccc

SEQ ID NO: 18735 - DNA, 23 bp, Artificial sequence
  Forward Primer
ataattcagaaggcagttggagt

SEQ ID NO: 18736 - DNA, 23 bp, Artificial sequence
  Forward Primer
caacatcctaccccaataaaatt

SEQ ID NO: 18737 - DNA, 25 bp, Artificial sequence
  Forward Primer
tttttctgtgacaccagttaaactc

SEQ ID NO: 18738 - DNA, 20 bp, Artificial sequence
  Forward Primer
tcaaaagtcaaattccttgg

SEQ ID NO: 18739 - DNA, 20 bp, Artificial sequence
  Forward Primer
ccccagataaatgtacagca

SEQ ID NO: 18740 - DNA, 28 bp, Artificial sequence
  Forward Primer
tttatctcatttatatgaacacctctga

SEQ ID NO: 18741 - DNA, 27 bp, Artificial sequence
  Forward Primer
aagaaatgagtacaggaaattcttttt

SEQ ID NO: 18742 - DNA, 27 bp, Artificial sequence
  Forward Primer
attgtgtccgttacagactttattatg

SEQ ID NO: 18743 - DNA, 20 bp, Artificial sequence
  Forward Primer
tgcctgtccttctttgtatc

SEQ ID NO: 18744 - DNA, 27 bp, Artificial sequence
  Forward Primer
aattatcttgatagagccttacaaaac

SEQ ID NO: 18745 - DNA, 21 bp, Artificial sequence
  Forward Primer
aaaaagctgaacaactttgca

SEQ ID NO: 18746 - DNA, 22 bp, Artificial sequence
  Forward Primer
tattgtcatgttcatcccaaat

SEQ ID NO: 18747 - DNA, 19 bp, Artificial sequence
  Forward Primer
agggacacagtttgcacaa

SEQ ID NO: 18748 - DNA, 20 bp, Artificial sequence
  Forward Primer
agatttcctcttgtcccagg

SEQ ID NO: 18749 - DNA, 19 bp, Artificial sequence
  Forward Primer
cacactgaccacctccaga

SEQ ID NO: 18750 - DNA, 23 bp, Artificial sequence
  Forward Primer
atctacttcccatgacacagagc

SEQ ID NO: 18751 - DNA, 29 bp, Artificial sequence
  Forward Primer
ggttaaaaagaaattctgttacaatgtac

SEQ ID NO: 18752 - DNA, 21 bp, Artificial sequence
  Forward Primer
atgtcagggatttgcttctta

SEQ ID NO: 18753 - DNA, 19 bp, Artificial sequence
  Forward Primer
tagattgcatttcggctga

SEQ ID NO: 18754 - DNA, 21 bp, Artificial sequence
  Forward Primer
ggcagaaatgatcttcaaggt

SEQ ID NO: 18755 - DNA, 20 bp, Artificial sequence
  Forward Primer
agtccatttggtatacaggg

SEQ ID NO: 18756 - DNA, 22 bp, Artificial sequence
  Forward Primer
attgaaatccgaaacagaagaa

SEQ ID NO: 18757 - DNA, 30 bp, Artificial sequence
  Forward Primer
gagacaggtatattatgtagttcttaaagt

SEQ ID NO: 18758 - DNA, 28 bp, Artificial sequence
  Forward Primer
aataaggaaaagaatctgaaaacattac

SEQ ID NO: 18759 - DNA, 27 bp, Artificial sequence
  Forward Primer
tattcaaaattaaacaatgaggagaag

SEQ ID NO: 18760 - DNA, 20 bp, Artificial sequence
  Forward Primer
tttctgaaaaccaagcgaag

SEQ ID NO: 18761 - DNA, 23 bp, Artificial sequence
  Forward Primer
agagtggtttttctttttcagtg

SEQ ID NO: 18762 - DNA, 18 bp, Artificial sequence
  Forward Primer
ttccttgggagtgaccac

SEQ ID NO: 18763 - DNA, 23 bp, Artificial sequence
  Forward Primer
aaataatgtggcagtatcttgca

SEQ ID NO: 18764 - DNA, 30 bp, Artificial sequence
  Forward Primer
ataattattaactaactcaatcctacctaa

SEQ ID NO: 18765 - DNA, 27 bp, Artificial sequence
  Forward Primer
aaaagatattggagactctttatttgc

SEQ ID NO: 18766 - DNA, 19 bp, Artificial sequence
  Forward Primer
gcaggttgactcatgtgaa

SEQ ID NO: 18767 - DNA, 30 bp, Artificial sequence
  Forward Primer
aatcaattaatctatctacctatctacagt

SEQ ID NO: 18768 - DNA, 26 bp, Artificial sequence
  Forward Primer
atctaaagaatagcacccaacttaaa

SEQ ID NO: 18769 - DNA, 28 bp, Artificial sequence
  Forward Primer
attacagagtatagagtagagttccctg

SEQ ID NO: 18770 - DNA, 30 bp, Artificial sequence
  Forward Primer
aaatatagatagtattcagtctgcagagta

SEQ ID NO: 18771 - DNA, 20 bp, Artificial sequence
  Forward Primer
caaggggacagtgagtgact

SEQ ID NO: 18772 - DNA, 24 bp, Artificial sequence
  Forward Primer
ggttacatccaattttataacttc

SEQ ID NO: 18773 - DNA, 29 bp, Artificial sequence
  Forward Primer
ataaattagagatactccaagttgaaacc

SEQ ID NO: 18774 - DNA, 20 bp, Artificial sequence
  Forward Primer
aatcctctgtgacttttgct

SEQ ID NO: 18775 - DNA, 19 bp, Artificial sequence
  Forward Primer
tttctgcctttggtgttgg

SEQ ID NO: 18776 - DNA, 20 bp, Artificial sequence
  Forward Primer
atagaagcctggaggaactg

SEQ ID NO: 18777 - DNA, 19 bp, Artificial sequence
  Forward Primer
atcctctgagcagtgatgg

SEQ ID NO: 18778 - DNA, 29 bp, Artificial sequence
  Forward Primer
tcaactacttttgatcttaacactacagt

SEQ ID NO: 18779 - DNA, 25 bp, Artificial sequence
  Forward Primer
aatacatgtttatggaacgaattca

SEQ ID NO: 18780 - DNA, 20 bp, Artificial sequence
  Forward Primer
ctgattttcaggccctcttc

SEQ ID NO: 18781 - DNA, 27 bp, Artificial sequence
  Forward Primer
acactttatctactgtcatatctgcag

SEQ ID NO: 18782 - DNA, 18 bp, Artificial sequence
  Forward Primer
attcctgagtccctggcc

SEQ ID NO: 18783 - DNA, 30 bp, Artificial sequence
  Forward Primer
ctcatttattatgtcaactctaaattctac

SEQ ID NO: 18784 - DNA, 30 bp, Artificial sequence
  Forward Primer
tattttagaagatcttattcttagctcact

SEQ ID NO: 18785 - DNA, 30 bp, Artificial sequence
  Forward Primer
tcatattttagattccacctataagtaata

SEQ ID NO: 18786 - DNA, 21 bp, Artificial sequence
  Forward Primer
atccaccttttcttttaactg

SEQ ID NO: 18787 - DNA, 21 bp, Artificial sequence
  Forward Primer
atgtttagcagacagggaagc

SEQ ID NO: 18788 - DNA, 29 bp, Artificial sequence
  Forward Primer
cagatatatttaaataaagtttggtgtgg

SEQ ID NO: 18789 - DNA, 25 bp, Artificial sequence
  Forward Primer
tgtactcttcatttaaacattgcac

SEQ ID NO: 18790 - DNA, 22 bp, Artificial sequence
  Forward Primer
cctggttatgagtgtgacaata

SEQ ID NO: 18791 - DNA, 23 bp, Artificial sequence
  Forward Primer
ttttgtttttccagtatttcagc

SEQ ID NO: 18792 - DNA, 24 bp, Artificial sequence
  Forward Primer
ttgttttacaagagaccatcaaaa

SEQ ID NO: 18793 - DNA, 28 bp, Artificial sequence
  Forward Primer
aaaaagcttattttcgtatggttatatc

SEQ ID NO: 18794 - DNA, 24 bp, Artificial sequence
  Forward Primer
gcatgtgactaatcagaaatctct

SEQ ID NO: 18795 - DNA, 24 bp, Artificial sequence
  Forward Primer
aaaaatgcttctgcttttacaatt

SEQ ID NO: 18796 - DNA, 22 bp, Artificial sequence
  Forward Primer
tggtcacttctctttcctttct

SEQ ID NO: 18797 - DNA, 20 bp, Artificial sequence
  Forward Primer
agagctctttttctccaccc

SEQ ID NO: 18798 - DNA, 19 bp, Artificial sequence
  Forward Primer
aagctttgtctgcatgtgt

SEQ ID NO: 18799 - DNA, 18 bp, Artificial sequence
  Forward Primer
tcaggagcatctgggtcc

SEQ ID NO: 18800 - DNA, 27 bp, Artificial sequence
  Forward Primer
tcatatttgaaagaaattaaacagagg

SEQ ID NO: 18801 - DNA, 24 bp, Artificial sequence
  Forward Primer
gctgagagagaccactttttctaa

SEQ ID NO: 18802 - DNA, 22 bp, Artificial sequence
  Forward Primer
ataaagacattttcccaaaccc

SEQ ID NO: 18803 - DNA, 27 bp, Artificial sequence
  Forward Primer
gagaactttttcctgaattttaacttt

SEQ ID NO: 18804 - DNA, 30 bp, Artificial sequence
  Forward Primer
taattaaaccagtaagactaagtaaggtta

SEQ ID NO: 18805 - DNA, 22 bp, Artificial sequence
  Forward Primer
aaaatatcctgatgaaaagtgc

SEQ ID NO: 18806 - DNA, 19 bp, Artificial sequence
  Forward Primer
agggggttgttttgatgag

SEQ ID NO: 18807 - DNA, 21 bp, Artificial sequence
  Forward Primer
tcccacttttcacatattcca

SEQ ID NO: 18808 - DNA, 24 bp, Artificial sequence
  Forward Primer
tttaaggactcattgtcatccttt

SEQ ID NO: 18809 - DNA, 24 bp, Artificial sequence
  Forward Primer
aaatcgatggagaaaagttacaca

SEQ ID NO: 18810 - DNA, 19 bp, Artificial sequence
  Forward Primer
tatctgccaggctagggtc

SEQ ID NO: 18811 - DNA, 23 bp, Artificial sequence
  Forward Primer
aaaaaaacctggctgttaataat

SEQ ID NO: 18812 - DNA, 19 bp, Artificial sequence
  Forward Primer
agggatggctcagaaatga

SEQ ID NO: 18813 - DNA, 18 bp, Artificial sequence
  Forward Primer
acgtgctcatgatgggtt

SEQ ID NO: 18814 - DNA, 20 bp, Artificial sequence
  Forward Primer
cggtaccctgaaaacacaca

SEQ ID NO: 18815 - DNA, 21 bp, Artificial sequence
  Forward Primer
tgtccaacttggtgcttttaa

SEQ ID NO: 18816 - DNA, 18 bp, Artificial sequence
  Forward Primer
tggctgattttgaccccc

SEQ ID NO: 18817 - DNA, 24 bp, Artificial sequence
  Forward Primer
attcatctgaaagtttgactgtgg

SEQ ID NO: 18818 - DNA, 20 bp, Artificial sequence
  Forward Primer
tgctttcttcagcttttgct

SEQ ID NO: 18819 - DNA, 22 bp, Artificial sequence
  Forward Primer
atagcaaactttcaaaatgcct

SEQ ID NO: 18820 - DNA, 24 bp, Artificial sequence
  Forward Primer
aaaagaaaggacctgtgttctaaa

SEQ ID NO: 18821 - DNA, 18 bp, Artificial sequence
  Forward Primer
acacacagcattcatggg

SEQ ID NO: 18822 - DNA, 22 bp, Artificial sequence
  Forward Primer
tatcacatcccttgttcctttt

SEQ ID NO: 18823 - DNA, 27 bp, Artificial sequence
  Forward Primer
taactagtttctctgtacccactattg

SEQ ID NO: 18824 - DNA, 20 bp, Artificial sequence
  Forward Primer
acaaagggtctctcctgtgt

SEQ ID NO: 18825 - DNA, 27 bp, Artificial sequence
  Forward Primer
ttaacaaaatgtctttcaaggaatatg

SEQ ID NO: 18826 - DNA, 19 bp, Artificial sequence
  Forward Primer
tgtgtatccaggaacagct

SEQ ID NO: 18827 - DNA, 19 bp, Artificial sequence
  Forward Primer
ttgggaaaccgctaagaac

SEQ ID NO: 18828 - DNA, 19 bp, Artificial sequence
  Forward Primer
tggaaagcttaggaagtgt

SEQ ID NO: 18829 - DNA, 23 bp, Artificial sequence
  Forward Primer
aacactgaatgagtaacaggcag

SEQ ID NO: 18830 - DNA, 26 bp, Artificial sequence
  Forward Primer
aatagtaattacaagacatggatggc

SEQ ID NO: 18831 - DNA, 22 bp, Artificial sequence
  Forward Primer
agttttaaccactggatcacca

SEQ ID NO: 18832 - DNA, 24 bp, Artificial sequence
  Forward Primer
tttgaatctcagctctaccaattt

SEQ ID NO: 18833 - DNA, 26 bp, Artificial sequence
  Forward Primer
accaaactctaaacaagataaaactc

SEQ ID NO: 18834 - DNA, 25 bp, Artificial sequence
  Forward Primer
agctttaaatgaatttgactttctg

SEQ ID NO: 18835 - DNA, 23 bp, Artificial sequence
  Forward Primer
gagactagttcaatccttagccc

SEQ ID NO: 18836 - DNA, 20 bp, Artificial sequence
  Forward Primer
tcctcactctkatggcaaac

SEQ ID NO: 18837 - DNA, 29 bp, Artificial sequence
  Forward Primer
tattataggagtttgttagtgaaaggaaa

SEQ ID NO: 18838 - DNA, 19 bp, Artificial sequence
  Forward Primer
ctgcctgagtgttctggtg

SEQ ID NO: 18839 - DNA, 23 bp, Artificial sequence
  Forward Primer
aaatgaacacacaaatacccatg

SEQ ID NO: 18840 - DNA, 28 bp, Artificial sequence
  Forward Primer
aatgaagctttactaaaagtatgactgc

SEQ ID NO: 18841 - DNA, 27 bp, Artificial sequence
  Forward Primer
ccttttttcccttcttttatttaatag

SEQ ID NO: 18842 - DNA, 22 bp, Artificial sequence
  Forward Primer
attattctcccatgaaaggagg

SEQ ID NO: 18843 - DNA, 25 bp, Artificial sequence
  Forward Primer
aatgttaatctcattcagaaactcc

SEQ ID NO: 18844 - DNA, 23 bp, Artificial sequence
  Forward Primer
acttgtctcttttgtttccaaac

SEQ ID NO: 18845 - DNA, 20 bp, Artificial sequence
  Forward Primer
agggcaaagaatgaaaatgt

SEQ ID NO: 18846 - DNA, 21 bp, Artificial sequence
  Forward Primer
tgaaaagaaacagaaatgcta

SEQ ID NO: 18847 - DNA, 19 bp, Artificial sequence
  Forward Primer
aacgccttgatcttggact

SEQ ID NO: 18848 - DNA, 23 bp, Artificial sequence
  Forward Primer
ctctttctctagggaaatgtaat

SEQ ID NO: 18849 - DNA, 25 bp, Artificial sequence
  Forward Primer
aaaagagtacctttggtttgtatga

SEQ ID NO: 18850 - DNA, 21 bp, Artificial sequence
  Forward Primer
aaaaactgacacctgggtttc

SEQ ID NO: 18851 - DNA, 25 bp, Artificial sequence
  Forward Primer
ttgtcattgtaatatgttggagatg

SEQ ID NO: 18852 - DNA, 20 bp, Artificial sequence
  Forward Primer
agaacatcctagtcatcggg

SEQ ID NO: 18853 - DNA, 18 bp, Artificial sequence
  Forward Primer
aaaatccatatggcccca

SEQ ID NO: 18854 - DNA, 18 bp, Artificial sequence
  Forward Primer
acaccagcatctgctccc

SEQ ID NO: 18855 - DNA, 22 bp, Artificial sequence
  Forward Primer
aatgaactggaaaaccatctga

SEQ ID NO: 18856 - DNA, 26 bp, Artificial sequence
  Forward Primer
ttttcttttaggatagaaagagggta

SEQ ID NO: 18857 - DNA, 22 bp, Artificial sequence
  Forward Primer
aaaaaattctggaaatggatgc

SEQ ID NO: 18858 - DNA, 24 bp, Artificial sequence
  Forward Primer
agtaatataatagaacttccctgc

SEQ ID NO: 18859 - DNA, 18 bp, Artificial sequence
  Forward Primer
tcctcacagaaggcgtgt

SEQ ID NO: 18860 - DNA, 26 bp, Artificial sequence
  Forward Primer
ttagttcattgagaggaagttaggtt

SEQ ID NO: 18861 - DNA, 19 bp, Artificial sequence
  Forward Primer
ttgccaaatgaaagttgga

SEQ ID NO: 18862 - DNA, 25 bp, Artificial sequence
  Forward Primer
aaatatttgtattgtatccacggaa

SEQ ID NO: 18863 - DNA, 24 bp, Artificial sequence
  Forward Primer
ttcatctccctgatttttaaattt

SEQ ID NO: 18864 - DNA, 25 bp, Artificial sequence
  Forward Primer
tctagtttaccatcatatttaggat

SEQ ID NO: 18865 - DNA, 20 bp, Artificial sequence
  Forward Primer
gcatcaagtgctgtcagttt

SEQ ID NO: 18866 - DNA, 25 bp, Artificial sequence
  Forward Primer
attgattcaagtgtaagagacttcc

SEQ ID NO: 18867 - DNA, 29 bp, Artificial sequence
  Forward Primer
aataataaattcttagtttcctagggttg

SEQ ID NO: 18868 - DNA, 27 bp, Artificial sequence
  Forward Primer
agaaatgtgtaaattagraagttcctc

SEQ ID NO: 18869 - DNA, 24 bp, Artificial sequence
  Forward Primer
aaagaaccactacttacggtgaac

SEQ ID NO: 18870 - DNA, 18 bp, Artificial sequence
  Forward Primer
agatgtgcctggaccatg

SEQ ID NO: 18871 - DNA, 22 bp, Artificial sequence
  Forward Primer
actttggtgtcttcttaccaag

SEQ ID NO: 18872 - DNA, 18 bp, Artificial sequence
  Forward Primer
acgattccaggctccttg

SEQ ID NO: 18873 - DNA, 19 bp, Artificial sequence
  Forward Primer
cttggatggtgtctcagcc

SEQ ID NO: 18874 - DNA, 20 bp, Artificial sequence
  Forward Primer
caacagcctgtggaaagaga

SEQ ID NO: 18875 - DNA, 18 bp, Artificial sequence
  Forward Primer
actgctgggtccatgcct

SEQ ID NO: 18876 - DNA, 28 bp, Artificial sequence
  Forward Primer
cccttatttttgttttaaattatgtagg

SEQ ID NO: 18877 - DNA, 24 bp, Artificial sequence
  Forward Primer
ttacattcctaatctcagccaact

SEQ ID NO: 18878 - DNA, 28 bp, Artificial sequence
  Forward Primer
aatgtctatttacacagatttctgactg

SEQ ID NO: 18879 - DNA, 25 bp, Artificial sequence
  Forward Primer
ttggaacattgtgtaatgatattgt

SEQ ID NO: 18880 - DNA, 23 bp, Artificial sequence
  Forward Primer
acacaaatatgttctgacagttg

SEQ ID NO: 18881 - DNA, 18 bp, Artificial sequence
  Forward Primer
tatgctgcccttgcaaac

SEQ ID NO: 18882 - DNA, 19 bp, Artificial sequence
  Forward Primer
aggtgggtgaaggtcttga

SEQ ID NO: 18883 - DNA, 23 bp, Artificial sequence
  Forward Primer
aaattcagctttaagaggctctg

SEQ ID NO: 18884 - DNA, 27 bp, Artificial sequence
  Forward Primer
ggggttttagtacctatatcrtttttt

SEQ ID NO: 18885 - DNA, 18 bp, Artificial sequence
  Forward Primer
acctgggtgaagatgggt

SEQ ID NO: 18886 - DNA, 20 bp, Artificial sequence
  Forward Primer
agagattgcccaagaaatgc

SEQ ID NO: 18887 - DNA, 22 bp, Artificial sequence
  Forward Primer
ttgaaatcaagatgtgaagtgg

SEQ ID NO: 18888 - DNA, 22 bp, Artificial sequence
  Forward Primer
aacatcaaaggmggtgataact

SEQ ID NO: 18889 - DNA, 24 bp, Artificial sequence
  Forward Primer
ttattttcctaaagatcctgagca

SEQ ID NO: 18890 - DNA, 28 bp, Artificial sequence
  Forward Primer
gcctttgtttcaaaattattatctactt

SEQ ID NO: 18891 - DNA, 18 bp, Artificial sequence
  Forward Primer
agtgagatggggactgcg

SEQ ID NO: 18892 - DNA, 21 bp, Artificial sequence
  Forward Primer
aactcacctttgtagccttcc

SEQ ID NO: 18893 - DNA, 20 bp, Artificial sequence
  Forward Primer
aagtaatgggaagtcccagg

SEQ ID NO: 18894 - DNA, 20 bp, Artificial sequence
  Forward Primer
aatggagttgctgagtcaaa

SEQ ID NO: 18895 - DNA, 18 bp, Artificial sequence
  Forward Primer
acggcagagagcatgggg

SEQ ID NO: 18896 - DNA, 21 bp, Artificial sequence
  Forward Primer
aaaaatggaacaaaaagggaa

SEQ ID NO: 18897 - DNA, 21 bp, Artificial sequence
  Forward Primer
gcttccttttgtcatgacctt

SEQ ID NO: 18898 - DNA, 18 bp, Artificial sequence
  Forward Primer
ttctttgccacgcaggta

SEQ ID NO: 18899 - DNA, 20 bp, Artificial sequence
  Forward Primer
atctcacagtctcacacccc

SEQ ID NO: 18900 - DNA, 28 bp, Artificial sequence
  Forward Primer
tttttctcttattcttattcaattgagc

SEQ ID NO: 18901 - DNA, 19 bp, Artificial sequence
  Forward Primer
cctcgccctgaaactattc

SEQ ID NO: 18902 - DNA, 21 bp, Artificial sequence
  Forward Primer
gctttccaaaagtgtgtgtgt

SEQ ID NO: 18903 - DNA, 20 bp, Artificial sequence
  Forward Primer
acaggcagatccaygtttat

SEQ ID NO: 18904 - DNA, 29 bp, Artificial sequence
  Forward Primer
taaatattgcatgagacctacttatatcc

SEQ ID NO: 18905 - DNA, 24 bp, Artificial sequence
  Forward Primer
ttactctgggactttgttaactcc

SEQ ID NO: 18906 - DNA, 18 bp, Artificial sequence
  Forward Primer
tcctacacaagccccacc

SEQ ID NO: 18907 - DNA, 24 bp, Artificial sequence
  Forward Primer
tctcctttcataggcagaatagaa

SEQ ID NO: 18908 - DNA, 22 bp, Artificial sequence
  Forward Primer
aatttgtgtggcctgttttatt

SEQ ID NO: 18909 - DNA, 20 bp, Artificial sequence
  Forward Primer
ttyatgtttcccatggacaa

SEQ ID NO: 18910 - DNA, 26 bp, Artificial sequence
  Forward Primer
tataaagcacaatttctgacttcaag

SEQ ID NO: 18911 - DNA, 21 bp, Artificial sequence
  Forward Primer
tagaaatccttcccattgagg

SEQ ID NO: 18912 - DNA, 23 bp, Artificial sequence
  Forward Primer
ttcacttctgaattatctttggg

SEQ ID NO: 18913 - DNA, 18 bp, Artificial sequence
  Forward Primer
acacctgcctgggagaag

SEQ ID NO: 18914 - DNA, 22 bp, Artificial sequence
  Forward Primer
ttttcaaggtagcctgacatct

SEQ ID NO: 18915 - DNA, 25 bp, Artificial sequence
  Forward Primer
cagaaaaagatatcatcygctaatc

SEQ ID NO: 18916 - DNA, 23 bp, Artificial sequence
  Forward Primer
acgctcaagatgttagtttcaaa

SEQ ID NO: 18917 - DNA, 20 bp, Artificial sequence
  Forward Primer
tgcacmactgttactctggg

SEQ ID NO: 18918 - DNA, 23 bp, Artificial sequence
  Forward Primer
aaaatcacaaggtcatgacagaa

SEQ ID NO: 18919 - DNA, 22 bp, Artificial sequence
  Forward Primer
ttkaaatcagtcatttttggca

SEQ ID NO: 18920 - DNA, 27 bp, Artificial sequence
  Forward Primer
ctctaattaatgattttttggaacttg

SEQ ID NO: 18921 - DNA, 20 bp, Artificial sequence
  Forward Primer
taccttgtcccaaaggatgc

SEQ ID NO: 18922 - DNA, 18 bp, Artificial sequence
  Forward Primer
agcccggtgagctacagt

SEQ ID NO: 18923 - DNA, 26 bp, Artificial sequence
  Forward Primer
tattggaattttataaataggaaccc

SEQ ID NO: 18924 - DNA, 18 bp, Artificial sequence
  Forward Primer
tgagcccagactcttgca

SEQ ID NO: 18925 - DNA, 23 bp, Artificial sequence
  Forward Primer
tacatcacattctttgtgtatga

SEQ ID NO: 18926 - DNA, 23 bp, Artificial sequence
  Forward Primer
acagccaaatcaattctagtttc

SEQ ID NO: 18927 - DNA, 18 bp, Artificial sequence
  Forward Primer
agaggggcaggcaagata

SEQ ID NO: 18928 - DNA, 25 bp, Artificial sequence
  Forward Primer
raaacaattcacatgtcaagtatgg

SEQ ID NO: 18929 - DNA, 28 bp, Artificial sequence
  Forward Primer
attaatgtattttatttaactgtgctgg

SEQ ID NO: 18930 - DNA, 20 bp, Artificial sequence
  Forward Primer
cagtagccacagatcatgag

SEQ ID NO: 18931 - DNA, 20 bp, Artificial sequence
  Forward Primer
aatggaatgtgggagaaatg

SEQ ID NO: 18932 - DNA, 29 bp, Artificial sequence
  Forward Primer
ttaggattatttttctataatgtctcctg

SEQ ID NO: 18933 - DNA, 18 bp, Artificial sequence
  Forward Primer
tgcttcaggccagcgagg

SEQ ID NO: 18934 - DNA, 24 bp, Artificial sequence
  Forward Primer
ttcctccttacatctcttttcatc

SEQ ID NO: 18935 - DNA, 30 bp, Artificial sequence
  Forward Primer
tgctaagatactgttattaaagaaaataag

SEQ ID NO: 18936 - DNA, 24 bp, Artificial sequence
  Forward Primer
acagccagaagtaaacagatttag

SEQ ID NO: 18937 - DNA, 23 bp, Artificial sequence
  Forward Primer
taagttttctgacagagcaagtg

SEQ ID NO: 18938 - DNA, 29 bp, Artificial sequence
  Forward Primer
ggatcttttattcacatactattttcatg

SEQ ID NO: 18939 - DNA, 18 bp, Artificial sequence
  Forward Primer
aggagtggcggttggtct

SEQ ID NO: 18940 - DNA, 30 bp, Artificial sequence
  Forward Primer
attacatgtcttataattaaggtagatgag

SEQ ID NO: 18941 - DNA, 20 bp, Artificial sequence
  Forward Primer
ttttaggttctgcctcgaca

SEQ ID NO: 18942 - DNA, 26 bp, Artificial sequence
  Forward Primer
atttacattataaggcttctttctgc

SEQ ID NO: 18943 - DNA, 23 bp, Artificial sequence
  Forward Primer
tgcaaaaatattcaaaatccaac

SEQ ID NO: 18944 - DNA, 18 bp, Artificial sequence
  Forward Primer
caccagggacctttccca

SEQ ID NO: 18945 - DNA, 19 bp, Artificial sequence
  Forward Primer
tgacagagtcttgggatgg

SEQ ID NO: 18946 - DNA, 18 bp, Artificial sequence
  Forward Primer
tgccttggagagcttgtc

SEQ ID NO: 18947 - DNA, 28 bp, Artificial sequence
  Forward Primer
atgaatatttaaatagatcccaaagatc

SEQ ID NO: 18948 - DNA, 20 bp, Artificial sequence
  Forward Primer
tcaaagaaaggagatgatgg

SEQ ID NO: 18949 - DNA, 20 bp, Artificial sequence
  Forward Primer
ttgcaacaaatacartggca

SEQ ID NO: 18950 - DNA, 20 bp, Artificial sequence
  Forward Primer
cagatcccatcttagttcct

SEQ ID NO: 18951 - DNA, 24 bp, Artificial sequence
  Forward Primer
tttggtgtaccttgtttatgtctg

SEQ ID NO: 18952 - DNA, 23 bp, Artificial sequence
  Forward Primer
ttatcctattcccaaatgtaggc

SEQ ID NO: 18953 - DNA, 28 bp, Artificial sequence
  Forward Primer
atcaaatacatactaacttggctatttt

SEQ ID NO: 18954 - DNA, 23 bp, Artificial sequence
  Forward Primer
atgcagttaaggattcaaaggtt

SEQ ID NO: 18955 - DNA, 24 bp, Artificial sequence
  Forward Primer
tattgaacttggatcctgtatcct

SEQ ID NO: 18956 - DNA, 25 bp, Artificial sequence
  Forward Primer
atatgaatggagcttctcaatatcc

SEQ ID NO: 18957 - DNA, 26 bp, Artificial sequence
  Forward Primer
atgctacaaggacaaataaatcaata

SEQ ID NO: 18958 - DNA, 21 bp, Artificial sequence
  Forward Primer
aaaaagccaaaaccttttcag

SEQ ID NO: 18959 - DNA, 24 bp, Artificial sequence
  Forward Primer
aaatccaattcattttaaagagca

SEQ ID NO: 18960 - DNA, 30 bp, Artificial sequence
  Forward Primer
tttttcagaaagtgatagttatatatggag

SEQ ID NO: 18961 - DNA, 22 bp, Artificial sequence
  Forward Primer
gacttcagactggagaatttcc

SEQ ID NO: 18962 - DNA, 26 bp, Artificial sequence
  Forward Primer
aaatttgataacaaaaggaagagtga

SEQ ID NO: 18963 - DNA, 23 bp, Artificial sequence
  Forward Primer
acgttccttcatttgtaagacct

SEQ ID NO: 18964 - DNA, 27 bp, Artificial sequence
  Forward Primer
atatttgtcacattcagttttcactaa

SEQ ID NO: 18965 - DNA, 20 bp, Artificial sequence
  Forward Primer
ggtcttctgggtgatctcac

SEQ ID NO: 18966 - DNA, 19 bp, Artificial sequence
  Forward Primer
ggagcttaaggaacccagt

SEQ ID NO: 18967 - DNA, 19 bp, Artificial sequence
  Forward Primer
tttgcttggagtcttgtgg

SEQ ID NO: 18968 - DNA, 21 bp, Artificial sequence
  Forward Primer
accaccactcaagtccaagtt

SEQ ID NO: 18969 - DNA, 24 bp, Artificial sequence
  Forward Primer
ttattggatttcttagttcggtca

SEQ ID NO: 18970 - DNA, 26 bp, Artificial sequence
  Forward Primer
aaagaggaattctaaatgtgttttga

SEQ ID NO: 18971 - DNA, 22 bp, Artificial sequence
  Forward Primer
gaacctaaagtctccttttctc

SEQ ID NO: 18972 - DNA, 25 bp, Artificial sequence
  Forward Primer
agaactgaattcacatctcacaatt

SEQ ID NO: 18973 - DNA, 26 bp, Artificial sequence
  Forward Primer
ataagaagtcaagctatgtgatagcc

SEQ ID NO: 18974 - DNA, 20 bp, Artificial sequence
  Forward Primer
tgctgtaccaaactcagctg

SEQ ID NO: 18975 - DNA, 18 bp, Artificial sequence
  Forward Primer
atcagctgccacccactt

SEQ ID NO: 18976 - DNA, 23 bp, Artificial sequence
  Forward Primer
accctgtacactgttgaacactc

SEQ ID NO: 18977 - DNA, 30 bp, Artificial sequence
  Forward Primer
atttatctagaactatctatctataactat

SEQ ID NO: 18978 - DNA, 28 bp, Artificial sequence
  Forward Primer
attacttttagcctttagaaaatcatga

SEQ ID NO: 18979 - DNA, 21 bp, Artificial sequence
  Forward Primer
tggtgggtagtagtgaaaaga

SEQ ID NO: 18980 - DNA, 19 bp, Artificial sequence
  Forward Primer
aggtccactaacctcctcg

SEQ ID NO: 18981 - DNA, 25 bp, Artificial sequence
  Forward Primer
tttatatgtagctccagcagtcttc

SEQ ID NO: 18982 - DNA, 19 bp, Artificial sequence
  Forward Primer
ctggtaagatccttcttgc

SEQ ID NO: 18983 - DNA, 24 bp, Artificial sequence
  Forward Primer
tggttaactgaaacatacatgctt

SEQ ID NO: 18984 - DNA, 18 bp, Artificial sequence
  Forward Primer
atcgcctccaatgatttg

SEQ ID NO: 18985 - DNA, 24 bp, Artificial sequence
  Forward Primer
gcctaaattatcccttggtaaatt

SEQ ID NO: 18986 - DNA, 19 bp, Artificial sequence
  Forward Primer
agggaggagcctgcttatg

SEQ ID NO: 18987 - DNA, 30 bp, Artificial sequence
  Forward Primer
gattatattgtttagtaggtatttaccata

SEQ ID NO: 18988 - DNA, 18 bp, Artificial sequence
  Forward Primer
agggatcaaacccatgcc

SEQ ID NO: 18989 - DNA, 25 bp, Artificial sequence
  Forward Primer
tttggttatagcrtttttcttcttt

SEQ ID NO: 18990 - DNA, 21 bp, Artificial sequence
  Forward Primer
accttgaaacctgatttgtcg

SEQ ID NO: 18991 - DNA, 26 bp, Artificial sequence
  Forward Primer
taaatgctaacagtaaaattctcctt

SEQ ID NO: 18992 - DNA, 28 bp, Artificial sequence
  Forward Primer
aaaactgagcataagaacctataagatt

SEQ ID NO: 18993 - DNA, 20 bp, Artificial sequence
  Forward Primer
aagtggaaatcccagttcaa

SEQ ID NO: 18994 - DNA, 25 bp, Artificial sequence
  Forward Primer
ttattraattcatcaggagaaaacc

SEQ ID NO: 18995 - DNA, 26 bp, Artificial sequence
  Forward Primer
cctgaacttcataatgkgatcttatt

SEQ ID NO: 18996 - DNA, 25 bp, Artificial sequence
  Forward Primer
tttttgaatctgattcttcaacatc

SEQ ID NO: 18997 - DNA, 23 bp, Artificial sequence
  Forward Primer
tcaaatcaggtagaaagcaaaaa

SEQ ID NO: 18998 - DNA, 27 bp, Artificial sequence
  Forward Primer
gtaggttgcttgtaatttatgagattc

SEQ ID NO: 18999 - DNA, 28 bp, Artificial sequence
  Forward Primer
cttttatttgtaacttcagtcactattt

SEQ ID NO: 19000 - DNA, 25 bp, Artificial sequence
  Forward Primer
ttaaagttcaaaggacagatagcat

SEQ ID NO: 19001 - DNA, 19 bp, Artificial sequence
  Forward Primer
ttgcacagatgacatcgtc

SEQ ID NO: 19002 - DNA, 25 bp, Artificial sequence
  Forward Primer
attaggtgaggtttaaattcaggtc

SEQ ID NO: 19003 - DNA, 28 bp, Artificial sequence
  Forward Primer
gagagagagatatagtctcttatcccaa

SEQ ID NO: 19004 - DNA, 24 bp, Artificial sequence
  Forward Primer
aaaatatgaatgaatgaaggtttg

SEQ ID NO: 19005 - DNA, 19 bp, Artificial sequence
  Forward Primer
aatccaattttcgtggtgc

SEQ ID NO: 19006 - DNA, 24 bp, Artificial sequence
  Forward Primer
tccagtaacattctcaaattctga

SEQ ID NO: 19007 - DNA, 26 bp, Artificial sequence
  Forward Primer
acatatagaaaacagaattaagagct

SEQ ID NO: 19008 - DNA, 19 bp, Artificial sequence
  Forward Primer
ttttggcccttagatcttt

SEQ ID NO: 19009 - DNA, 28 bp, Artificial sequence
  Forward Primer
atatgagacttttctaaaccttgagttc

SEQ ID NO: 19010 - DNA, 23 bp, Artificial sequence
  Forward Primer
ttgaggatctgttgtgaataagc

SEQ ID NO: 19011 - DNA, 20 bp, Artificial sequence
  Forward Primer
aaccacttctcctaaaggcg

SEQ ID NO: 19012 - DNA, 23 bp, Artificial sequence
  Forward Primer
cttattcagaatcagtgtgtgca

SEQ ID NO: 19013 - DNA, 19 bp, Artificial sequence
  Forward Primer
caaccgaaaaacaatttca

SEQ ID NO: 19014 - DNA, 29 bp, Artificial sequence
  Forward Primer
caaaaagaaatactagagataaaaaccac

SEQ ID NO: 19015 - DNA, 19 bp, Artificial sequence
  Forward Primer
tgtgtcaacacggcctaag

SEQ ID NO: 19016 - DNA, 22 bp, Artificial sequence
  Forward Primer
atttttcacagtccatttgctc

SEQ ID NO: 19017 - DNA, 25 bp, Artificial sequence
  Forward Primer
tcttcaattagatagaggagatcat

SEQ ID NO: 19018 - DNA, 23 bp, Artificial sequence
  Forward Primer
ttgtaaactctcagtgcacatgt

SEQ ID NO: 19019 - DNA, 29 bp, Artificial sequence
  Forward Primer
tttattacaatagtgagaaactgatcaac

SEQ ID NO: 19020 - DNA, 19 bp, Artificial sequence
  Forward Primer
atggtccagaagcgctaca

SEQ ID NO: 19021 - DNA, 27 bp, Artificial sequence
  Forward Primer
aactagaaaataactatgatacccggt

SEQ ID NO: 19022 - DNA, 23 bp, Artificial sequence
  Forward Primer
aatatgttggcctctggttaact

SEQ ID NO: 19023 - DNA, 19 bp, Artificial sequence
  Forward Primer
gaggatgagtaccgggaag

SEQ ID NO: 19024 - DNA, 22 bp, Artificial sequence
  Forward Primer
atcatgatttgctctaggaggc

SEQ ID NO: 19025 - DNA, 21 bp, Artificial sequence
  Forward Primer
acacatgcacatttttggtct

SEQ ID NO: 19026 - DNA, 26 bp, Artificial sequence
  Forward Primer
tatatcaaccctcctaggtagttttc

SEQ ID NO: 19027 - DNA, 21 bp, Artificial sequence
  Forward Primer
ttccaatgaggttgtttgtca

SEQ ID NO: 19028 - DNA, 28 bp, Artificial sequence
  Forward Primer
aagttaaccacagactagattatattag

SEQ ID NO: 19029 - DNA, 26 bp, Artificial sequence
  Forward Primer
attttaccctaattcctcatacaacc

SEQ ID NO: 19030 - DNA, 24 bp, Artificial sequence
  Forward Primer
actgcagaaagaaaagagtaagca

SEQ ID NO: 19031 - DNA, 27 bp, Artificial sequence
  Forward Primer
aatgtcacatagttcaatctaaaaggt

SEQ ID NO: 19032 - DNA, 20 bp, Artificial sequence
  Forward Primer
ttggagaaggaaaagtcacg

SEQ ID NO: 19033 - DNA, 19 bp, Artificial sequence
  Forward Primer
aaaaaatgtggcgtgttca

SEQ ID NO: 19034 - DNA, 18 bp, Artificial sequence
  Forward Primer
ttcccttcccagtctgct

SEQ ID NO: 19035 - DNA, 23 bp, Artificial sequence
  Forward Primer
atgggttggagtttatttcagat

SEQ ID NO: 19036 - DNA, 18 bp, Artificial sequence
  Forward Primer
tccgagctcacgctgcag

SEQ ID NO: 19037 - DNA, 18 bp, Artificial sequence
  Forward Primer
ctggagcgtgacatttgg

SEQ ID NO: 19038 - DNA, 19 bp, Artificial sequence
  Forward Primer
aaactctttttggggactc

SEQ ID NO: 19039 - DNA, 24 bp, Artificial sequence
  Forward Primer
tagcatcattagcctacaacttca

SEQ ID NO: 19040 - DNA, 19 bp, Artificial sequence
  Forward Primer
aggcaggagacggtagaga

SEQ ID NO: 19041 - DNA, 24 bp, Artificial sequence
  Forward Primer
aaaacagaaacacacgacagttta

SEQ ID NO: 19042 - DNA, 25 bp, Artificial sequence
  Forward Primer
aaacctactcgactgagactctttt

SEQ ID NO: 19043 - DNA, 28 bp, Artificial sequence
  Forward Primer
attaaaatcagtctcacaatttctacat

SEQ ID NO: 19044 - DNA, 19 bp, Artificial sequence
  Forward Primer
acaacaccgtccctgactc

SEQ ID NO: 19045 - DNA, 24 bp, Artificial sequence
  Forward Primer
aaatccctgatgatttgtttaaag

SEQ ID NO: 19046 - DNA, 18 bp, Artificial sequence
  Forward Primer
tggagcgtgacatttggt

SEQ ID NO: 19047 - DNA, 22 bp, Artificial sequence
  Forward Primer
tttatgcagttttccctagagg

SEQ ID NO: 19048 - DNA, 20 bp, Artificial sequence
  Forward Primer
tytgtgctatcatcatcagc

SEQ ID NO: 19049 - DNA, 25 bp, Artificial sequence
  Forward Primer
agtaagcaggtatgcagtgactact

SEQ ID NO: 19050 - DNA, 21 bp, Artificial sequence
  Forward Primer
ttcaaccatcctctgaaatga

SEQ ID NO: 19051 - DNA, 18 bp, Artificial sequence
  Forward Primer
cttcctgggggatggaca

SEQ ID NO: 19052 - DNA, 26 bp, Artificial sequence
  Forward Primer
atttacccaagtaacacttttctgag

SEQ ID NO: 19053 - DNA, 23 bp, Artificial sequence
  Forward Primer
taacactttgactttcaagcatg

SEQ ID NO: 19054 - DNA, 18 bp, Artificial sequence
  Forward Primer
ccaagcgctgcatacagt

SEQ ID NO: 19055 - DNA, 22 bp, Artificial sequence
  Forward Primer
tactcatgtctgactttgtgac

SEQ ID NO: 19056 - DNA, 25 bp, Artificial sequence
  Forward Primer
aaaacaagcaactgtaaaaacaagt

SEQ ID NO: 19057 - DNA, 24 bp, Artificial sequence
  Forward Primer
atccagtcactagaaccataatgc

SEQ ID NO: 19058 - DNA, 19 bp, Artificial sequence
  Forward Primer
cccagggaggaaaggatac

SEQ ID NO: 19059 - DNA, 23 bp, Artificial sequence
  Forward Primer
tttgactattctgtccccttatg

SEQ ID NO: 19060 - DNA, 23 bp, Artificial sequence
  Forward Primer
cactttctcttatgggaggaaac

SEQ ID NO: 19061 - DNA, 23 bp, Artificial sequence
  Forward Primer
aaaaacctgtatcaaacttacct

SEQ ID NO: 19062 - DNA, 21 bp, Artificial sequence
  Forward Primer
agcctttatagccaggataaa

SEQ ID NO: 19063 - DNA, 18 bp, Artificial sequence
  Forward Primer
ctgccggttactgctcat

SEQ ID NO: 19064 - DNA, 22 bp, Artificial sequence
  Forward Primer
cctgtgtggtctctagsaaatt

SEQ ID NO: 19065 - DNA, 28 bp, Artificial sequence
  Forward Primer
tttaattgtttttctctagttaatctgc

SEQ ID NO: 19066 - DNA, 20 bp, Artificial sequence
  Forward Primer
cagaaaagagtggacagaca

SEQ ID NO: 19067 - DNA, 19 bp, Artificial sequence
  Forward Primer
atgggcaaaacaaagagct

SEQ ID NO: 19068 - DNA, 22 bp, Artificial sequence
  Forward Primer
ccttcttgaactaacyggtgag

SEQ ID NO: 19069 - DNA, 22 bp, Artificial sequence
  Forward Primer
agagaggtctatgaggtgaggg

SEQ ID NO: 19070 - DNA, 23 bp, Artificial sequence
  Forward Primer
ttgagggaattattaggaggaaa

SEQ ID NO: 19071 - DNA, 21 bp, Artificial sequence
  Forward Primer
atcatcctaggtatgccctcc

SEQ ID NO: 19072 - DNA, 18 bp, Artificial sequence
  Forward Primer
acacatccctccaaccca

SEQ ID NO: 19073 - DNA, 24 bp, Artificial sequence
  Forward Primer
ttagttctctctcattgtttgctc

SEQ ID NO: 19074 - DNA, 29 bp, Artificial sequence
  Forward Primer
attaatttaatcatcaagacttgactagg

SEQ ID NO: 19075 - DNA, 18 bp, Artificial sequence
  Forward Primer
tgacatccagtggccagc

SEQ ID NO: 19076 - DNA, 22 bp, Artificial sequence
  Forward Primer
ttaagctcatttttttcctgca

SEQ ID NO: 19077 - DNA, 28 bp, Artificial sequence
  Forward Primer
atataaaatgaaggctaaataattctgg

SEQ ID NO: 19078 - DNA, 28 bp, Artificial sequence
  Forward Primer
agggataaaagctgaaaataaagatata

SEQ ID NO: 19079 - DNA, 26 bp, Artificial sequence
  Forward Primer
atatttagaggcaaaataaaggtagg

SEQ ID NO: 19080 - DNA, 18 bp, Artificial sequence
  Forward Primer
agttcccctggcaggaag

SEQ ID NO: 19081 - DNA, 19 bp, Artificial sequence
  Forward Primer
cctggaatctgttcacatt

SEQ ID NO: 19082 - DNA, 21 bp, Artificial sequence
  Forward Primer
cgatgtccagcttataaccag

SEQ ID NO: 19083 - DNA, 23 bp, Artificial sequence
  Forward Primer
acagaatggttgtaccttgtgaa

SEQ ID NO: 19084 - DNA, 18 bp, Artificial sequence
  Forward Primer
tggacccctctgtcttcc

SEQ ID NO: 19085 - DNA, 29 bp, Artificial sequence
  Forward Primer
aggaattccaataaataaatagtacttgg

SEQ ID NO: 19086 - DNA, 20 bp, Artificial sequence
  Forward Primer
agagggacagccattaaaga

SEQ ID NO: 19087 - DNA, 21 bp, Artificial sequence
  Forward Primer
aagtggastsagaagtccagc

SEQ ID NO: 19088 - DNA, 26 bp, Artificial sequence
  Forward Primer
agaygtatttttcagttgtttcactc

SEQ ID NO: 19089 - DNA, 22 bp, Artificial sequence
  Forward Primer
ttctacaacatgctcctccttc

SEQ ID NO: 19090 - DNA, 28 bp, Artificial sequence
  Forward Primer
tgaatctatattttaacatctttcttgc

SEQ ID NO: 19091 - DNA, 19 bp, Artificial sequence
  Forward Primer
gaagtgggcagagtgaaat

SEQ ID NO: 19092 - DNA, 18 bp, Artificial sequence
  Forward Primer
atctcgatgggcatgcat

SEQ ID NO: 19093 - DNA, 25 bp, Artificial sequence
  Forward Primer
ttgtctattcaacacattgttcaga

SEQ ID NO: 19094 - DNA, 22 bp, Artificial sequence
  Forward Primer
cctcaaagaactcacaggtatt

SEQ ID NO: 19095 - DNA, 21 bp, Artificial sequence
  Forward Primer
ttctgaaagcttcccctgtac

SEQ ID NO: 19096 - DNA, 25 bp, Artificial sequence
  Forward Primer
ttctgtttaaggaatgaaaaggtaa

SEQ ID NO: 19097 - DNA, 22 bp, Artificial sequence
  Forward Primer
atgaactcattccgtggttaaa

SEQ ID NO: 19098 - DNA, 19 bp, Artificial sequence
  Forward Primer
ttatctccggcttcatttg

SEQ ID NO: 19099 - DNA, 25 bp, Artificial sequence
  Forward Primer
tcttctgaaaagtctatgatatgcc

SEQ ID NO: 19100 - DNA, 18 bp, Artificial sequence
  Forward Primer
ctgggcctttgagcatga

SEQ ID NO: 19101 - DNA, 25 bp, Artificial sequence
  Forward Primer
aatgatgcacttgaatttaaaagag

SEQ ID NO: 19102 - DNA, 23 bp, Artificial sequence
  Forward Primer
aaaattactcatccattccactg

SEQ ID NO: 19103 - DNA, 19 bp, Artificial sequence
  Forward Primer
actcattcctccatgaagc

SEQ ID NO: 19104 - DNA, 26 bp, Artificial sequence
  Forward Primer
aaaataaagtgattaaaggcataggc

SEQ ID NO: 19105 - DNA, 23 bp, Artificial sequence
  Forward Primer
attttaaacaccacagtggtcag

SEQ ID NO: 19106 - DNA, 21 bp, Artificial sequence
  Forward Primer
ctatcacagagtttctccaaa

SEQ ID NO: 19107 - DNA, 28 bp, Artificial sequence
  Forward Primer
aaatataaagggaaatctactttatggc

SEQ ID NO: 19108 - DNA, 19 bp, Artificial sequence
  Forward Primer
tgctgtgcacttctctcaa

SEQ ID NO: 19109 - DNA, 18 bp, Artificial sequence
  Forward Primer
aacagcccccaaaacacc

SEQ ID NO: 19110 - DNA, 25 bp, Artificial sequence
  Forward Primer
acctctttgtgtataatcagctata

SEQ ID NO: 19111 - DNA, 18 bp, Artificial sequence
  Forward Primer
tgaaggctgaccatgcaa

SEQ ID NO: 19112 - DNA, 29 bp, Artificial sequence
  Forward Primer
tatttattgacttgatttatactggaagc

SEQ ID NO: 19113 - DNA, 21 bp, Artificial sequence
  Forward Primer
agttcttcatggataaaacgg

SEQ ID NO: 19114 - DNA, 28 bp, Artificial sequence
  Forward Primer
agttacaggaggaaagttaaaagtatca

SEQ ID NO: 19115 - DNA, 29 bp, Artificial sequence
  Forward Primer
aaattctcctttactgttcttaagattct

SEQ ID NO: 19116 - DNA, 22 bp, Artificial sequence
  Forward Primer
attttcagtgtgttttgctgac

SEQ ID NO: 19117 - DNA, 22 bp, Artificial sequence
  Forward Primer
aaaaggcacagaaataaaaagg

SEQ ID NO: 19118 - DNA, 21 bp, Artificial sequence
  Forward Primer
tcctgatgaacactgacgact

SEQ ID NO: 19119 - DNA, 30 bp, Artificial sequence
  Forward Primer
tttattagtcagaggaaagactttttattc

SEQ ID NO: 19120 - DNA, 21 bp, Artificial sequence
  Forward Primer
tcaggcgaacttactttctgg

SEQ ID NO: 19121 - DNA, 24 bp, Artificial sequence
  Forward Primer
ttgtcctaaacctttataaatttc

SEQ ID NO: 19122 - DNA, 30 bp, Artificial sequence
  Forward Primer
catcagagttactatgttgtaaagatttta

SEQ ID NO: 19123 - DNA, 24 bp, Artificial sequence
  Forward Primer
tctttctttttagcaacattctat

SEQ ID NO: 19124 - DNA, 30 bp, Artificial sequence
  Forward Primer
tattttatatgtgtaataacatgctcctaa

SEQ ID NO: 19125 - DNA, 24 bp, Artificial sequence
  Forward Primer
aaaagagtaagtgaaaacaaaatc

SEQ ID NO: 19126 - DNA, 25 bp, Artificial sequence
  Forward Primer
aaggggatatatgttcaactgtact

SEQ ID NO: 19127 - DNA, 18 bp, Artificial sequence
  Forward Primer
tcagcgcccttgcattta

SEQ ID NO: 19128 - DNA, 23 bp, Artificial sequence
  Forward Primer
tacataaatccccatttacataa

SEQ ID NO: 19129 - DNA, 21 bp, Artificial sequence
  Forward Primer
ataaaaagatgctccttggca

SEQ ID NO: 19130 - DNA, 26 bp, Artificial sequence
  Forward Primer
aaaatgtctctttcatgtttcatagg

SEQ ID NO: 19131 - DNA, 19 bp, Artificial sequence
  Forward Primer
agagcatggtgtcataggg

SEQ ID NO: 19132 - DNA, 26 bp, Artificial sequence
  Forward Primer
agatatccagcagtacaaattagctt

SEQ ID NO: 19133 - DNA, 25 bp, Artificial sequence
  Forward Primer
tggatagaattctgttttggatagt

SEQ ID NO: 19134 - DNA, 26 bp, Artificial sequence
  Forward Primer
aatttattgagcatttactatgggtg

SEQ ID NO: 19135 - DNA, 20 bp, Artificial sequence
  Forward Primer
aaacagaagccagtggtctg

SEQ ID NO: 19136 - DNA, 20 bp, Artificial sequence
  Forward Primer
attgtctttggccartcctc

SEQ ID NO: 19137 - DNA, 27 bp, Artificial sequence
  Forward Primer
taatgttctcttgctattaactcatgc

SEQ ID NO: 19138 - DNA, 18 bp, Artificial sequence
  Forward Primer
tctggtttgccaagaggg

SEQ ID NO: 19139 - DNA, 19 bp, Artificial sequence
  Forward Primer
aagcaaaatgtcacccaga

SEQ ID NO: 19140 - DNA, 25 bp, Artificial sequence
  Forward Primer
ggtcacctagagtcatataccaaaa

SEQ ID NO: 19141 - DNA, 20 bp, Artificial sequence
  Forward Primer
tcctgcatctttgattcaag

SEQ ID NO: 19142 - DNA, 19 bp, Artificial sequence
  Forward Primer
tactgaagggggagaagga

SEQ ID NO: 19143 - DNA, 21 bp, Artificial sequence
  Forward Primer
attgtagtaggtgccgtgtcc

SEQ ID NO: 19144 - DNA, 24 bp, Artificial sequence
  Forward Primer
aataaagtgggatcatagcagagt

SEQ ID NO: 19145 - DNA, 19 bp, Artificial sequence
  Forward Primer
aatattccatggcacacgg

SEQ ID NO: 19146 - DNA, 26 bp, Artificial sequence
  Forward Primer
ttgtacaattttaaagtaaaaagggc

SEQ ID NO: 19147 - DNA, 24 bp, Artificial sequence
  Forward Primer
caaaatgcttgattaaaactcaaa

SEQ ID NO: 19148 - DNA, 24 bp, Artificial sequence
  Forward Primer
tcaaagggattaagttttattgtg

SEQ ID NO: 19149 - DNA, 20 bp, Artificial sequence
  Forward Primer
ttctcagcacgtttggttct

SEQ ID NO: 19150 - DNA, 23 bp, Artificial sequence
  Forward Primer
tgatacggtttactgasagcatt

SEQ ID NO: 19151 - DNA, 22 bp, Artificial sequence
  Forward Primer
ttataatggagctgaagggaac

SEQ ID NO: 19152 - DNA, 22 bp, Artificial sequence
  Forward Primer
tgttagagtctgaggtccagag

SEQ ID NO: 19153 - DNA, 28 bp, Artificial sequence
  Forward Primer
cctcaatttttaaagaaacagttaattc

SEQ ID NO: 19154 - DNA, 25 bp, Artificial sequence
  Forward Primer
ataaaatggaaaaggttacacgttt

SEQ ID NO: 19155 - DNA, 24 bp, Artificial sequence
  Forward Primer
taagcattcttatcagtttttctg

SEQ ID NO: 19156 - DNA, 21 bp, Artificial sequence
  Forward Primer
gactcttcacttcctcagaaa

SEQ ID NO: 19157 - DNA, 22 bp, Artificial sequence
  Forward Primer
aactctcatcacaagggaaaaa

SEQ ID NO: 19158 - DNA, 22 bp, Artificial sequence
  Forward Primer
agctgatgtgtcagacatgtta

SEQ ID NO: 19159 - DNA, 18 bp, Artificial sequence
  Forward Primer
aagtggggatgcagaacc

SEQ ID NO: 19160 - DNA, 26 bp, Artificial sequence
  Forward Primer
aggttctgtgtcatattaaaacaaca

SEQ ID NO: 19161 - DNA, 18 bp, Artificial sequence
  Forward Primer
ctgttgtcactgctgggg

SEQ ID NO: 19162 - DNA, 29 bp, Artificial sequence
  Forward Primer
atagtgggtatgtaattgtagtttctttt

SEQ ID NO: 19163 - DNA, 26 bp, Artificial sequence
  Forward Primer
aaggcttttatctgtgaaaatactct

SEQ ID NO: 19164 - DNA, 20 bp, Artificial sequence
  Forward Primer
aacacttcctctgggactca

SEQ ID NO: 19165 - DNA, 19 bp, Artificial sequence
  Forward Primer
gcaccaaactgtacggaca

SEQ ID NO: 19166 - DNA, 18 bp, Artificial sequence
  Forward Primer
gagatgccaaagacaggg

SEQ ID NO: 19167 - DNA, 22 bp, Artificial sequence
  Forward Primer
tttaggcttttgcgtttttaaa

SEQ ID NO: 19168 - DNA, 30 bp, Artificial sequence
  Forward Primer
atgaatactagaaagagatttattataagg

SEQ ID NO: 19169 - DNA, 24 bp, Artificial sequence
  Forward Primer
actttggaaagacatcaatattaa

SEQ ID NO: 19170 - DNA, 24 bp, Artificial sequence
  Forward Primer
taaatcacatgtatcaactgtttt

SEQ ID NO: 19171 - DNA, 18 bp, Artificial sequence
  Forward Primer
cacgtgagctgaccaggg

SEQ ID NO: 19172 - DNA, 26 bp, Artificial sequence
  Forward Primer
atatttcatcagaaatcttcaacctg

SEQ ID NO: 19173 - DNA, 23 bp, Artificial sequence
  Forward Primer
aagtgattcattaagattacggg

SEQ ID NO: 19174 - DNA, 26 bp, Artificial sequence
  Forward Primer
agaagaaaaaccaaataatttatgcc

SEQ ID NO: 19175 - DNA, 26 bp, Artificial sequence
  Forward Primer
tttttactctctatccctgctcttaa

SEQ ID NO: 19176 - DNA, 18 bp, Artificial sequence
  Forward Primer
gacgctgcccgatgaagt

SEQ ID NO: 19177 - DNA, 18 bp, Artificial sequence
  Forward Primer
tcacggcatctggcaact

SEQ ID NO: 19178 - DNA, 19 bp, Artificial sequence
  Forward Primer
tgcttggctaagtactgcg

SEQ ID NO: 19179 - DNA, 24 bp, Artificial sequence
  Forward Primer
tttttgctatgtgtgacctctaga

SEQ ID NO: 19180 - DNA, 26 bp, Artificial sequence
  Forward Primer
aatttctaagacatcaaaagtgtcct

SEQ ID NO: 19181 - DNA, 23 bp, Artificial sequence
  Forward Primer
tttttcttcaacagtgtagcaca

SEQ ID NO: 19182 - DNA, 28 bp, Artificial sequence
  Forward Primer
ataaagattattggacaaagattaaagg

SEQ ID NO: 19183 - DNA, 24 bp, Artificial sequence
  Forward Primer
tttggctacattttcctttttaaa

SEQ ID NO: 19184 - DNA, 18 bp, Artificial sequence
  Forward Primer
atcgggcctctgaagtcc

SEQ ID NO: 19185 - DNA, 21 bp, Artificial sequence
  Forward Primer
ctatcacagagtttctccaaa

SEQ ID NO: 19186 - DNA, 24 bp, Artificial sequence
  Forward Primer
atgtaagtctcattagactccgtg

SEQ ID NO: 19187 - DNA, 18 bp, Artificial sequence
  Forward Primer
tgtcgtgtggagcaatca

SEQ ID NO: 19188 - DNA, 24 bp, Artificial sequence
  Forward Primer
ttatttggtaggtgaaatgcatac

SEQ ID NO: 19189 - DNA, 21 bp, Artificial sequence
  Forward Primer
aattaaacacaagcctccgat

SEQ ID NO: 19190 - DNA, 18 bp, Artificial sequence
  Forward Primer
ctgagcctggcacttgaa

SEQ ID NO: 19191 - DNA, 29 bp, Artificial sequence
  Forward Primer
aactatactggtacatatttgttttggat

SEQ ID NO: 19192 - DNA, 24 bp, Artificial sequence
  Forward Primer
tagggtagatacaaaggattggaa

SEQ ID NO: 19193 - DNA, 18 bp, Artificial sequence
  Forward Primer
agctcagctcagtctcgc

SEQ ID NO: 19194 - DNA, 24 bp, Artificial sequence
  Forward Primer
tctatttttttaaggaatctccat

SEQ ID NO: 19195 - DNA, 21 bp, Artificial sequence
  Forward Primer
agatctgcacagagggagaat

SEQ ID NO: 19196 - DNA, 24 bp, Artificial sequence
  Forward Primer
tgtattccaacatacagtcattgg

SEQ ID NO: 19197 - DNA, 24 bp, Artificial sequence
  Forward Primer
tgtattccaacatacagtcattgg

SEQ ID NO: 19198 - DNA, 28 bp, Artificial sequence
  Forward Primer
ttgattatatttttttctacgtcagaga

SEQ ID NO: 19199 - DNA, 28 bp, Artificial sequence
  Forward Primer
attctaaataaaaggtgttggttttact

SEQ ID NO: 19200 - DNA, 20 bp, Artificial sequence
  Forward Primer
ttctcagcacgtttggttct

SEQ ID NO: 19201 - DNA, 23 bp, Artificial sequence
  Forward Primer
tgatacggtttactgasagcatt

SEQ ID NO: 19202 - DNA, 22 bp, Artificial sequence
  Forward Primer
ttataatggagctgaagggaac

SEQ ID NO: 19203 - DNA, 20 bp, Artificial sequence
  Forward Primer
aagctttctcttggaaatgg

SEQ ID NO: 19204 - DNA, 22 bp, Artificial sequence
  Forward Primer
aacaaatgttctttcaccttca

SEQ ID NO: 19205 - DNA, 24 bp, Artificial sequence
  Forward Primer
tttttatgtcaaaggccagatagt

SEQ ID NO: 19206 - DNA, 24 bp, Artificial sequence
  Forward Primer
tgtaacaccctgtgtcagattaag

SEQ ID NO: 19207 - DNA, 27 bp, Artificial sequence
  Forward Primer
ttttggaatatcaattctcttttgtac

SEQ ID NO: 19208 - DNA, 20 bp, Artificial sequence
  Forward Primer
tgtgtgaaccaccagagact

SEQ ID NO: 19209 - DNA, 25 bp, Artificial sequence
  Forward Primer
tttcaggtcacttcactagaaaact

SEQ ID NO: 19210 - DNA, 22 bp, Artificial sequence
  Forward Primer
attttcagtgtgttttgctgac

SEQ ID NO: 19211 - DNA, 22 bp, Artificial sequence
  Forward Primer
tctagcctaaggatgagaaaag

SEQ ID NO: 19212 - DNA, 26 bp, Artificial sequence
  Forward Primer
taaatgaaagagcaaattttagtgag

SEQ ID NO: 19213 - DNA, 25 bp, Artificial sequence
  Forward Primer
tttaaggattcgtttgaaaataagc

SEQ ID NO: 19214 - DNA, 19 bp, Artificial sequence
  Forward Primer
tggacttgatcctgtcctg

SEQ ID NO: 19215 - DNA, 23 bp, Artificial sequence
  Forward Primer
aataacgtgagtcctaaactcgg

SEQ ID NO: 19216 - DNA, 21 bp, Artificial sequence
  Forward Primer
aaaaatcggcttaaaggaaca

SEQ ID NO: 19217 - DNA, 19 bp, Artificial sequence
  Forward Primer
gcattgcattcttgatcca

SEQ ID NO: 19218 - DNA, 21 bp, Artificial sequence
  Forward Primer
aatatgccttcattggtaggc

SEQ ID NO: 19219 - DNA, 23 bp, Artificial sequence
  Forward Primer
cctgagtaatatagcagcaacgt

SEQ ID NO: 19220 - DNA, 30 bp, Artificial sequence
  Forward Primer
ataaataataattcagcaagtaatctagac

SEQ ID NO: 19221 - DNA, 23 bp, Artificial sequence
  Forward Primer
atatgaaaagatctgcaaaacca

SEQ ID NO: 19222 - DNA, 24 bp, Artificial sequence
  Forward Primer
aggagaagtactgtatgctcattc

SEQ ID NO: 19223 - DNA, 21 bp, Artificial sequence
  Forward Primer
ttttaaatgagcctctctggc

SEQ ID NO: 19224 - DNA, 18 bp, Artificial sequence
  Forward Primer
gaggtctatggtgcgtgg

SEQ ID NO: 19225 - DNA, 19 bp, Artificial sequence
  Forward Primer
ggattgtggcttcaaagaa

SEQ ID NO: 19226 - DNA, 21 bp, Artificial sequence
  Forward Primer
ttttcatggagtttcagatgc

SEQ ID NO: 19227 - DNA, 22 bp, Artificial sequence
  Forward Primer
agccacgagtttaggataaagg

SEQ ID NO: 19228 - DNA, 22 bp, Artificial sequence
  Forward Primer
tgttagagtctgaggtccagag

SEQ ID NO: 19229 - DNA, 28 bp, Artificial sequence
  Forward Primer
cctcaatttttaaagaaacagttaattc

SEQ ID NO: 19230 - DNA, 25 bp, Artificial sequence
  Forward Primer
ataaaatggaaaaggttacacgttt

SEQ ID NO: 19231 - DNA, 24 bp, Artificial sequence
  Forward Primer
taagcattcttatcagtttttctg

SEQ ID NO: 19232 - DNA, 21 bp, Artificial sequence
  Forward Primer
gactcttcacttcctcagaaa

SEQ ID NO: 19233 - DNA, 22 bp, Artificial sequence
  Forward Primer
aactctcatcacaagggaaaaa

SEQ ID NO: 19234 - DNA, 22 bp, Artificial sequence
  Forward Primer
agctgatgtgtcagacatgtta

SEQ ID NO: 19235 - DNA, 18 bp, Artificial sequence
  Forward Primer
aagtggggatgcagaacc

SEQ ID NO: 19236 - DNA, 26 bp, Artificial sequence
  Forward Primer
aggttctgtgtcatattaaaacaaca

SEQ ID NO: 19237 - DNA, 18 bp, Artificial sequence
  Forward Primer
ctgttgtcactgctgggg

SEQ ID NO: 19238 - DNA, 29 bp, Artificial sequence
  Forward Primer
atagtgggtatgtaattgtagtttctttt

SEQ ID NO: 19239 - DNA, 26 bp, Artificial sequence
  Forward Primer
aaggcttttatctgtgaaaatactct

SEQ ID NO: 19240 - DNA, 20 bp, Artificial sequence
  Forward Primer
aacacttcctctgggactca

SEQ ID NO: 19241 - DNA, 19 bp, Artificial sequence
  Forward Primer
gcaccaaactgtacggaca

SEQ ID NO: 19242 - DNA, 24 bp, Artificial sequence
  Forward Primer
tggctcttaaatagtgctattctt

SEQ ID NO: 19243 - DNA, 24 bp, Artificial sequence
  Forward Primer
atttttggaaaacaaatcaaagtg

SEQ ID NO: 19244 - DNA, 23 bp, Artificial sequence
  Forward Primer
aaagatgaaaattagcagaccca

SEQ ID NO: 19245 - DNA, 27 bp, Artificial sequence
  Forward Primer
aaaaactagaactccctactgtaaagc

SEQ ID NO: 19246 - DNA, 20 bp, Artificial sequence
  Forward Primer
atcaacaccctgcatctgtg

SEQ ID NO: 19247 - DNA, 23 bp, Artificial sequence
  Forward Primer
aattggtgttgtattgtaggctc

SEQ ID NO: 19248 - DNA, 25 bp, Artificial sequence
  Forward Primer
tattttatgatttgattcacgaagg

SEQ ID NO: 19249 - DNA, 25 bp, Artificial sequence
  Forward Primer
tgtgtactttaaaggataggcattc

SEQ ID NO: 19250 - DNA, 22 bp, Artificial sequence
  Forward Primer
acgaagaaaatataccatggga

SEQ ID NO: 19251 - DNA, 27 bp, Artificial sequence
  Forward Primer
aggtatttttttcctaaaatgttctca

SEQ ID NO: 19252 - DNA, 24 bp, Artificial sequence
  Forward Primer
tgctatcacacatactttttctgg

SEQ ID NO: 19253 - DNA, 24 bp, Artificial sequence
  Forward Primer
actactccaacagaaaagtgaagc

SEQ ID NO: 19254 - DNA, 21 bp, Artificial sequence
  Forward Primer
ttcatggtgaggtacaggatc

SEQ ID NO: 19255 - DNA, 24 bp, Artificial sequence
  Forward Primer
ttgcacatttaaactgaaaacatg

SEQ ID NO: 19256 - DNA, 24 bp, Artificial sequence
  Forward Primer
agcagcatcttcttatttagactt

SEQ ID NO: 19257 - DNA, 19 bp, Artificial sequence
  Forward Primer
cagccctggaactaggact

SEQ ID NO: 19258 - DNA, 28 bp, Artificial sequence
  Forward Primer
ttgtttaataattcaaatctgtctagct

SEQ ID NO: 19259 - DNA, 18 bp, Artificial sequence
  Forward Primer
ttcgctccaccacccagg

SEQ ID NO: 19260 - DNA, 27 bp, Artificial sequence
  Forward Primer
ttaaatgaaagagttaggacagatgat

SEQ ID NO: 19261 - DNA, 26 bp, Artificial sequence
  Forward Primer
atagacttgtgtccttctctgtcttt

SEQ ID NO: 19262 - DNA, 25 bp, Artificial sequence
  Forward Primer
acctctttgtgtataatcagctata

SEQ ID NO: 19263 - DNA, 30 bp, Artificial sequence
  Forward Primer
tatataactccttctgtcttatggattaag

SEQ ID NO: 19264 - DNA, 25 bp, Artificial sequence
  Forward Primer
aataaatactctggtctccttctcc

SEQ ID NO: 19265 - DNA, 29 bp, Artificial sequence
  Forward Primer
tgaatgataaccctaactacaatattaca

SEQ ID NO: 19266 - DNA, 21 bp, Artificial sequence
  Forward Primer
attgtaccttaagagccccct

SEQ ID NO: 19267 - DNA, 22 bp, Artificial sequence
  Forward Primer
ttttattcagatgtagctgacc

SEQ ID NO: 19268 - DNA, 23 bp, Artificial sequence
  Forward Primer
aaaagaagccatttcttttgact

SEQ ID NO: 19269 - DNA, 19 bp, Artificial sequence
  Forward Primer
ttcagaaggaaacatggac

SEQ ID NO: 19270 - DNA, 21 bp, Artificial sequence
  Forward Primer
taggccttagctgacsttctg

SEQ ID NO: 19271 - DNA, 18 bp, Artificial sequence
  Forward Primer
gaaagcctcacagcctgg

SEQ ID NO: 19272 - DNA, 25 bp, Artificial sequence
  Forward Primer
ataaatgaacacatatgtccacaca

SEQ ID NO: 19273 - DNA, 20 bp, Artificial sequence
  Forward Primer
ccagaatgaggagtgagatg

SEQ ID NO: 19274 - DNA, 20 bp, Artificial sequence
  Forward Primer
attactttccaggaaacccc

SEQ ID NO: 19275 - DNA, 18 bp, Artificial sequence
  Forward Primer
tgaaggctgaccatgcaa

SEQ ID NO: 19276 - DNA, 20 bp, Artificial sequence
  Forward Primer
aaaccctggagaggaatgac

SEQ ID NO: 19277 - DNA, 23 bp, Artificial sequence
  Forward Primer
aaggttaatcaggtaaaagggtg

SEQ ID NO: 19278 - DNA, 21 bp, Artificial sequence
  Forward Primer
attcatgtgtgctccagctac

SEQ ID NO: 19279 - DNA, 27 bp, Artificial sequence
  Forward Primer
gagaaaacaaagtttgtaaaacagaat

SEQ ID NO: 19280 - DNA, 21 bp, Artificial sequence
  Forward Primer
aaattgagcacagcaggtagg

SEQ ID NO: 19281 - DNA, 18 bp, Artificial sequence
  Forward Primer
aagcccatggtccggtgc

SEQ ID NO: 19282 - DNA, 23 bp, Artificial sequence
  Forward Primer
attttaaacaccacagtggtcag

SEQ ID NO: 19283 - DNA, 20 bp, Artificial sequence
  Forward Primer
cagacaacagactccagctg

SEQ ID NO: 19284 - DNA, 18 bp, Artificial sequence
  Forward Primer
ttgagtgacaccaggcgc

SEQ ID NO: 19285 - DNA, 28 bp, Artificial sequence
  Forward Primer
aaatataaagggaaatctactttatggc

SEQ ID NO: 19286 - DNA, 22 bp, Artificial sequence
  Forward Primer
tataagagccggaagtaggaca

SEQ ID NO: 19287 - DNA, 19 bp, Artificial sequence
  Forward Primer
ccgcatttgcatagtctgt

SEQ ID NO: 19288 - DNA, 28 bp, Artificial sequence
  Forward Primer
atccatgctttaggtaaataattctaca

SEQ ID NO: 19289 - DNA, 19 bp, Artificial sequence
  Forward Primer
ggaacagggagtggagatt

SEQ ID NO: 19290 - DNA, 18 bp, Artificial sequence
  Forward Primer
accaggaagcccagatca

SEQ ID NO: 19291 - DNA, 21 bp, Artificial sequence
  Forward Primer
atcaatctggttattcctttc

SEQ ID NO: 19292 - DNA, 18 bp, Artificial sequence
  Forward Primer
ccagtcgtgtagccccct

SEQ ID NO: 19293 - DNA, 20 bp, Artificial sequence
  Forward Primer
agttgagggcttgaagtgtg

SEQ ID NO: 19294 - DNA, 21 bp, Artificial sequence
  Forward Primer
aagagttcatgatccaaaccc

SEQ ID NO: 19295 - DNA, 18 bp, Artificial sequence
  Forward Primer
aactccaagtccaagggc

SEQ ID NO: 19296 - DNA, 19 bp, Artificial sequence
  Forward Primer
tctttgggggacattttct

SEQ ID NO: 19297 - DNA, 24 bp, Artificial sequence
  Forward Primer
ggttattgtaggcctaatggatag

SEQ ID NO: 19298 - DNA, 19 bp, Artificial sequence
  Forward Primer
aagtcaggcagaggtgagt

SEQ ID NO: 19299 - DNA, 19 bp, Artificial sequence
  Forward Primer
agaccaagagtttggagaa

SEQ ID NO: 19300 - DNA, 23 bp, Artificial sequence
  Forward Primer
ttcatagcagaaaaggtacgaac

SEQ ID NO: 19301 - DNA, 20 bp, Artificial sequence
  Forward Primer
gaggcctagatttgagtcat

SEQ ID NO: 19302 - DNA, 21 bp, Artificial sequence
  Forward Primer
agttcttcatggataaaacgg

SEQ ID NO: 19303 - DNA, 18 bp, Artificial sequence
  Forward Primer
ttctcctcttggcccgta

SEQ ID NO: 19304 - DNA, 21 bp, Artificial sequence
  Forward Primer
aggattcactgctcattcatc

SEQ ID NO: 19305 - DNA, 21 bp, Artificial sequence
  Forward Primer
tttgtgacattgagcaagtgc

SEQ ID NO: 19306 - DNA, 25 bp, Artificial sequence
  Forward Primer
aaatatctgaaagcttcaagaatgc

SEQ ID NO: 19307 - DNA, 19 bp, Artificial sequence
  Forward Primer
ttgccagaagacctactgc

SEQ ID NO: 19308 - DNA, 18 bp, Artificial sequence
  Forward Primer
tccttgtgagtggtgggc

SEQ ID NO: 19309 - DNA, 27 bp, Artificial sequence
  Forward Primer
ggaataggatttaggatgtttttaatt

SEQ ID NO: 19310 - DNA, 24 bp, Artificial sequence
  Forward Primer
aaatgctaaaagctcagaaaattg

SEQ ID NO: 19311 - DNA, 20 bp, Artificial sequence
  Forward Primer
caaactacctacagctcagg

SEQ ID NO: 19312 - DNA, 23 bp, Artificial sequence
  Forward Primer
atgaaagtgatttcctttcacaa

SEQ ID NO: 19313 - DNA, 27 bp, Artificial sequence
  Forward Primer
ataactaaactgtcattatttcgtcct

SEQ ID NO: 19314 - DNA, 22 bp, Artificial sequence
  Forward Primer
acagctttcaaagagagtagtt

SEQ ID NO: 19315 - DNA, 24 bp, Artificial sequence
  Forward Primer
taggaaataagaatccatagggta

SEQ ID NO: 19316 - DNA, 21 bp, Artificial sequence
  Forward Primer
taataccttccggataaggat

SEQ ID NO: 19317 - DNA, 26 bp, Artificial sequence
  Forward Primer
tgatttaatcaattcaatacactgct

SEQ ID NO: 19318 - DNA, 18 bp, Artificial sequence
  Forward Primer
tccaaccccagtgccctt

SEQ ID NO: 19319 - DNA, 24 bp, Artificial sequence
  Forward Primer
atactatgttgcatcagctttcac

SEQ ID NO: 19320 - DNA, 25 bp, Artificial sequence
  Forward Primer
ttaacacattaaggtactattatgc

SEQ ID NO: 19321 - DNA, 30 bp, Artificial sequence
  Forward Primer
agagtagaatgtgtagttagatatattttc

SEQ ID NO: 19322 - DNA, 24 bp, Artificial sequence
  Forward Primer
taaacatgctgaaggaagtaaatc

SEQ ID NO: 19323 - DNA, 27 bp, Artificial sequence
  Forward Primer
ttttaggacaattactgaaaaatagct

SEQ ID NO: 19324 - DNA, 18 bp, Artificial sequence
  Forward Primer
tgaggctgaaggagcccc

SEQ ID NO: 19325 - DNA, 19 bp, Artificial sequence
  Forward Primer
tttgccagagcaatgactc

SEQ ID NO: 19326 - DNA, 25 bp, Artificial sequence
  Forward Primer
atatgcatttgtacactgacagttg

SEQ ID NO: 19327 - DNA, 28 bp, Artificial sequence
  Forward Primer
aaatatcatcaccaattttaataccttc

SEQ ID NO: 19328 - DNA, 29 bp, Artificial sequence
  Forward Primer
ttttgaggtaaatacaatttatagaggtc

SEQ ID NO: 19329 - DNA, 24 bp, Artificial sequence
  Forward Primer
atttattacatgaggggcagtatg

SEQ ID NO: 19330 - DNA, 19 bp, Artificial sequence
  Forward Primer
gagccaaagactgggaaaa

SEQ ID NO: 19331 - DNA, 25 bp, Artificial sequence
  Forward Primer
taaaatttgcttatcgtacatcaca

SEQ ID NO: 19332 - DNA, 21 bp, Artificial sequence
  Forward Primer
agaatctctgggacaagagtc

SEQ ID NO: 19333 - DNA, 27 bp, Artificial sequence
  Forward Primer
cctgtttcatttatacctacttgaaaa

SEQ ID NO: 19334 - DNA, 24 bp, Artificial sequence
  Forward Primer
atctgctagtcttcagtccaattg

SEQ ID NO: 19335 - DNA, 19 bp, Artificial sequence
  Forward Primer
tttccaaaactcaccacag

SEQ ID NO: 19336 - DNA, 24 bp, Artificial sequence
  Forward Primer
accacccacactttatctactgtc

SEQ ID NO: 19337 - DNA, 18 bp, Artificial sequence
  Forward Primer
tcgggaggctgtaaatgc

SEQ ID NO: 19338 - DNA, 18 bp, Artificial sequence
  Forward Primer
gcctgagggcctgaacta

SEQ ID NO: 19339 - DNA, 18 bp, Artificial sequence
  Forward Primer
aagagcagccttgctgaa

SEQ ID NO: 19340 - DNA, 18 bp, Artificial sequence
  Forward Primer
tgcacgggttacagctga

SEQ ID NO: 19341 - DNA, 28 bp, Artificial sequence
  Forward Primer
atattccacaaactctataaaaggttaa

SEQ ID NO: 19342 - DNA, 27 bp, Artificial sequence
  Forward Primer
ttacattgactcataagaaagtgtcat

SEQ ID NO: 19343 - DNA, 24 bp, Artificial sequence
  Forward Primer
gaatatcatactccgaagacttcc

SEQ ID NO: 19344 - DNA, 23 bp, Artificial sequence
  Forward Primer
attaaggctgtggagtttttacc

SEQ ID NO: 19345 - DNA, 19 bp, Artificial sequence
  Forward Primer
tctacgtgtcctccccaac

SEQ ID NO: 19346 - DNA, 19 bp, Artificial sequence
  Forward Primer
tttgggggtaaaaccactc

SEQ ID NO: 19347 - DNA, 24 bp, Artificial sequence
  Forward Primer
tggatggattaaacatttttcttt

SEQ ID NO: 19348 - DNA, 20 bp, Artificial sequence
  Forward Primer
aaaaccacagccatttctcc

SEQ ID NO: 19349 - DNA, 24 bp, Artificial sequence
  Forward Primer
acttagagactaaaccaccaccaa

SEQ ID NO: 19350 - DNA, 27 bp, Artificial sequence
  Forward Primer
ataactcaaagtgattttccatatgag

SEQ ID NO: 19351 - DNA, 20 bp, Artificial sequence
  Forward Primer
ttttctggggacaacaaaac

SEQ ID NO: 19352 - DNA, 23 bp, Artificial sequence
  Forward Primer
ggaaatttgccttactctttaat

SEQ ID NO: 19353 - DNA, 18 bp, Artificial sequence
  Forward Primer
tgtgtcctcgggctcaac

SEQ ID NO: 19354 - DNA, 20 bp, Artificial sequence
  Forward Primer
tcacgttcctaccttttccc

SEQ ID NO: 19355 - DNA, 19 bp, Artificial sequence
  Forward Primer
accgagtggggagttagaa

SEQ ID NO: 19356 - DNA, 27 bp, Artificial sequence
  Forward Primer
ttttcactttgtaaatagagtcagctt

SEQ ID NO: 19357 - DNA, 20 bp, Artificial sequence
  Forward Primer
aggcaatgatgattcccttc

SEQ ID NO: 19358 - DNA, 18 bp, Artificial sequence
  Forward Primer
ttgggaggtggggttgag

SEQ ID NO: 19359 - DNA, 22 bp, Artificial sequence
  Forward Primer
ttcatgctagtggtgacagttg

SEQ ID NO: 19360 - DNA, 26 bp, Artificial sequence
  Forward Primer
tggtctattgactctacttatgaatt

SEQ ID NO: 19361 - DNA, 29 bp, Artificial sequence
  Forward Primer
agaaatatttttgcagyctattgatatag

SEQ ID NO: 19362 - DNA, 25 bp, Artificial sequence
  Forward Primer
ttaccatcacaatttcctaattacc

SEQ ID NO: 19363 - DNA, 18 bp, Artificial sequence
  Forward Primer
tgctgcagggtgtcagat

SEQ ID NO: 19364 - DNA, 23 bp, Artificial sequence
  Forward Primer
attttatgtttctccagggtctt

SEQ ID NO: 19365 - DNA, 19 bp, Artificial sequence
  Forward Primer
atttgctatgatttggggc

SEQ ID NO: 19366 - DNA, 21 bp, Artificial sequence
  Forward Primer
tgggwgaggtaaatgaaatgg

SEQ ID NO: 19367 - DNA, 26 bp, Artificial sequence
  Forward Primer
aaaaggtaaacgttagttccatttta

SEQ ID NO: 19368 - DNA, 24 bp, Artificial sequence
  Forward Primer
tagcaaccagagagaactcataaa

SEQ ID NO: 19369 - DNA, 19 bp, Artificial sequence
  Forward Primer
tgagctttccttaggggtg

SEQ ID NO: 19370 - DNA, 21 bp, Artificial sequence
  Forward Primer
tcccaatcatagagaatgagg

SEQ ID NO: 19371 - DNA, 27 bp, Artificial sequence
  Forward Primer
aatgtgtaaaacattttgtaaaacctg

SEQ ID NO: 19372 - DNA, 18 bp, Artificial sequence
  Forward Primer
tgagatggtagccccctt

SEQ ID NO: 19373 - DNA, 28 bp, Artificial sequence
  Forward Primer
ttcttcatatagaaagaacaatatcttc

SEQ ID NO: 19374 - DNA, 29 bp, Artificial sequence
  Forward Primer
tatttattgacttgatttatactggaagc

SEQ ID NO: 19375 - DNA, 22 bp, Artificial sequence
  Forward Primer
ttgaagtcctaaaaacacccac

SEQ ID NO: 19376 - DNA, 29 bp, Artificial sequence
  Forward Primer
tataagtactcttgtgtattgaacttgga

SEQ ID NO: 19377 - DNA, 26 bp, Artificial sequence
  Forward Primer
aaaatagaagcatctgccataatatc

SEQ ID NO: 19378 - DNA, 26 bp, Artificial sequence
  Forward Primer
tagaatacaggcagtgtatttacttc

SEQ ID NO: 19379 - DNA, 24 bp, Artificial sequence
  Forward Primer
aatgaatgaatgatttttggtttg

SEQ ID NO: 19380 - DNA, 24 bp, Artificial sequence
  Forward Primer
tttcatgtggaaatcaaaaataac

SEQ ID NO: 19381 - DNA, 22 bp, Artificial sequence
  Forward Primer
aaaagcatcataatgaaaccat

SEQ ID NO: 19382 - DNA, 23 bp, Artificial sequence
  Forward Primer
aaaatattccaaacaagtttccc

SEQ ID NO: 19383 - DNA, 20 bp, Artificial sequence
  Forward Primer
tgaaagatacacttccccat

SEQ ID NO: 19384 - DNA, 23 bp, Artificial sequence
  Forward Primer
atttctttccagaatgattgcta

SEQ ID NO: 19385 - DNA, 30 bp, Artificial sequence
  Forward Primer
aattagagatagtttagaagttaacatcgt

SEQ ID NO: 19386 - DNA, 23 bp, Artificial sequence
  Forward Primer
atgtcttctgatctgtgaaatgg

SEQ ID NO: 19387 - DNA, 30 bp, Artificial sequence
  Forward Primer
actacttgcattcctaaattaaatatatcc

SEQ ID NO: 19388 - DNA, 19 bp, Artificial sequence
  Forward Primer
acaagagctgcaggagttc

SEQ ID NO: 19389 - DNA, 21 bp, Artificial sequence
  Forward Primer
ttgctttaagagaacagagaa

SEQ ID NO: 19390 - DNA, 26 bp, Artificial sequence
  Forward Primer
aatgtacaagacaaactgagaagaat

SEQ ID NO: 19391 - DNA, 27 bp, Artificial sequence
  Forward Primer
tataatggatagaagcaaaagaatttc

SEQ ID NO: 19392 - DNA, 28 bp, Artificial sequence
  Forward Primer
ttcttctctaaacatacacactatgctc

SEQ ID NO: 19393 - DNA, 20 bp, Artificial sequence
  Forward Primer
tcccaaacctttgcatttac

SEQ ID NO: 19394 - DNA, 19 bp, Artificial sequence
  Forward Primer
gttggcttgaaagatcaag

SEQ ID NO: 19395 - DNA, 27 bp, Artificial sequence
  Forward Primer
tttaccattcaaacataattattggtc

SEQ ID NO: 19396 - DNA, 22 bp, Artificial sequence
  Forward Primer
ttcatggttaggactcygaaat

SEQ ID NO: 19397 - DNA, 25 bp, Artificial sequence
  Forward Primer
aatttctttaccaactgagctatga

SEQ ID NO: 19398 - DNA, 25 bp, Artificial sequence
  Forward Primer
tgtgtgccttatgtacaatgaatac

SEQ ID NO: 19399 - DNA, 24 bp, Artificial sequence
  Forward Primer
tttaaattgcatgatgacttacca

SEQ ID NO: 19400 - DNA, 28 bp, Artificial sequence
  Forward Primer
aatacaaaattattttcatacaggaagc

SEQ ID NO: 19401 - DNA, 19 bp, Artificial sequence
  Forward Primer
gaacagcagcaaaacacac

SEQ ID NO: 19402 - DNA, 27 bp, Artificial sequence
  Forward Primer
tgtttgaggattattagttcataactt

SEQ ID NO: 19403 - DNA, 26 bp, Artificial sequence
  Forward Primer
aataagaggtgttaataggatttgga

SEQ ID NO: 19404 - DNA, 24 bp, Artificial sequence
  Forward Primer
aaaacctggagctgacttctaata

SEQ ID NO: 19405 - DNA, 20 bp, Artificial sequence
  Forward Primer
tttccttgatgatgtggtct

SEQ ID NO: 19406 - DNA, 19 bp, Artificial sequence
  Forward Primer
caacggtctctcacacctc

SEQ ID NO: 19407 - DNA, 19 bp, Artificial sequence
  Forward Primer
ttgccatcaagtgtgcttc

SEQ ID NO: 19408 - DNA, 19 bp, Artificial sequence
  Forward Primer
ttgtaattcacctggccac

SEQ ID NO: 19409 - DNA, 24 bp, Artificial sequence
  Forward Primer
agcawtagggtaaagataaaacag

SEQ ID NO: 19410 - DNA, 20 bp, Artificial sequence
  Forward Primer
ttactatgccattctgggga

SEQ ID NO: 19411 - DNA, 25 bp, Artificial sequence
  Forward Primer
tgatatgcttacaaattgtcaactg

SEQ ID NO: 19412 - DNA, 20 bp, Artificial sequence
  Forward Primer
tcttctgacccttcactcaa

SEQ ID NO: 19413 - DNA, 21 bp, Artificial sequence
  Forward Primer
atttctgggaaatgagaatgc

SEQ ID NO: 19414 - DNA, 23 bp, Artificial sequence
  Forward Primer
aggatgcaggatcttagttctct

SEQ ID NO: 19415 - DNA, 26 bp, Artificial sequence
  Forward Primer
aatctagaaraatggtacagatgagc

SEQ ID NO: 19416 - DNA, 25 bp, Artificial sequence
  Forward Primer
aygtatttttcagttgtttcactca

SEQ ID NO: 19417 - DNA, 24 bp, Artificial sequence
  Forward Primer
ttgatgatgtggtctaagaatctg

SEQ ID NO: 19418 - DNA, 22 bp, Artificial sequence
  Forward Primer
aaatttcaggaaaacctcctca

SEQ ID NO: 19419 - DNA, 27 bp, Artificial sequence
  Forward Primer
agcttctgtattttactgaagatctga

SEQ ID NO: 19420 - DNA, 24 bp, Artificial sequence
  Forward Primer
caaagatgaataagaaagtgttct

SEQ ID NO: 19421 - DNA, 18 bp, Artificial sequence
  Forward Primer
tgcagtcaatggggtcac

SEQ ID NO: 19422 - DNA, 18 bp, Artificial sequence
  Forward Primer
tctccagggacggagacc

SEQ ID NO: 19423 - DNA, 20 bp, Artificial sequence
  Forward Primer
agagcaattcgattcactgg

SEQ ID NO: 19424 - DNA, 18 bp, Artificial sequence
  Forward Primer
ctgacaactcctgggcag

SEQ ID NO: 19425 - DNA, 24 bp, Artificial sequence
  Forward Primer
atttaatggaaaatcgtttcttca

SEQ ID NO: 19426 - DNA, 20 bp, Artificial sequence
  Forward Primer
agctcacttgcaagacgttc

SEQ ID NO: 19427 - DNA, 23 bp, Artificial sequence
  Forward Primer
aaataattcacgtggaaactaat

SEQ ID NO: 19428 - DNA, 28 bp, Artificial sequence
  Forward Primer
tcaactatttaaatgcaatgtagtcttt

SEQ ID NO: 19429 - DNA, 25 bp, Artificial sequence
  Forward Primer
attttgaatacagaactgcactctg

SEQ ID NO: 19430 - DNA, 22 bp, Artificial sequence
  Forward Primer
tgggaaagctttataatggaaa

SEQ ID NO: 19431 - DNA, 24 bp, Artificial sequence
  Forward Primer
tcttcaaagcactttcaataaaaa

SEQ ID NO: 19432 - DNA, 28 bp, Artificial sequence
  Forward Primer
aaattatagttgatgtggtaaagaacaa

SEQ ID NO: 19433 - DNA, 19 bp, Artificial sequence
  Forward Primer
acagatggtgcttgatctc

SEQ ID NO: 19434 - DNA, 24 bp, Artificial sequence
  Forward Primer
tgctttgattggtttgataattaa

SEQ ID NO: 19435 - DNA, 20 bp, Artificial sequence
  Forward Primer
tgatcactcaccactttgct

SEQ ID NO: 19436 - DNA, 26 bp, Artificial sequence
  Forward Primer
tacttccatatctaaccatgtttcaa

SEQ ID NO: 19437 - DNA, 18 bp, Artificial sequence
  Forward Primer
aacagcccccaaaacacc

SEQ ID NO: 19438 - DNA, 18 bp, Artificial sequence
  Forward Primer
ccagggggcaayagagga

SEQ ID NO: 19439 - DNA, 19 bp, Artificial sequence
  Forward Primer
atagcaggctcacagcatg

SEQ ID NO: 19440 - DNA, 29 bp, Artificial sequence
  Forward Primer
aagatactgtgatagctatctgaaaaatg

SEQ ID NO: 19441 - DNA, 20 bp, Artificial sequence
  Forward Primer
tccgttttccctctaaatgt

SEQ ID NO: 19442 - DNA, 27 bp, Artificial sequence
  Forward Primer
gctagaaactcaattaagtcaaaatga

SEQ ID NO: 19443 - DNA, 21 bp, Artificial sequence
  Forward Primer
gcaaataacactttcctcttt

SEQ ID NO: 19444 - DNA, 21 bp, Artificial sequence
  Forward Primer
aatcaacaagactagcacgca

SEQ ID NO: 19445 - DNA, 24 bp, Artificial sequence
  Forward Primer
aagagatggaatgtactgactggt

SEQ ID NO: 19446 - DNA, 22 bp, Artificial sequence
  Forward Primer
tgaagctttgagatgttatgga

SEQ ID NO: 19447 - DNA, 18 bp, Artificial sequence
  Forward Primer
atgctcagggcctctgcc

SEQ ID NO: 19448 - DNA, 23 bp, Artificial sequence
  Forward Primer
aagtcttccgagcttctttactt

SEQ ID NO: 19449 - DNA, 23 bp, Artificial sequence
  Forward Primer
atttatttcrcctcttccatgtt

SEQ ID NO: 19450 - DNA, 21 bp, Artificial sequence
  Forward Primer
tttgtgagagacagggttttc

SEQ ID NO: 19451 - DNA, 30 bp, Artificial sequence; identical to SEQ ID NO: 19119
  Forward Primer

SEQ ID NO: 19452 - DNA, 20 bp, Artificial sequence
  Forward Primer
tgtatgcaccacgaggatta

SEQ ID NO: 19453 - DNA, 30 bp, Artificial sequence
  Forward Primer
tatttattactcactaataggatcacaagt

SEQ ID NO: 19454 - DNA, 28 bp, Artificial sequence
  Forward Primer
gtgaattaaatataaaaatagccaacac

SEQ ID NO: 19455 - DNA, 22 bp, Artificial sequence
  Forward Primer
ttctccaaagcaagtagggata

SEQ ID NO: 19456 - DNA, 18 bp, Artificial sequence
  Forward Primer
tgcttttttggaaggacg

SEQ ID NO: 19457 - DNA, 25 bp, Artificial sequence
  Forward Primer
aaaataaactccccatatcacctat

SEQ ID NO: 19458 - DNA, 23 bp, Artificial sequence
  Forward Primer
aaatagcctgggacatgttatat

SEQ ID NO: 19459 - DNA, 19 bp, Artificial sequence
  Forward Primer
tgctgtgcacttctctcaa

SEQ ID NO: 19460 - DNA, 19 bp, Artificial sequence
  Forward Primer
tcatttccttctctaggga

SEQ ID NO: 19461 - DNA, 30 bp, Artificial sequence
  Forward Primer
tattgttttataacctgtttcttttctact

SEQ ID NO: 19462 - DNA, 28 bp, Artificial sequence
  Forward Primer
ccctaatatttctaagtattccgattta

SEQ ID NO: 19463 - DNA, 29 bp, Artificial sequence
  Forward Primer
aaattctcctttactgttcttaagattct

SEQ ID NO: 19464 - DNA, 21 bp, Artificial sequence
  Forward Primer
tcctgatgaacactgacgact

SEQ ID NO: 19465 - DNA, 25 bp, Artificial sequence
  Forward Primer
aaatatccatgagtcttgcactatg

SEQ ID NO: 19466 - DNA, 28 bp, Artificial sequence
  Forward Primer
tttttaatctgacagaatgactaaaaga

SEQ ID NO: 19467 - DNA, 24 bp, Artificial sequence
  Forward Primer
ttaaagtagatggcagaatttcct

SEQ ID NO: 19468 - DNA, 18 bp, Artificial sequence
  Forward Primer
agcattggaacggggcct

SEQ ID NO: 19469 - DNA, 27 bp, Artificial sequence
  Forward Primer
ttttgaagaaataataaaagcagtgtc

SEQ ID NO: 19470 - DNA, 20 bp, Artificial sequence
  Forward Primer
atcccatctacgattctacc

SEQ ID NO: 19471 - DNA, 18 bp, Artificial sequence
  Forward Primer
tgtgggcagagcctccct

SEQ ID NO: 19472 - DNA, 21 bp, Artificial sequence
  Forward Primer
aaacrsactcacttgccagat

SEQ ID NO: 19473 - DNA, 600 bp, Bovine  MMBT08498
cttgcactgtaaccatggttattttatcattaaagtgaatgcagsggccaggtgaagagttttgtgagaaccaggttctcgtgtggtttagtctttgagtgcctgaagcragtcatccttctccatctatgaratgggacaaaggaattgggcactggttaatctatctgtctcagcaaagtgctgcaaaggttccccaggacactgcacatgaaatcaaagcagccaccacctccactgtcaccaatctttacatgcttacaatatgccaggcacaggctaatatgttaaatgcatcayctcactaaatgcttaatgtgacttggtggcgtagacattatttccataataatgaaaacactttaccaggaaattatcatttaattctcattgcagccctttgggataggttattaaggagcctcatttaacagaattggaatcaggctcagagaggtgaagcaacttgctcaacagcacacagccattaactcatggaaatagagctcaaccctcctctgcttggtcccactgccaatgcctggatgatacacaagctcattctacagatgagaaaactaaggtttagagaaaggctga

SEQ ID NO: 19474 - DNA, 600 bp, Bovine  MMBT04310
caaagacataactgggtcagagccttggacactgacttaaccttcctttgcccttctctgctgaagctttggacggaatatggacaaagagcaatttaaatctctttccattcctgtccttagagcagcttcacatctgaacctctaataaagatgcggataataaaatggcagggaaagtacaatggaaattatattgactctcatagaagtgttggaggagaaatagattctcttccctcaactctgtaataatataatcatggtatgatttctacttcgctagacttgggactattyggaaatctttaatgaatataatcaggtagtaagcatttaaaagwtrctcttttctgaaagccaggaaattatatgctcagtcagtggaaaattcaaagaaaaaggaaaaagraaaaaaagcaagctacctttttttttttaaacaacataatacacgtgtcgtgatggaatcmaggtgggaaatgagacctgagttacggcatttgctttggaccctgcagtataaacttggggggagtcatataatatctttggggatgcggcttttgtgctgttgcaaaataataattgcaagcattt

SEQ ID NO: 19475 - DNA, 600 bp, Bovine  MMBT09435
tcagaggtgatcatgtgatctcctgaaagtcaataaaactcaaggaaacttttgctaggaatgctggcagagagtkagatggtctttcccacagataatgctaacaattatggcatcacaagccagatcagtcaggagccaaacatggggtctgagaatgaagatagttcagtggatgatagtcaaatgacagagagaaacgaggtccctggatcaaaacatgcttgaagtttactcttcccttgcactttcacattacataagccgtttctcccactttcgcttatttctctgagctgraaattctggatacctgcaatagtgagtcctgactgatattattgctgtaatggccccaggagtgctatgtaaatgagaagcagtcaatcaacttacaggattattgttgctatgtaaataaatttctcttttgactgmgtgagcagagacttccaagccagggcagttttccaaattagatttttcattgtctcagccagaagagaggcacattaggctactcagagggcaccaagcctgcccatacctctgagaatgagactttcctgccagctttccctaattgctgagggccaggtg

SEQ ID NO: 19476 - DNA, 600 bp, Bovine  MMBT06751
agctcattcagttctagttactttttcttttgtttcaaatggcagccttctctgtaaatcagataaagaactgtatcattatgttatcatctttgaaagctccataattgtagcttttctacccaagtcactgaaataaaacatctaattctacactaaatataaatttatttccagttttatgtattgtattatttactaggtgatagtgcttccaacctttttcagaggtgagcctatagtataaagaactattttttaaattacacatattttcacaaaagacaatgaaggctacayagattaggagttactcttagtagttcgtcaatacttccatattttttcttaaggacataaaagacagatattactgattttgctttaaaattagtccaaaaggctggaaaaaaaaagtcatattgaattaattaatttagatctaattaatttgtgtattcactagagcaattaagatttgtgtaaaatgagcagggattaaaaaaagtacaataaacaatatgaaaatatttactagggataatttactgctgagagtctattactgtatttttctctttatccttgttcctcaagaac

SEQ ID NO: 19477 - DNA, 600 bp, Bovine  MMBT09899
actcttcaacatggagaatcagaaagtctcatccagagatgttgtctcagacgggtgcagagctctccccttctccccctcccactccatccgaatgctgaggacacgtggagcaagagtacttccaacatcggagacccttgggaaatttaggtttctaaaaaccaaattaaagaactgcatacaaaataggttgattacagagatcataactgctttaaacaagccaaagaaatcccttctcaaaggaatactacactgattctttttgtggttccttcatgaaacagatggtctccsgttggcgctacctttgcaaacctgggcatctgtgatgggggttctacacgcccccctggtctgaggagccagtctacttgcactaatgagctgagtgagtgaggaaccaaaaatgacgtccttgccttttcttgtaaaccccttttgggaygaaacttaagtgtgtacacacacacayacacacacaattaactcttcagtctgctccctcataaagtgacaataaaaatacttgtcacagagggattaaagaagctgtctatactgaaaaattaactttaaataagtcgacaatataca

SEQ ID NO: 19478 - DNA, 600 bp, Bovine  MMBT07829
aatgaatagagtgactatacaatttatcgttcaaatgagagcacttcccaggagagaaaggttgcaccaatagtgcagaaaccagtactgtcccaaatgaaccgtgacatgtagtcatcctgacatgaagcacaataacatcaaactatgcttcctcgagcttactagcatcgtgtggaatgtgatggcaaggggcaaatcctatgttacactgatccagagagtgctaatcttgtagaaatcattggtaatagtgcctctgaagctgtaaagtgtggtggcccttttccttactccaarccaggcaattttgttaggatttaatccatattaatttacttactattcaaaaactctgaaatgcttatctccattttaagaggaagaaaccaagatagattgtytgaataacctgcccagagtcacagagctaaaactggttgagcgaagatatgaaaccacaaggtctagytttccaattcctattttaatcactgtttatacacctccttgttaattctttttctcttgcataaattttctttaataatcagaacaatactttaagaggataaaacttttaggatgaataaatttccc

SEQ ID NO: 19479 - DNA, 600 bp, Bovine  MMBT08559
catgtcatcctctgtcaccctcttctccttctgctttcaatcttttagttttcatctgatgcaaatgggaataaccatttgaaattaccaccttaaaattaacaagaaatatgagatcaaggaggaactatttccaaggaggagccatcatttttctctgagaaacagcccccctgaatgggacatgtacaggtgtggtagccgcctgcccttcatcactgggtcatgagcatttaagtgtttgtccaacatctgaatagagtctaccgttacttctgggtcttcttctccttctcagaygtgtacagttatgatttatggagcccatttctttttcctgctcatgaaacatcatgcatgtgactctcatcgggcttttgaggcaagcatggccaaggataggcaagtaacctgtggtttctataagaaagacaggttccctggaccactgtagtgcgagaaggctttcagaattccccctttcagttggacatgacaaatacctgaatggactctgggactgagaagtagagcagcatttaaaaacagacttcagactctggaamcagactgcctgggtagggctaagtcactcagcra

SEQ ID NO: 19480 - DNA, 598 bp, Bovine  MMBT17264
  misc_feature (1)..(113): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcagctaaatgcatatttgacatagtcaggaacttaaataggcagttgttccactactgaaaattgtctgagtggaatgcctgagcactggcggtagtctaaaaagaaaataagagacatctgtcggggtccttcaagcagttcagctttctaatcagaccatctgaattccttagtgaaagayaagaaaaaatcctgctacccattaggacagtcactcaatggtgataaagcagatgtttaaacaaggtacacatactatgtctgtcagtctgtcatttagtgaagcggtggagcgcactggagagggggttaaggaacagatgagggagaggaagcaaagaatcctgctagacctgagtctgtgagccatagaagcaatggcttaaaataacaatgtggcaacctaagacactgttgyaggtctgaaagagaagctgcaatttgctaattttgaaagactaggttagtgcwagtgaacc

SEQ ID NO: 19481 - DNA, 600 bp, Bovine  MMBT00723
atataagcaactagtagtcaagagtgaaaaggggatataggtgacacatggtaaaatggcctatttgattatttgaataccatttttgttaaacttttggttgcatatcagaaactatgattaattttttcataatagtgtgcatactttgtgatttttttatttaaaaatattacaggtaacaaaaccgttgttttttacaagttgttatcttattacgagtaataaaactgttggataaagtttagtaattctaaataaaaaggaaagataacatatatgtcagagtccaattatgcygatarwtgaaacttcaggtatctttctgtgtgatagaatatctgctataattcttaccaattttgaacttatcttagtttttatgtgtacatatctcttttaattaggctagaaatgctgtattctttagccattaactaaaaatttaatttcaatgctagaatattattttggatatgaattaaccacctgacatatcaataaacttttttctatttaagataattaaagcaaagttatacttcctttcctgtataactaaaatgacaattttgttcaggacctcaaatttatatgaga

SEQ ID NO: 19482 - DNA, 600 bp, Bovine  MMBT04766
gctttcatttttatgctggtagatatttttgatgtacagtttcattctcagtgcttcctgtttcagagtctgacaaagaggagaaaccgcagagtgctgtcatacccaaggaagtgaccccagcgctgtgctccctgatgagcagctacggcggcctctcggggtcagagagtgagccggaaggtgagcctggctccgggtggtaacagtgggtgtggctcgctccactgttgcctctgatgtacactgtgcatcagtagcatcctttcacgtgtatgtatctgaggacgagatgtgtcwtgcacattcttaagttgagcctcaaattcctttctcatttgattccgaagttaacatgggatgaagggacgtgggagagatggagaactgtgttgctcctctaggagaaaggggcaaaaataacataatgaaagaagaggaaggggaagagatatccactagtgaaatcagagaaaattctaaaagataaagcaaaggaagttaatactccttcccactctcaagaacccttgtcttaacacgtttcgcaccttttgaagctggagaggggtcctttatgacaaagaggatggtaaaatt

SEQ ID NO: 19483 - DNA, 598 bp, Bovine  MMBT10814
  misc_feature (1)..(69): n is any nucleotide
nnnnnnnnnnnnnnnnnnnnnnnnnnnnnnnnnnnnnnnnnnnnnnnnnnnnnnnnnnnnnnnnnnnnnactgcataatactgctggactccaaattgtcaaacattacaaaacaagaaatgtttcaacaaccattcagcatgttttaaggacaaaatatatataatatacttgatattatatatgtattttatcacatactcagtaaagtatgccaaggtgattcatccatccaataaaattgaaaataaaaattttacatttctctacttgtcagtattcaggcttctgaaggtggaycttgaactcagaatggtcagtttttgaggaaagccacataatcrgtgagtctggctaactgctgctctttggggatggrtggaacaggggygggctctgataaggaaataaacctgttaaaggaaacatccagggyccctgcaactggcttcttgggcatgactatccttatggtggagtcrgcttgccagccttgttcaaggatacctttcacagcctcctctacagggagtccaacaaaggctgcgaaatcgtcggcaatgatggaggtataggcttgggagaccagggcgaaggc

SEQ ID NO: 19484 - DNA, 601 bp, Bovine  MMBT06093
  misc_feature (1)..(1): n is any nucleotide
nctgtgaatgttttaatgtacaataaagcactttgatagctgccttaaaaaaaaaaaaaactggtaatgtttgcaagtgtttcctgaaggcctcactgaaataccaccagcagctaacaaaggggaaagggttagtcgtcatcaataatacggggaaagttgctaaatgactctggcaaacagcacagtaagtgaaaagattggggtgcagtgtggggccactacaaggaacaccacctgatctggggaacgatgctcctcccatggggtaatgtggagtccagaaggcattgtttctccsccttaacctttgtaactgctgcaggagactttcgccatcagagttcagttagtcttaagttgttgctatttagtccctaagtcatgtctgactctgtcagacaccatggattgcagcacaccaggctttgctgtttttcactatctcctggagtttgctcaagctcagtcttcaattctgaccccttaattggcaacttacaccttccagaattatctgttggacaaagttaaaaaaaacaaacaaacaggcattcccatgcctgcccataaaatatgtcttacatctgagaagacttaa

SEQ ID NO: 19485 - DNA, 600 bp, Bovine  MMBT02373
gaccgatctgactttaggaaaactgagaccaggcctgatgacttttgtttcagcttcttgtctccttgaaacttgggaggtacagcagcacttgatgtatatttcccaactcagctccagtttttgctctccctgggtccctatggatagttctatctttgaggatggaagaggttgggatctgaaggcctcttctatctgtgaagctgcaggtgtctccttacctcctgctggatgaaatttgggatggggaacaaggatggcagattgtttcttgagagggttttaagtgcagagtgratgttctggtacaggcttctcagaggcatcagagatgcctgagggatacagatacttgccaacttatgctcctgtcttgatactagttttcagttctttctgagcatcctcaagcagtaattttgcccaaagagsggcagggccaagcagtagccctagcacatgggagaagaggagagctgaagaggccaggcttccttgcctgggaggtgacaagagttgtctcctaggcatggtctttctaggagctgctctgtggcattttgtagaggagaaaaaacattcatgccataggaactc

SEQ ID NO: 19486 - DNA, 579 bp, Bovine  MMBT05603
tccaaatctaaagttttcaagaaaaccacttgaaatatggatatacacccacttatattaatggacttctccattaatggtagttggttagcatattatgtcctgagatattaactastaatactatgaattccagtgattagccatttaaaagctaagcattcagaacaggaagacaaacttcagtttttcagagatacttaaagttttacggaacaaacctggttcttgacaaatctcatgaaacctactaataattgcttagaagcctttcttgaggtctttcaatatacaattaaygaacaaaagtcacaaatcatcggcatctctagttcttcttgccacagtaaaaactgtttgaaataattataaaacaaaagaccaacaaactcaaaagcatttctttgtcagcacatttttagggaagtcacagaaacattgccgaacatacgaagaaacaaatattagaacagattggccatgcatttgggtgatagtacaaatgtttgtaacatgtctccacttatggtgcttgttagagtctatttcaatagttacattgccaaagaacttcttttt

SEQ ID NO: 19487 - DNA, 600 bp, Bovine  MMBT20503
tggacttgttgagagggctgtctttatcataagactgtgaccttactgtatttgtcactcttgtacatctagtctttaacacctagaccatgcaaggtggttcagtagttcaagctgtgtatgtctcagagtcacctcaggagtctgaagatataaacacccagaggccctggtcctcccgcaagcctggccctctgatcctgttgctcctctcagagatgttgccatgagtcaacctctgagaacctcatgcaacgacaggcagtgaaatccagagctctgcagaatgttctagagcaycccacctctcttttgctttctctctctctgcaccgccacccttcccaacccctccccgtctttctctccttgagttattttcatacagttcttcatgatctgctctcttggcacattgagaagatttgtattctatgatgtttccaagtgtccaggtgtttggcatcttatattttaatatacagatgcttgatgggagctaggccttgcacacactccccaccaaggcatgcacggactatctgatgctttctaccggtttaaagtctcagcagtccctattggcatggtaattgttta

SEQ ID NO: 19488 - DNA, 600 bp, Bovine  MMBT02421
ctactcatctgtacctgggtctgactgccaattagcagctcgagatagtcacacatggtggttgaaactgccctggagggtacaggttaatgatgctcagagagagtaaatggaattgatggctgttcagccctctctcaccctgggctggagcagtgctgagagtcctcagagatgctgctggcaaggtcaggtactcctggcacatggaaagtgttgccacaagagggctggtakgggtcctcctattccatagacctcctcataggctcaagtatctggagtaggccttcctttccmcaaggagcatgccagaatgaatatatgtacccacagagggagggatagtttcactgagggcagtcgctaatccttggatggcagacaagcagcccctataatgcccttgtccttagagggctcagggcagacaccctgaattgatgcctgcactcttgcttgctgagctaaactctggccatggttcctctcaaatgagccttctaagtagtactatcatcaatcacagttggtagcagaaatggaatccatttgccatccttgcattaatcttttatcggagattaacttgtctgattg

SEQ ID NO: 19489 - DNA, 600 bp, Bovine  MMBT18047
ctcgcctccctccgcgggggctgacccttttcctgcgaggcttccggagagggtcttcgctcaaaacccaaccagagcccttgccaatgtgcttgggggaggaaagcttacttgacatcagccttccagtgcattcctgtaattacagctcaatgctaaagcgctaaatggttattattatgaagccagggtgtttgctgccaaggcgataggaaagacaccaacacgaggtttagggaaatcaagggtttttactggatttgagactaaggaggggaggcgagaacaagagatggagayctttagtcatgtatgcaaaggcgccttagactggtgacagcagagatgtagaatgtacaaatacaggttcaggtacccattttcaaggattctggaatatataggcagcttcaatgttgaaatgtatgcttccacaaactcttcgtggaattttcacccaaagacgtctagtgaaatctgggtcgctcctccccaaaaggagctcttggcctgtggtcagatcattctcgattccagcccacactttccctgttggcgcctgcatcgctgcctggcgtttccaaccctgggaatgttgaa

SEQ ID NO: 19490 - DNA, 601 bp, Bovine  MMBT10303
  misc_feature (1)..(1): n is any nucleotide
ntgcatttaaaaaaaaaattgcttctgtgagcaaggttataaggaatattattccctaaagataggctattttgcacactcatagaactcttaggataaattcccaatagcagaattatcaggtcaaagagtagtcttttgttaggagtttggttatgtgcccaatgtgattaaaaatattacacagctctttcataattcaatttgttttcctttccttttcattcttccctcttcattttcaaagtttcagatctaagcaaaaattaatagtattctcccaatttaaagagctttgtaytgtgataacatgctactttaatggtgaattttttgtttctgaaatcagattcttattgtaagtgagaggcttagggcacttgtaattgcatcattgcacaagtcaacaaagtgctgtttattgcttacaaagttggtatgaaacaaagaaaaaagacattaagcacaacacaccagcagctttgaaaatgcaggaggggtcaagagcaagtttcaacatgtcatttcatttgctttttgttaaggtctgaagaaagtctaagaatatggaaacgcattacaaaagaagcattcagtctta

SEQ ID NO: 19491 - DNA, 598 bp, Bovine  MMBT12068
  misc_feature (1)..(23): n is any nucleotide
nnnnnnnnnnnnnnnnnnnnnnnttccccgacgcagcacagctgtgcccgggacacacagagtctctcaggtgctggtgcagccagagctcactccccgctctcctcacttatctctgtgacaatgtctatcaggctctggagcccaaagatatagccagcatcctggccttcgtggaccacagtgtcctcaccatacagcctgcacgtggtgtgcgcaaaatcgatcatgcgcacgtccaccgagctagtgccgatgggcttgtaggcataggcgccggctgactcgtcagcagactcytccgacaggtcctccaagtcctccgcgtctgagtccagggccacttcagcccgctccttgccgtcatagatgatcagcagggagcttgagtagaagcggtaggattcttgtcgctccagcacgcccttgagttcagtcagcttcctgagcaccgggcccaggagctcccggcgcaagtaccggccgttgtggaaaaactggaaaagtgcctctttgaagccctgtacggacagcttccgtccgtggtacttgttcatgaacatgagctgcccactgcccgcctggtacacctgtggga

SEQ ID NO: 19492 - DNA, 600 bp, Bovine  MMBT04279
acagctgtgtaatttttctccaggaactctcagctgctcagtctaagggccaaagaaagaggatggctgtataagaggtgaaagtgatacyraaagcatgatttaagtggtggacaccagtgtccagggctggacaggggaaaatgggaagacagaaggggctgattgattaggagaaaatggaagactcaaagcactgggggtcacgaggtcaaagagcaagcatagttcaagtaagaacaagaaagccagcagaagcaaacggtggagagaagcagatgtcttgcttaaacatgaagmctgaatctgaatctctctacagaggaggatttgtgttcatccatcttctgtcrtatcattctttcttaggattcctgatctttctgtgactttcacccacaagctggatgaccacttggtggggctcttgcagagacaatgtcagcctrttggttgaaaatgaagattcccctgaaaaccggaaatgctatgaaattttgcagtttagtttattctagcactttagtggtaagtactgagaagtactttttaacctcacttctttgagttacctagtccctggtgcatcaaacagaaaaa

SEQ ID NO: 19493 - DNA, 600 bp, Bovine  MMBT19729
aaagaacagtgtaccaggagcatctggtacactgaatttgtcacactgcagacaagctaatctcattatgggagcccacaggggagaagagaaaagattcacatttagtccatatgaactaccaggagacccatcaaggcagttgggctagctcatgatacagcagcttctagcaaattaccagcccataacaacttagtcataatgagctgcaagaccctgcaccataagctccaagccattaaagggaattcaagtacatgaattcgtgtacacagtagaaccttarcatctgtctgygctaagccaatattttgcttatatctttttaggaacagcaaaattaccsttgtgtcccctgaaactagggactggaattttcatcaactgcagttttcacctgcgagacagggcagagccgatccacttcagcctcccccggccaccgagccgggcagcaagccgctcattctggcggctgttttgtacatattaggctgattttctcccaaaccatttcctcttgctgttcaagtgggaaaaacaatagtctagtcataaattaaacaggcaacaagacatgcggatccacgaagagcc

SEQ ID NO: 19494 - DNA, 598 bp, Bovine  MMBT16345
  misc_feature (1)..(222): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttaataaatgactgttgaactgagtgaatgcatggataaacagagttgtcagatatgatcctgaagaggtgaaacrtttaatttagtatgtatattcactttccattttattaataagaaactacagactggagctgcaagataacctttactaatgagagtgacattgcatacacaaacaactgaaacctctaaccaggcttgtaaagtgtttttattttacaaccaaatttgatttgtcctgccaaatttgcattgctctgctcattattatcaatagcaggctttgtctttttttttttttttaacccatttctatttagatcatagaaaaaattgtaacttgttcagccaaagattttttctttgaaaag

SEQ ID NO: 19495 - DNA, 600 bp, Bovine  MMBT08987
gaacaacaaagctagctatatgaggtaccaacctgttttagctaagagcatgaactctgaaaccaaaaccatgtggattcaaatctcaactccatcatttagtacagtatgtccatggacagggcttccctggtggcttagctggtaaggaattgcatgcaatgtgggagacctgrgttcgatccctgggttgggaagatatgtttatgacatttgtgcatctcagttttgtcatttcaaatatgggataattayygtacctaactcatacatttgtgcttagaacagtatataagtaaytgtatctctatacagtatctctatacagtaactgctgtatatgtgtttgctactattgctatyatccttttatttaatagccctggcgtggaatagcaggtgccattaggaaattgattctggaattcaggttttctcctgtcatcatgaagaagtattttctttccactttgggttcaggagctttcagtrtggaaagaggcacaggcggtctttagtacatcaaaaactgaggacatttgtacctttatcaatcatcaggctgcacagactggccagaactaacaaggaactttttat

SEQ ID NO: 19496 - DNA, 600 bp, Bovine  MMBT11858
cacataaagacactgatatttgcattcttctcagagatcaagctttggatggagctgggtcatatgcggctaattacactgctggctcctactcactttatttggcaaagtgtgattaaaatgcttattaaaacatatcctccarttttgtttctcatttgttcagtcatgtacaactctttgcaaccccatggactgtagcccaccaggctcctctgtccatggaattttccatacaacaatactggagtgcgttgtgatttcctactccaggagatattcccaacccagaggtcaaayccagtttcctttgtctcctatattggcaggtggattctttaccagtgagccacctgggaagccagtttcattacatcacagggaactcaattcaggtccatgtaattctgctctgggcactttgctgaggtttcctaaaagtatatagttctatttctcacattacttctctttccgggaagagacagcactcctcagtcatcctccagcctcaggacactgaactctgctttgtgatttctagttcccaccttgaagccctttctttttttccatgaagcaagaagtccaaacagtaac

SEQ ID NO: 19497 - DNA, 600 bp, Bovine  MMBT13228
ctcttagccctgacactaaaaggcttcactggagtcctcaggaagatagtgtgagccatgcctgtgctctggctttatagttggggagggtactgtatgaaagattgtccccttttcctcctagaaacaacctgagatgcagagatccttactcaatcctggctctgctcccagtttaggcaagtgcttttccctctctggatctcagtttcccagtctgcaaaatggacacagttggcctagatgccctctgacaccccctccagctctaagcatctcgattttatgcgcagttcttcrcagtcttatgacctgaattcagttaacaggtagtgttgcagggggttatgtttgcagtgatgcaactgttaagcctcagtgtcatgtgacacagtagagtacgcagaattggaaagctgctttgtttgcagcagaagattscaaacttgtgcacagtaaaaaaaaaaaaaaaaagaagtcctcaaaactttcttagtctgcggcctggaaaaactcgagcttatcatgagattgttgcacttggactcccacgggagaggaatgctccatgtgctaaaagtatccgctgttgactgattc

SEQ ID NO: 19498 - DNA, 600 bp, Bovine  MMBT07398
agaccttccttgtcattatcattgtcatttttcaaagatatcctttagaagttctctttctcaggggccattgttgttaaacttaattttttgaggtgaaaaatatctttaatttgcctttgaccttgaaggatacttttgtttattttagatgggcagttatttcagcattctgaatatattatactattgttttctattgaaatatcagcagtcattctaattgtttccctctatatgtgatatatctttcctatatggttggtgtcaagagcctctcattgtctttggtgttctctrgattcattgccatgtatccaactgtgaatttttcaaagaaatgtactgagcttcctgaatttgagtgttcataccttttgcctgtttgggagaactttcagccattatctgttgatttttctccattctctcctccacaaactgattggatgtgtgctagactgaatcagtcaggaaaatagaatcaataccaagtagttcaacagaggaaatttaatatggtgccatggtctgaatatttgtattctccccaaattcgtatgttgaaaccctaactgccagggtggtggtgttgggagg

SEQ ID NO: 19499 - DNA, 600 bp, Bovine  MMBT01279
atcttaggtcttagcaatgcaatatcccagagagtaaaggatgaaactgactacaaggtgaaatgctgccaataaaagaagccaaaaagaaactcactcttcaaggatagctcattggtgtcagctcaggtcagaatggtgttgcagcaccctcatcattgatgactgatactctgacctctttagctcggagatgggatgggagctgatgctgttagcttttaatataatgcctgggcaatttactggtaagtagaaaaggaagttggtgaggatgagctcacatttgccaatgaacartaatgtgcagaaaatgtttaatcagactgtgaaagtttaacttcaattcatcaatcaagcatttccaagatactgactctatgattggcactaagtaaaaggcctgaggggaatgaacacagtccctgacattaaacagcgtaccttttaccaaggagacagaacaggctaaagaaaatgatcaatggatgaaaagacccccaaacagaaaaatatgatcagttctgacaagcagaagagtttaatggcctggcaggcaagttgtagagccaagtaggttcaaatttcagctctattact

SEQ ID NO: 19500 - DNA, 600 bp, Bovine  MMBT01425
ggcttctctcctagtgacaagttcatggaggctgagaaacacagtgagtggcctttctcgcctcacttactgcctgggagagggctgttcataactttccgctgacatctggagaacgtaggttttggaggagcagagcccagactcccgcaagccagcggagccaagtctttttttgagtttccagcacaacccatgttataataggagttggtcattgtgtttaacagtgaagcaaagcccaagtgcatgtcacaagcacatctcttctttgtgccggggtgagcagaggtgaccctycctgagtgtgtaggatgatacgaagagcattacagacatgggaaagcatttcagagcacccaaatgtggcatgagtaatcacaggcatagagcccacaagactgccttttcagcccctgcctcccctttttgtactccagttcagtcagttaagacagaaattaagtggtaagaagaggggccgcccgctcttcagactccaaggtgtttgtagcccaggacccctgcgtgggcatgggcccagcagagcctagagaacatcccctgctgggatctttctcagactgacttgctmacttc

SEQ ID NO: 19501 - DNA, 600 bp, Bovine  MMBT01892
ctcagcttctgtctgtaagttgtttcagtgtcctcttgacatggcagccactccgccagaccaagcaatgcaagagacagtcaggtgaaagctgtcctttttgtcacctatcctgggaagcctcagagcatattatctaccatgttctattcattagaaacaagtcactamgtctgacacatattcaggggcaaaggaattaggttctgccttttgaaggaaagagtgtcaaatattctgtgaacacatttaaaaaccatcacatggaatagcaagwgccagtggtacaataataacatkcactagacattcttgaaatatccagccccatcatggcagagagcttgtctgcttgaagckatactgcattccttgcacctggcacagatgttcacacatggaagcttcattaaatattttttggactgttgatgttttgtagatgaagatattcattttcagatatttcagtgacagatctcactaagtaagtgttgaagccaagatgtaatttgatcttactacccagtttctctttctgctcaccttgctatctgtcaaacagaatcactcatctctattaaaatactcactttgctc

SEQ ID NO: 19502 - DNA, 600 bp, Bovine  MMBT09481
accagtcagtcctctgtgttagcacatttgacagatacttgggatttactggcgtcatctcatcttcccacccagccttgccccttctctaagccaatgtcttttacaaatattgtgctgtgacactcgtctctgctcccattaatagaaaagccagctggagtccagagagtacaagtgatgtgcccgagctcacacagcagtgagcatcgcagccagaatttcaacctggatgggtaaaactcaggagcacagcgctcttccgatactaagctgctcttctccttattagaaacacartgtaattaagtgctcggggcttgccataattcaaaatacacttgacaccacaatctacccgagacaccatccataatggaacaatgacagggaactgccctcttggcaggtgagattctattggtctggctccatcaycaccattactcgttctgtatctcgattatctcccccataagacatatttacagcaatattaaaagggagatgaagggatatattatcttccttatgtacaacatatattacacgcccatgccygtcacagcccagatgatgcctgacaagtcagcctgcggt

SEQ ID NO: 19503 - DNA, 600 bp, Bovine  MMBT02715
tcaggtgaaaaaagagtcctcctggctagcccaatttacatacagcaggctgggaaaaggggggcagaaaaaaacgtataaaaggaggagccaaaattgatctctcttctttagggtcaaggcctcaggcctcaaggatatattttcctttgcttgccaaataaaactgagctgtaaccaagctgtaacactggtggcaaatttttgctgcagtgagacagaaccaaggaattacacattccccccaacagcttcaagctccatgtgcatgacttaaacactgataaacaggtgactgastgttggcagttgtaatatgtatccacacaaatgccatatgctgctttattaaatgcagtcatatccgttagattcctaacatgtccaagtgctaggtctagctcaccagaaaaataaaacatagaaggaatcatgccctccactccctcagattctgatagaccttctatgttttgatggaatccacactgatcaagaaaaagaatcaggttgagccagtaatagcaaagacctctctctgagtttagtgaccttgatgggacaaaattataatcctgcagtgtctgtaaaaaggtattc

SEQ ID NO: 19504 - DNA, 600 bp, Bovine  MMBT05233
agcckggaccacctacatcataatattctgaagggattattgtgtatgaagattttctgtcccacgtgtacaggatcctcaaagatcatattctctggagggtagatggattggatagtggcttaggtatctacattttgacaagctccaaagttgaatggtggcacactaaagtttaacaattattactgttgaccttacgtggaagtttagtgagagcagttttgagcatgttctgtttgaaatagaagcgtctggttggcagaactgaagtagagatttgggagtgagcagaatgtwtgtatttgaagtgaatgagcagaatgattgtatttgaagccctgggaagggtaaaaatgcagagataagatggaacaagagggacggaaccttaggaccatgacttggagaaaatgaacaatcagggaggagctttgggaaaggtagtcaataatagattctgcctgggcagtcagagaggcaggagagccagctgggctggcacctggaaggcgagatttagtgacataaagactgatacgtttccccattgttttgcagctagtggttcattagtgtccttggtaagggtggatgaat

SEQ ID NO: 19505 - DNA, 598 bp, Bovine  MMBT01454
  misc_feature (1)..(59): n is any nucleotide
nnnnnnnnnnnnnnnnnnnnnnnnnnnnnnnnnnnnnnnnnnnnnnnnnnnnnnnnnnncagggagaacatctcccacccagggcaaaactttcagaaagttctagaaagagtcctggttccccagtgaaggtggtcagaatcacacacctttgaactgrttgcatttgactcagtttctcaagcattccaggaaatagatttgaggaccagagaagcaggggagcacattgcctcagcacaccccaagggagctcactaggagaaggagtccacaacgggctgctccctgccatcgccyaggctaatttaaggcactgaccacgctgaccacactttaccctttcctcattccaggctcatgatcaggaaattttccgatatttggcctgaatttttctttgcttggttttcaccccctggatttacagcaatcccgtgcttctcattaaattgggactgaccgcttcaggcgagttaagtaatgcccagatgtatggccaccagaaagatgaaaaccaggtctgttttcaagtttgctggaaggcttgcagacttcagagaaatgattttcctccttttccagtagctcctccctt

SEQ ID NO: 19506 - DNA, 600 bp, Bovine  MMBT19058
gatgaaggggtgatgagacactattctggaggggaacatggagatagtgatgggatgggaaagttaagtggggtgagtaagcatgagtgtaggtcaaaagtcagaagtggccttttagaggtcaaaattagattgcttaacttctaaagtagcagacaaaaattcaactataagtgaaaatgaaggaagaaaaaaaaggaattagaaacaaaaaaaacctgtactatcaatgagaactctcagctcagatgttgaactaagtcctcataaracagtctggaaatgttgcccagctccagyacctaccaactctgtgaccttgggctggrtacacagtttctctgaaactstttcctcatctctaatatgrggaaaactatcatggctaccagctggctatgaagagtaaatagcataaggtgcgtgagagtgctctcctacgtggctctttgtagacagtgaatattctagttctctcctctcttctccctctttagcaagtctagcttattaacacttactcattcaagaatatttcctgagtacctgtatcagttaggttgctttcaattgcaagtgacagaaaacctcacctaaatg

SEQ ID NO: 19507 - DNA, 600 bp, Bovine  MMBT10026
ctcagtaacagatataaatacacgcaagacactattttctcctttgaccacttttgcatctacttgcaaagaggagttatgggtataaaacagagcaaactacagacaagtagtaggaagactcaaggaagtttaaaaagaggagacaaaacctagcaaagcaatttgagttatgcctcatagaggaaaaagtgagttttttctgtatctttgtcatctcttctctgcttctctgatgctaagaaactatttacttttgaacttcttgtgaaataagcaacaaatggtacccttaaaatytgagccacttttagttgggaattctgacttgcagatgaaagtgtattgtcatgaaaaccagctgttctaggtttaatcccatgcaagttttaatttactgactcatgtagaagcatctaaaagattcccttgggatgctgccrtttttcaaacacattgtgttttgactcagtgagagcatatatttactaattcataaaatacacatttatgaagctatcttctatgagacaggccctatgctaggcatggaaatttaaagattaatgagacatcrttccatttacagaactcataatc

SEQ ID NO: 19508 - DNA, 600 bp, Bovine  MMBT02233
actgcttttatagaatgataggcttggagtatttaattgatttgatttgatttaaaaatgaacaggaccttgatcttatgcaagtcaatatcaaagggcaccgtttctaagtgtgtgctctgaatggtttcactgcttccttgagttgcaattctgtagtggggaatcggggtgaaatcacgttagtgaagaaggcatgtgtctggcaagttcccaaggcatgagtatttatggcacgatgaactgtgaatttgatgttgattcacgcacacaacaagcaggtggttcacatctaatttygttgcctgcaaaaatgagctattttaaaatgtgtaaaatgtttgttttatagaaaatctttagccaaaatgaacaataaataaatcaaggtcagtacaattagattttctgtgaaatggagtaaactcaattgacatggtatggaatacrtattctattctagggactatgtaaacaatttggaggatgggatgacaaaggcttgcaaccttttcagagtactttttaataatgacatattaagggctcatatgagctttgtaaaataagggcatggagaggaaccgaagaacatgtact

SEQ ID NO: 19509 - DNA, 600 bp, Bovine  MMBT02716
attgactgggccacatcacaaaatcaggaggtgaactgacttttcttttaaaacttgcaaactctcattttctctagaatagagataattaggtggactttcttgtgctgcttctcttagattggactaaacttaaaacctattatgttagcagagtatttaattgaaagaagtattttccaatctagtaataatgaggaaacaagatctaaaggacaaaaggaaagttttgtggcaggtgtgacaggtggaagaagagtagatagaaatgagataatgaagagaatggtctataaagtytgatgtgcagccagactagaagttcaaataagaatatggagaagttgagaaatgggagaagagagaggaaaagtaaacaataatggaaatagaagtgtaaatatacacctaattttcaaataggcaaaatgcttttgcttatatatttttaaaagacaaattgcaaaaggaaacattatgacaatacaggtaaaacagtgtatgkcatttttttctcatgaccaatagttctgtgaggccagagcatgtcatattttggaattatttttttttaagttgtctatgacttagtgacctaga

SEQ ID NO: 19510 - DNA, 600 bp, Bovine  MMBT05626; identical to SEQ ID NO: 4518

SEQ ID NO: 19511 - DNA, 600 bp, Bovine  MMBT01807
cctcttgaaccatcctggaaactatgctggagattatgtcagtgcatttggccatttcctcaataattgaagtaagtgataggttgtcaatatcgagagactctgaggtagctttacatccagaacttactgaactagtatctgtgtcgacactacataattttgcaatgatatattccaaaattgttgtggaaatgagctgaatattagactgcaattcagtggctctttgctgattcttgtttgtcttctctctacttaccttagaacaagatggctgacagtgagggtgggcccctrtgagcttgcataacatttcatagagtgtttccccaatattatctaacacttgtaatctggaattctctttcagatcttttccattaatgacactatggagagcacatggagtagctaaaattttgtaaaaagattttttatcctgtctgcttggcaaaatgttccctttatcaactttatcagatccatgtgaagctgttggctttgagttatctgaagagagtgaaatattgctttgatctggatgtccacttgataatrtttcacaaatacaagttaataatggtgattccatgatgt

SEQ ID NO: 19512 - DNA, 600 bp, Bovine  MMBT06707
raggacttgggggctgagcctgagggagatgactctattgtggccgaggatgggtcctggggtgacgatggtgacctacagttcagaaatcaacatgcagtaatccagctctgtaaatcacatccagatcgtggccatggttaaagactgcagaggaaagctcattagggtgggagggccctctgccgtcttcccagccccctgagcgaccttggacctgagctttacatcttcagctggataatgagagggagttgaatggcttctggggtttcttccagctttaacattctatgactstatgatttgttgtttgtgttaccaagcaaaacttgggtgtgctcaccctcgagcagtaactaaccaagctattgacacagggtggtagtgaaggaaaactgccacatttattgcagggtgcccagcaaggagtctagggacgctagtgctcaaaagactctaactccgtgacggatttcaacaaagcatttttttttttcatttttggaaagtatttatttatttatttgactttgccaggtctttgttgcagcactcaggattttcagtcttcagctgcatcatgcaaattctgagttg

SEQ ID NO: 19513 - DNA, 600 bp, Bovine  MMBT08886
gtgtctcttgtgtctcctgcattggcaggcagattccttaccactgagccacyagggaagccccccattatgtatcatttaagcttataggcaaaatccctttagtgattaacttgtaatactgaattgagtacaaaggytatttcctattacataaggacagatgagaaaagtggagtggtaggtaaccatggtggtccttgaaaaccttgttcaggagcgtcataggtcaagaagagccattgttgttttataagcaggggacagaatttgagctgattaggaaacagtgtctaaggwaggacagaaatgagacagggtgagcagttgccagagccgtgtagtgatttaggtgagagagaatcgtttctgtagaaatgaatgtaaggggcagatctatgagatggaaggggtgtggagtggaggagaagagggctttgaaagtgacctgaggtttctagcctgtgcatactgcaggcagggggctgggggaaggatgctgctgagaggaagaacccaggaggagggtctgctaggctgggaatagggatcttctcgagctcacactgcatttgagggtctggcaggatgttccttggg

SEQ ID NO: 19514 - DNA, 600 bp, Bovine  MMBT00863
ggcctttgttatccaggaaaggacactgaaagggtcttagaatgacatgatttggaatctgcagaactgggggtcacattattgctctgccatgtgttagttttggcatctgaagaaaatcactgaatctgggggttcattttcctcccccacaaaaatgagagtattaaggacaaaaattgcctcccaaaattattgtgagaatgaaataaattggcatgtgtgaacgtacttgggacagagtaggttttcaccaaacgttaaatgattttccttaatgaaggracgaaggcgtcccayctcattttcccttctcactactgaagtgaaagaaggatcgtggcctccagkgagaagtcctgstccccaacctgagagcacgtctctcgcagcgtgatggtggagtttgggccattctagtcttgatttcttctctccatctggccaaggagtctggtgggggtttttttttaagactyttttttggatgtggaccatttttaaagtctttattgaatgtatcacgatattggcttctgttgttttgttctgtttttttggctagagtcgtgtgggatcttagctccccagccagggatt

SEQ ID NO: 19515 - DNA, 519 bp, Bovine  MMBT07641
tctaagatgtcccagttgcaggaagagtgtgttttttgttcttttttaaatcatgtcctacttgaaactaaccttatgcctttggttcagatttctttcagaacacacaccttggcctcattccctcctttaaggtgttgcctgaggttcagttttcaatcctgtttcttcaccagtaccctacattcttttctgttctgagttcaaaactcccatatccatgtgaaaaggaaatctagagctgtgtcacaaagacagggcccagtcataatcagctcaccatctttggaggtatatcakactggactacagtagaattcatgcattaaagttctgaatcaaaataacttaggtccaaaatcttcagctgcctacagaatattttacttggaaatgccataattccctcaatcgatatatatgatcatagatatccctgccaactgtttacctatcagtcacaagagcctgttcagctattacaatctgttacaatccgtcaatccaagagttcatcac

SEQ ID NO: 19516 - DNA, 600 bp, Bovine  MMBT11031
cccggcttgctgcagtccgtggagtcacaaagagtgggacatgactgagtgactgaagaactgaacaaattttgataaattgtattttcattttcagttagttcaaatatttttaaattgttctcaataattctttggccctggtgttatttagaagtgtgttgtgtaatttccaaatagttggaaattttctagctatttttctattcctgatttctagtttaatgccactgtggtctaagcgtacacatatgatttctagccttttaactttsttcagatatgttttcttccccagcrtgtggcctgtccttggtgaatattccttacgagcttgagaagctatgtcatctgctgtcgggtggagtgttgctctacatgtcgttagatgcagttgagggacagtgctgttcaggttgtctgtccttccttcctgcttctgctgtcagttactgatggaggcgctgaaatccccgataatggatttgtctaatcttttagtagttctgtcttytcccctgcttctacccttgaccgtcttctttccaaaggctgcacggggagtggttaagaatgtcagctttagggtcagccagacct

SEQ ID NO: 19517 - DNA, 598 bp, Bovine  MMBT18180
  misc_feature (1)..(154): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctaaataaggaatcccttattaaacaaaaaggacaatttatcagttggttaataggacgaggggaatttgttatcagccagtaacctatctttgcttggaaaaaatcaataccaaagaatttaaacaagaatatttctttactraagtcaaatgtcttttgtgtgcactcccaggatgaaattatctgaggaagcaacatataggaacagtacaaaatctctctggcctaagtgacttcaattttggttctggtctcttgacaagcagaatgtgagctgaccttctggaagaagaaagggccagtttttcacagatctacttccagcgttctataccagaagccagcaagttctgacccactttccgggtacagcttatccacatacccttatccacacaaacacttcatcctaaagagctgtgtggccctgtaggggcatg

SEQ ID NO: 19518 - DNA, 427 bp, Bovine  MMBT06259
agatgagaaaacaagtcctgggataacttatttttcctaggataaagaaagaaatttgtagaattctttctcctttgaaataataaattctttatttaaactaaaacttgaaagtaatatccatttctctgatatgttgaaagtagtctcttggagcctgtagtgtaatcttaaaccattcatcctcaatcatgggaaaaagaagttgccagaagcagctgagtgctccattgagcacagatgagctgaccatctgccaggccccagagaggwcaggccctgactattcccatgtcctcrctagatccacctgctcccatctttagtccaggaggcagtcattgcttctgccctgaggatgaaagtaagaagaggacacggtgggcaactgctcattcacagcagcccacatcgctcaacgtcatag

SEQ ID NO: 19519 - DNA, 600 bp, Bovine  MMBT20274
cacaaacaatagaaacccgcagctccactgagggatgaaagtrttcagaagtttctctgtaaagaaacacaatcagctttccagcaaggatagtttccttttcatctagaaatttacatatttatacaaaacctgcagacatttttatctttgcagacattmtctctcttttgactccatccaggtttccggtgrgatagtccctaataaagtagggaaattagacttttatatgcacttcttgctrtaartgtgaaaatgcattaaaaggagtggtttgttgtcctcagtaatctcatytggctccagcataattctttgagataatacccttgctagctggttgtattccatgtgtgtatagaccatattatgtttccctaatctaaattatgcaaagaaccagacccttactttccaccatattgtatagacacttatttttactaaattgacatcaacatttcatcatctttgaagtcttgattmtgttttcagcttaaaatttttccctcaggttttaaagtctacttcttcctaaaacattttttgaacttgatcatatttacatattatatggctaattctggagaaggaaat

SEQ ID NO: 19520 - DNA, 600 bp, Bovine  MMBT04642
ttgtcacagattattggtgttcagttacatgactttggttgtctaaagcctgtgtgtgctcaccagctacttcgttctttctttttcatctccatcattcaacaaccagatcctatcagccatgccactttaaacccatctttcttttcatggggtctggatatcactgtggttttagctctttgacagatatattgcttttttgagatattcagaaactgtctaaagtcatgggaggctgagacagtagccacatcacgaccctgatttcccttgtcttgattctactcagttgctcaygttctctgtgtgttgctcagaatcccaagaaatgcatttctatctacttagaatttataaaatacaactgctgctggttttatttgttctctattatcacagtgacctagcagatgaaagaataggggatagacccctggtggttcagtggctaagactytgtgctctcaatgcaaggggctcaggttcaatccctggttagggaactagatcctacatgctgcaactaaagaccctgtgtgccacaactaaagaccctgtgttgctgcaactaagaatggtaaaccccaaatatatata

SEQ ID NO: 19521 - DNA, 600 bp, Bovine  MMBT03042
ggggtttccctgatagattttagcatttgaagcatagaactcatatttccatgtaatatgcctgaaattcttatatgtctgagacaatgtacttattacctagtcaaaagattggctagacagaaaatgggaagcatgtgctgaagagagagttgcacatagctctatcagtgaatggaaacaaatgtctttactatttgaaaaattgaaacaatatgaccattatgtcaaattaaatttcctggcttactcggcaatttcagaagcatttatcatgataatgtatgaatctcgttgcayatattgtcttggatatatatacaattctaagaaaaagaatctatgtacaacaagttactattctatcctctcagtgacaatgttttgatatgaattttatatattttctacttacacacacaagttaataaacacatactcacacaactccattcagggaagatgaaacccaaaggaaaagagagggaaaattatattcccaaagtgcaaaccatggaggggaggagtatatattctgttttgaagttacacataaatattcaattaacctatttctcctgtcttttttatgactacata

SEQ ID NO: 19522 - DNA, 600 bp, Bovine  MMBT13437
gttcttaaccaagactatttaacttaccacgtattcactgaaggatgttgtggctttggttgaaaagatcgaaaaccactttctctgctgctgttttaaaaacaaatcatgtgcctagatactcacgatttccaaataacatttccatcttctttctagaaacttgagggttagttgggaaacatcaattttacttctttcatcacttgacaagtactttgtgttgttaattaactcagctcactatttgccaggtgttgtgctgggcactggggatatattaatgaactagatatagtscctgcygtgtagagcttacagttggtctagacaataattgactggacaaattaattgagaaatgacaagttgtgataagtgctgtgtcagtcagagtctaaccagaaaagcagaaacaccttgagtattggaagtaggatgttttcgcaggaaattggttacagaggtgatagagaaaccaagcaggggggagagaggctgcccagacagtagacacagtaggaagcagctgtccccccagactggagagacagtggagggaagtggggttgctggagcttggggtggaggagttggaac

SEQ ID NO: 19523 - DNA, 600 bp, Bovine  MMBT03335
aatccacttcacatgtatttctttctgcccttgtacatacatatatgacatggcttgagagtttcccttaagctgcaattactttgggacattttctcttaaatttaagaaatagatgcagaaaatcaggtttgaattcctggctatatgccaatgactaatagttctcttcggctcttttctgtgatgcttctgtaactggatagatgatggtgacttttaatggctgctttgggccttgggaaaaattatatataatatatatatggaaaagaaagccattaaggacaaaagattgtygaaagctttactgactttcaaactgtgaaaagaagaggccaaggtaccttatgcttttgatgcctgagggctatgaagcagaaagggaaagaagaaaaaaaaatcacatattggggctctgatttgaaatcttttttcttctttccatctgtgggtacctaaatagggtcaaaaagccagcacctcagttattttgttgaaaggctaacaaaatgtctcaactttcagcacacattcccactataagtgataactaagtaagttgatcttcaagtcactaatgctttcttcctgttagaa

SEQ ID NO: 19524 - DNA, 600 bp, Bovine  MMBT03696
tcttctgatgactaagaaaggaattacaaagcagaaaagagcagcaatacataagattttggtcgagggttttcaaagccttcatctgctttcactgagtagaggacactttgtatacacttggtaactgatacagttatcaggtttactgtctattgcttaatttttttccattctccttcagatagaaattgcaatgtgaatttggtagtagtatgtattaatttaaggattgaaggaagatccagtgataggtgttgcaggactaatatttctgtataatctttacagaaaaatgaygggcagttcactgtgatccagctggttggcatgctgagaggcatcgctgcaggaatgaaatacctttccgacatgggctacgtgcatagagaccttgctgccagaaacatcttaatcaacagtaaccttgtgtgcaaagtgtctgactttgggctttccagggtactggaagatgatcctgaggcagcctacaccacaagggtaagatctaacagaatgccttctgaaatactatgctggagacattgaatatttaaagattttaaaaagaaaaagaagttcctcccacataggaagaaa

SEQ ID NO: 19525 - DNA, 600 bp, Bovine  MMBT05083
ccctaacagcaggtgtggacatgctcaggtgtcctccccaggggccgacaggcctccaaaagcctggggcttcttccctgcagtttggaagtaaggagaggacagctttgggttgtttcttccagaagggggtcgaagggcttaatatatcactgtggctgcagacaggtgaagggctaggctagcttgcagagaggagttgccttccgtgagaagagggtgccgtggacagggttccttctaaggctaatcgaaccatgagactggtttctccccagtggtctcagaggccctgggagygtrtctggatatcctggtagttgcagcattttgggagcctcgctgccccaggaaaagccagcactctgagcaagactgaaaagcatcgccctctagtccytccgttaatgagatcatttctgaatcgctgtttgtttgggttaagaagatattctcctttaagaaaataatcctttcatgattgacgccagaaacaaaagcaaaggctgtacccagcccattttgagacctgtaattttttktttctttagcagatctaaatccgatttaaatcgttgaaatactttgctgtattatcgc

SEQ ID NO: 19526 - DNA, 598 bp, Bovine  MMBT07104
  misc_feature (1)..(7): n is any nucleotide
nnnnnnntgtggaccacggcagcagctttgtcctctcttcctgcactgggggagctctctttgaaatccatcttccaccccactatccaagagtttctcgtgaacataaactcactcacgttctcatctactcaaaatcccccagctcccatcccagtttcccactctctacaggacagaatttccaatgtaaaccctgaagaacctcctggtcacctcagctcccactctgcactattaatcttagccaagaggacccctctcatttccctggcaagcctattcatatcaccatgcttytctctcgacaatcccccagttcagccttcaaaactgctacttgtccttccctacccaaatcaaatggctccttttctctgaagtctttcctgcccctcaccatgcccactcccaggcagtcactcctgtctctttactccttcagtaaatgtgcatcttcacctggtcagtctcacagaggatctaggctggcctgatgacagagaccaccacttctctttcctcttcttctctctagctcctaaagtgatcagcaccttttaaactataaataaacacttactataaaaragaagat

SEQ ID NO: 19527 - DNA, 600 bp, Bovine  MMBT12904; identical to SEQ ID NO: 4756

SEQ ID NO: 19528 - DNA, 600 bp, Bovine  MMBT06323
agtctcaccaaaagactcagaaaaatctttccatgacatattccagaaaattgccacaactggtagcctgacggacagttgtcaactggttgtccaactggcaccagttcattcgagattgagcatgagaggtttaaacactaatacctttgagctgctgaaacactgtgtcatactgagaggaggcttgcttttagctgtaaatctgatcacaaagttacattttcctccaaaaagaatgaacagaatcaaatccttccattatcacaaggtaactgaagaatgcaaaacacaatcgakgacttccctggtggtccagtggttaagaatctgccttctaattcaggggacacaaactaagatcccatatgcctcagggcaactaagccccctgcgctgcaactgaaacccagtgcagccatggagaaggaggtcttaaataggtagggagtaaagtgaagctaagcctggcctctgtctcaagaagaataaaggtatgatagragggaagggcttgtgaacyaaactttgagactgacmttgaaagtactaatgaatttggactaatagcacaatgcaaaaatttactgaagtgaaatt

SEQ ID NO: 19529 - DNA, 600 bp, Bovine  MMBT09363
ctgtgagatagtgtcaggatcgtcgaacattgccataggaaccacagagtagtaggaagaacttgaaatagttcaaggacctgctttttctgttgataacttccccaagtcatccaggagttactgcaaatatttacaggggagaaagggctgcccaggtggctcagacagtaaagaatctgcctgtaatccaagagaccctggagaagggaatggctacccactccagtattcttgcctggaaaattccggaagagattctcatgggcagaggagccaggggggctatatatagtccayggggtcacaaagcgtcagacacaactgagtgactaagaacgaacagggaagaaaatggagacagaatattatcttctctaccatattggcccttgatccttgatgartagaaccaccagctagtcaataatgacctgtgtctaggatttctacttttgttaaaacacacactcatccacatcatggtttaattcagcagaggtgatgaagagaagttgattttctttcattctaacttctaagtctcaaaaaaaaaaaaaaaaacctgtgttttcctaaaagttcataacwgctctgaaa

SEQ ID NO: 19530 - DNA, 600 bp, Bovine  MMBT09786; identical to SEQ ID NO: 4565

SEQ ID NO: 19531 - DNA, 600 bp, Bovine  MMBT09770
ttactgtacaggagaaattaacagagcattgtaagtcaactacacttcaattaaaaaaaaaaaatcagctacagctaatcccaccatcagtccaggccctgaacatttagtgcaaaggtcagtcatgtaaaagagccagacagttaatccttcaggctttgcagaccatgtatctctatcacgactactggactctgccattggagcataaaagcagccagagacagtacctcagtgaatgagcatggctgtgtaccaataaaactttatttacaaagtcaggcaagaggttgactttgrcctaagaactgttggttgcccacctctgatgggaagcatcacaaacctcaccttctgctgcagctcctcgatgatgcggaagtggctctgatagtccggacacacggtggactcagggcatttgctcagctctcggatctggctctccagctccgcgttgtcccgctccagccggcgcaccctctccaggtagctggccagccggtcattcaagaactgcatggtctccttctcatggctgttgaagaagccttcgccgaaggtcccgcagattccgatgttgcctggaatgtcgcaggt

SEQ ID NO: 19532 - DNA, 600 bp, Bovine  MMBT09504
gagtaatatcatgttttcaactttctatatgtttaatcaagacatgaagtagggttcaaactcatttcccccaaaagaggactttsttggcaatccaaccaagtcaagaaaaatgttagaggcccatttgagcctcagagatgactggacatcagaaagcacatggccaggatgcctttgagccaacttggcatgacaattctatcagagtagtttttccatagtctttgactccttctaatctcacatctcaaggcttcatcgctgaagacttaggtttccttccctagaaccagattraaaagtcccmggtaggcctgcccaacatgggtcacttgcctatgtcatttctttgatgagtcttttttggaccagttccgggcgaaggggagttgttgattagggagcttcaaccatttctcacagtccctcagtgttctcatgcttccagagcccttcatttctgaggaagccttcattcatatttaaacattagaacaggagtgtggaaacgtttctcacaggtctattttggagagttctatgaacgggaggaggttgagtgcagtgattgattagtaatgtcttccacatcctggg

SEQ ID NO: 19533 - DNA, 600 bp, Bovine  MMBT04694
acagcaaccggctgcccagcctcggggaggacacgctgcgcggcctggtcaacctgcagcatctcatcgtgaacaacaaccagctgggcggcatcgcagaggaggcctttgaggacttcctgctgaccctggaggacttggacctctcctacaacaacctccacgggctgccctggggctctgtgcggcgcatgatcaacctrcaccagctgagcctcgaccacaacctgctggaccacatcgccgagggcaccttcaccgacctgcagaaactggcccgcctggacctcacctccaacmggctgcagaagctgcccccggaccccatcttcgcccgctcccaggcctcggctctgaccgccacgcccttcgccccacccctgtcctttagtttcgggggcaacccgctgcactgtaactgtgagcttctctggctccgcaggctggagcgggacgacgacctagagacgtgcggctccccggggggcctcaagggccgctacttctggcacgtgcgcgaggaggagtttgtgtgcgaaccgccgctcatcacccagcacacgcacaagctgcttgtcctggagggccaggcggccacgc

SEQ ID NO: 19534 - DNA, 600 bp, Bovine  MMBT08375
actaacacaaacacacaatagaatcctatagtatacagtttaatttccattatctcatagatgtctacgttatccattattgaacattagtcttgaactgtcaggataaagttgacattaactaaagtttgaatttagtccatagcatctacgcacatgtgtttgatttgtcaaaacccaacagcataatgtttcacatatttattcattctcctttgttgctgttagccatgtgtgcatttgcaaaatgaactagctttgtgaatggttatagagagaaaacaagaaatatgtaaagasaataaataaataatttgcrtctttaaaaaayacgtagttagtgtttctgtctaaaaatattgtgtgatgaagaaatagatccgaaacaagagtaattcttttcccatgaagcaacactaaccttgcaatttttactcagctcctttgygtaaggatgaattcttccccccaaatcttggagaattgtaaaaatggaaatgaaaagttgactcttgagacgatgtattcctttaccccacctgtgtgtaactgtctacttcagaatgctttatatccccaaagtgcagccatcttctctaa

SEQ ID NO: 19535 - DNA, 600 bp, Bovine  MMBT11472
gtgaaagcacatgtcctaaccgctggaccaccagggagtcctcccagtcccacactttaatcatatacttacttctcgctgacttactccaagctgccttcatcacacaaccctgagtgattcaactcaagcctcttagttctgcaccccagtattcccattctgtgcatattactatcactgcctaatttgagggtgtctggccttcctygctactaaaaccacagctaaaacaaacacgcaacattcctatgtattcctgaagtcctactcagctcaaagtctgctctgtcttaactscaaggcccttgtgtgtactccactctgctcacagcctgagcctttccacactcccaagttcccacttcgtctttcacactcaatctggctgctggggagtttgggagccttctcggcattaaaaaaaagaaaaaaaaaatgcctgcccaactccttgttaatttaatctattttctgatcaactgtgaagaatgtggggttttttccccttcaattttaaagcctttcgcttgtaattaagcagctctgcagctgaactcagggcggcacaggaaggtcagaactgcccaactgttctgc

SEQ ID NO: 19536 - DNA, 600 bp, Bovine  MMBT18670
tagcattggtaataacccagtgagggttaatgaaatcaatatttcctttatcctcaacacaggtagtgtaggtatctcttctgtgtatatatttagaatattgtgagcctatttctctagttaattgggtatacattcagtgatcactggtatattcataaattattagaagggcaagagcacttggtttctttctcaagaggtagttcaggaactttggagatctataaacctccagcaagttaaattatcctacatactacccataggtactattagaacacaaatgttcaacctttmtgaagaatacacatttcactaaatctgtaggcagaattgttattttacatagtctactatgtgatttgcaagaattrctgttacaacaaccaagaaagcacttgaaaggtatctgaaattatttttcacacagggctatatatttctctatctaatatgacagcmtgycattcatataaacatatttatggctgtgtcagttcatatcaagcacattgggacagtgaaaaaaatgtaatctagatgaaaaagaatttcatctgattctcaagagtccccactcctctgtaatgcattaga

SEQ ID NO: 19537 - DNA, 600 bp, Bovine  MMBT08171
ttttttctttggtgattgtatagcagagtgagtcttaatctagaattttgttgaaatcaggaaaacgagtggacttgccgtgtgaaaatctgacttatcagtgaatgcctaacctctaaataatcttctttttgtgcccttccttttttcttctgattattttccttttctctttggagacttaggccgcttatcttcccaagaaattctgacaagatttttcagaagcatcctgaaaactgcagacagcgttttgctcttggttgtgggaagcgtggagacagctttgccagccccgcrgcacccaggctctttgctgcctagggaaacyggcccgtggtgaagccgtaacttgttcccttctgattctcagtcgaagtttattagcttgtgatttaagcaaaccatctggtgctgctggcactgcacactgtccgcctagagctccctacttaatgtcttagtggaggcagtttaggttacatacttgaatccctactctggtctggacttttttttttaatgtcttaaaacatgtgcttttgaaaatcgtactgtgacccgaagcacattttaaaatcgtggagaatttcttcgttg

SEQ ID NO: 19538 - DNA, 600 bp, Bovine  MMBT06493
ttatttattcctacatcttaattttaactctaaagaaaccaagagccagaaaatgtgatgacctaagatcacacagttaatttactccaggggtgaaaaggacactttggatgtattcaggtgatcacacattcttcaagtgggaagagaggagactttcacttttaaaacatttaaagcaaattattatcaagaatagaataaattcatctacacaaggaaaagtagtaggagactcttcctattaaccatcagaagagaaacattcaggatctgtttagtgcttattttattacctcygccagtagacagaacaactaagaagtgtagccctctgaagtttaaagtctataaggatggctaataaaaactttgaagttgtacagaactttacagttcttaaagcttycatgctgctatgatttagcatagcctccaaggatgcatgtgaagtgggctggcagtaactaggtccccctgatttgcctgtgagtagagcacttgcccagatccacaaagcaatatctcatgggagagatccatagaacccagtgctagcccagggccccaacagcacaccccacccacaaataacaccgg

SEQ ID NO: 19539 - DNA, 507 bp, Bovine  MMBT10070
caaaatttaaataaataagagcccaagactaggaaatagacaatcctagagtgtaatagttaacactgttttgctcttatgaaacaaagataactaattcaaacatgtgaataaaaaaatattattttaaaacaagaagtcattaatttgagttttttttcttttaatgatgactgtagccagtgcatttttttttttttgaaataccaagattcttaattatcatttgaggagaacatacaaatctcaaagattcctgcttcaaatttagacagtgaggacagtaaatatgacaccatrtcgccacctagtggacatttcagaaagtgtctagacatccaggtttctgttgtcatgattatacttaggatcacaaaacccaggactcaggggaacttttcacgctgccctaaacagggctcttgtttcacgggatagtcataggtgcaatttgcattgcattacagtgcaaaccacctacatttgcattgtaaaatcaagtgtcaa

SEQ ID NO: 19540 - DNA, 600 bp, Bovine  MMBT06754
tgacgtttccatagcagctggcactaagcagctttgcttactaattagtctcatggtacagtctgaaattccctttatccaaagaccagaggttagaagatatggccttttttgtaaacataaccttatgtgacaggaaaccaaaaaagcaaaatttatccagatgaaacagaaaggggaaatgtgctcagccaaactgttagattcaagctgagagttggcagaacacggggaagaaaataccctctcctgatttgttatcatatacatactcagtggaatacttaataatcaggcttkttttgtaatgcagtttggcaactggcatctccagtacccaaggtctttaaatttcattacaagacatgatttaacactgctttagaggacgtcggtctgctgattcagctccaccacttcctgtcaacaagaacactaatattataaaaaaactcttctcacgtactcagtggttatttaacaaagtaatctagctctcaggaaatagagaataatccatcaggccaaagagtttactgggaattcagagctgcctcacaatatccaggtactcaagtttatcctgagtcttctttacgt

SEQ ID NO: 19541 - DNA, 600 bp, Bovine  MMBT06320
aggtgtaatttttaaagactcattctcaaagttcttcatcccttcaaacttttaaaaataagtattgtaaaactttttcctgtactaaaaataacaaaaaatgagaacatgacatttgaagcaatgatcttcaatttagaaccacttatagttcacagtattctaatcctggtaagaaagtacagttgccttagctcatcctagcattaaagtaaaactcattctactatttcttgaaggacagaataacaattggtgcctgactaaataaatgaatgaatgagtgaacacatgcataastgatgaatgtccttcctccccagaagctcaagtgtgaccaagcgaggcaggctggcagcctaccaagatgccttctagggaggcaattattatcttggtgattttaccctgatgccaagtctggcttttggatttgcagactcagcttaaagctagtctgtcagcttataagtggggccacatccctccgacagcttctcattaacccagctgagaaagatcagaaagtcaacttattaatttactatataaactataaattccatgaggactactattcagcaggtctagtgcatttcc

SEQ ID NO: 19542 - DNA, 600 bp, Bovine  MMBT07260
cagaacagttatttatggggctttttatatttctctgttttggaaccaaatgctcttgcatgaccacaaaatgactgataatggctcataaaactgagagctgttcatctgcataactcaaggctgtttatcatctccttataaactcgaatgcctaataaatgctttctgataataatacattwaagaatgtggctcgtgtatattaagagtaaaacttctagtccacttccagcttagccatggcagctaatttgaccactaacccgttgtagctgcttcctctagakcttgtggacragtggataggatcaagaattcacattgagatgaagagtgatgaggagactgttggtatacttctgggatttggtgactttgtcaatatggtattggaagatgtcactgaatttgaaatcataccagaaggaagaagaattactaaattagatccaatttttctaaagggaaataatataccaatgctggttcctggaggacaaggacctgaaatatgaatgacttccttgacttatgctagatgctgttctgtcttgtaatgacaacaaaagtttttttttagtcttttaatgtttgtat

SEQ ID NO: 19543 - DNA, 600 bp, Bovine  MMBT11553
atgtgatgagaggctgactttctaaaacttgagcaaactctgcccgaatggctttaataagtttaatgagcttctcagagttgagatgatcaggttttggggtttagatcttggttttgctcttatcttcatgcgtggcctgacagccaatcattttctgtgactgtttatggaagccactgatagttgaagtttcctcatttgtaaagtggaagtcacaatcctccatcatttctgagaactgggaggaggaaagtgctggccactaggaatcgtgtctgagtttcagctacaaaccayggacttttgagagactttagcaggaaaatgccaggacatacctggaggatgtttttgtttccctttttgttttttaaagggagaaagagcaatcctttgtactttgtgacctgttatgcacaaaccttaaagcagcaagggccggaccccattcctagggctcattcaaagttataaatgcacagatatacaaaggatgtttacaaatatggcttattatgcttacagtagcaacaacaggagttcagttttagtccgtggaaaattgctgcttaataagaactttcccaaacccatgtc

SEQ ID NO: 19544 - DNA, 600 bp, Bovine  MMBT11565
tttagtaatgaaaatttagtaaatttagtaatgaaaatacatatttggacaattttgtccaaatatcacaaaataaatgattaattcttttgtattgtgaaggattcttttctcccttttaagtcagttgcatcaaccaatctcttctattttcagtagaatgttactacagacacagtctaatcaaatatacctgggttaaagtggatcttgatttagtcactttctattgacaaaactttgatgaaattactgatattctctatattctgcacacttagcctaaaaatgtggataaartattatcatcatggggtggttttgttaattaccrggagtaatccatttataccacccagcaccatgcctggcaataaaaaatgttacacctctaaatcattttacttttaatttatttcactatcacagaagatgatataaatatgtgcaaaacattagaaagacacaactattataagcccttaaaatactaactgatattattaaactcctgctttaactgtctatcactgcatcccttaccttttctccaacaccaccaactgagccaatggatcctggaggtccttgtggtccctg

SEQ ID NO: 19545 - DNA, 600 bp, Bovine  MMBT13824
cagtagaaaactattccatatagtatcgtatcccaaatgccgcattttattattcatttttccatcctagatcagttctcacttgggtgcctgttatgctatttctctctcatagttagtttgagaagtaacaaacggtctttgctactcagagtgattcactaatcctgcttaggatgtaaccagagctactacgtaaactccaaagacactaagagaaaggggaacagtggatgctagtttgtctttaagtatagaaattgcctcaatggtcactggatatgagagtagctaatccarttcaaggttactctcaggatatgtgcatggaatgcgacctgggtttacagagataacatgattctttgatcatacaaagaccaactgtttctgtgcagaaatgtttgagttagctgaagctattgagtgaatttgtccacagatagtcactaacaatgatgtcagaacccagaaagatacagtgaaatgactccaaaattttatttgagaatctgtttaaatcccccactgaaatgttgagtatcaccaaaaaattaacaaaaagtacacttttattctaattagagttttattttagat

SEQ ID NO: 19546 - DNA, 600 bp, Bovine  MMBT09759
cgctcaatgagatcaagaggatggaggagctctctgtgaccacaaagtgataagaaaatacaractttcttcgtatyggttcacttaatgatctctaactgggaaattcacacacaacaggggcctcatcttggtggtcaccagacatgaaagcctccagcctagacatcagtctttttctttttttttagtttatttattttaaatgaaacaaagatgaatattttaatgagagaaggtacaattcacaaagaatagacatcataaccacaaagacacctagcattagacacataaccrcaaagaaacaaagatatataaatcaaaaattcagaagaaatatagggaaaaagaaaaaaaaataatcatagtgagacatattaacgtttctctgagaatattttatcaagtgcagaaaaagtaagaataggagcatctggaatgatgccattaataatttaaatataatagactttaattaattatattaatcttatatcctacacaaatatatttaaaattctgtatgtcatatgttgctactagatagacatcagtctttagcgagggtagagagagacacttcccacgacaatcact

SEQ ID NO: 19547 - DNA, 600 bp, Bovine  MMBT20958
ctctgtggacagaggagcctggtgggctacagtccatggggtcgcaaagagacagacacgactgagcatgcacatgtgcagaactggtatctcagacatcaaagaaatcatgtttgtttcagaaacaagtttcagcattgaatcctttggtatctccagatagtgatctcttccttgcatttattccttcactaattcattgacttggcaaatatttatcaagatcttcttaactacagagcagtaattaagaagctaaaggattaagaaggataaaatgtatttcgtacataggtaacracaggtattacagagtgtgacaaatccatgatttagggacaagttctcacaatgacattctctgaattggaagtccattcgaacaaaaaaaaatctgtaagactagccatcaacaggagttactcaatctggaggatatggatgtatcagtcccccctgacatatccaccataactgtaactttattttgtgacttgggtaaacagaacacaaggttgtgttgtaatgctgtaatgacagaagcattattttctggggaaaaatagttggaaaagaaaagtatttgcaaatggtacaaat

SEQ ID NO: 19548 - DNA, 600 bp, Bovine  MMBT20113
ggatggcttcaccgactcgatggacatgaatttgggtagactccgggagttagtgatggacagggaggcctggcgtgctgtggttcatggggttgcaaagattcggacacgagtgatcgactgaactgaactgaactgataggatctggcagcagagggcaatggaggcaggaagcaggcagtgttcccctgttcccttcacgcttcattgtctggctcagcaagtggcaacgtgtccccgtgacacaccttctgccagcgcgagcacctcctstctgagtccagctctcaccgggcccyccacttcctaccaggccagcgtctatcacagcttcccgctgttttcatttctggtgctccgaactctcttaccctgcccactccactgtccagtcccttcgttaaggaatcttctgttgaaccacctgagaagttttctatctcctctgggaccctggttgatatatgcaattataatacatttcaatattttcccatgcaacctacttccctatcagtcatgctcttagtttaataaaatattttccatcattaaaaaagaaattctggagaatctccaactggcacatgcagcttttg

SEQ ID NO: 19549 - DNA, 598 bp, Bovine  MMBT02942
  misc_feature (1)..(24): n is any nucleotide
nnnnnnnnnnnnnnnnnnnnnnnnattatgaggttaatgcagaagtcaactggtgaagtttctgtcaactgttacacttaatgtcctcttcctgattaagagaaaatgaaaatattaaaaatatagaaaagtgaactttaaacaacactattagccagaattcaagtttaaaatcagcattagttctcgtaaagttcaacaaacatactttaccaaatttaactatcatttatattaccacctttttgcttttcaaattaataatacagcaaagtaaagcagaagcaggtgaaaaaattyaaaggtaaacgtgatataaaatgaaactgtatattcagctaaaaaaaggaataccatggtgttctacatacttgctggcaaaaagaaataaaagttagtagacaataccatttctagaaattcagttacttcaagttttttttttcccactcacctctgaaaccaccaccccctcttcctcctctgaaacctccacctcctcttccacctctraaaccacctaaaaataaaggaaatattaattaaataactgtaacctatcatattttgataagcctataaacatcaatatatttct

SEQ ID NO: 19550 - DNA, 600 bp, Bovine  MMBT02372
tttacctctgcattttctccattcaaaccaggcaagtctgtagcagttaattttggcttttcattttctagaggactggacacttggtctaaaatcctttgcagtcctggacttaaatcaaatgatgctcctraccatagaaatgaattatcttgccttgtgccagttaacttggatttttgagaccttttatctttttcttctccaattacttctctttgggaatcatcattacctacagtcacttgatcactcmgtttcagtatttttagagattctgcagtattatgyttctcctgsacaggaactatgtctacattgtccaaagctgcaaccatctggacagaatcgatttctgaaaatataatagactcatcactgaaacaagacaatggctgctgattatcttgattctcattcatatctggttttttaattatgccctctggttgtagacacagagaatcatcgaaatggactgatgttatttcagaaggaaggtgttctttttcttgtccatcaggtcgttgttcttctacaaggtagtcttcactgaaactgtcaaacagtaaactaccactcaaattcaaacttgtttca

SEQ ID NO: 19551 - DNA, 600 bp, Bovine  MMBT07137
tacctttcacaaacctaaacctgtgtttttcacatgtataaaatactagaaatcacacraagctttaagcacagcaaaccactaggaattacatgagagcattccccatttttacaaccgcttcaaatttattgcacwaaagcaagtgtggaagtgcactgcctacctgcatcagctctggaccgctggccaggtgtctttccgaatggggtcttcattcatctgtatttaggtgagcagcacagctgctggactagggtgaaaatccaacacgctccaatttgaaacttcacagacttkcaatgttcttgttaatccatcatcccaagcgctttttttttttaaacaagttcagcaaaaatacgtgaaatcttamgtactctgtaaaacagtgaaataacagttcattactagagcatcacacaagagcaaacttctccaagtaagccatcaaacatgacattattttaaatgtaacatcagtgaaaatgcattttgcccagaagcaattaactttaatttctcagtccttggtgccaaggactgcacagagaagcaagagaaaagaaagtactagacccttcaacaaagaaaagggta

SEQ ID NO: 19552 - DNA, 600 bp, Bovine  MMBT03917
tacctgggctatttcagtgtttttcttgaactaatctgcttccactatgctaccatagcgtgtgtatggtagcactcaccaatcagtgattctgatgacatttgagttaggaattgatacacatctagttaaaaaaaaaaaaaaaaggccttgaatggcttcccatttcactaacaacaaaaattaaaattagtagaatgagcagctattatggtgcttatctaatttatcatccccaaatgaagaccttcttcatactgaaaaggagcactttgaacaatcagtcccagacaacatgcrtaaacagacacaatcccagacaaagcagaagtgttttcctcctactctcccacctggaagccccttcacaatctacccctgccccctgcaatgaacttgacttcatcacctgcctcctcccttgcaaatatctctcactacatacgtcttttcttgcacatcctaaaagctgtcagatttcctcctgcatcaaggttctttgcccaggcagatgtttttgcatgtaatacctacccttccttctcctatcctcagaaatcactccgtacttttcctttgtttctgcttgagtgtcgcctg

SEQ ID NO: 19553 - DNA, 600 bp, Bovine  MMBT20156; identical to SEQ ID NO: 4821

SEQ ID NO: 19554 - DNA, 600 bp, Bovine  MMBT11121
ttattttaaaatatgtgtctattgtaataggcaaatgttctccaactcaaaacaacagcaactaccaccataaccttctgcccaaaggacaggattcttctgttaggctggccaaaaatttaattcaggttttcccataaggtggtactggaaaaacccraaaaaagtcgaccaacctaatattttcattatcagttaatccatacaatcattcatttaacgttccatgtggcagctagtgcactgaatctacaaggcggaaaagataggtcttattttaaggagctcacaacacagtasgcaagacagagaagtaaactgactgctcctacaagtccacaactatttagcacccactacatgcaggacaaataatttaaaataactatttgggatttccaaatagtagtttccaaatgacattgtttatctgtatcaccaacagactcaattttcaggtcccactccagacatactgaatgagaatttcagggcatggggccccaaaagctttttaaggtgtttttttttttttttaattttcctggtgattttgatggcaatccaagtacaggaaccactggtttccccacacaacga

SEQ ID NO: 19555 - DNA, 600 bp, Bovine  MMBT13727
tatagctaaaatttaattaatatgtaattttgagcatttaatgtaaatgcaaagtctgtcattagtgtgatgtgaagatttcaaatttgaatgcaaatatacacataatagacataagaggggcagattgtttctaaaaagctgtacattttattataattgcttaaaaggaattaatggcatttatgaacccattgtgggcaatgttggagagtgatataaacaaatcagcttcttattcttgaaaacwgcatatttgtgaagcagaatgcatgtgcaggaaaaaaaaaaaaaaaagayttaccaaataraacaaagtrtggcaaaataaagaacttctcaaaagcttcaattatgtgcaagaaaataytcagaaagaacgtagtggatataagtttactttaggctttctgtctcaccaaagtttttccttcttatagagtttagatacattaaaaaaaatgatttgagccataactcattcttttccatttcctgtattctgaaaataacagagaaatataaagaatatgtagggccctggctctggtatttggtttagttgtcctgaggaaatcaactaaatctcgttccttacat

SEQ ID NO: 19556 - DNA, 600 bp, Bovine  MMBT21031
tcttaaaaatatagtacttttgacagttctcaggtcatagaattattgatttatactctgcaaatatatcctaagtatattcacatgaataattagaatttggggctttgatatcatttggaagcacactatttaggttggatggttctagaatcaaacagcctccacacagttcttagttcctgtacatttcttagttattgctttttacactttggtaaattatttctgttccctttgattaagttccctcatcaatataaaagataggatcatgatagcacatacctcataaggtgytctggacattaaattagtatacctaaaactctgtcatttcatwttataagttgtggctaatattaatttgttcaaaagttaagcaaaaacataattttgtcattctgtgagcttcaataattcattaatttgaattcaatttattcttygtaagttgaatatagggcyttggatatcatctgaagtkyaggttacaattaaattgctgattacagaggatcactaaagatatttgtgctatgtaaagaagtctattatctgttctattctagtttttcaatgtcagctgcaatctctcta

SEQ ID NO: 19557 - DNA, 600 bp, Bovine  MMBT01109
aaattctgtaactccataacaagctaaacagaaggaaatgaaattctctgggatgacattcagggctttggtagattgccactctatcttgcccacccttgaaaaaatgcatgacaaaggatacttaatgagctccatcgcccctcccactcactttctctggaaagccctgatttgaggtgtgaggtccgcctgcctttggagtggttagtaaaactcctggaactcgtctgtcagcctaggtctcagcagttcgatctcattatgagaatctccctccccttcactcccactcagacrttcttttctgtatcttgcagtttgacacttacccatgaaacatcaagaaaagtcacttaaaattggatttttttttcagtcagaatgtcgaaaataacaagattcagaaggagactggagtaataaacttgacccctttcttacctcctctggccgttctttggcattcccttctcagcattgccatggaaaccgctgactcctttcttgtcagggtgattataccttttcagattttgacaactggaagatacaagtgaaagaaatccagactctttcattactgctcccccttccact

SEQ ID NO: 19558 - DNA, 600 bp, Bovine  MMBT17611; identical to SEQ ID NO: 4503

SEQ ID NO: 19559 - DNA, 600 bp, Bovine  MMBT08158
ctttctcccctctttctcctctgcttccatgtggtcctaggcggatgagcaaactgacttcaaaagcacagaggagttccctggcttccctgatgcctggaccccacagggtgggagatgctttctgggttggctgaggaggaagtcaagctgggcgctacccatggagcctgcttcctttttcactcttggcctcattccctgcaaggcgagcttgcaaggacggttgctctggttacaagaccaaatcactgctgtttctgtctcttcctccgtgaaggtctcgggggaatcagcttrttagagaagcagtggctgagtgatggagtcggctaggacagtaaagggactccttggaggtcctcagatacaaagcccccggttcttctcttgatgaagccagagcctccatctcagggctgcctggacaaccctatctgcgactgctcccgtctgctgtcttcyacttcatacagcggtgctctggtatcagagtcagtctgcggtttgaatgtgcccgctttgatgtcaatccttactgtagaggcagaagctccattgtccctgcccaactcttccctgcactctctctggtcatgg

SEQ ID NO: 19560 - DNA, 601 bp, Bovine  MMBT13803
  misc_feature (1)..(1): n is any nucleotide
ntctgtactgctgactcacttggagatattcgagaaggtatgtctatttgtaaacttgcaytggctaccattttggatgagggcagcagactaaaattaaagtaaaactcaagtttctttaattttatatgaaatttgctacgaatcagtttttccctcagaaaaacttcatgggacattcagataaaaraagagaaggtcaaagagtcatggtgaaatggagttttgacttggcttaasaatcgctccaaggaaatcacacacttcacctttgcctcctgtgagaggagagcagaagacrtcagaggaagaaaggagagcatactctctcctcccgtaagatgcttggggccaaacttaggatctgtgtcttagggtgcctcctgggctttgtgatgacaactcagagtggatgcgcagttgggttagcagcaggacatagtccagggcaggtgggaagtgtgtggaaacagagagaagttaagcaatttgcccaaggtcacaccacgcataccaaacatcttgttccagagcccacattctcagctattatttagttctgctgtatgttctgggagaagggatgaagtgtgtcattgcc

SEQ ID NO: 19561 - DNA, 601 bp, Bovine  MMBT21975
  misc_feature (1)..(1): n is any nucleotide
ngagaagggatgaagtgtgtcattgccagtgacaagggcaatctgggatccaggttaagacttttacatgctcgtccaaacatgatttgtgtagagagaatttgccatttgtggttttttttttttttggtcgtgccacacaactcacaggatcctagttccctgaacaaggattgaacctgggtcctcggcagtgaaagtgcagagtcccaaccactggaccgccagggaaatccctagaatttgccatttggacttgactctgcctgagatgatcctacagctgaaccctggggtagcrttaaggggggttattgctcccggaagctgggcaggccaagccaggggggcaaggcaggcactgcatgcgaggtgtctggggtcccaccgtgtgtagcaggtgcagcagggcctcccgcaggcagctgtgcctcacgtagaagctgatgatggccaggtgggtgctgtagctgtgcaggtagaagaggcattcttggtagtaggtgttgttcaggatcttcccttcaggaatcacttccagagagaggctctgggtccggagggttgcttccagctctttcaaggtggccaagaagtcatc

SEQ ID NO: 19562 - DNA, 600 bp, Bovine  MMBT08652
caaggaaatgggaattttcacacttattcacacatatatttgagtcattttccaagtgaacaacacattgatcctactttataatttaataggctttttgtgcctcttctcatctgtaaagtaggaaaaacaatagtacctgctcatgggttgtcattaggattaaatgagtcratgtatataaagtacttggcatagtggccagcataataaatgacaaataaaggtagctattactcatattccaatgagttctttggtttctataaatcataaaaggtgctccttgaacacacacayrcaagaagtttccaggggtttgctaggtctatgaaatttgatmttccttgccttaccttggcaagaatcttaactagctaaagttattgatccaggtagcaagatccacacctctacataactgtttccactcactgcaaatttccagaaagtaatcgtttcaggctgtaagtgtccatgtttggtctcaacccaggagaaactcacttgcaytggaagatgggagcagaatccataccctgcttttgagcaactgggttgaggaacaaatagacttttttttttctatcccaaaataag

SEQ ID NO: 19563 - DNA, 600 bp, Bovine  MMBT05326
aaaagcaggctctgtctgagatatagatatggcgatgaggttaaatagacaccagaaaatcacatcgctattttcgctaagatataaattttgccagcattttccagatcacactggagaagggaaagcttccacagaatctgagagtgatgggttcatgggttctgattgcgtgattaatatacactcatggtatttttcggtgtgtcagcaaaacgtacaggtctctgagcctgacatttaattattacacggatggttgcatgaactagaggagtgaacacagactttggagtcccrgttcatcattaatggtgaggattccagtctccatttcttccattcagtctccatcactcttactatctaccacctgtaatccttttagagccagtataagaggaggaagggcttcccaggtgccactagtgagaaagaagctcctgccaatgcaggagacatgagacacaggttcaatccctgggtcaggaagatcccctggaggagggcatgaaaacccacttcagtattcttgcctggagaatccctgacttcccagaggagcctggtgggctacagttcacagggtcataaagagtt

SEQ ID NO: 19564 - DNA, 600 bp, Bovine  MMBT13077
tcgatgaacgtgagtctgagtgaactctgggagttggtgatggacagggaggcctggcatgctgcgattcatggggtcgcaaagagttggacacgactgagtgactgaactgaactgaagaccgcagaacaagggacctattgctagggaggaaagggagttaaggaggatgccaaaaacgcccagataaaatacaggctttgctgaaggccccatttacttccttgcccttcagatccagggctctctctgaccagatcccaggtttcattcccccttctttacttcatttccattacygtgtcctgtgtctccaggatgttcacatggaattctgtgaaaactgtcttttgtgtgtctttcttgctttacgtcctcttctgggactgacggccacctgtccagggttcttggtcttttcacgacaaacgaccctcagcaggtttctctgaggcctgtttacttacaggcttccgagtctttgcggggatgcagaccagactctcctgctctgcaacacaccagtcatactgatacattggaatgctcttggtacctggtgtgtttcccatgtggtggcagggaagaacagggttcttt

SEQ ID NO: 19565 - DNA, 600 bp, Bovine  MMBT05331
gtcacaaagatcccctggagaaggaaatagctcccactttcagtattcttgcctggagaattccagaggagcctggcaggctgcagtccagggagtcgcaaagagtcggacacaactgagcgactaacacttggaggtaaagagagtcaggagagatgtgtaaatagttgtaaaatcaactgctgtggcatgtggggatggattgatgggtgggagctttatttttaagctttgtgaaatcatcttttatagcctgtatccgttttagaggttgtcattaagaatcatgtgctgagtatrtagcatggttgacatattgtattaaatgttgggaataaaataaagaatcttggaacttgggagctggaagcatctttgagatttttctggctgtgtttgtagttttattataagtttaagttggctcttggctgtttctacagatgcagtgaccatatttttctgaagtaaaacatctttttcatcacagaaatttttttttcaatttgtaaattatggacaggcaaagttttacaaaggcacataaattgtgtcagattttatcttagatttactatcttttggaaaaagaagagagta

SEQ ID NO: 19566 - DNA, 598 bp, Bovine  MMBT13510
  misc_feature (1)..(25): n is any nucleotide
nnnnnnnnnnnnnnnnnnnnnnnnntttccttatgtttgctcttcaggaaaaaaaaaaaaaagaaaacaactgtaacctttttaaaatcgaaaggatgatataaaaatgcccagcatcttcttccgtaacgcttacaaccccatcaagctgtattattaaaatgacagggaaccctgttatctagtagatgaaaacctcgccatgagagctttggagcagagggaaacctaatccctcttgttgccactgtgatgacaggtattgtattccaggtgygggagcgataacacggttgcctyaccgtgtaattatcattgtttccgttggtgttatcctaagtagtaattatcactaactcacatatggcatttggtagtaacttggaaaacagcctgccactttggcttcatcatttggggtggatgttgatggcattatgctggaaatcctgagttgctagtagttgcttctgtgaggctcccaagagggctgtatacactggggactctagcaggttgggaagcaaagtgccgctttgtcattagctgtacgagtaccyrattctccaatataaacctctggtaatgttyaggtagg

SEQ ID NO: 19567 - DNA, 600 bp, Bovine  MMBT09507
gtagtgcttaaaactgcccatcttgtcaacactgtgactagtgatgagggaacaaatgttccagggtagaaaccagagaatatccaagtatatgaagaactgagtggggctggaaaacagaatactctacacctaattcaatgtgacttttatatatacaacattgactctgtgccagcttttgtatgcagcattgaagatgcagggaggagttaaacatcacctctgtccttgggggagatcccagtgtggagggctgggcaaaaaacacacagcaagctagaccaggaacagtgttayaagaggcatttgacgagacatttgttcttgatagtaattctcaagttagagtgagattactcattgagcattttcatgtgttccaaaaaaggaaaacattttcttgttctgtacagagatgatgctacagggaagggataaagttttctttcttctcttctcttttgtaaaacactgaatttgaactgctgaggtggcacaactataacagctcaaagtttcagtcctggtttgaagatgaaagccaaactgtgtacatgggttctttattcctttgctaaataaattcctctgtgaact

SEQ ID NO: 19568 - DNA, 600 bp, Bovine  MMBT05154
ctaaatttgtgttaacgtttccttactcatttagtgatgatacatgctacatttcatctctgaaagaagtggcagttttctgtattgttttttattttagtttcaatttaatagtgcaaaagtcaagtagttggttcccagaattaatgttttattttattaatgtttgatcttcttaatatttatatttctaccattttttgatgtaattcaagtgagtataatcattgcctggcaatcatttggatgtgattgaaatatgaagtatgcagattgggaaaaggttgaattaggaaatayatttatcacattttcacttcagcatgacaataaatctctccattaggtgaaaccagccatgtaactatctgcttcctttaagaggaaagatataaaatctaatcagttttatgaaacagtcttgcatgagactaaacaacaattcaaaactgacaaaatactaaatatcacccactgatgctcactcagagaaaacactccagacaattaaaatttctacattcatgaaatatttccacagcaaatctccatatcctagggttcagatttttctatatctcttcactgtggccatacatg

SEQ ID NO: 19569 - DNA, 600 bp, Bovine  MMBT00854
agtagcaaaatattccaactttattctatgacacaaaattatattaggttaataatgtaattatgttatattaggtaatataaattgcattttaatccacttaaatggaaatttctgttgagtgttcattgaactgttgagaagcttaaatggattttatgaaaattaaacatcttaattcataaagaacttaataaactttaattctggcttacataaaattaaaatttaatatttaagtctaatttatatgtttatctttttggaaaatagatacatcatattttaatacagacctcytgaagtttaatgagaaagcaaagacattttcatgcttataaatgtacataaaatgatagttcaggacttcatttttacgctattcccaagagtggttttactgattcgtaaaccatacggcttatacaaactgaaggaaacaactttaagaaagttggagtcatgcctctgaaaaatcctgtcactccttgtcttttataaattttataaaagacgctaatcatatttagctgtggaactcctagaaaatgaaagggaagggaaaaataaagttaattttatgttttagctttctttcaa

SEQ ID NO: 19570 - DNA, 600 bp, Bovine  MMBT07256
ccagcacaaaccttatctggtgtttctgggtatcagcctcttggaaattcaagtggcaaatagttactgcacctggtaacatgctttgaacatggaggagcctaaggcaaactcaacagcaaattcacttgatcttggttctggctgggtctagagtacctcaggttcctgtctgctgtctgtaaacctcagtttctcccctttcttccacctcaaacaaggacaagggacacccagcccgtgccaggggccgggaagagcccacctcatccctccagagtcagtcctaacgccagcctrcagccctttcactggtgcctccgccgtggaccgcagcatcggctccaagtccttctgagcgcctccttgacctctttgttgcggaggctgtagatgagcgggttgagagctgggatgacaagggtgtagaacacggaggccatcttatcagtgtccagggcgtagctggagctgggacgcaggtacatgaagatgagtgtcccgtacagcatggccacacccgtgaggtgggagccacaggtcgaggctgctcgccaccggctctcggccgagcgcatgcggatcacagcgccggcgatg

SEQ ID NO: 19571 - DNA, 600 bp, Bovine  MMBT20275
agataatgaaattacagtatatctactcccagtcaacataactccttggaaagactgtttatgcgccctgtgtaaaagttagtccattgtttcaatgttttaagaaactatagtcacagaaagagtattgcctggtaaatgtttatttaaaatatgcccccaaactgggctggaactctgaaatgttagatttccttcagaaatgtttacccagattcacaaatctttcagactgtggctgtacagaattgctgagtcaattcatttcttcagacgggcttctctgatacctttttattytgttccaacaaaaatrttttcaatagcaaggaaatttttccctgagagaccatttctacacactgaaaagtttatttcaataattctgcctttttggaactaaataaactttgaaactgaagaagaaaaagagtaacttaaacacttgtgtagctttaactgcatatcatcaatttcctttctaaacagttacctttgtggggtctcccacactatcaactctcaccactataaaaggctgataacagcacagtaattaaaatacagctgagaaaagaagatatttaaactaatttgcat

SEQ ID NO: 19572 - DNA, 600 bp, Bovine  MMBT11656
cagtaccgccctcctggccctcgtcctccttctgctctggaagcactgggactccctcacctacctcctagagcacgtgctgctgcccagctgagggccccgtgctccccccagctccccactggcccctgctgctccaggggggaccctggggctcctgagtctgtggggcgtcttcacgtgtccagtttgacctcctgcccaaactgtctgtcctggcgacttctgcccccttctctgtgtgtgcttcttctgtctgatgccttttccttgttgggctgaagggagcgttgagtgtakctcccgcaggaggttggggagatgcctgtggccacgcggagctaaggacccggatggactgtttacagtcacagcagaacttctcccagcagacgcctggggtcaggaaggccgaagagagctttcctggtggggagcccacgctggagacagctctagccccggctcgtggagatggtcgggatgaaggcaggagcacgggtggcctccctggcccaggaggctccccagctcacccctccgtcctccagagctgggtcctgggtggggcccttctgggatctgaggatgccggctctg

SEQ ID NO: 19573 - DNA, 600 bp, Bovine  MMBT19606
gctgacaacctttggatagattttatgtgtctctattttctccattgccttggaaaaactacttctctttaactctcytgaaatcccaagtttcctcacacaatatccattcttggcatttacttcttgccaaacactgagctaaaagctttccctgcattatctcacttaatcctcacactgaccctcactggtatgtatttgaattccagtgttacggatgagaaaacagctcagagtcagtatagaaggaaatgtgctaagaccacacaggcaagcattcaagctctggttgttctrgctccaaaaattgtgcactcacaactgttctacagctagccagcaacaaggaacacaagagtaagttccaaaacttcctctagtcctttycagcatttggaagaactcaaaaytgtttgcaccctttgcaggcagattctttaccatctgagccaccagggaagccttttgcatccttctgctccttcaaaattgagtcctttttggattmttttcaatagataagccttaaggtatatgaaagtctactatatatgtatcttttaaaatatttattttttattttggctatactgtgct

SEQ ID NO: 19574 - DNA, 581 bp, Bovine  MMBT19610
tggcatttacttcttgccaaacactgagctaaaagctttccctgcattatctcacttaatcctcacactgaccctcactggtatgtatttgaattccagtgttacggatgagaaaacagctcagagtcagtatagaaggaaatgtgctaagaccacacaggcaagcattcaagctctggttgttctrgctccaaaaattgtgcactcacaactgttctacagctagccagcaacaaggaacacaagagtaagttccaaaacttcctctagtcctttycagcatttggaagaactcaaaaytgtttgcaccctttgcaggcagattctttaccatctgagccaccagggaagccttttgcatccttctgctccttcaaaattgagtcctttttggattmttttcaatagataagccttaaggtatatgaaagtctactatatatgtatcttttaaaatatttattttttattttggctatactgtgctttagttgtggtacatgggatcctttttttttttttttaagttgccacatgtgggatcgaacccaggccccctgattgggaacacagagtcttag

SEQ ID NO: 19575 - DNA, 600 bp, Bovine  MMBT06702
caaagagacccctgctctgagatgtttctttttcactcaatatgttcttcttggaatcctaaccaatttcacgagtgatgacttcaaacttgcttctctctgttgagcttcagacctgcatttactacatttgctggagtctgtctgatgtccagaacacacttcaaattcaacaactcaaaaaaactgtacttagcatcttccttttagagccagctcactgtcctgggttttccatctctaccttactgttcaagcctgaactaagattctggtctcccaacccagtacatcaaatcyactcccacatcctctccagactgttttcttaagagcttctccatttgcccccatactctgttcccacaaacaagccctggtgatttctcctctagattattgatacccctgacttcacgatgcaattcatctccatagcaaagataaacattcgttcatgattaccctaggcattcatatgatatggcacttccttagcagagttaacaaagcctctcgtaatctggctcctctctgcccgcttacctcccaactgcttggcatgcagtgtcagtgtcagtgtcagtgtcagtgtgtgtg

SEQ ID NO: 19576 - DNA, 600 bp, Bovine  MMBT08547
tttcaatggaccgctttttcctgctccactgtaaccgtaattgatcactgctcacagaagacatagcttccgtattttggtccaccacattttccaccatcacgtaagtatgcttgttaggttctcactttattatctgcctatttattgcttccagaatgcccagtaaagctgaaatttttcatttaaagtgatagaaaaattttcctaaaatacttgcttaatcatcttagatttgacttttggcaagacagttaagcacatagaaatgaaaacactacatttcacaaatacacacamaaaaaaatmcaaactttcactgtttttcttatagagctcagtcgtaaatgtgcagcttacatataaactaaaaacacttttaaacatgattgtcacaaaaatattttaaacagagatgaaatgtatgaaggcacacacagattgtcgatagtgacatcagttacatcacatttctttagaaacagaacctttcctgtttctgtaaacaactttttttttctcacacatttaaagtgagggttagtgctgacataagattattgctatactcacagtttgagtgtttccactgtgtatgag

SEQ ID NO: 19577 - DNA, 598 bp, Bovine  MMBT05372
  misc_feature (1)..(37): n is any nucleotide
nnnnnnnnnnnnnnnnnnnnnnnnnnnnnnnnnnnnnaacacccaggactgatctccttcagaatggactggctggatctccttgcagtccaagggactctcaagagccttctccaacaccacagttcaaaagcatcaattcttcggcgctcagctttcttcacagtctaactctcacatccatacatgactacaataacatagtaatcataaataatgttaaactgtatgctttgaccttagaaatccaatatgcagtgaagaaatctgtccattgagcaaatatttatagcacatctwctaatgctcagtgctggggaacaaaatagattttttttttgtatcatgtcgtttatattttatttacacttttacttaattatctacatatagtagaatgtactttttagaaaaatcttgccattgwtaagtccaaatttacttttaactttggtataaactttccttgacaactctaactcccacgagtataacaaggcaatagatatgtttggcagrgcaactatttatgtcctgtcttctgtgttgccagggtgatggtagcaatatcgaaaacattggaggtggttgttattgg

SEQ ID NO: 19578 - DNA, 601 bp, Bovine  MMBT20235
  misc_feature (1)..(1): n is any nucleotide
nttaaactgtatgctttgaccttagaaatccaatatgcagtgaagaaatctgtccattgagcaaatatttatagcacatctwctaatgctcagtgctggggaacaaaatagattttttttttgtatcatgtcgtttatattttatttacacttttacttaattatctacatatagtagaatgtactttttagaaaaatcttgccattgwtaagtccaaatttacttttaactttggtataaactttccttgacaactctaactcccacgagtataacaaggcaatagatatgtttggcagrgcaactatttatgtcctgtcttctgtgttgccagggtgatggtagcaatatcgaaaacattggaggtggttgttattggcaaggatcctaactttcattttcaaatggaagaactgtaaaaagcaaaatgtaggctgggatgtgggctgtagactggtcatggctatacctaaactagatgaatggattattaatggttaaccaagtatggatgctattctcggaaaactaatactgataggcaatatttccttaatatttaaaaattaatgaaatttggtcattacatcaaatactttt

SEQ ID NO: 19579 - DNA, 600 bp, Bovine  MMBT10468
caaaaacaaacaaacaattttcttctaactcttcttaatttttaaaatatgttatcatgattttccagaaatttattcaagcacatacataaatatattgctttctgtcctgtaaaatcaattactcgcagcttttaagaaacactcttttcctgaagtgagcagtttactccattagcttgctgtgggcattagatatcatagcaattacagaaagatgattcaatgaatattaattggtaagaaaaatcaatgaggcttggcattgcctcttcatgtaaagactatggtgtcccttayagcattattatgaccattatttgataatccttgctgtgaattctgattgatttctaaaatctagaacatagcatcatttacttggattctgtactgcttggcataaaaggaatgagtctactgttgtgttccctagagcctccytcagattttatattataagagcagactgtgtcatctatacagtaagaaaaagaagagatttcattacagatctattgggtgccagttcttagctttattttggaaatgttttccgggaagcataatcactatgaatgttctgaataaagaattgca

SEQ ID NO: 19580 - DNA, 600 bp, Bovine  MMBT02961
tataaatatgggaaagaggaaggattttattacattaatgtattttttgaaaaatgtatgtaaatatgaaatgaaaaacactgtccaaaagtacactctacagtgtacaaagaatgctattcacaatgatttcattaatgagttctgtttctttgtacttacaattgctgggttatcattgtttatttttatatccaaacagtgaaatggaatatggagcattacaaaacttggagatgtgaactgtgccccaagcaaccacaagtgattctgaatgttatgaactaactttcaatgggrttcatgtggcaaagctctgttgtgtctaggactctattgttgggagttctccaaattaacatccacatagactacagtttttactaaagtaaaagtaacatgaaygcactaattagaagttcagttatatatttcatcagtattaactgcagcaattttctctaataacaaacgatatttttataagaagaatgtttaatcaatgatgttaataatactgaaagtcacttaatcatgtctgactctgtgaccccatggactgtagctaggctcctctgtccatgaaattctataggcaga

SEQ ID NO: 19581 - DNA, 600 bp, Bovine  MMBT16278
cgttaagtgatctctcctggcatctcctgttctacttatgattggactcaagcccagtctctctggctacttctcggcatagctcgcctcctactcctaaattcaagtgctcagctatatcaagctgctgagttgtaactttgcccctcgaccatctggaagggctatttttatacaagttgtagccacgtctctctacttccaagcatcggatggctacccagaagcttgaggaactaggccacccttccaatcaccatgatgacggagacactttggaacaggtggaagagtagaaaygccttgaatttctcttttgtgacaccttgcttattgagaagtcacttakccagccatctaaaccatccagaatcccagttgaggacagaaaacatgcccmaaagtgaagatctccatcacaggtgtcacaaagtccaatcactaaaggcttaggtcttctctcaagacctcatgactcatattttaaagacagttctagcttaaagggtgacctggtctctggctcttagaaaattgggagcagaataactaaaggaaagacggcaatttgtaggtttatatactgaaaataattttttc

SEQ ID NO: 19582 - DNA, 600 bp, Bovine  MMBT09888
aaaaaaaaaaaagatgaaaaataacaataaaaaaaatcagggtagggggacttccctggtggtacagtggataagaattcacctgccaatgcaggggacacaagttcgatccctggtccgggaagatcccacatgctgcagagcaactaagcctgcacgcctgcagctactgagcctgtgctccgcaacaagagaaactgctgcaacgagaagcccttgcacccaccgcaactggagaacagcccccgcttgccacaactaaagaaagcctgagttcagcagccaaaactgcgaccccaygggctgcagcccgccaggctcctctgtccatggggattctccaggcaagaacaccggagtgggtagcctatcccttctccaggggatcttccccaacccaggggtcgaactggggtcttctgcattgcaggcggattctttaccagctgagctaccagggaagcccaaaagaaataaataaattaaaaaaaaaaattttttttttgatgatcaaaggcaggaaaagaggaaaagggcagaggctatgaagctggtctccatccctgagcccaaggagaaagctgtgagggatgggcaggg

SEQ ID NO: 19583 - DNA, 600 bp, Bovine  MMBT09593
gtagagaaaagctcttaaaaaaaaagagaggaaaaaaagcttggagttgtcctcatttgcctctcctttgagccccagtgttctctgttctcaatgcaaaatcctaacttccagagtggggtggtttttctctggagaaagaaaaataaatgcaatggcagaggcttgctaactaagtactgaagatccatattcaacagtaaaactgactttttgaagtagggcatcaagggaattggaaagaggacagagagagaacactaacttttcaaattcaatcctaaatttaagctgtatttycccccctcatttatgtccctgtctcattcctctgcgattttcactatccaagagtggtttcaatagttctcattgtcaaaagagttttgccaatatcgatgtgagttttcagatgttcctgaatgagaagggaagtaggtgtttgtggagctagcgaactccagtactcttgcctggcaaattccatggatggaggagcctggtgggttgcagtccatggggtcgctaggagtcggacacgactgagtgacttcactttcacttttcactttcctgcactggagaaggaaatggcaaccc

SEQ ID NO: 19584 - DNA, 600 bp, Bovine  MMBT19249
ggtttggtcatggaaacttaaaaccattagggtatgaatttgggtccctgaagcagagcagaaggacagaatccttggagccgatttcctgatttactctgtcatttctaaaggggtcaggtctatctcctggatggaagtcggtccatgtgcagatgtgtgtgtttgagcatgggagatcatgttatttgtttcagaactgtagcaactgtgggctgctagaataatctgtattccagctcttccatgggattaggtaataaggtgctgccaggatcccctcacattcagtaaaagcamtttaaaaagtaagggccttgtttcagcatttgatttttgctcagactctttctccatgaggaacatgactagagaagaatcttttaatatttagaaaatcacatgcatatttatatacaaaattacatcctgttaggataaacctagaaatccagcctgaactactcctcaaagatttagctttggctctagatattgctaagaatgctgtttctaacttctgaagtccctacctcaaatcacaaatggtggattttgagaaaacatttaaatcatttatttcaggtaacaataagctgt

SEQ ID NO: 19585 - DNA, 600 bp, Bovine  MMBT08480
tccaagtggtatttctcaagctggagagcatgttcatttaatccacaaacactttttaaaggcctactatgtgccaggcgctcctctaggcactaaatcagggaccagaactgagcagaccctgccctcggggtgggggtggggggaccctcccagcagctcagatcaggaggtggcttcacgggcatcaggtgcgtgtccctagaagctgscttgcacgtccgtgcctgcacacgcgcatgtgcatacactcacggcctcctcccaccgcctgggcccaccagtcrtctgccagcccayaggccatcacctggaaaacctgcccgtccacctcggcataggccttcacagcgtgctccgggaacatgaaggtgacgaaggcaaagcccttgggcttcttggtcaggctgtcgatggggtaatgcagctccgacacgggacctgcgggcaggaagggcgtcagtgtcccatgggccagggccaggtgtgagctccgggcaggaaaatgctgggcactagtcaggggaggggttttaaccagtgagagcgtggagctgaggtggctgctgaactaaacaggaggactatttaaacagcaga

SEQ ID NO: 19586 - DNA, 600 bp, Bovine  MMBT08809
agggggtcttcccgatccagggattgaacccgggtctcctgcattgtaagtggattcattgctgtctgagccaccagggaagcccgtgactcttaggcaatttataagactgagtccagtagattgttaacatgtcaaagaaggactttcaaagtatctgtggagaagtgccaagtattgctctcattgtttaaaatttccagcccatggaggactaatatttgtataaaatacaatatcatgtcactgctgtgtcctattgctataaaagttcctagatattttcattgtggttctgtyataaactgtccacaaactggttttaawctcctttcaatagcatgaacttaaaattctaatttgggatttcttagctctcactttctagaagtttctgatatctttgaattcaagttgcagacagtttcctccaggaattgattattttcattctttgcaataactgatacaaaatgtctaatataattcaagagcaccaggaggttttattatcagtgctccaaaaatagccccaccaaataaattctctccgttgtattagctgtatgtattgtgtatcataaaacaagatagtttatg

SEQ ID NO: 19587 - DNA, 600 bp, Bovine  MMBT01771
aaattaaggttgctaatcagctgatcttaaaagaagattatgatgatgtgatttgagtgggcccaatgaattcacatgactccttaaatgtggatgagggaggcagaaagttaggtgaatgcactcacctaactgtaggccaccggaaacctcctgttaaaratagaataatagtgctagtcccctaaattagtttgtttgttgactcaggggtttcatttactctcattaactagtttggtttcagaggtctggaaatcaattacacttgtgtgtaaaacttataacatagagcagaaytgagcattgattcctcctactaagtatgattagccctttacatgaaggcaagatgctttcaaagttgatttggttaaatcctaaaacaattgcacctcaagaccartaccaaaagaatgttccaatgctcwcttatgcattcctctcatgtgccgcagatatatcttgctgtatttttgcttttcttcacaataagcatttccagttgtcttgcctaagggttttcacgggtagatactcttttctctgaaaatctgaactgttgttagtgattagaattccaaagcaaacatgccaaga

SEQ ID NO: 19588 - DNA, 600 bp, Bovine  MMBT21845
aagagctagttaaaactggcatgtaccaaaataagaggattggtatattagcaatgaatattttagtgtctacagttgttctacttttcactgcaatacagtgtttcttatccttcacttgtgtaatagaataaatgacatatttctgaggactgatttatttgtcttggtttgtgtgaattgattcatttcagagcattcaccagaatagttggtatcaaaataatgctgtatacaaaacatataaatgcattattgaatgaagaatgaactgaaagaccataagttctcaaagatgakgctcasagcaagaggattaaattgcataaaaatcaagtcactactctgaaatacttagtgtaataaaagcttgagagaaaaatgtaagatgaactcaatttctcagccattgctatgagtctggatgtgcatcctgctgttatgtgaacaattaccatgcctggagggaactgaatgaatgttggcacctattggcagatgaaataaaaacctaagcttattctcctatcatgaggctcacatgccatatgctaaaaactaatacattaagctggcataatgaggaagataacacattgt

SEQ ID NO: 19589 - DNA, 600 bp, Bovine  MMBT09838
gtaccatacatactgcgagatcatgttaaagtcaatccacaacctatactatagtgaatattttaagaagttggagaggtaaacatggagagtaccatggagaggttaacatctaaatcagcagttaaaaataggtatgaaaaatacaaatcaagatttcaaacaaaaaataagtacccttactgaactatgaaactttcattattctaaaattacaatatctccatctggtaatctgacatgaacaagctgataaatgcaatcagaacaacagtatattctcgcaaaaccagaaatttyctgaaagcctggaaaaatatgtccacaacagatggatcatttagaaaataaatacatcaatctgtcaaaaggascactagtctaatttcctaaatgaaaatcagtgggagctctactttccaagagtctgtgacattagaaaggccaaagaggaaaaacccagagatgcacataaacagatttgctatgagctagagtgcatactgtcaggtttcctgtcaaacatactcaatgtaggtaaagtccttaccagttaacttcttcacaggttggagccgaacactgatagactgatgtgtg

SEQ ID NO: 19590 - DNA, 520 bp, Bovine  MMBT04412
  misc_feature (1)..(1): n is any nucleotide
ntggtttcatgatgtctcamacaggctccataaccttcatgatatacaaccttggaatttgtgtgcacctcgtcttttctctgaggcagagattcaacatatttgaactgctgaggtggagaaagtgacttattaatgtttcttagcctacgactgygtctgttggcaaatsttaggggcagaaatgtgacttgcgtgccctaggtaaaatggtgttcatgagccctcctttgtgactgagcaagtgtgtaagagaagttttatttcctgcagagaagcaggtgaatcagtcagcacatcmacatcactggtgtctctgccctgggtggcatgccwtggggttaggaagaaattctgtcacaatcaggcgaaatatccaaaacaagcctgctctgtgatttcccatgaatgctcttgttttctgagtcctagctttccccctgtgagccctacttatgacagagggaagattcaccaatgggcaatgcttgtttcctctttaatttcccttttgtcaggg

SEQ ID NO: 19591 - DNA, 600 bp, Bovine  MMBT02648
cttgacaaggagtagataagaacagactgcattagtttatcaaagatgcatgaataaactggtgctcctaagtgtttgcagggactcgaaactatctgtatatgaaacttaccattgatatccttacagtcacagaattcactcatttagttcaatcagcgaatcaatcaatcaatcactccattagtcattgtcccagagagggtttgaggtcttttccatctttcttcctcttacactgacctcagatgcatcacccaactgcacagacggtggggatgtggaggatgcagatctttyctcgtatctgagcctcaattaattcatctgtaaattggggtgggtgacattgttctggcttctgcctgttgttagatacaaatgacataaagaccagaaaaggytttgaagactgtctgtgctttacagactgtagagcgtcctggcaatgtgaggactcttcatcacactgattaagtagatagagattaatagccaagcatgaaggctgagaattggattaactgctctgggctagattctattatcataatgataatcatttgttcacccagtgaatatttaccgagtgcttttccc

SEQ ID NO: 19592 - DNA, 600 bp, Bovine  MMBT09828
atggactgtgtttggaagtcagggcaggtaagctgagagcaggaccgggaggaatatcagaagccaaatcaggaagacaacaaaacagccgtgacagagggtcaaggccagaggagtctgtaatattttaagggacaaagtgacaggatacaggagaaaaagatcaggagttagtgttatagtggagaatggaagcagagatacaggctccaacacagaggagctgtgtgtgtactggctctgggcaagccaattatctttctgggcctctgactcctcatccataaaagtggaaaaccmatacagtctcacaggggtgttgcagggtgtgtgttagataaatggcatatggtgagctctctgcacataaggggtatgcgtgtgtatatgtgaataacaagtctgcaccatgggaagcatcatcatagatggtgactatcacgacgatcctgagaggcatgacaggcaccactccagcatatggaagaggagctgaaagctcagagagattcagggcggctcagggtctccgagtgacagatctggaacacaggctgctggtccttagctagctcattctatcagctgcatctgccctgg

SEQ ID NO: 19593 - DNA, 600 bp, Bovine  MMBT10546
tagaggggtgggatgggatgggaggtgggagggaggctcacgagggaggggacatatgtatgtatacctatgactgatctgtgatctatggcagaagccagcacaatgttataatgatccttcaattaaaaataaattaacgaaaagaaaaaaaacaggagtgagttagtgaacgctgactcccaccccagctggggttggtgcccggccctcctgctgcagaagcccatgatctttcctagccagtccccggagggggagcaccgtttatttttrtattgtgtgtattttgtctggtcwactgattccttgtttcactgagaaacttatattcgtgtgtgtgctstgctgagtcgctcagtggtgtccgactctttgtgaccccgtggactgtagccygccaggctcctctgtccatggaattctccaggcragaatactggagtgggttgccatgccctccgccaggggatcttccctgcccagggatcaaacccaggtctcctgcattgcagacagattctttaccgtctgagcccccagagaagcccccacttacatcagtagtcagctctagtttatgtgctggataatttttta

SEQ ID NO: 19594 - DNA, 600 bp, Bovine  MMBT18970
aaaaggatacaaagcataatcagcaaagggaaaggaacatgagacaaggtccagaggaaaccagacgcaagcttccaagagtcctctctcactgaagtcacacaggacatcttaattctcccgatgggaaatcaggacaacccgtgtgtaatgttatctaytagggaagcttattagatactcagttcctgaagtatctggtcacrtgtgcagcatctggcagatatgaaccaaaattccagactctcagaaggcaggcaggtattcagcataaactccactgtttgtacactttaggyrtactgagtcatttttggacagttctggaaatggtgggaactcttttgaaatctaagcttagagttactaacccagagccaaacgcttaagcatatctttttaaggacagcagtctcaagcttgctagtgttaactctgttctgaacatttactcaggttgttgcatctgtaagtagtccattcattttcattgctgaatagcatttcatctgcagacgtaatatgtggctggtggtgggaagtaaagtccaatgctgtaaagaacaatactgcataggaccctggaatgttaggyccatg

SEQ ID NO: 19595 - DNA, 600 bp, Bovine  MMBT20142
catgaatctycttaaacatctgtttttgtttttttccccaaggtgtaaaaagatggttccagcttcaaagagattcactatacatagatcttctaatgttcttactctttctctgaaacgttttgcaaattttactggtggaaaaattgctaaggtgggtagataatattattaacaactgtttatgctgagcctttcaaggcttaactgyccagcagctacatggaagttktattacctgattttctaagttcttccagcacttgttagtggaataaaatgtcaaagaactgagctcaragtttgctgtgtgtgtttacagagtgtgtgtgttttcgtctgtatcccttagctgactagactttctgaaggtcacacctggtgcttattatccgcgtttgggcgtcatagttggtgaaggtgctgagtgggttcagggaacgcttatggcatttcaagtccaaagatttcccagccagaccttgccattctttgaccagagtttgcttgtttattcgtttgttttctgattggtagtatactgacctttcccattttcttcccactttctgaaactgaaagtggtcagaaatccagtaa

SEQ ID NO: 19596 - DNA, 600 bp, Bovine  MMBT08796
tcctgaccaaccagcaatcacatccgtactccctgaattggaaagtcttaaccactggaccaccagggagtcaccctaaaagaggagaattttaaaagcccaaattgagtgtttatctggtcttttaggtggaaggtttgcttcattactgcaatgttgtacaggcaagaagttaaaaaggtaattccaaagctaaattactcttgcagaaccaacacgacatgccagcagagcccagaaaagatgtkcacctgcccaagtgctaaatttagaaagaactaatcacaccgaacggcgtamgaatttcagagagggaatcttcttcattaatatttcataaaattatgagtgaacacgaaaacaaagagggaagagtgttcaattttaccccctgaagagataagaatgtttccatgttctatttcttcctttattgaccaaaaatgtattcgtatgtaagtttcacattgcagatagcaatgttatcatgattttttttaaagtcctaattaacatccttaataatgcatttccttgccagggttatatatgactgtgtagtgagcattttagcatcattcctatttttccctttggcca

SEQ ID NO: 19597 - DNA, 600 bp, Bovine  MMBT05337
atgaacagataaaaaccctcctgtcttcccaatatattccttccactcttcttatgatcaaaggcatcatttatctcctcttgcaattagaacatcggtgatggcacctccacacttaaaaaggacaggatcctgaacacaactgcctactgtctcccttgattgactaatctgagctcaaattctgaaggctgctggggtccagtgcattaaccaggcccaaattctcttttttccttccctcctcatcaagccctgcctatactcctaggaaagagggatatcatttttcgtaacagyaaaccttgcaaaacaagatatgggctgaagaaatgagatgtatgaggcccctcttttggatctctcattattcgggaaaatgcacactttgctggatggcttaattttctctgtttgagctcaattcatccaggaaggagcagcacacctcattaacttactttccacacagagcagtctccgaaacgaactgcccacttcagcacttgagtctgcgtgcaccctgcctatcaactgtattggggcaattttcatgaatcaagactcagcctgttccatgcacagcaagggttcttacct

SEQ ID NO: 19598 - DNA, 600 bp, Bovine  MMBT04002
actctgattctttgttgtttcatgggctttctctagttgtggtgctcaggattctcaytgtgatagcttcccttgtttcaaatcacaggctctggagtaygggctcaggagttgtggttaatgggctcagttgccttgcagcacgtgggatctttccagaccagggattaaatccgtgtccccagcattgccaggtggaatcctaaccacaggaccaccagggaagtactggaatgaatattttttaagtaactkcatgatacttttcatccaaaaaagattaattttcaacttctgatrtaaattttaaaaattcaccacatttatagagttttatagttcctctttcatttcctctgtccctagaatccatgactaattaattgaaagttaaagagcatgagaattttcatctctcatgcagtttcacagcatygaaaagagttgcagtttgtgagcactgatggccaagaactgttcctatctcctgcaaaaagcagggttgccatttctaatgtttcctaatcttattttcaggcttgtcttacgaagtacacacagatattaaaatgactgcactgggagaggtgagaggtgaaa

SEQ ID NO: 19599 - DNA, 600 bp, Bovine  MMBT12469
tgcagcacgtgggatctttccagaccagggattaaatccgtgtccccagcattgccaggtggaatcctaaccacaggaccaccagggaagtactggaatgaatattttttaagtaactkcatgatacttttcatccaaaaaagattaattttcaacttctgatrtaaattttaaaaattcaccacatttatagagttttatagttcctctttcatttcctctgtccctagaatccatgactaattaattgaaagttaaagagcatgagaattttcatctctcatgcagtttcacagcatygaaaagagttgcagtttgtgagcactgatggccaagaactgttcctatctcctgcaaaaagcagggttgccatttctaatgtttcctaatcttattttcaggcttgtcttacgaagtacacacagatattaaaatgactgcactgggagaggtgagaggtgaaaaatcctacatattctatgtgcatcctgcctgaggattaagggagagaatttgcttaggaaatcaaatcaaattattggctgtagaacaagctttggctctatcatggcattgcactggagatcaaatgtttacttt

SEQ ID NO: 19600 - DNA, 600 bp, Bovine  MMBT06302
ggttgggaggcatatttctaagaaggctttctagaataggtgatgggtaagttgggtccaaataaatataatctgttacaaagggcaggaaattttgtgcagaaatcgtagcctgagaaaagtcttgggatcaaaatacaatatcgtgtttagggaacaagaaacaatttagtattttcagaagacattatataaagaagagtgatgggaactgaagttgtagatacatttagggttccatcctcgagagtcttggaaacaacgtaagggaaatttgagtgtagcctgtgggttatagakagatcttttagatctctagtaggaaaggtgatagatttgatagatttgcagttgtaataaattccctggttctagaaaagtaagctgccctgttgtaaggacagttgggaagcctcaggagaggcccacatggtgaggcactaaggctttctgccagtagccctgtgagatcatcatctatgaagtggatcttccagtcctggttaagttttcaaatgactctgaatgtgactgtggggagaccatgagccgacaccatgcacttaacctgcagaaactgtgacataagtgcttgctgtt

SEQ ID NO: 19601 - DNA, 600 bp, Bovine  MMBT12738
gaactcattaccagttgaagaagtctctaatgtgactacagctaatgtgttcttgggactaatttagaaaacttcagggaatctgctgctgctgctaagttgcttcagttgtgtctgactctgtgcgaccccatagtacacaccttcaaatataaaatatttgagtgtgtatgagatgaactgatgtatcagtatttgaatacatgtgaaatagcaccctatttctcagtattccatatttcaagctattccagtgctcctcccaatcatatagcttcacctcttgtattgagatgatakggtagaatgtaaaatagcaagaatcttgatggaagttaaaatsttagcttttagggaagggatataaagaacacttgttatataatagagttagatgtgcaattgaaggggyttccctgatggctcagatggtaaagaatttgcctgcattgctcgagacctgggttcaatccctgggttgggaagggcatggctatccacttcagtattcytgcttggagaatccccatggacagaggaccctggcaggttacagtccatgggggtcacaaagagtttgacacttaagtgtgagtgata

SEQ ID NO: 19602 - DNA, 600 bp, Bovine  MMBT11056
tgctacataaccccacttttatagttggttaagtctattaatttcacgaaacataaatatcttagctattctgatattgagcacttagatgacggtatatttttaataatataaataaggctgaatattttgccattttcttttttaatgataatagttaacttccataaattacacattttgaacagttgttgagtattagaaagaaattagataaatattctgagcagaatctctgaaatagttttttcagaggacttattggagacatatcttttgtggatatatatggattgtttkagctgaaaagataaggccacccacagcacagatttgttttcacactccatctgtttggtatatactgtgtagattaggaaaaagttctgaccccagtgagacagaatgtttagtaatatttctctcatattcttcaatttctctgtgagtcactttctccagatgcctaacaagattgtgagctttgcaaaaatcttccaaaaatggaatctgcttctcaaaaaatgaatacagtttaatgaacacattgcattcattacaaaaagtactacttaaataccaaaatatatatgttacaac

SEQ ID NO: 19603 - DNA, 600 bp, Bovine  MMBT02264
ctctgataactcctaagaggccaactgaagctccttattcccagagttccaggctctctygatagttctcatttcctayaagtccctggtagctaaaagamttcactcagtagatttaacacatgttaagaarttacgaaaacaacataaggtttatttttctgaaaatgaactttctttttattcacaacaggaaaaaactcctcaatctaatagaaatcttagccctaagttattactttctagtagtctctgaaagtgtatgtttggcatatggtatattttactttagttttatgyktaaaggtattcgaataaagaatgtatttttttaaatcttaaaaagaaataagtaaaatacatttctaagaacttcataattattcactgttcatttaaaatctagccttttgagatgtgcttatgtattatgcatgtctttttacagaatctaactacagaaattccatctctcaatgccttattcaattcatttttggtacctttatttttccaaaaaaaaaaaaaaaatgtccctaatcatatttccattcttctctcattataggggttgtctctctctgtctaaaaggcattgct

SEQ ID NO: 19604 - DNA, 598 bp, Bovine  MMBT02198
  misc_feature (1)..(3): n is any nucleotide
nnncacttttaaaatgagagacctaaaacaatgcattctgctttcatttatttgtctattattagaacacttgcagggagcaatcaatacagtgaaattgtaaacgaagcagtctgcatgactctcgtacattcattttcatgggaaaaattaagtgctacgaatataatacaattccagtagggatttgaagcagtgtttggaaatgaaaygacatccattggtctttaaatgyaactttgcatctccttcaggaataatttgcttttaaatgatcaataaagatttggcgagcttttygagtaacttaactgtatgtacaggttcaaacattgtttaatatatagagagagactctcatgtgaatcacagtggtcagtaggataattttagggtctgttctcttgctctctatctctttctcacttactcactctgtctcttgtccagagctgttaatccagatatgatactggatttaggctccctgggaactcctggtaaatgcataaatatattgagagattgcgtctttttattaaattttagcaactctgcttccttcagaaatcttcaaaggttatgtatctgagtggag

SEQ ID NO: 19605 - DNA, 600 bp, Bovine  MMBT05287
tggctcaatcataaaggtctcttccagtaactcaccttctaataaaagcagatgggtgggtcagtattttttcctttgtatttgatttttctcttctgggtgattcactgttagatataactgctatcgtgtgaacacaagaaagctgcatttccacagccaaaggaaaggatgcctttccttagcagtgataaagcagcattcaaaggattgatgtgtgacagtcatgtgatgcctttggcaaaactgataaatctcacggaacggaacactgagagtgaggtcaagtgttgctatcarttagtgcttaatacaggttcatgtctttgtatcagcaacagatggttttcaatttaattgtcccacatcttctataattctaaagatgaagctttcataagaaaggaggttataaacaacctgaaaaattaaggcccccattttttttatgaataactcattgtcatcattctatcccaccatttttatagtgatccttaggaagttacaggtacattttaaattatgaaaaaggatgaaaattatatatgaaaactgtagaaagctattaggcctctgtcataattaattttttaataa

SEQ ID NO: 19606 - DNA, 600 bp, Bovine  MMBT18738
gcaaatccggtttttgctcccttgaccagggaagtaccaagaagataacatctggaaggagaccctgaattcatgtaaggaatctcttgtatggaatcacggggcttccgtcagctccacttctgtgctgctctgygttcactgcctctgagcaagacactgccctactcacaccacactgcccacaccttagccgcaggcgccagctgccaacccatctggggttcctgctgccgaatgccagagggtcagaggcagggagggacctgcatcttctgcattcccttccattttaagtcrgggcgagcctccatctgttgggttcttgggtgtggagctagtcttaaacattaatcattttacgagagtggtgaagagggcttccctggtggctcagatggtaaagaatctgcctgcaatgcaggagatgcaggtttgacccctgggtcaggaagatcccctggaggagggcatggcaacccactccagcattcttgcctggagaatcccatggacagaggagcctgacaggctacagtccctaaggtcacaaagagtcagacatgactgagtgactaacacacttggtaaggcagacat

SEQ ID NO: 19607 - DNA, 600 bp, Bovine  MMBT17119
aaattaaatccaggcatttgaaaagtctgtggtctgagacatattttaagtctatggttttaaaccgcaaatcagacctcacacagtaagtgcagtctggctccctgtgcacagtggcattggttgtcaacggttgcaaagagcaccaatgtcagcttcatgttaatgacctgaagacccagtctggtccggccccgcccccccccccgccctgaggaatgctgtcagtccccaggcaggcactgtcatggtgctccccctaattctggcctctgagtctcctgacaggttagtggggcycttgaccctttactgctctgtgacacctggccgactttgctacctgacctcctgcactctggactcagagttcctgggtccacgaggcctggtttcatcaacctgctgtggctgaacgtctttgaacttggtctttggacaatttgacttagagctctgccagtccaacttcaggctcatcccttaacccagaccagcccattcaagattctccagaggacacagagaagacccctctgaagtaagacagcaccccatcccctcaaagagctatttgtagagacaaggatggacctagag

SEQ ID NO: 19608 - DNA, 600 bp, Bovine  MMBT22492
ttccctgaccatgcttactctttggctgaaagcagtgatggggtgcatggtcttggtgtccactcagaactcagcagctgcatctatcagctgctgattatgctcttggtagcaggagatctgagaggcacattttatggcttttgcccctttcccttctacccttcctttcttcctccctttctcctttccttccttctctttctcccttccttctctcttttttttctgttttttttttttttttttaagtgttgtttaagttccagccttagtgccaggtattggtgatatacaatkaatatggcaaatatgatatctgctcttatggaacttcattgttcattcttctgtaggactttggggtagagttctgttgaaataactgaaaacattcttgatttcaaggaggaagagagacttacctagctccatgccttccctccctactttattatcccacagagcctggtcagttgcctcatacatcattaagatgaccatatttactaagttcaaaaccagcccattcttattcatgacttttttttttttttggcagaaaaagtcgtaaacaagtatgaaagttaaattgtagtt

SEQ ID NO: 19609 - DNA, 600 bp, Bovine  MMBT20497
ttttaatgaccctatgttgattgctgttataaagcaaagaatattatgccaataataattagtatttctgttttgtgggttttaatgctcttgtataatgtttttctttgaggtaagtattatatgaggaatttttatattttcaataagaaaaagcccagcctggaacagcctgagtgaacaaaggagctgtatcaacccctaaattgtgttttagaggagcacratttcagatgctctcaaattcgccaccgaggaggatctgtctcctgtcccagtctcccctgccacacacagackaatcttgttctttgtgactctggtagctccaggcttcccttggagttggaaatgctcttgatgttttgtgtattgctttcccactgcgtctttctgggattaggtagtctctccatgactatttcctgcagaaaagaaagaagattctctttttccagaaggtcctggccatttctccttctgtctccttagctctgggtgcagcagtagtggctgtggtccagggcatgcagctgaggtgatgcacgtggcttctcagcaggaagcggggcacagcgggtgctttccactgctgggggg

SEQ ID NO: 19610 - DNA, 600 bp, Bovine  MMBT16934
tgaggaggttcttacttctatacctgaacctagactgaccataatataacttcctactatggaaatatctcttacagtaagacatatgccataacccagaaattctacttctcagtatgtatataagatacatatatatatgcatatatatactcagtacttatataagatacacgtatataagatatacaaaagcaaatgtttatttcatttatcttaataataataaaatcctgaaaagaagtcaaatgttttctatatggtgagtggttaaatgactcttgatatttttattttatkaaatattatgcgacagttaaaaagaacaagccatacctatgtctggggccttccaggtgtttcaggggtaaagaatctacctgccaatgcaggagatgtgggttcgatccctgatctgagaagatcccctagagaaggaaatggtaatakactctagtattcttgcctgaaaaccctatggacagaggagcttggcaggctacagtcagtggggtcttaaagagtcagataagacttagagactgaatgacaacrtattgatatctatgtttggttatagcaacagaattctaagacgtt

SEQ ID NO: 19611 - DNA, 574 bp, Bovine  MMBT06042
  misc_feature (1)..(1): n is any nucleotide
ngcaagagtatggcatgctttgagaacaatactggatgttagttcagtggggctggaccatcaggtgcagatagtagctgagcctgcagagctggaaatttggcttttgcactgaaggtaaggagagccattacagtgttgggaggggagggatgtgctcagacatgaatgttagaaaacgtattgagatagcagcgtgaactgccatggggggagttgctggaaatataacctaggacgaagaatggcccactccagacactcttgcctttccatgttccctgcaagtaaaagcccatcygggaaccaagctaacagttgaacaggattttcaattattctggagcaatgctataatctacttcctatgagaagaatgctgtttgccatggctgaaaatgctcaattggtagttctctgggagaaagtactcaatttgcaaaaatttaaatacccacagagtaaaaacaaaagcagctaataagaaatatgtcactgaaattgaacagaagctagaaaagtccaatttcttgttttactttatcttttcaaaagctggttccacagccattta

SEQ ID NO: 19612 - DNA, 600 bp, Bovine  MMBT19535
atgaggcaggcgtaattgacttctgcttgaaacagtcagtctgcccttggcaaaacagccaaatgtaccttgaaaatggcaattatttattaccattggattttctgagatttgtgaaaaactcaaagtstgccagactctataaaaatattagtctcaactaatagaccttttaaaatttcttttaactttcragaataaaatatgaggaattaagaccatcatgtttagtcaaaaaaaaaaaaaaaagaccatcatgtttaggaggaccacatgctcaaaagatgaccttgatgtatrttacarttttcmacatgctatataattcaacaaagttttgtgaaaactgatgctacaattagaaaataatggccaaaatatttgtgtacatgcatactgtgagaataaaacaaaatgctacactctccaacaacaagggttctgttgagtgtttttagtgtttgagtagaaatgagttcccaagggtgaaaaatccaagagtcacgtgtggatgcgagagttggactgtcaagaaagctgagcactgaaaaactgatgcttttgaactgtggtgttggagaagactcttgagagtccctt

SEQ ID NO: 19613 - DNA, 600 bp, Bovine  MMBT19536
taattgacttctgcttgaaacagtcagtctgcccttggcaaaacagccaaatgtaccttgaaaatggcaattatttattaccattggattttctgagatttgtgaaaaactcaaagtstgccagactctataaaaatattagtctcaactaatagaccttttaaaatttcttttaactttcragaataaaatatgaggaattaagaccatcatgtttagtcaaaaaaaaaaaaaaaagaccatcatgtttaggaggaccacatgctcaaaagatgaccttgatgtatrttacarttttcmacatgctatataattcaacaaagttttgtgaaaactgatgctacaattagaaaataatggccaaaatatttgtgtacatgcatactgtgagaataaaacaaaatgctacactctccaacaacaagggttctgttgagtgtttttagtgtttgagtagaaatgagttcccaagggtgaaaaatccaagagtcacgtgtggatgcgagagttggactgtcaagaaagctgagcactgaaaaactgatgcttttgaactgtggtgttggagaagactcttgagagtcccttggactgcaagga

SEQ ID NO: 19614 - DNA, 600 bp, Bovine  MMBT02952
agcactaggagaaaamcctaaaatttatgtaggttgaaatgartgaaatattatgatacaaattaagtggacagtgcaataaaagaaaatgatcctattgcattctatgagcccagtccatgtttgatgtgtaaaatgaatatatatgctttccctttttaatayagttttattgaggtaaaatttatgtaaaataacctgcatgtatttaaagtatacaatcagaagctttaatttatgtatatacatataacatatgttaagcaatcaccacagttaagataatgaacatatccatcwctcccccaaatttcctgatgtctctttataataaaatctgaccctctctatacccaaccttgtccccagaaactcacaaatctgctttctgtcactatggattagttggcgttttctagagttttatcrgagaaggcaatggcaccccactccagtaytcttgcctggaaaatcccatggatggaggagcctggtaggctgcagtttatggggtcacgaagaatcggacacgacttcactttcactttcatttttcactttcatgcattggagaaggaaatggcaacccactccagtgtt

SEQ ID NO: 19615 - DNA, 600 bp, Bovine  MMBT10792
tttaactaaaggtatagaaaaggttcaaatccatgcagaggaaaagtaaatgcatattttgagtttatccaaatgctaaggcctctttctgattctcacaagtgaccatcagacttgaactgttcaaaaatttccaaaggagcccatctcctcaccaaaatatttctatgttaaaaccttcaagaaggcaactggcccagtttttatgatcccaaattaccttggtttcaatgtaatctttgtaaactgggattcccttaggaagatttcaatcttaaaaataaagggatattaagaaayaaaaccctatcccctgctccattttcagagcccatatgccaaaattgtagcttattcatcccaagacattaaaaaaatatattattttgtgacattaacttagaaatttgtacttttgtgtggaatattctaatgtaaaactagtacattatgataaatgtccctttcttggaacctcctctgagtgaatcatcctaggaagcttttctttcattttaatttgtctattatgtcagtgtatagaaccaccttaacaagatggagttaagagaaaaaaatttaagacttagttgtagcccc

SEQ ID NO: 19616 - DNA, 600 bp, Bovine  MMBT07259
ggggataagtaactgagtagacatcccttttatccaagctgcttctgctgctgctgctaagtcgcttcagtcatgtccgactctgtgygacyccatagacggcagcccaccaggctcctccgtccctgggagtttccaggcaagagtactggagtggttcgccaatgccttctccgagcctttggacctcttcaattttagagtttaaaagctttctaattgttgccttttacttactcaatactgactttttattatctttttgatgaaggaaaatgcaaagaatactgtagcctgaartttttgatgaccctctcttgacagatccagatgtggcctgccataccttgacaaaccacatttttctcaattttgtttcatacagatgtaggcttgatgcttctcagagccatcaagcatctgaaagataaaagctgttgaacatcccagagggccatgtttcataaaactgactgtgtgtcaatagagacaaacccagccatgtttagttcagagtcaggtaatattcatttcaggctttctctgtcaataatgttgtgatattctgtgtaagaaaaatgttaactttttgttcttttt

SEQ ID NO: 19617 - DNA, 600 bp, Bovine  MMBT02311
agtctcttgcttggatgcagctagtataatgtacatagtaaatccacwgggagaytgttgatttatcccagaatgaccaaactagccaagagatccaaggttgtttccatggtttagtaatgaaccaaacccctctccactgagaggtagtgatgggacatgctctgtggttcaaattcagaccagctcaattttaggctttggttttacactggctactaaaaggaaggacttccctggcagttcagtggtaagaatcttcttgttaatgcaggagaggcaggtacaatccccggctcwggaagatcccctagagaaggaaatgacaacctacttcactattcaccatgagaaaaccccatggacagaggaaactggtgggctacagtccatgtggtcacaaaagagtctacaacttaggctaagactaagacttaggctaagttgtgtctacaacttagcaactaaatcacagtaataactagaaggaaagtgattattactacatggaggagaaggtttgtaatgaattgctaggtgaaaacagacacctcattaggatttaaacagttgatttggttatcttggagttttggtatc

SEQ ID NO: 19618 - DNA, 598 bp, Bovine  MMBT13340
  misc_feature (1)..(30): n is any nucleotide
nnnnnnnnnnnnnnnnnnnnnnnnnnnnnnaatgaatgaaaaacacctgttgctagaggaaataaacaacaacaaatccttgctgaactttttagacaaactagagaaaatcagaaagactctttattcagtgatatgggatgagtgtatcaaatgggagatctgttgtcagaatttaggcactaagaattactgctgaactaatgttatttattaggacttgtgtcctgatcctttacctgacttatcagartgttgtgagaatccaccaagataaaagaatataaactatatacaccycgaaacactagtcaaaaaatatcagctgtcatttgggaaacatggaaatcagatgacttcaaataagaatctgaaygyctgattttttttagaaagtctagggtatcaggagaacatgttttgtttgtttgtttttcctgcatggaaaaactatactagagttgaacagctggtttggcacttcagtytacatttgcaaattacattatttactttacatcacatattttacattatgccatactaccaaccacaagctagctttagccttttgcccctggacctttatatatttgtt

SEQ ID NO: 19619 - DNA, 598 bp, Bovine  MMBT00595
  misc_feature (1)..(16): n is any nucleotide
nnnnnnnnnnnnnnnnctcttcctaatctcactgggtttgcagccatgatgggaaagggggccctacacccagctccaggaaccgcttcatttctccctaatcctcccaatagcagagacagcccagggtggggcaggatggaccagcatctcagggttctttctcccacctgtgtacatcagctcagctacccagggacaagcaggcccagagacaaatgggaaacacagagagatacatgggagacattgtcatacacacagctgcccagggcacatagacacacacacagatgaaaygcactgaggaccaagaacagacgtgaacaccaatagagacagacacacagtctcagatgtccaggacacagaaacacatgtccacaccaagccaggagcccagggacatttgtgcagacacccatggactcatacaagccactctgggatgctcagacaccaggaataaggggatattcccacacctgcacaaatgcagctcctacccaagggtgcgtgctcagtcactcagtcgtgtccgactttgcgacccccatgcactgtagcccaccaggctcctctgtccatggaattttcc

SEQ ID NO: 19620 - DNA, 600 bp, Bovine  MMBT07782
agttttggtggtgacgtctgtctgggaggggtttggacttagtccaccgctgttgccgttagttaggtcttaattatttttcccccagagagtagttttcagtttctttttagtaatggaaaaacattttttttttcaaaacagtatttatacccatctccaaatgatataaaacataggatggctttttaaagcaaatgtgtattttcagtaagcatagtgagctgcacagtggargtgagagaaagcatttttgggcttgaatggagctgacccgagagaaccttctcctctgtgggygctgggccgttcccgaatcctgcacggtctggcagtgactgcggtggtggagtgcctgtgagtgggctctctgggaatgggaaagactgtaaaaccctggagtgcgtccccagaagactgaccttacragagaagttctgggaaacaaaccgcagggagactttacaggaatttttkgttgagcccacaagcaaggcacatgaggaaaagagatgtaattatagtttgtaagtctatgaaaagatgcaatgagtgacatgaaatagccattctaagtttcttcttcctgttggacaggga

SEQ ID NO: 19621 - DNA, 600 bp, Bovine  MMBT13151
tcttggagaagatcactcatgctgctatagctgacttaactggtcctcttcatcaccacatcatggcccaagaaggattcaccttgaactctaactgagagggagcttaagttcccatgataggaatgatactacgattggaaagaaaatattcaggagtcatatctgacccaaacaaaagtcatgcaagacacaggggcttccctgaggccttgacaaacaaaagttgtgatgaaggatcacatagtcatttgttctttcaacaagccaagaaggaatttgtcctggaaacacatcttrcttcatctacataaacatcaccagtcaagtagaacagtctgtgactaagataaaagaaaaagcatctgactgtctagaacagccctagctggactttaagacattttcttaagacctgggcttggtaatcaaagcttctggctttaggatctcctgcaagaactaacaacccattctgcttctggtcctcccctgtgttatgattggccaatgcctcttttacagagactttataggaacccactaattcccctcccttggacaataatattatacccagaaagawagatcaggagggga

SEQ ID NO: 19622 - DNA, 600 bp, Bovine  MMBT11385
acgaacttccccagcctttggtggctcaacctgcacttcctcaagtgaaagagaagagtttgttttccaggcaatggctgccaggcatgtgattgtctgttgatacaaggacaataagatgacatcatttagcgataacatttaacttctgatcatacaaatgacacttacttgctataatttgtaacaataagaaaatcacacacaaaaagaaaagagatcattgcaatttcagacataagctggtaaaattttagcatatttcttttgagtctcttaaaatatttttatacagtagaratcatgtcatataagcagttttgcattttagggttttttgtttgttttgttttagccagtgaaagccaccatatattgaacatttactgtttgcttsttctaaaatgttttctcgtgatttcaaaatgctttataattttaaatagctgttttatatttcatcatttgaatatatccaaatattcttaatcagcaactaaatcatttccattgttttgactattataatatatattgtttataattttgacttgcctggttcccttaagcaagaattactaggggaaggatagagacatg

SEQ ID NO: 19623 - DNA, 600 bp, Bovine  MMBT09401
ggaagaagcgtgagcgtgaggggggtgcctgctggtagacagggggatggaagccctctacctccctttcttggatggtcctgtttccttcttcccaatygctcgtcacccgggagagttcagggtatccagcttgaggtgacgaaaaaggctgttgaatgttatcatcatcagctgagcacagaggggcgctttcctgcctctctgcccggccctgggtggggctggaggagcagggacgagccagtgctccctctggggcctctgctttctctcccccgttcaaagcccggttgctgsggggcaggagtgtggactgtctcgtgtttccccatttggccggggtctcatctcttccttgcccggatgattccacctgctctgcattttctggctgttctttatcctgttcacttgtgaggatttcccccaaaactggaccgtcctccccgagcaggtcggcttctccctctggctctggagctttctccccctggagcagctttcgctgagtagccgcgaattcataaatttcttccatctcctcctcgttgaccttttctctgtcttcttcgtggccctcaggcatcagcaggtcct

SEQ ID NO: 19624 - DNA, 600 bp, Bovine  MMBT02284
aaataaccaaataaaaagagcaaagcttaaatcgaataatataaacatgattatatcttaggttttcttatcctaggggcttgatattatatgaactgcctacttccatcaggctattcataaactaaaggtaaataaatattcagactgagattattcactcattttcctgcacattcatttccagtagcttcatgattaatcaaacatgtactcttagagaatactttgaggagcaaggcttccatttcattgtggtttgacctataagttgaagagctggagaaactatacaagagkgtctcaagtactttaatcatggatttacaagcattaaattctttcttatgaatgtgttsgtgctttcacatttttctaactgaaaacattccacagtacattagagatccccaatcctggttcaatgctgtttctagttaatgactgtgtatgattcacatagagtgagttgcaaggtgatatgtaagtaatttttgatatggatgtgaaaaataactttgagatatgagaaaataggtaggccaattgaaagagagtttttgaaaaggtctgaagaattaaaagagcatgttgtgttta

SEQ ID NO: 19625 - DNA, 600 bp, Bovine  MMBT02000
aaggcatttccaaaggtagtgtcagcatgggcagtccagaacatttttccatctgttggtttttatcagaaatatctgaagtcatattgcataattaagattgctgtgacaaacaatttttaatgctttcatgtgcagtggtattttccccaaaagtcatttctgttgtcttaagtggcaaaactaggaagatccattggaaaatataaatgattcaccaactctctatggagaattgagataaatatttatgttggtcatttatcattcatttaatactcaggggcttattatatctayacttactatgttatctctttkaaatattcctatgtgagtgatttttcatagcagccttagagaggggtcctaagagatgagacatttctgcatcttaataccacatttgctgagcaactaccttctatgtttcaagaatatgtatactctattgatttacgcacagtggacttctgtgttgttgtgctgattgatatgcctgctagacccagaatcttatataaaacagcttgaccttaaaaatggtactttatgaaagtgagaaattaataaactaagaatcataggcaatagctttgg

SEQ ID NO: 19626 - DNA, 600 bp, Bovine  MMBT22014
agtctttttgatcatcatcttttcatcatctttttttaaaaaaattacaggggaacccctacattaatacatagttctgagtttcaagaatcagacatttgctaggccagcagatgctttctccacacccaccatcacagtaacgctttgctactctgacttatcaagtcttaacattcagcaggtttctgtcgagtatttcaggaatatcattaatcattctatcgccttaaaaaggtgttgatagtgcaggtttgggacaataagctaaatgaggagaaaagttatagatctcccaastcaaagcttgcttgttattcaggaactacaaaactttcactacacaatgacagccagcattcaaaaatgtgaaatgaatgcatatgctttttacagttcctttcattaaaatgcagcaatgactcttttcaatgggtaaccaaacatgcaaaggaatgcatagacagagtcactcctttccctgagatcttktaacattttataagcattccrttgtattgcttttgtttacttacctgtttctttttctatatcaggttgtaaatttcttgacggtaaaaattttaccttactcatgtc

SEQ ID NO: 19627 - DNA, 600 bp, Bovine  MMBT07271
atcttgaaatgcaactatgctaataatgggaagtggctgcaaagctatagaatctggcccagatttcactgagggaccaggtgcccagaattggaaagggcagtcaacacagcacagtcgggcagtgggtgttgaagagaataaagcatttcatgtctggaccccagcggactccagttctgcaataacctagtaatgataacctcagtcatccaaggaccccaggttgggagtcaccagtctggccacctgaacttcccacagatgcgcagaagggtaggggaggtgctgtgtctatgygggatgagaccygctgggactgccagccaggggcgccctggcagcggaggtgaggggtgaagagggaagagagggatgcaaacaggaggagggtctctggagcgttactgagctctgtcctctgcccggggctttcacaagcttcttcctcacccacacctgactctggtccaagcacagcacgtcagcccccagcccggcggggcggaggctctcacgggccagtcagagtttctgcctgtttgtcttgttatgtttctctgaagccagggacgagggatctctctgccctggttgcag

SEQ ID NO: 19628 - DNA, 601 bp, Bovine  MMBT02356
  misc_feature (1)..(1): n is any nucleotide
naagaatagaccaggacaatatgctcggcattgatcactgtaaattcatttttaataactgttgatttttatacagcattggtacttatgttttcttacaaggatgaaaaatagggattcatgtgaaaagtactcaatttacaaaatgtctctaggaatccagaaataaattgtaaaataaatatgaagggcttatcacacattagcttcatctcagaatattcaccttggctaaattgaccagatgagtttatgttgttttacatgtacataactcttaaaattaaaaaaaaaaaaagtragtattctgcctgaaagcatcccctaactgcttactttcactttgaattcttctgaaaattctcttccatctcagatttcttcatagcccagggacaatatccaaactatataatctggtatttcaagacccaaatttgattttttcaacttctccccaacatgagctctctttcagagaatttagtctactctctttcaaaccaaaactccccagaatctcctctaccactctcctccagtcaccgattctcttgccttgatttccctgtgaaatacatattttattttaaacagcaca

SEQ ID NO: 19629 - DNA, 600 bp, Bovine  MMBT08373
ggtgatagaagttttaaaagattaatgtgagggacttccctgatgacccagtggttaagaatctgccttgcaatgcaggggacctgagtttgatccctggttggggaactaagaccccacatgcagcagggcaactaagtctgcatgatgcaactgagcctctgtggtgcaacgactgatccgtgtgcctcaactagagaattggtgcgccacagcgaaagatcccacgtgatgcaacgaaggtccctagtgcagccaaattaaataaatattaagaatagattaatgtgagaatgaatraacacctgcatttgactagatgactacaaaacaggaatcctgggaaaaaagatagcatttagtagagttaaaagtaacatcagaagatggacttatatctgggcttccctggtagctcatctggtaaagaattcacgtgcgatgcaggagaccctggttcaattcctgggttgggaagatccactgaagaagggataggttacccactccagtattcttgggcttcgctggtggctcagacggtaaagaatctgcctgcagtgcaggagcatctgggttcgatcacggggttggaaagat

SEQ ID NO: 19630 - DNA, 600 bp, Bovine  MMBT08862
tttcaaaatggtttaaactatgcctatgtacagtcactaaatacaatcaagtatttttattgtaataagtaatttgaaaattttccattattaatcatctaagaacattcttgctgaaaacagaacttatcatgagtttgaaaatgtacttttggttttcaatttcttagtcctgtgttttgatttaggtttttaatcagatctatttcagtaaatcaaaacttaccgtagctgtgcccaaggttatgcagtttaacagagaacagccttttgtactcagcaagttttacagggtagaaygaaaacatgtttgtagattaatgatgtagtattctttgtgattaaattttcaagtgaagagtcgcagcatcaagtagtggaaataacactggggctggagttagaagaactgaatcagagctcatttatgggttgagtaaccttgggaagtcaattgtcctctctgaggctgtttttctctttagtctaggggatgataaaatccaactcatagcatcattgataggcaactttacagaagtcagtgtcaggtttcttctagttagtcaataaatatttatgttttattttataagaatc

SEQ ID NO: 19631 - DNA, 600 bp, Bovine  MMBT07535
atcagccccaccacagcagtgcaggggctgctggaccaggccagctcctaggacacgttcttcccccacagacctcaagagtacagacccagggacccgctctcccacaggcagcacatagaggccaggaagctgctcgcttggccttcactttggcagttcctctcttctccttctcgtgccactgccctctgaccatttgcaagtcagagaacagaggccaaattgggaaagtgacttacctgggtctgtggtaggcccctgcccactcaaatgctttctgcagtcatttttcaaaaygttctagcttgggagtcctccttggcctagttgacaaggattaagagatttcctggcagtaggggtgagttggggcccctgaatgtttgctgaaggagtgagtaaatgaatggatgaatgaatgaaaaaattagtgaatggatacctgaatgaatggatggataggtggatggataaatgaatgaagtgagtgaatatggaggaaaggaaaaaagaaataaatggatgaatgaatgaatggatggatggatagatgaaaggataaatggatgggtgaatgaatgaatggatggatggatg

SEQ ID NO: 19632 - DNA, 600 bp, Bovine  MMBT03670
ataagagagatggagacagaggcttgagacacagagtcacaggggagaaggccatgtgaaaacataagaagagattagatttatgcccccagaagccgaggaatatatgaaggtattagaagctaaaagaggccagaatggatttttgaagggagtatgggtctgacaatatcttgattctaaactggcctcctcaaaactgttaaaagaataaatttttattattttaagccaccagacttgtggtagtattacagaggccctataacactgatacactgctactccatatgaagattwtttgattgattatgattaaatatatacattaaagataacaagaaaaatagtgaccaaaatgcacaccatgattcttggcaaagaactgcttctgaaatgacttttgtatttttaatatttaattctttggcaattacaactgtgaaaaatatgtatttacatatttttgcaccattttattggaaaattttatatgaatgctagactggaacagaataatgcaataaagtcataaaagatacaggaaattacagtaggattttataactcatggtataaaacctgttgaaaatgcagttg

SEQ ID NO: 19633 - DNA, 600 bp, Bovine  MMBT16824
ggtgtggctggtacgaacctcaccgggagtagctacagaggtcaatcccgccctctgtgccccctccctcactccccaccttgggtgcacaattctgacttctctgggaatcccaaccattagtgaaacagaaaaaccctcctttcaaaatgactcttgcagtggtttcccttggtcttcctaccttcctagcagctcctccagcttcctcattatctatacatgcaaggcggcctttacccttctctgactctgttctgggccctttctccctcccacatctccccagcttcaaacacrtatagccaacttcctgctgtgacatctccacccaaatgccccataagcccttccagctcagccagtcccaaatggaagccacttcctgcagccaccagcacatggctgggaaccagcttctctgcgtctggttttcttctcatcaccggggtttgamtgatccccggttccttcctgccttgaccctgctgcattttcaccaggtcctgtcccaggagcttccaccacctgtcccttcactccatccctactggaaacacgtgtgcagatgtctcctccccaggaagcctccccctgccc

SEQ ID NO: 19634 - DNA, 600 bp, Bovine  MMBT04732
aagagctagagttcaggaaccttatggtttcaacagcccaaggctttttgtacacacagagagaccataagaattcttgttcacttgttaaccacatctcagaggtggtgagaaataccttggagaactcatgggctaaggcgaaagaactagagagcaatctagttgatttgatcgttgtaaacagacaaaccaagtggttcaagtaaatatgctcttgtggtttgaattgccaatttagataattgtttgcttttttaattaaatgaataatcagtaagtctccactttgctttttaycccccctctatagacagagccaaaaattgtttttatttgggtggcatctgagtttaagattgtagaaataataataggaatgaaaaatgccttaagacaatcacttcaaatattaattcctcagttagaagcttcactgtctcatatcattcataagacactgaaaaggagcaagatactccttatgagctctgatttcttctccctggatgtccttggctaagccatctctttcatttgtttaaaaactatgtagtccagattctgtttaaggacctgagtggtacagagatgaaaagc

SEQ ID NO: 19635 - DNA, 600 bp, Bovine  MMBT03609
tcagagacctaattttcctgccacagtgcttcacataaactattcctagaagaagcatagtaactgttattaaaatcattgcctagatcaggaggctgttcagggttaacatgccgccaaagttaaatttctccagacaggatgaccacaaataaaggtcaaatgactccttactgccatctcatcagaatacagagtcttggaataactgaatttaaccgcctattttttcagcacatttccggttttttggaccaatgaccaaaatatttggtggttatccctggtgctgtttccctycctggccacactggtttccttccattttcctcagggtgaagacgactggcctatcctgcatgttccttcattcctctcctgatcctgcctcagtgcagaggccaatgccatatctcacggacaagtttctgaarcttaataaaaacagaagatgccaccatcaatcttatttactcagctaaccaacaagcccaggcaatgtgcacaggctggaaaacagtacgaaatccatggctctgaccccctgattttagacatagatgagtcatagtgacgacctcagcagagagattccagatg

SEQ ID NO: 19636 - DNA, 600 bp, Bovine  MMBT20726
tcacaaggaagtttaaggaatctgagtaacatttaaaacgaccacttcagtagattaaaagttgagcgtatcatcacactgtttctttgatatgatcactcctcctccccatgatattaaataagaggagggggtgaactctaacctaaactctaacctgcaatcatgtttccaaggaaagagaagcgagatgggaaaaacaaaaacaaaaatcaccaactcatttagaaactcatgaaaggcagagtagagtttgcacatatcagaccgatttgcctcggcgtgtgaatcatttaacargaaaaaacacggactgactcagcttgagtgagctctttctgtctctgctgaggtcctcccttagtgtggcccctgtcgctctcttcagaacttgttccgcttctccttgctcactggagagaaacaggaagtgttgtttattaataagcctgaccagggtcacacccaaggcaatatcagggctttacctctcctgggcttggggagaggttcaaagatcaaggatatgctcctggttagaatgagaggcaaggccagactccaaaaaataaactcacaactgggacttgacataagtcc

SEQ ID NO: 19637 - DNA, 600 bp, Bovine  MMBT04154
tttgtttttatcccagtgtttggcacagagtcctgaacaccaagtggggcccctgaaccctgcctgacaccaaattgcattctctaatgtcattcctgttttgctttgtttgataaagactggataataacaaaggggaaagggagcgagtaattaaagtgtgttttgtgaaaactttatgagctaagtccgcaagaaatagagtgtaacgtttaaaagtagggactctggggccagacacagtttcaagtcttggctccattctgtcttagctgcaggacatttgacaagttactcaamctctctgagcctcaatttttttcagttgtaaaatggataaaataataggaccagccttggagagctcttgtaagaactgtatgagggtaatacaggcaaatagcttagctgagaacttggcccacggtgcccagcaaaggttaactagtattatcatctgtactggggagaggtaacttccccagttcccgtaagggatgttaaggctgaaacaaaaggttggcaagataagagttctttaaaaaggacttgttattttctgttttacactacatggtgtggtatacagcaaaggcaata

SEQ ID NO: 19638 - DNA, 600 bp, Bovine  MMBT01121
tcatccttgtcaaatccatggccaatgaactgcaaactatcagaacaaggtgttggatggagtcgatcatactttgatgagtaaaccaacttgacttgttcatttatgaaagaagtttgaaatgcgctcaggcttagtcatgggctggtgagggtgttttcctcttaaaccactcttcatagaggacaacctgtttctaaaaatgcaggagacgtgtgggcaaagtgaccccagtccctgaataaattgctgcactgacttttctatgagtaaaatattataaattcgaataacctcttyggagcatttaaggtacaggaaatgagtcatcgaaagaacctcctgcagcctctggatgctggcaaacattttttttwaaaaaccctcattaattagtgggaaagtaaacttgaaaaacctgagttaatattattttgaaaagaaatatcgtttatgactttcacgttctttccagtataatgacttcaaagtatttcttaatccagtcctttggtgaatgtgttatttttttttaatacacgagaataaaattcagtcatgtgcatggaaagtaagctgctataacaaagcaaactgtta

SEQ ID NO: 19639 - DNA, 600 bp, Bovine  MMBT13711
aaattaagaatgttatgataattttgtaaactatccaggtgtaattaccatccaataaaaataaaatatttcataatactcttagttttcactagatattggtttataagtcatggttctattgtttaccttgtcacaataaagtccttaaaaccaatattctttatttgttgatatgtactaagtggaaatctttataatcctgggattttatgtgcaaaaagctgcccaggtaggccccagctccgggtgtgcagtacgtacaggctgcaggagcatccttgtgatccaggggcctakgttggctggacctttctcaagggacccagaaataacacagctaaaagtggagaaacagaagctaagatctcagctgatatgggccttgcatgaggtcagaggacaagtagtcatcagtaagagaacagtagtgattagaactggaagttgagaaaaagaacaaggctttatgagggctaaatcagctaaaacagttcaaaactaaggctctgaaggacaaagagtgtaagaatattccccatcccctgtttttagtcactggtttaggggatgatttagggggttcccaggtggtgctag

SEQ ID NO: 19640 - DNA, 600 bp, Bovine  MMBT08484
tatttccacagacatttttaaaagtctgttctaactgtctcagtgatttaatttctatcataggtttccttttctttttttttttttttttctggtgtttggccatgcctgtgggcttatggatctttagttccccaaccagggatagaacccatgccccctgcagtgaaagtgtggagtcttaaccactggactgctttggaattccctatcatacatttcaactcattctcctaaacctggttgctcagtgtcagcatcattgacatttaggcagatgattcttggcagtagaggccraggcatygtagcatcctgagcagcaactctggtctccactcattagaggcccggagtgccctcccccaagctgtgatgatcaaaaatgccaaatgtcccctggcaggcaacttgttccccgttcattgaaaagccattgtctaaagacataattcacttatctagtgtgttccagaggcaataatgtcgaagggtrgaaatcagtgactagatgaccttcagggaaagaaaacaaaattaaattataatgggacaagtaaaataaaatcgtttggtttctgtatttccacgaaaggcatg

SEQ ID NO: 19641 - DNA, 600 bp, Bovine  MMBT15306
agagccagagacatatggattaaagtgtcatgagagrcatacgcagagacaccaagacagacacacttcacacctgacacagggtcacttgtggagccacacgcaggcacacacgcccacacggaacacacgtgcacactcacgaacagacaactgtcaccagccagctcaccttgaagggctggggctggaagctggtgggcttccagaggacaccgatcacctctccgccatgctggtcatagaagaaaagagccaggtgtccgaaggcctcctaggaaagggcaggacaggaaaaaractacaggtgggaacctgatagccaacgccacggccccaactcacctggaagcctcctcccaagggccagccagccctcaaggacctaccctgagctgtgccaggtagagctgaggcggatcatagcccagcacgggcataaagggaggagggccctggctcactgagcaggccccggcagaaggaggcagctggtgagtccacggcctggcggtgccgggggatgtggcggggagccaggcggatcagcacgtcgtacatgtccaatggtggccggaacacggtctgaagaagggcagg

SEQ ID NO: 19642 - DNA, 600 bp, Bovine  MMBT12849
acctatggtactgaacattttattaacataaatatgttttctttcttataaacttttttggtttaaagtctattttgtctgatattactgacagctcctttttggttactatttgcatggaatatcattttccatcctttcactttcaatgtatttttgtctttggatctaaaatgagtctctggtagacagtatatagtcagatcatatgtttttcggtattctgccaattttgtcttttcattggagagtttaacacctatttacgtttaaagcaattagtgacagggaagcacttayccctgtcattgtgctgtttgttctctgtatactttatagcttttttttttttctttttgtccctcatttcctgcattactgtcttcttttgtgtttggttgattttttttattgtgaaatatttaaattcctttcttatttccttttgcgtatattctgtagctattttctttgtggttaccatgggaatacatttaacattctaagtttataacactctaatttgaatttataccagcttgacttcaacaacatacaaaattctgctcttttacagctttgtcaccacccctttttgtt

SEQ ID NO: 19643 - DNA, 598 bp, Bovine  MMBT06014
  misc_feature (1)..(72): n is any nucleotide
nnnnnnnnnnnnnnnnnnnnnnnnnnnnnnnnnnnnnnnnnnnnnnnnnnnnnnnnnnnnnnnnnnnnnnnncttggctgtactgaggtgggagcttcccctgctccctctttttggcagtctgacattttgaacagatgcgatccatgagaagctataattatagtacaaaccactgccagggttttttctgccggggaatttctatgcccagctagagtacctctcggtgtgatctgtatatcctagattagactgtgccacactcagttcaggcctgcttggtttattgcctcttgwtgaatacagagaaactataaagggaggcatgatctgcttacttcaggaacaccaatcaagaactgacagattatatttaaaaattgtttcctgagttagagtctccacatggggactcagtgggtggaggaggaacacaatatccttctayctgctttcagacaggtggcaaatcagaatagcttttctcagttttactctataacctttcagagttcatggaaagtcctcagcttctgcagtggtttttgagaaaatctgaggtttcatctttcagagggctcttcaccatgggaag

SEQ ID NO: 19644 - DNA, 600 bp, Bovine  MMBT16216
gtgagaaagaaagtctagaaggttctgggcagaagattaacatgaaactttgaagagayactctggctrcaggggaggctcagatagactatttagaatggaactgcaattaaaatatgggggaaatttatccgtattttggtaaacatacatatggcttactatgattagagggcacagcctttagtatactagtaataccttgcagtgtgatatgcaaacttgtgtgatataaattatatacatgagatgttaaaacaacctttaaagaaagtaaaaatgcataaagtaaaagtgacrgcaaattattgtaaaaggacataaacatccaagaatataaagttgattctctttccaaagaaaaatgcatgtgattggagaaaatatcttaaatttcttgytctttataacttaaaattatattacatataatagtatgtattatatataataacatatattgtattagtcactcaattgtgtctgactctttgcaactccatggactctagccaaccaggttacwctgtccatgggaattctccaggcaagaatactggagtggggagctattcccttctctagggaatcttcccccaa

SEQ ID NO: 19645 - DNA, 600 bp, Bovine  MMBT05237
tccagtattcttccaggagaatcccatggacagaggagtctggcaggctacagtccatgaggtctcaaatagtcgagcgcaactgagcaccacgcaacgagtcttcttatttcacagtgaacatggcagtgatggattgaacgcgttgaagagaaaagtgattgattttctgacaagaagccattctatgtcctcttatcagccagccccgccccctaaactgaaagggtaagaagctaaatgctgaaacaattaaggttacttgacattctaactcctggccactagaggggggtagcraccaggcttcttctctccccagctggatgagaggcctctgcccaaactgaaatgttatcccttgaagagtgacaattcagcatacggttctgttcattagcttttccctctgtggagtcagtgtttcctactcaagtaaaggtagctcgtctttcctaagaggagtatttccaaccttgttagtgggtatagagtctttggccgctttaaagtcatagcgcctggatgtggggcaaatagaatggtgcacacaccttccccacccctaagacatagtttccacatatgatctgatatatg

SEQ ID NO: 19646 - DNA, 600 bp, Bovine  MMBT07824
tctccacatgacatcattatctttaatatagattatggccaaaacctccaaactcttctcctgtcccctgctgtacagctgtctcctctttgtaatcataacatggtagtccagcggataatgctgaaacatagattagatccagtcatttctctactccaaaccttccacggctccccatttcctcagtaaaagtaaaaatctttatagtgatcaacatgactcgacgtgctctcagctcttctccttgttatttctctgtcctcaccattcagggggtggatttcaagcatccttacytgaatcccttgttttcctgttatattttccttatagtttggttgtttgaaatgttcttctcctaaatattttcatgatctgctccctcacatcattcagatttgtgttcaagtgttacttcctcaggaagaccctcagccctgactaaaatagctcttcctttctgtctgttgtattgtcatcagtaatgcttttcttgactggtccaactacctggccagaatataaactccatggggcaagagttttttttgtcttattgccactgtgtttccagggactagggcaacacttggcaca

SEQ ID NO: 19647 - DNA, 600 bp, Bovine  MMBT06346
agaactgtgaccaaggaaataggagatctcatatagcagacagatgaaaaaaattcccaagactatggcaaaaaaggaagtatccatatgatagttgtataagaggcctagagaacacaaagactctgttttagtagaaggtcagatgtctcagcaagtcaggtgttcagaagataaaatatgcttgaaaatgagataaaaaaaatcatgatcatatgaaaaaattattgaggcattttatagagcttttctggggtgatattcataggttgaaagtaaaccaaatcaaaagagggcaawttttaactccagtttaaatacaagaamagcagaggaaggaaatgtaakcagataatcttctagactcagcaatgaacactatttaaaaagttatgatggaaaacctaaatgtttttaaataaaaattgaggcataattatattgataggaaaatagagrgtaaaattgagtcaaaatgatawaaccttacaaaagaagctgacagttaaggtttaaactgatacaacagtatattcatattctgttgacctgtggagataattaccaaataaaatagctaaatattaaatgtgtttgctc

SEQ ID NO: 19648 - DNA, 600 bp, Bovine  MMBT19364
aagatagtaaaggttgcaatcttaatgcccattttatatgcatgacttgagttgagcccttatgcataattcatgcggtcatttacaggcttttacacgactccccctttaaaagttaactaacaaagggcaatatcagccatggcaacaaggatattatgtaaatctatctcggtaccaacataagagggggtgggttgattaattaaaaagacagaggaggacaggaggcaaggtgcacatgcctcttgatgttactcatcatttattaatgtatttaattgaaaagaattttgaagsgtaaatatgtgtttgtatattgccactggstgggagagcactgcttaaccctgtgagcaaccatttgaatcagtggaaaacacccgatttcattcatttcatttcctctcctttcaaggaacagcatcatgagaaggtgaactaagtcttgggtttgatatcagctttagcccattatactaaccgaggtacttaactcctttgaggctcagtttcttgcatatagaatatacactaaaatacccatttatttacctggtacagagtgggaggggactatccaagggtatggataggagg

SEQ ID NO: 19649 - DNA, 600 bp, Bovine  MMBT15386
ataacatctaggatctggtgccaaattagtgtgacctttggcaagtcacttcccctctgggggcctgtgttctcatctctgtactgagaatattgccctgtgtctcagctctaaatggtagactccaatccaagagttaaactactggagtcttgagctagaatggacaggagggtgatgaaggcttggtcctgcctgtgggtgctacctacccccagcatctgatggtacagcaggtgatagtaagagatgccgggatgaggaaaactgaatgaatagagtcttgtgttccacgctccrggagctggagaaggaggaagggaaagtggtggcttcgggactgggatagcctgaaacttcccaggcggtccttgaatttggaaatgggtagaatttggtgtcttgggtgagaaagggaatgaatatcagctgggacacctagggaggtggttcctccaggtgaagcaacagagacgagtacaggaagtggagtcattgctgaaacagatcttatcccaggagcacaggtctgatccccaggggaggggagagccagggaggagccagggagacctgtggggctcccaagggcttccggga

SEQ ID NO: 19650 - DNA, 600 bp, Bovine  MMBT14011
ctatctcaataggacttccctggtggctcagacggtaaagaatctgcctgcattgtacgagaccatggagaagggaatggcagtccactccagtattcttgcctggagaaatccatggacagaggagcctggcaggctatagtccatggggtcgaaaagagttggacatgactgaacaactgatactttcactatatctcaataaagcttcaaaaataaaaaatgaatgaaactacgagggagaaaggacagcttttgcccacagttgtaagtacactcaacagtgctttcaaaggggarttccttgtgccaggaaacaggaagacatctctgaattacaccagctagttagggttttgggaggccatctgtgcacactaggagtttttggatgcaagtaacagaaaaatccagctggttaatgtcttggctcgtgatagggtgagtgttcagggttgttttgatgatgatgcggccaagccccaggttcccttttcggtcccctcctccgtgatggttcctttttcatagatcctttttcctcctctcatgaccaccaagatgcctgccagtttcggagggctgtttgatccctggttc

SEQ ID NO: 19651 - DNA, 598 bp, Bovine  MMBT02513
  misc_feature (1)..(36): n is any nucleotide
nnnnnnnnnnnnnnnnnnnnnnnnnnnnnnnnnnnncatttctcaacagtatgtgtaataggtgttgatggtacttagtagaatagctttttgacacgaaaattacttatgtccagtataatcattcagattctgacagttcaaatgcttatcctaacagagatgactttgctcttgctaggaagtgaaactgacataagggttgctgaaggaaataaaatatgcagcactctaatatgtgttagaaacagtcttctcattttgcttaagaattttgagatccatacggtgattcaaagytaaaacatttgaaaacgatatactagttttgttttagcccacacattttaaacattcactgagtagtccaaagggtttatagtaatacagggatgtctttgtaatgtattataagatttttgaatgaatttgtaaaaaatgcaaatgaatgaaaggttttaaatcwttcagtctggcctagtatctagaggttggagttcaaatatatctccaaatacagagttcttttgagagttagttgagtatcttaattgcttaaaataatctgtgatcatcatgtatacctgtggtggattca

SEQ ID NO: 19652 - DNA, 600 bp, Bovine  MMBT02746
agtcataaaacaattgatatctggtagtatatccagccagaattcatgttggagtgagttggaaggaaaggattgtggtgacttctagcattctcgtttgcaagcctgatctgtccccttattagacctggtttctcatctgaaacagtaatgccgccgctggagacaggaaaccagacagcagtctgccctgataagggagggcattgtctaagggagggagccctgcttccccctcaactctccttccttgaaatttagtagcaataaaagagatacaatactacaaacgcggtttcwcaaccagaactaagactgttttctcccaaagcaaaaactggctctgctttctctggattgtcaccatagtttaatggcacattagaaaaaactattagtatattttgtgtctgttggtcagagtatttaataaatagtaaggtcctttctctagcaaagcaggttcctagagcgattggaaactcattccattgtgttggcaggtcgaatacattaccatttccccatctcattattaaggggagccagacaccaaatgcagtcacttacatggcccttcagcttctatgtaaccctggg

SEQ ID NO: 19653 - DNA, 583 bp, Bovine  MMBT05153
taagaaggagaagaaggaagctgtcatcagcggatgtttgtacctgtgacttgggttacctgagtagagcattcaatagtctttgaataatgcaaatatatgccatgggtattttacacatcatagacatatttggggttggagaatggggttctagactgatgaatacaaaatggcattcaaaaatattaatgatctgtctcctgcctataggcctctttcctacttatatttctgtagtaccaaatttatgtatttacccaaatgaagcttatgacatcatgactttgtgccttgtayggtacatgtcttctatcgctcattgtcatgaactcctatttatccataaaaaactcagctcctgtgtctacttctttgataaagcctttcttgatcctattctccaaaagagttaaccctttccttatctttgtggcatttatatgtttaatattatttctcattatactcatcaaactatatgataagcatggtcagatgtttttctcctcaagccgtgtgcttattggccttttcatgaggttgaagtatatgaaactaccatttttttcttaatcagttt

SEQ ID NO: 19654 - DNA, 600 bp, Bovine  MMBT21472
taattcagtgtagtggcacacttacatttagtaattctaccatttgggaggtctagcaggaatatgatgagacttctgacaccattttggatgtttttggttaacctcctagtgataggagctgcagctccctaaaatgtgagacatttctgtttggagctgtggccttttatgcctccatttgtaagttatttccccctacttctctgctgatcagagaaacagtctgttgtttgatacgctctatttaaacgagactgaactccttgataatacagactggcagcttgaatttttttsaggggaattttaaagtagtataattgggaatagaagcttagttgatttctgtttttttattagaatccttttctgccaattttagaagtaggtgatttctatgtattgatatggcatatcagctggggataactagagttgtatgtgttgactctagactataataagttaatcaactataccttggcttcattcaattttgttttcaacacagatggttgttattgtttgttctgggcttgcctccctctcagggtcaagaaagtgactcctcggagacctctgtgcgaggaccccgga

SEQ ID NO: 19655 - DNA, 600 bp, Bovine  MMBT02579
tatgtgcattttgaacactcaaattacatagctgatccagttggtgcacttggattttaactctcccgggacttgcagcagcctgcctcagacacagcctgtgggcttcacttactggttgataagctgcccacttctcattccscaccctgcttctgctgggctgctctcctgaggtcttctcacttctaagaaaagattgacctgcaagcccaaacttctgtgcacacctgctgtctctgctctgcggaacctcaggcccttggggccccttgcccatagttctcagttaccgacccycataccccttcccatggaattcaggccagtggtcttgttttcacttgagaaaaacaagtgaaaggcagtcagagttgggccaggatgggctcttgctgggccaccagctttgtccctgagcttgcagcagcagtcaagtggggcccaggcatcccttggaggaggagcatttggcctaaagcagtgtgggaaagccccaccactccctgtggaagggagcctgcgctcacggggagttttcacaatcaaaacacaaagccagagattctgtgcttctctttgactcatctgcctgcctct

SEQ ID NO: 19656 - DNA, 600 bp, Bovine  MMBT09605
tgctgcagtcatttttcttgtctaatatttgtcatcttccattagtcaggaatactaatgagtagtcagggtgtccaaatgacaataattcaccgttttcccagtcatactgagactgtttaaatgcagctrtaggaactgtaaagcatttgcrtgttactgctatggtctaggtcccataaagttctttctggagttttgctcactaaatcagccctaacgcactttcatcttctgtgtgcgtgtctcggcttttcactaaagcttgcttctagatgtttgcttggttggttcctcatyccctttaatgtccgttcagatgttascgctctggcgagaccttcactgyccttccccccaaccactctctggtttagagtgttgctcctctgcctctctgccgttctgtagtagtttttcgtcttatgcggcttttgttttgttttagtggtacttatcactaactgccttgctttgtttagtcccttcttggttattgcctttttcctactaaaatacagggcttctcctgtgactcaggggtaaagaatcctcctgccsatgcaggagatgcaggagacacaagttcgatccccgggt

SEQ ID NO: 19657 - DNA, 598 bp, Bovine  MMBT02999
  misc_feature (1)..(47): n is any nucleotide
nnnnnnnnnnnnnnnnnnnnnnnnnnnnnnnnnnnnnnnnnnnnnnnaaggagggaggcctgtgtgaaggctctgacgcttatctaggcacaggatggtggtggcatggaccaaggtgctctaaagataagaagggaaagaattctggactcatgttgaaagggagccaacaagacacgttaacggattcgtggtggaataagagagaaaacaggagtcaggatggcttccaagaacctgaaggatgaaattatcattcaatgagatgtgatgggtaaattctgcatgtaaatgtcttcmttgaaaggtagggcagtgacctttagatcaggtgaattggggtgaatgggtggacaatctaaccagtgcccagattcagcaatgcagggggtgatggaaagacaggctgaggagaattcaggccaacaagccattgtcagggtcctccctggtctcctggacacagccaagaggcagagagcaaggtggtctcaggtcacagcrcacagaaagcctgtgactgactggttttccaggagccatgctaaattcctgatccctgaaaactgaccgcttgcttttgacaaaggaaataacc

SEQ ID NO: 19658 - DNA, 600 bp, Bovine  MMBT04840
agatacattcccaatagaagtttcaatattgaatgrgctataaaaccatgtaataacatctacaagttcatttggaaataaatggctagattggagtttcaacctgggttaataattggtgtaggcatattgacctttgtacttgttcatgtggattgttatttgctatgtcactggaaarcctgattcagcatcacacaagggtatctggagagagaggtgtgaggaccagaactacagggtgatacacgttctcattctcactytgtttttataataatattaagtctaaaatatgtyttaacaaactttatggctcccaaagaggggagagggatacattaggwgcttaggattgatakatatacactactatatataaaaataaataatgacttactgtatagcacagtgaactacattcaatatcttgtaataacctataaataaaatgactctgaaaaagaatatgtatatacatatatatgtatgcaatggcaccccactccagtactcttgcctggaaaatcccatggacggaggagcctggtaggttgcagtccatggggtcactaagagttggacacgactgagtgactt

SEQ ID NO: 19659 - DNA, 600 bp, Bovine  MMBT02772
atgtttttacatttagaaaaggagtgtgcaactaaggattaaacaaatatttgtgagtcagattatttttttcattgtttggcactgatatattgttgaaatgtattagaatatttttacaagtgactctttcacagtagaattgagaatgcaaaagaggaagtagaaggaaagaaagcaactggaaaaaaatcttaaaaacttgagattattacagagaaaaatcgtcctgtgacttcttctgaagataaagtggtagaataaagttagaaatttaaatcttagattaaggcaatattragtgtttttatagatcagaataagatgccaagatagagtttaaagtccctttctggaaatctcttagaagtgaaaaagattattatgcacctaattgaggtataattttgcctgagatgtaaaagatcaactaaataacctctcaaggtccttttgttccaatctttcaataattatttaaatgaaatcaagaattaaatgcttgctttgacttgcaatatcttagtgcactgacctgggctttgtaacttaatatctatgagtactaatctattttaactagatgggaacaggaaaaat

SEQ ID NO: 19660 - DNA, 600 bp, Bovine  MMBT16790
ctttttatggcctggtaactcattctttttagtgctaaatagtatttcattgtctgaataaacagcagtttatccattcacctactgaaggatatcttggttgctttcaagtgttggcagtcgagtgaagcagctataaacatccatgtggattttgtatggatacaagttttcagctcctctgggtgaataccaaggtgcatgattactggatcatagttttgtaaggaactgtcttcctgggaagctcttccaagtggctgtagcattctgcatcccctctaacagtgctcctgtctstccacatcctcttcagcatctggtggtgtcagtgttctggattttggccaaactgataggtgtgtggtgaatcctattttcctgacccagataatgagtcttagtcattttagtttcccacacaatgttgagtccataataattgctaaataaatatttgctgaatgaatggaagactttgccttcttttatgtaggttgttgcattgaacagcctatatgtttttctgaactacttacaaaattgtcttcaaaactaaaccgggcactatggagggcaggaatcaaccagaccttactc

SEQ ID NO: 19661 - DNA, 600 bp, Bovine  MMBT18306
taacttttctgtaggtttgaaaacatttcaaaatatattattttttaaaaccacgcaattgcttattttaccaaaccattttagatcaaaggctcattgcttaatttcaaccaattctgttcttcagggcaaagaggtaaagatatggtatgcctaaccccaaaccacaggtatgcaaatcatgttgctaaccaggccccaattcatactaattcatcaacatttccatgcccagtgctgcatcagctctctcaggtccaactgagacaccaaggtttgcagacttcacttccaatgtcrcaggtgctcattgctcaaaacagccccacccctgctgtgatgcaacaaagaggtactcctttgtggtaacagtccttatctgtcatctgtcagcctttggcaaacatgtatctcttcagtgtccctctgatttttttctacgtgctcttcctctgtcacctcattctctgctcctgctgccttgagggcttagggggtagttttgaggctcaatagttcgtggggacacgacttagcaactaaacaacaacaacctcctcaattagcatcctacatgcagggtctccctccgaagtgtcc

SEQ ID NO: 19662 - DNA, 600 bp, Bovine  MMBT04241
gggttctcaagattaggaaaagaatttccatttgttagtcacattttctcctctttgcatactccattatttctaccccctttgttaggcgacagttctttaaatttataaactcattgcagagaaccaatgaaatgatcattgcacatctacatgggataaaaggaaaccttcagaaaattgggatcctagaactgaattgtgtgctgagaattgaaagatttgatcattatatcctccttgactggatgctttcttctttactaataggcttaactccttatacccaagcacttatgyagatgattctatgtcatacgtgatatttatttttggtattcctcgtagtctgttttcctcttagtcgctcctttcccgtcaaagtttcccacaatatttcctgccttgttttctcttcacggtcttcacaccactcctgatgacagcgttcattagagagcagtcagttttgctttcatagttattctaagcactgagcagtgatggtggatgtatcagggctgacatgttccatcaatccagggtacttgaaaaggaatggttaaattgatgccctaaagtttgatttttgcttcaata

SEQ ID NO: 19663 - DNA, 488 bp, Bovine  MMBT13609
gaaaagttccagctgctgataaagccccctacctggtgagacagaaggagcctggagtggcgtgggaaatgagtcataggcagcgtgtcttcgggaaagtcaccttcattccttctacttcccactttcatggcagctgggccagtaggggttggcttctgtgtggggagtgtgagggcatggtgagggagtgggactgggcttgagactgagtcccagcctcaggctgtgtcctctgttcctcagcaaaaggccaaagataaccgggcagctcaccgcatcaacaaggtgcagaaggtragtgggctcagggtgcgcaggggcatccaagtctggttgtggggcagcctccctgagggtgggggtcagagggcctgcctacagcagcctaactgttctgtgcctggtctcctcctgtagcaggctgagagccagatcaacaagcagaccaaggtgggcgacaggcccgcaagactgaccgaccggcc

SEQ ID NO: 19664 - DNA, 600 bp, Bovine  MMBT11990
gcacagcacaggacggggagcacggggcaggaaggggagcacggcacaggatgggagcacaggacggggaggacagcacaggacggggaggacagcacaggacagggagcatggcacaggacagggagcacagtacaggatggagagcacagcacaagatggagagcacagcacaggatggagctggggaggcccttgctccacccagcaggagcccacaagcccagcccctggagcaggaatcttcttacctcctatgaggatcacacacgctaagctgtgtaaactggtcgtgagcaygaagtgatactggatggcggcctggtgtcactttcattattaacaatttgaaaaagcagattaacgcaccaggcccggcttaactctcttggggctcccgtgaggctcaggtgaaataacagaacacacagaacatcctaaactctcggtgtgaattaactgcccaagtcctctaaacgccctgccccttccagaggctgttttaaaagaggagctgacccaggagcgtttcccccttgccaggctcctgtgctgaggcccccagagtcaagagccccagggctgctctccatgtctgtg

SEQ ID NO: 19665 - DNA, 600 bp, Bovine  MMBT23001
aggaaggaagcaagaagagaaagcataagcatacagataaaaataatagaggtcccttctcttgcattttctaaattatgtttagaggtggaagcaaaattataacatattctaatgttgttctcaatatatgtagagaaaatatttaagacaattatatcataaacaggggaaggtaaaggaatgcaaagggaggtaagatttctgcacatcacttgaactggtgcagccaatctggaaaacagcttggcagtttctgaaaaactaaacatatattatacctaccatatgagccagcartcacattcctgggcatctatcccagagaaattaaaatgtatattcacacaaaaacctgtacacaaagatgtataacagctttatttgtaagagtcaaaaattggaaacaaccaaaatgtctttcaataggtaaagggttaaacaaaccatagtatatcgatagtatcaaatactagtcagatataaagaccaaagtgtacaatttggatggatcttaagagcattatgctgaggggggtaaagatcatttcaaaggtaatgcactacataattccatttatataaaattctcaaaataac

SEQ ID NO: 19666 - DNA, 600 bp, Bovine  MMBT22302
cctgcctcccctcctctccacttgccagaatgcctgccccttctactccagcccttcatcctgcttgatagcatggacccagtgtttgtaccccatcgcctggataaaagctggggaagaagaggaggcttcctcaccgcgttcttctggctcactcactgtaggaagagaagggagcaggggaaagaacgtgtacactcactactgtgtgtctacatgtgtgctggagaaggcacagcctcggaaaggtgacagccagggtcttctctgttgtttgtcgtctgsgaaataacgtgacayttactgatgaccagtgacttgtctgtttcagcaaaaactatatgagaatggttctgaaggtttcagacagggtgctgacatcacatcgtgtacatctgatgcttctacacacttgagggttttttaattgaagtatagatgatagagtgttgygctcgttttaggtgcacagcatagtgactcagttttacatatttagacattctctcttttcttttccattatggtttaccacaggttagtgaatatagttccctgtgctatacagtaagaccttgtttatccrttctgtgtacaata

SEQ ID NO: 19667 - DNA, 600 bp, Bovine  MMBT10846
gcctcaaatgcaacttcttggttcttatttctagaaggagagcttttttggaacttgaggaatccttctgagagaaattgatcagagcctttgcatctgagactaaactcagtgtattcaactctgctaaagtctaaacatagctccttccctatcaacataatggtctttcatgattttatttatttatttttgtgtgtgtgtgtttatttatttatttatttttattcaattttaattaaaaaaaaattatacatgtgttccccatcctgaaccctcctccctcctccctccccatayggtgtttgggatttaggagattaggatcctttatcaactctttgggtaaagagcaagttgttcatttaaccatcttatagtctggaaggcaggattatggagacaatgtacaaggctttttgggaccatctgaaagtccagctatcaagtactccagctgacttcacttctgcacttgaactcctaaaagaagttaaggaggtgagtaaccaacttcccatttgtggatattaaatcttagttgtggcatgggggatctttcattgtggtacgtgggcttctctctagttgtgatgcaca

SEQ ID NO: 19668 - DNA, 600 bp, Bovine  MMBT05181
ttaagtccttcagttttgatgaaagctttgatgtttgattagagaggataattagaataattagggaaggtttctggcttttattggtgatttagacagtgacatgtttatggctaagctatggcatcaaccagatttcatatttatatacatatatttttttccacatctcttatgtttaggaaagaatattctgaaaataagttgaaagtagaaaattgaccttgattttatgacrtaagtcttggagtaagccaaccatttgttttgggaggtttctagagctgatgaagaaaactstctaaaagtcctcatccttcgtgaatcagctggtgctgttgctctgcattctgtttaatcaagtcaaaataattttgggtttaatagatttttggaatctcctgtacctaaatggaatgcttttgccttaagtgaatttgacactcaactccctagagtgcctttattatcagcatgttttcttcacaccttttgcatattttcatgtattaggaagtcacttctcttgtgactttgagcgttgacatagatcatgtggtttatccaaatcagcctctccttcccctggtgctgtgctgc

SEQ ID NO: 19669 - DNA, 600 bp, Bovine  MMBT08339
cttggggagacacatgcagagccatcacatcactttttttcagacatctttcttggtcagttataatcattttgtttgtccccactcccaatttctacttgcctctagtccatcctcctcactgcttgccaaagtgatccttctaaaacacaaatctgatcatattcaaaaagcttttgaagggtaagttttatggtatatgccatatatcagtacaacaaacaaaatcgtctgaggtgccgttgcctacaggataaagtccaaactcctttgcctggcactcmaagcccccactctatyttcttggcctcatctctcatgatgtacatcagccacattgctagtgtctgctcatggccttctgcctagaatgctttatgccccagccaactatttactgtcttcttcagtcgaccagagtgcaatttacctgtttaaaatctatcattttgttatacattgtgcatgtctattatggctcatattaagcaatgccttggattatagtaatttatgtatatgtctatttcatatactttaacctgaaccccttcagaaccatttctttttcatttcttaagttctttgcacctagcccag

SEQ ID NO: 19670 - DNA, 600 bp, Bovine  MMBT12125
tttaatctttatttgatctgtatgcattggatttctaaacaggtggctaacatcatagaaacttgtgatgataataatagatttaacagagaataatactagagagcttccagaagcttaaaaaatcttaaattagaatcctaaatctagttarttcaacacagggtgtttcaaccttctcaagaagctgtttccttcataggtatggtcagtaatcacccactagaatgtaagcgttcatccttaactaacctctctcttaaattacacctactcttcgaatatatgccagtattcatkgtattagattgtgtgaataaaaagcagtaatgtatattttcttcccttataagaaatattctggtggaaataactataaacaataaaacacaagtattcttayatccttataaagataagtacattgtattgtgggattttcttcagtaaaggttagtgattaatggattggtgtcagcttgcccagacaaatgttactaagctgctggacttacattatgactrtattatcaagtgggtgaaagcactgaaaagaaatcagataaaaatgagactgacttaggaggaaatgattggtta

SEQ ID NO: 19671 - DNA, 600 bp, Bovine  MMBT04893
attgccatttcaagttgacctcttttatccaaaccagagttatcttaagtgagtttagataactacctaaattagtcatcattaaagactcacaagctctaaaaaatttgactttaagtcgtcttacttttagaaactttgttttgtaagaaaatgtaaaattcaccaaaatatagaaaaatgattttaatattttttcagttttcttttttagatgcgattcaaatttattcataaattttatttaaataatctgctctatctaatcactaataatagaaaagaatacctctctggcarcttgtattcatcattgctgaaaacccataggacatatttaacagtagaatgatcttgtgtttccccactatttatgagatgaaattctgccaaaagaaaaattatggttgtaataagagagatcctatattttcataatatatatacaacttattttagcaagttgaactaacagttaaatcttatactggattcactttttaaaaaataaaaaaagaagcaaaccagtatttctactctttcatgtttaggtatttgttatattctttgatacatttaattttgtccaagttgataatt

SEQ ID NO: 19672 - DNA, 600 bp, Bovine  MMBT11826
tactactgcagttgtatgaaggcagcattaccatcatgtgatggaacaagctgatgatgatcaaagtacacaagttgacgcagtcatttcagcccagtcacgacttcggtcaaacccatcccccagggagatgcgcagctcttagaatgcggagactgattacgaacctggtttcagtgtcctcagaaaaggctctcccaactcaactttccaatccaaatctctcagatttgagcctgctctgcttctcttcttattagtactgagaccccttcaagaatgcctgatttttttcctttmcttcacacagaccgtggctgtcttcaaagactcctgcctagaaagaggcttttcagggtcccattagagaaaagcccattcagcattgggcgaggtagctaaaaacagggtccctcccctggggggctggtgtgatgcccaacagcacacagtgggcgctgcatacaatgctatttcctgagggcgagtgtctcgatggccagaccaggcctgggattccctgagggccacaggatgttggcaagctggttctaacagctgcgcaagccaccgcaggcaaggacagagtgggggccatgg

SEQ ID NO: 19673 - DNA, 601 bp, Bovine  MMBT09037
  misc_feature (1)..(1): n is any nucleotide
ngggattctgtcagatgcagagatatacacggcgggtcacttacattgccacttcatacctttattactgcctttgctaaaagctgcttaactgccagaagacatctgcccattatggaagcaataaattgagatgtcacaaaattatgagaaacaggtgcttcaaaatacaacacaaggggattgtcatagacttttctttttttttttttctttttagmatctctggtttcatgtgtcttttcacagatagatgaatccttccttgctccagtctgataaaaggaaaggaaaattaacyttattkagagagattattaatatatgcctgctctgtattcttaatatatactgggccatttaaccctcacatccattctgcaagctgcataatctcaacctcattttctcaatgaagaaaataaggaaggccccaagtcattcattcagaggcatccattgagtacagtatgccagtgacttcatggatcactagagatacgagaattgatcgtaatatatttttcataaacatatcaataatgcaaggagaaatattatgcacmgtgttagagattgggcgacacttgtgctgaggctt

SEQ ID NO: 19674 - DNA, 600 bp, Bovine  MMBT04478
tgaattttctctttgttgttcattctgtccaatacaattgttgctgtcatcagcgtccattggttcagtttttactctcatccctgcttctgaatgaggcaaatcatcaggcagagaagccaagcaattctgaatcatctcaatgactcgttccagatgcttttgaaacctctcggctgtctcaagacgttgacgtttctgcacctccatcatgactctcaaggtctctcttgcttggtggggtcggtattcatttatgagatgatgtacatgcacaaaaagcagcttaagatcttctarcttctcttctcgttttatactcccagggctccgtatcaagatatctaagaggtctaagaaattaataaggatagacatattgagttttctcagttctttcttgtgatcaaactgcataggatgaagtcgttcaataccctgactttctaaagggcggatgataagatcatcacactggaactggttgccaaacatcatgtaactgtcctttattggaggtggaggcttgggagcgaggccttcctgaatattttcatctgtatactccttgatgtactgcatcggagggggtgggagggc

SEQ ID NO: 19675 - DNA, 594 bp, Bovine  MMBT10881
aaattttcccattttgagcctgattttttcccatttctatcagggagaatgccagggggaaaaatgagttaaatataaacattttaaatgggcatgaactaattttctctgatagagaagaaatagttctacttaaagagaacaagacctcacctgcaatatcttgcagttcttctgttcctcacctctgttctcttctagtcatttttccgagactctactttttgctcatcctgtcacccttactcttctacttttcctgatatatcacaatcactcttactccacacactttgattytatttgttcatgtctctaccactgtaataattgagcatttcccccatacatcttatattaacttaatatgttttctattgctgcataacaaattaccaaaaatctaatggcttaaaatcataccgatgtattagttcacagttttgtaggtcagaaatccaggggcttcacctggattctctgtttaaggtcttgaaaggctgaagtcaatgtgtctgctgggcagtggaagctctggagaaggatctgcttccaggttcattcagattgttggcagaaaccggttccttaggg

SEQ ID NO: 19676 - DNA, 598 bp, Bovine  MMBT13778
  misc_feature (1)..(17): n is any nucleotide
nnnnnnnnnnnnnnnnncatgtcacttaggaactaaacacttggtgtttggcaaggggagatattttaaggcttgagagttaataggtgaactgtgaatatatatattttttcatacactgggatatttttgtcttkgaagcaaattaaagccttgtcttccaaggcagggagttatgtgcaacatactaggattatcttggtatatttttcaaaatctttttctgtctagatattttgatagatgatgagagatattcatrttactttaaatatgttcatcgattggaagatagttgasagggcagagaatgttcatataagtcagagaattaagaagcataggcatgcaagatgtttattactttataataataaccccccttgtataacccycctttatacaattgcktattatctctccctcatatttattattacacttatttagctaatgcttcaacttttgttggtttcaccagatttaaattttcatacagtcagggactatttatatttttcaccattacattcctggcccataacagatacttgaactatatagctgctgatgaatacaagctaagaatacagacatc

SEQ ID NO: 19677 - DNA, 598 bp, Bovine  MMBT06634
  misc_feature (1)..(69): n is any nucleotide
nnnnnnnnnnnnnnnnnnnnnnnnnnnnnnnnnnnnnnnnnnnnnnnnnnnnnnnnnnnnnnnnnnnnnaactttgtttacatggaatgctgggtttgagaaatgcttgatttattactgtgaaaaagtattcatcctaatacagatgtagaattactgctagaaatcagcaatgtggagaagctttaaaagcacaggggagatcttgtgcatagctctttaaggtaagtgttaatgttctataatattaacacacgcttcacactgctgtcctgatgactctccgtaaagaattacttkattcattcctctaaaactcttgtttatgatttacttttattgcctaatactttataaattataattcacttctttgcacatttgaagttgcttttaaagataaatagaatactataaatgttatatattttatacatattaaaacgcaatgaaaataccagaagtatgaaatgtaaatatatttatttcatttttaattgttttggtgggatgtttgtaaaatgtaaattaatatctgtgacaacaacttgtcactttgttctttaagttcattaatgtactactaataaaactgtac

SEQ ID NO: 19678 - DNA, 600 bp, Bovine  MMBT02930
cagatggatggtaactaaagtcacacatgctgtttcctcagatccataatccatgatatttaagggccactccataagccaaaatacctatacagtcagcaaaccaaaggaggaaacacacttctggattctatgagttcaagatgttctttcaccttataaaatccgatcattcccacagaaattttccttttggtctaaagctttctttactaggtattagcctgaggtaaaaatgtttagaaagaggaagcacagatgaaatatagttagctactgtgtgatttaagaaatggaaargaaaaataaaacactagggattaatgttcagataataaaataactgtataactctgtgttatctttaacctaaactctcctcctataatttcaaggtaaaagagctccactagtacagaatttttaatgattcactggtgtgtaatttaagaatttggagaggggtattttcagtgatgaactactgcatttgatgcttttaacttgtcttttatcaattactaaattttaaaactttgttaaaaaatcataacatttaacagcaattttttcttctaaaggaaaaagaaaaaagaaagc

SEQ ID NO: 19679 - DNA, 600 bp, Bovine  MMBT12662
cagccttgcccctgaaggttcagtgagatgctggctgtcgacccctttgcacgcagccgggcacagagtaagcacaaggtctggtgtccctgccagtataacccgtgtccttgcctgtgggacagactcgagggtaggaggggcgacaaggaggacttcagaaagccagaacaaagcatgcttggtttttcaccttggtagaagagtccgttcrgtggcttcatatattacttatttctttttgcaggatgctttaagggacacagaggagagacttttaagaactacagagctgagatygtcctgctgttggctctggttattttctatgtaacactcatcattttcacttgcgtaagtatcttttgcaaacatctctcattattaaaagatcacctggggcaccaatcttaatgtgttttgtagatggtgcgaatcatttaataatagcaagggacctgttctcagaaccctggccttactgaggtccccagacagtgagactctctactggaggctcccagcttgttctccatctggtggttctgcatagagacgtgcgtggagaaagtgaatcaggaggtgaagaaagtttgtgaa

SEQ ID NO: 19680 - DNA, 600 bp, Bovine  MMBT01237
atccactgatggcccaaagcaataaacataaacttcccttgagaaaatacttgtggagagaacccagattctagttataacctcataaagcactgtattctctcatttcatagcttcacccacataccattttcagccagaatccacccccgggacctgggaatctccactggattccatgttcttggtgaagctgtgtcaaaaatgctttgccagtgggcccttcttcccttgaggctcatcaaatattgctagtagagagttttctggctttgaatatttcctttcctcaggtacccrggaataccgtgtaatttgtaaagataactggggtaatgaatgcgcactgtagtccgctcttcccagtagtaattggcgcacctttcatctcctggcaagcagagtggttgggattaggaccaaaaggcagctatcatctctctcatttcctgactcagacaaaaggcaaaaaaaggtgcctgtctgtgctgataggtgtctgatcaaagcagctgaaagctgtcagaagccagccagcctgagcagcctggctgctgctttctgcagccctgcctttgatcggccagccgtctaactgcg

SEQ ID NO: 19681 - DNA, 600 bp, Bovine  MMBT05596
ctgtaatctgggtccatgtcttgcctctttcatagtctatgagctccgtgagctggggcatgtctgatgcttctctgggaccccagggcccagacccaacttgcagcagaggccgccacacctggctgagtgactctcactgctggtcctgaacttgggcagcaccttcacaacccagctgggcactgtgctgcctctccaagttaatttcttttcctgtgtgtggtctctccattcattcattcattcattcatcctgctttgtgccagatgctatggtccccatcccctcttcttgaytccttgcactactagagaactcatccccaacccctgggcagcccagcagactatcttrcccataaacagtacttggcaaatattgattaacaatcagttgattaatggatgaacaagatattccatatagtggaatattactcagcaacaaaaagaaccaaagtgctaacacatgctacaacatgaataaaccttggaaacagtatgctaagttacagaggccagacacaaaaggtcataaatcatatgatatcatttatatgaaatgtccagaacaggcaaatttatatgaaatgtcca

SEQ ID NO: 19682 - DNA, 600 bp, Bovine  MMBT09228
agtctttcagtgatctgctggtttagcctagccagaaaggctgcccacctagaaagaaggcaagattcatgttgctcacatatcctatcaagaaaaacaaaaaaaatcagacttctttacacttacctccctgctctacctgcaattcttgcagctcctcttgtgataaagatgcacattctggagcgggctcacagctgtcactagctgcaccatgttcagaattcaccatctcgatatcagacccctagagaaaaagcgatcatcagttaattgtctatcagctacccaaagctagayttgactacctgtaaatgcttccattattaaaagtcccagatgctgctataatccaaagggaacagtatctattgcttttgttcaatttagtccataaaacctacagcagagaaacagcagaaaggagccacagatttagactctgaaaggagtcagtccagaagtcaaacactctaactgcactaaaaacccaagagtcaatctgaatcccagaggatttctacatttagctatttctattaatttgcttctactcaacatttatggaactattctagccaaggcattttgctaggtgtc

SEQ ID NO: 19683 - DNA, 600 bp, Bovine  MMBT05946
gagtcctctccaagggcacaagaaaggaaataaccctataacgtattctgttgcataattagaaaatacacatagaaccggaaatagcaactatctcagttactatgataatatggagaaaagcatttttttattttgaaagaagcgaaatttggtacaatacagctgtctaccacaatcttgttttctagaaaaaaaagaatggaaataaaaatgactaataaatgtaagccaaattaaacaggtatatagtcacaagcaaaactgatactatgacttcctrctttgagcaagtctctygttgcattacgtcagtaacctttcccatacggagccattgaaagctaggaaagcggaggtcagcttggcgtgatgccccatcagtggggacaaatttaattcaacagacaactgggtgcctctggagatttacgagcggaacagaagaatgacatgattagactcatgcctagggaaatagcagtggattagactggggagacactgagggttcagagccacagtaatccaggcaagaggttacaagaggttacatgtgcgaagtcacagctccccacccaaaaaaaaaaattgtacatg

SEQ ID NO: 19684 - DNA, 600 bp, Bovine  MMBT01169
gtacacatctgatattcaaatayatgaatcaagaatctggagggtttcctattgcccaccagctggcaggaccacttaaagctgctaagtgttccatccaaagttgcaagccaaaaaggaaacggactgtaaccaaaggcatggcttctcagctgacaattatgaagggaagagagaaatttggtctgtctaaacatctggcacgagcaaacatctggtctagttttccctcaatatgtactaatcatgtgtaccagagagaaataacaaacaaaaaaaatggaaagcggaacattaacmttttcattcatttctagggaggaaagaaaataaccccttcacccatgaggtcagagtagttaatgaggactttgaatcccagggattcaaactcgtttctctagttctggcaaaatcttacagtgttggcttctgagtgggcttcccagcactgggctttcccatgtgggaggggagacagtaccatgtcctttccctgtgggaaaacagaactacttgaactggctgcaaactgtactccggctccctttatttaggcagagatgctgtcaatgaacagtgtgaaatccttcagaatct

SEQ ID NO: 19685 - DNA, 600 bp, Bovine  MMBT01152
gtggsctcgtaacaatggttacacgaggtgggaagtagaagagggaagagtttggggagcagataagttgctctagtgacaggaatgaaaaagaagccaggggtctggcttctggaaggtgcctcttttaagggccgtctaagtcctttgcaggctcccactaatgccgtcttttttcctcttctttttgcatccagcatgatctacactttagtgagctcttaactcsaagaccacgcacatycacagagactgagatgggagaggcccgaggctgtgcagtccatcctgctggtgacrggagcagggaccagtgtggggatgtgacagacagagatgggcagatactcggaattgggagccggaagcaggcagcagccagcgcccgagccagcccgctgtcacacgtgtggtcgccctgtgtaccagtcttccgcgtttgcaccccacacttggcctgtagatcccttctgggcagcaggggcatgtgaggtgatgaaacacgaaacctcttctgaacgagaattgctgcttcctgaatcccctttattgaaaggctccctgaagttcatgctgcgttcctggtctgtgggtgtgatg

SEQ ID NO: 19686 - DNA, 600 bp, Bovine  MMBT06901
ttcatttttaacatatgcaatggccaagtcctcttatagattaaggactcagtgaattataggacaccttttccaaaggtccccagagaagggagaattctatccctttggcgaaagatcttataggaggcaaaggaaggcataaagacaaaagtctttttctaagacaaaagatcacataggagattgtaattccccttagaagaatcctttctaacatgatggacccatcagtcagcaacattttggggcactctactgagtacaaggtacaattttgtacagaaaaatggacgacarcattctagaaagcaacacttggaaaatgtaacaaatgcattaagtcccttatataggagcatttgtgttgagaactttcaaagatgcaaatgtgtgttcttcagtgtcaggtgggagtgaacttgcagcttgccctctgtctcctactcctgatgacctttcagctccaccatgtcccacctcctctctgtcctccagtcagtaactcttcttgtctgttcactcgatgccagcccctgtatgccagctgttgtacttttcaaggtactgaagattgaaaattctttattttctgtgtgt

SEQ ID NO: 19687 - DNA, 600 bp, Bovine  MMBT18915
atatccagtagcatattgggcacttactgacctggggagttcttctttcagtatcccatccattcagtatttctagactctgaaacccctggggcaatagatgggaatttggataagccttgcacagggatggaagcatgaagagagatcctctccttctgaccaagggggaatcaagcaggtcaatgggcaatcaaaagaccgttttcccctcaaacaggcagtgagggttcccccagcatggtgacattggaratgtgtgcacttggtcgggtttctcagttctcccatgctttccargtctttccaggccatgagaaccatgggacctagaaccactttaactaagccgcatgaagttcttccttccggagaccactggccttgattctggccaaggtgctgagagatcycagagcctcctgtggtgggcaaagacttgctgctagcagctggtcccacgatggagagcttcatctcttcagtactccttgagtaacatgtctaaatgaaaaactccctcgggtttaagctctgawtgtcttaatctgtcttaatgtcttaatccttcattttgaaggacattatttttttggtcta

SEQ ID NO: 19688 - DNA, 600 bp, Bovine  MMBT18914
taagccttgcacagggatggaagcatgaagagagatcctctccttctgaccaagggggaatcaagcaggtcaatgggcaatcaaaagaccgttttcccctcaaacaggcagtgagggttcccccagcatggtgacattggaratgtgtgcacttggtcgggtttctcagttctcccatgctttccargtctttccaggccatgagaaccatgggacctagaaccactttaactaagccgcatgaagttcttccttccggagaccactggccttgattctggccaaggtgctgagagatcycagagcctcctgtggtgggcaaagacttgctgctagcagctggtcccacgatggagagcttcatctcttcagtactccttgagtaacatgtctaaatgaaaaactccctcgggtttaagctctgawtgtcttaatctgtcttaatgtcttaatccttcattttgaaggacattatttttttggtctataattataattatagattggcccattattcctcctagagtactttggaaaataatgttattccactgtattctggcttctgtggtttttgttgcaaaatctgccatcatttgt

SEQ ID NO: 19689 - DNA, 600 bp, Bovine  MMBT22889
aacatgctcaggaggttaaggaacttgtccaaggtcccaagcttagggagaattgaaacccaaggcaccctgagcatgaaattcatcctagtccatccaggatacctaactgcctctcwcaggttctacactattgaagatatcttgacatctttaggactttgactagtttattcagagtgaagacaaccaaaacacttttatcctgactctccttcctgtgggggaacctaggtgatcgtggccaccaatgtagcagaaacctccatcacaatcagcgggatcgtgtatgtgattgaytgtggcttcgtgaagctccgggcctacaaccccaggacagctatcgagtgcttggtggtggtcccagtgtcccaggcatcagccaaccagcgagcaggacgcggtggccgcagccgttcagggaaatgttaccgcctttatacaggtaaatgtggcttttttctcttttaggggttttgcctttctcctagtcagcctgggcatcagagaatattacaggtatctacccctattaagcagaacttaagacccagatcttcctcacaaggccttctgtaatctgacccccaccaccttcct

SEQ ID NO: 19690 - DNA, 598 bp, Bovine  MMBT14996
  misc_feature (1)..(150): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagaacaccagaggaggggccacagagatggagaccagagattcaggccttggctgcattcccaaggagcctgaggcatccaggtaaggaaaagtccagatggtcccaggcagcagaatagatacttaagacccctcctcaccttctkctggaggccctgggggactctgtgagtctccgggcacaagtctcccagtgagttcactggccccatcatggagaactgatctgatttccggaagatgcctgcctgccctttgtccccctgagcctctgggaaggctctggattcagctgaattaagaggcaggagatgatcaaggtgttgggtgcttgggcaggagtctccatggtaacagagccatctggctttcttgcctggcaccaggccttgtgacttcatgatggaatcttctctgccaggcacagaggtttcccagggggaa

SEQ ID NO: 19691 - DNA, 600 bp, Bovine  MMBT00743
cgttagtaacttttaaagaaggacgttgtttgtgtgtgctctggttagctttctgtgtagcccttcttgtagatgtttacttgaccatttcacaagggtaaccactaacacgtaaagaaaaaggaccttctactgccagtgttactatgtccaagttgttatcctctcaattcagtgttgatgaaatccaaatttagtctcgtttttgttttagaaactctctagatatttagaaataagtagaatggagctttctctcaagttttccaaatattaatgaaaacatcctgttactcataraactataggtgtatcttgaaccaattttatatcagtcttttattttgaatgttcatagctttgactttggcacagactacaagaaatacactttataagtctcttgctcccaagtctctaaattgcacattctgaaaaactggctatttccgcgcagaacatagagattgaatgcaaggctataattcactttcaggttttctgctgatgacataaaccaccagagctcgttggtttatgaacagcaaccggacacagagattgaattatggcatgtgtcggtgatgagagataaagaat

SEQ ID NO: 19692 - DNA, 600 bp, Bovine  MMBT04250
aaaacccaatgaagtcgtagtaattcctgtgggtcagatgttctggttgttatattagtttattacataacctgattattggtaattttttaagatactgagaaatagttattttacactttttgagaaaatttgatgctttggggagatttggcacttttcaagaggaggcatttgttgtrtcataaacattggatatctttgccattaaagggtgtcagagttcacaggtaatcacaagtcagactgttgaaaggaagaatggtactttttcagtcagtgcagtgatggtgtgagtcrgatctagatacagtttatttggtatgaatcacccagtccattggggcagaaaatcctggagaccaaggttaccaaaaaaaaggtagagagatgcaccttgttctaagtttggaaaagcctgttttatatggggtctgtatcaatcagatacagagaactggagaactgaaactgttaatgttgggagacagatatgaagaaagaaagacattctgtaaggaattatatcccataactgtggggctggcaagtcagaatccataaaacaggtagaaggaatccataaagcagaatccataa

SEQ ID NO: 19693 - DNA, 600 bp, Bovine  MMBT08961
gggatcttctacatttcagtcctctcgggcgaagcagttagttgtcttggcaaaggtcatgcaggtctatggtcacgtttgagaccaaacccacagatttaggtccacctatgctctgtatttctactgctgtgtgtcatcactgagccagcccaggagactctttggcctccctagttagtcaaggattagagaggcagtcttgacatttataaattctgttatatcactggtcatgtcaaaaagagattgtttgttgccaaatttgtgggatttgggaaaagattctgctgtcatggmagactggctagaaggacaggctcctctttcactcttacagaaaatctactcctgccccgaagcttgagattccatttcctttgctttgataaactacaagtggttttaaattgagtcataaatttctccaggccttttggagaccaagcccctgcctttgattccctcacctcctgcggcagtgaaacctgctggagacctactcacatcctttgtgcacatttaggctgggagtttgaaatttacaggccaagctttgcagcacgacctccactttttaatagcttgaaaaggaaccag

SEQ ID NO: 19694 - DNA, 600 bp, Bovine  MMBT01901
gtggagggcttatctgggcaaagtgatggtacactggtaaatagattgcatagttttgaatttgccagaaagcttcagcttctgtcttatgctacttggaccagtcaaggtatccctcctcagatggcaatactgcagcaatcgagttaaaaagaagaattaaaaaagaagaaaagaaaagccccttaagaaaagagagacactctttgatttcttcagtgctcagggttgctatttttaacttaagaggttggtgccggacactggggtataaacactaaatctaccttgatattcaargaacccatactgtcacaatctgtgtcaaaagaactttggttttgtgttcaaacctctctattgtttgaaagcttctgtgggagccttgctttagagctgcactctcaaaaagatacctgatttctaccaaaatctgaactggaaggtaattgctatttatattacctactgcctatcagacactgcaaagaccggctgtcactaaacgttaaccttacaacttactacttgacttccagtttgactttctgttttgttctgtataaccaacacacgccatttattccctaggaagaagct

SEQ ID NO: 19695 - DNA, 600 bp, Bovine  MMBT12486
attatttgaagacactgaaatgacttgtttaaataggatgacaaataaatcaccatttgataatttcatcaaatttaactcagtaattcaactacaaacttaataaaggtcttgctaaattgaccagatttatttttcccagaagccactgattcagtagtcctttggcttctagtggtcccaacactttaaaattcaaagttccttatgagtctttgtcagtatagtattatagctacatacaaccaagacagaattagctttaggactttgtaatagaatttaatctaatttttaagygctttaaataaattatatagtcatgtaatgtgaacatagtttcttttttgtgtgtgtttttgccattgtgtaagaaatcattccttttttcaattatgctttaaaaataaactacagcacatccacaaatgcctatttccatctttgatatatttatgtaggcataaaagtgaatgagtgaatcctactaacctaactatatggatctgccagcatttttagaacctgtcctgttgataataatgagagtggcatattttattagatgtagagttctgtgcttttaaaaaaatatcattt

SEQ ID NO: 19696 - DNA, 600 bp, Bovine  MMBT05869
ggactttgaaaaacctaaaacatggaccaataaatatactttctcacatggtaaagtggaattcacacccctacttctagtctatgatgtttttatggtatttttttcagctgtcatgtaattcatcaatgaaaatcattagcatctgaaaccacttagtgttcacaggatttttctgtataatttcaagttattaagatacataaacctaactgtggaacccatctacacaaaacccactcaccacacttcagaattttaaaagattctactttaaaatgaacaatacacaatggagargaaaatatctagaagtacaaataggawaaaatgagcagtgtggctttgaagattttatttcattgaatcccttcaaattctgaatttmctgtgaaaatggctgcatttttaaatactaagttaatgtaaaatatgcaaataaaactgtctaaagtcctcatcgcactatttgaaatattaattagtacttagaaagccaatgggtgggggaggaggactgcaaagcagttcacaggaagaagtgtcaagaaggaatttcatagagaaatgggtacttggagttcatagttcctttctctg

SEQ ID NO: 19697 - DNA, 600 bp, Bovine  MMBT07019
gaatatttaatgcctgaggagcaaggttatgaaatgtcaaaactactaagtgaaggatctaatttaagaggcagccagagagtctgcaatttaaatatttaaagatgatacagaaagtacaacactgaacaccaatctactccaaagatagcattttatatctcaggtttattctggaattcctcacaagtgtacaagtgatattataaacaaagacaagcaatgctgaaattacttgaagggaaaggaagggagatagaagtaccaggcaataaatgctctagtcaatggcttctcaarctgttcttcacaaaagagacctgactggacaaaatagaggtaaaaatagatttatcaaagtaatcaggtcctgaaaatggaatagtttgagacayagcatattccttgtaattaaaaactcacttcttcatcagcaygcacagtcactcaatcatgtgagactctttgtaaccccatggactgcagcctgccaggctcctctgtcaatgggattttccaggccagaaagcggagtgggtagccattcccttctccaggggatcttgccaacccagggattgaacccaggtctcctacatt

SEQ ID NO: 19698 - DNA, 600 bp, Bovine  MMBT19580
cattttaaaaaagaaaattgtttttcatgttcaaaggaataacctcaaggactctgcactcattcttaatttgctatttaacttatagcttccttggggaagcaatatgatagactatttttgtttatttatttatttattaatctatttatttatttttaaataagttttctattttatggatacccaaatgaatttggagaggaaaactgaaatgtccttccacctagaaaggtagaaaaacatccatactcctgtgactaaatactgacctaggtttaatggcttaaaactgttctkctgattatgttttgtttattcttatttttcaaagtgaaatattccaggaaatttaggctactatacatgacacattattttataytttaaaaatcaatattattttatattttaaaagtcagttgtgtctgtgttaatgtaaacaatgaattatgcttctcttttgttctttctttgaatccacggagagtgagacagtctgattcactcaggtggacagttcaaattaaaaatgyttttctaacattgtgtcttatacttttaaaatacaatttggttaaacaaatggcaggaggaagt

SEQ ID NO: 19699 - DNA, 600 bp, Bovine  MMBT13216
tgtaaattctcttctattgccactgaagaaaagagagaacataagaggagataccattaattaactaataatttcaaagcttaggttggagagcagatttcaccaactatattagcattgtactggtctgtttaaaaaccgggctaaagatagccagggctatcaaaatattattaaaactgtatttgatctatgaactttgagcaattatagatatagaggcagagaatatgtgttaattaacataaaacctctgattcaaagtcatgttcactccaacagaggctgtcatagaataastctcacacatcacatcagatcagccgataatataggagaaaaggaaataggaatctgagaacgattatgacagagacattcccttatcactaactagctaataatcttataaattatctagggaaacaggagtgatgttttgcagtgtatgcaaatacagagagaatttgtcaacagagaatttgtcaacaataccctttatatagttatattaaatacaaatatatatatatatatatatatatttccctcttaagctaacaatgcattaaattcacacagcacatgttattatttaaa

SEQ ID NO: 19700 - DNA, 598 bp, Bovine  MMBT06078
  misc_feature (1)..(6): n is any nucleotide
nnnnnnaattcctttagaagattaattttggctaagcagaccgtcattgtgtttcttgaatgaattcttgggatttatcaggctctgaaaaactgccaagatgaatcaaaggcagacttgtcatgggtcttggagaaggaatgggatttctggggctgctgtggatccagtagccaccccctccctcacacccttctccaactcagcacccttactggccagctgtactctcaaggtctctgttgcccaactcagagagtcaaatattttggcaaagaaggaaaacagaccccagaatcyagtggttaagccccacttattcttgacataattgcctgactccagagtcctttctgccaaagcacgtgagatgaaaatgtttacgcagatcaactgctgcagaagggttaggaaatacaggcatggtgcttgtgcttctgtgcaccaagtcaaaaaactcgagccagagattttgatgaggagcagccaggcgcatgccagctctcttggaaggataatggtcacaggatgcttcactgggcaagtcaagcacatggaatcctgtgtttgcattcatctacaaatgccaaaagaacat

SEQ ID NO: 19701 - DNA, 600 bp, Bovine  MMBT15395
aaattctcaaaaatgcccccacactgggttcaaatgctatgtctgcctccttccttcctttttctcctaaggcatccacagggtggtccctgacttactccatgcctccaggtctagaggaaatggcaaatgaaatcttaagttgtagtcatcagagaaggtaggctgaaactttggcaggtatcagtcaagcagctcccaccccatcttccccctgctgccaccaccactacccaaacaggaaggaaggagaggaagaaattccagggatctgccaaaacccagatcccaagttctcckgggatactgaggagtatatggaaaatttctgggtatatttccaaggttttctgaagagcctggaaacacatattctgatggcttggggtggcagacctgtagagctcaaagctacagcctggtatgctgtcactgacaatccccaggcctttctgctctctaccgcaattgcctcctagggcctacccactggcttaggcccaaggttactccctccacattcttgaccccctcctacagcactgtcaaaggccctggcctaaaaggccagtcagtggcaaggacagaagagccttttta

SEQ ID NO: 19702 - DNA, 601 bp, Bovine  MMBT02768
  misc_feature (1)..(1): n is any nucleotide
ncttttcaggagatgccaaagtgttttcctctgcagctgttttttaaacattgtgtgtatatttttaacaggaaatctactagggagcagggttgtatctttagtaaatctactactatggctttatgtgaccccaaacacataagaacatcaatgcatccactttccatccagtgagtaytgactgagcacctttgtgctgctgcatggaaacactgggaatacagcagtgaatggaaagagaacgttcctgagtcccagatcttggagtctaggggaagaaattttttttttctcatamgagcataagcttamaaataagatgaacaatgaggcatatgaggacaataaaactgccaaacataatacagcattgttaacaaactgaaattaattttcttagaaagtattgctatgaaacaaacagaaaaaagtcctaccagaactaataagtgaatttaacaaaattaatggtgacagggtcattgtatgaaagtttaatgcatttctgtataccaccaatgactaattggaaaatgtagtaaaaaaaagacaacttacagtataaggaaacaagtcatcaaatatcaagaagtaaatc

SEQ ID NO: 19703 - DNA, 448 bp, Bovine  MMBT18583
tgtctcyctccagctgaagttctcaaatgctttcctccccaccattcttacatactcctagatgttcaggtctttttttgtggaatcttaggttgcagatagcacccacttttaccactttgtcttcactaccatcccttgactgcctgctaggaagcagtatatataggctacttcatcccccatgaaatgtgtaagcgataagaaataagaagctgtgctttgctttcaagagaaaaggctgggagtgagctttctgcaaattccttacacttagtgagttaacttgacattccttgytttacgtgggctgaagctggcacgcagcaatgccagcatttcctctgctgctagcatgtaattaaatgctttgtgaagtatttggggacattcggttatgtgaaaaacatcacagaaatgaaggttgcctttgccttgtcttttaatc

SEQ ID NO: 19704 - DNA, 600 bp, Bovine  MMBT20380
tggacatgccctaaatatgtgtctgttacatggagtggggctggaaggttgaccagcaacaatggtgatcctctttattaccctgatcagttcaggtcttgcacaatcacaaacaccctatctggcaaacacagtcctatagataactgcacctacctccttgaaagctagttagtgaccctcaattataactcaaacatgtcttagagacctcagtcctcatgccagtgaacttatcagaaagtatgaagttcagccaagaaatctggtaaatgacattttctccatcttcttacacaycctgtatgttaagcattttatagtctggagccctgaataaaatcataactgacacactctttaattcagcactagttctgactgattatttcctgtatgtggggttactatattgattgtgtggatttaaaaaaaaaatcctatcacaatgtagctcttaggagattgtgaccaagttaaacacagatttttcttttcagatgaactgccaagccagtctcctcctactatatttatatgcctgacttctatgagcctgaatatagaattttacacttagtctagttgacattcactttg

SEQ ID NO: 19705 - DNA, 600 bp, Bovine  MMBT08324
tctgtccaaatatctcagttgtgaccccagagaaaggagaaggaggtttttgccagtttgaatgggttctgtctaccagagcctttctggrgcaagagtctggagcaaggtgtaaatgagtacagtataggcaattccttttctttcacctatcattgtatttcatatttatttatttttggtgctcgggcttttgctgtgagtgggggctattctgtagttgtggtgtgcgggcttctcatttcagtggcttcttttgtttcgagcaggggttctaggtgctcaggtttcagcagttcrcctgggcttagttgtcctgaggcatgtggatcttcctgaaccacggattgaacctgtgtcccctgccttggcaggcagattcttatccattggaccaccagggaagccctctttttaaatatatactttattgtttgtttattttaattttagttgttctgyatcttcctgctttgtgtgggctttctctagttatcgctagcaggcactactctttgttgtggtgctcargcttctcamtgctgtgacttttcttgttgtggagcacagactctaagtgctcggccttcagtagctgtg

SEQ ID NO: 19706 - DNA, 601 bp, Bovine  MMBT15465
  misc_feature (1)..(1): n is any nucleotide
ncagagtaagagctcaggttggtatgacctgaatcctgtgttaattccaatctctcaccctcctaggaatgtgacagctcttcagctgtaggtgttttattattctcaaattcttcaggaaaaagaaaaaagacagttccaagagtaatgtattttggagacacttttctaaattggaaagcgaggacacacagtgacagaaaatcttaaatttgcaagcatcccaagttttgtaaccaaatatttcacaaaagaaaagctattataaatattgcagcaagttaaactttctttcaggatrgttctgaattccatgcccatgaatatctaaaacctgggaactgcgaattrgtayccatatratgtgttaacagtcactgttcattctgtctcctgcttcactggtggaaaagattaatatatcattcagttaataccaagtataatttattyccgaagtggtatgtttcctttacaacatcaaatctggcagctctatgctgtgctgttctgtcagctggaataatgcctttaatgaacttgtctctggaatatcaaatgtgtaatctgctacatgacttgcagctctactgctcagacc

SEQ ID NO: 19707 - DNA, 600 bp, Bovine  MMBT11913
agcaaagcaattgcccacagatgggtcatattcaaggcgcattgttgttaaccggctgtagacagtctgtgtcaaaaccagaagacatgttcaaattccatgagcttatatggaatgatttactataacagtatttgcaagatatgcagtgcatggccggaaaagtccagctaaggcagtagttggttcagtcaatatgcaaactttgctgaattcctttgcacatatgccctggactgttcttaattttcagaaccagctttttctatccataaatttaagacctaaaattgtagctamaaagtttgacaccaaattcaaacagggatccatcccattgctttgttttgcctgttacaaattcactttctaccgaaatcatttgtgaagtaactcatttatatagactaacatttcataaatagacataaattagagcatttatattcttgaaaagtatcatgaaattatatcaaacttttgaaagggtcataacatatcagatttttgggaaagccacttgaattttcttcattgctcttcatatccccaggacctagtctgtgaattgtacataaaaggawaatgaaaatattgttg

SEQ ID NO: 19708 - DNA, 598 bp, Bovine  MMBT15830
  misc_feature (1)..(44): n is any nucleotide
nnnnnnnnnnnnnnnnnnnnnnnnnnnnnnnnnnnnnnnnnnnncctccaagcttcctctactcttggccccattcctgctatgctgagcttggaaaattcagaccgctttcctgggagcctccagcccccaccaaaaattattaytcygccccaccatccaccatggcccctgatgttctatttcttgtatcagccaccatcatacccaaggatatgtttttctacagcttcctgaagccctggctgggtgagtaactgtgagtgaaggggatgatcttgggggcccaggaaaaggttsttttgcttactccccatggctgtctctgctaggggatgggctcctgctgagtgctggtgacaagtggagcagccaccgtcgcctgctgacacctgccttccacttcgagattttgaagccctatatgaagattttcaacaagagcgcagacatcatgcacgtgagtctcttgaacccagggtcccagctggagcattgggaaagggggaatgggcctcaacacatatggtctggaatcctgattcagctggatggctttgggggggtcactgattttcctctctaagcctcaatttcc

SEQ ID NO: 19709 - DNA, 600 bp, Bovine  MMBT12138
ctttctgttaatctcatatccttttctccaggagagaggaaatcagcctttcaacagaatattttagaatttagttataaattcatctaactgcccaccattttagagtttagaagtgtgttttggtggagtttcaaaagaaacaaggatagctgatggtaagattggtaaagctctggacaagacagctataagtaatttttcaagaatgtcatctattatgaggataacataatagatgtcatgttattctccccaaagacaccaatttcacaccactggagagcatttttcacttcycttctgacatctccaggcactcagttgcaacacatagaaagcagtgctttgaaggataaaaaggcatattcagcccgcaattttggcttgctttccctattatttttcctcagaattatgtaatctttgggttgttccagaaaataattaaaatgatcatcatctgtataggatcctgtccaatatgcttaaagatttttaatcacacttcaggtcgtgtttgagttttgcatgcaacctccactgggctagaaaaatgtaagcactaagggatggcaatggyyttcttatctaacatca

SEQ ID NO: 19710 - DNA, 600 bp, Bovine  MMBT08326; identical to SEQ ID NO: 4848

SEQ ID NO: 19711 - DNA, 600 bp, Bovine  MMBT01079
taacagactaaagataaaggagtcctctgtgcttcccacctcaggggcaggaagaagagcagaaatgcttcaagaaggcttatgcagatatgtcttgaaacagacttggaaagatcartgattcagaatgaggtaagcaaacttgttgaggcaagtcccattcaaatgttcaaggcagtaaagtggtctgaggtgtccacakaagtactaagaacaataattaaacagaatttcgcaatcttttccaaaccttttgctgccatgggacttttccttcaaacaagcttctgtcggagtccraatacaaacccatgtgaaagcaggttgctctagtttcagaagggtcggggaggggttgggcacggttaaaaaaaaaaaaagtctattaataaaattagaaaattgtaaatcatcatgggagaaaacctttgaattcatatttatatcatagtctaaagaaacactgatcagaaagtgaagttccccaaaccgacacttcattagtttttaaagtgaagagcttttggattttaaggacatttttacttaaggctggagaaggaaatggcaacccactccagtactcttgcctggaaaatc

SEQ ID NO: 19712 - DNA, 600 bp, Bovine  MMBT22281
gtgtcatgacttcacttccttcttccatttccctatttaaagtatcctttgagtctttagtataaactgaactgtatgtataaaatcctgaagtaaacatggaagatatacttcatttgttggctgataaaaggtggccagaaacaaggaatcgtggttaatttgatttctggttgaataagtcttaaagttctagatcgcacttaccatacgtggcctatccaatctgtgtccagcagcgagtagtaataggtccagaagcagtaggtagagactacaatggatctccttaatggctcyggttcaggaagtttattgtgggcaataaaaagctattgaaaagatgttgggagctagggtaagattggtactttagaaatacggctgtgtaaatagagattaagaagacagtggctaaaaggaaaagagactagttctagtgtgaggtaatgatcctgaaatactttggtccagggcactggactggtagtgagagaacaggtttacattagcagcaactcagttcatttccttgataytatttccaaagtgtaccatatttacagtcttgtatgctgctgttggtactcggttttaggt

SEQ ID NO: 19713 - DNA, 598 bp, Bovine  MMBT16199
  misc_feature (1)..(43): n is any nucleotide
nnnnnnnnnnnnnnnnnnnnnnnnnnnnnnnnnnnnnnnnnnntctacctagagaattcccagtgcattaattatagagtcaggacagtccactctgtcagtgagacgcatgaacctaaatatatatgaaatttgggtttaaaaactgtcatttttcacaatgcctcctaaagaatggaggtcttatcagtttagcctcttcacagcctagtcacagaattaaatgcttgtaagttttatttggtcatgaacaacatgcacactctttaaaggagaggatatgagccttgaatgaagaayataatgaagcttcccaccaaagtttctcattgatttgctagcttctaacatatgtgggcttcatcacttacctttgtagtacttaaataagtttctctgctacagagacaaggaaatccayagcataggattcaataacccatgagagatgaggtctaaagaattaaatgtggttttgctttttgtagctacagctccaatagatgaggggcagaagagtgagcagaaaccagaggtgttcaggactttatgtaggatagattaaaataaggagtctctgaaggaaatcttgatcaga

SEQ ID NO: 19714 - DNA, 600 bp, Bovine  MMBT04671
gtttccgaagtgatgccctctcatgctggtggtaccagggtgggcgagctagggcagccctcggtggctccgtctgcttatgcagttgtcttttcccctgcgttcaaggaagttctgtgttctctcaactttgcctcacttggttccccttcctgatgaccaggggcctctgcctgctgtgggctaggcagaaaccccagttttgtttttagtttccaggggctgtaggactagctttgaccagagtggggacatggccttcccttagaggctagagggacgggcctgacggggggtgcrtcccgtctctgtgatctgcctccccgagggccctgtctgggttcccagcacgaccgtcttcctcctgtattgctgccaaccagggaggcacagcactgcagcctgagaggggtcttagaggccatgagctcagtcctgtgctttcctgggattccctcctgtgacggagagctcactgcctcacagcacggcccgtggtattatcagacaggccctgtccccgtgccagcgtttcaccgcaccccaaatccttctgtctcttcccaccacactttagggttttccaactcatgcctgctt

SEQ ID NO: 19715 - DNA, 600 bp, Bovine  MMBT16285
tgctgaactttctggaatccwtcagatgcatattctgcatctttgcaaataatttttctttttgaataaatccatcataattccttcttcatcagaataatccaattcattcttatgatctcagtagatgtcatttcctcctagaagagtttttgaaacttttcaaactagtttaagtgcccattctgtgcaagttattgtttattctttcatcttctcttcaagaccacactttccttgtggggtgggactgtgtcttcagaactatgtgtgtatccttatttctctaggaagagtgcratttaaaaaaaaaaagctgttgagtgaatgaaaaatgattacattaattaattcttgctggatagtgagtaagcaataaaccaatccaaatatgggggagaaaacattttaaagtaatatttggcataaggggagtgcgaaatgaaaacaaggatgtgatcataaatcttatactaactgaatcaaaccattagcgttctcacttgccaccagccaaaatacacagcaacagccacagctgccttttctttgaaatacaaaaataagaacagttttcactgcactggtttactgtactaa

SEQ ID NO: 19716 - DNA, 600 bp, Bovine  MMBT16446
tacaaaatgaacaatacatttggttcttgctctcatgggtacacatgtgttttacaaggacactggtgatatattttgctatacaaatcacaagaagtagtttacacacagagctcatgtttttatacatttctccccaaagggtattcatatttgataaatcactgattgaaatctgaggcaattaagttgtgatgaccttggcatactagtgaatgtaatttccattaagacagtgtcagtcctttattatggtctgcctgagtttaaaaaaaaaagccaagttcggttcacggcacrtttaatttcttatccttcaaatacacacagtattttaattcacactgatcaaaatctacctggcagccccttattaggccaagttgaatgccttgcttagaatttccaytttttaattgatataaaagctgttaatctcccaaaagggaaaacaagtatctaacattgcattgatatttatttcttttagtctcatgttagaatcatgaatagaaatttctgctatattctacattgctgtaatacaatattttaaaatattttggttataaaacactttaacaatatccaagtttatgg

SEQ ID NO: 19717 - DNA, 600 bp, Bovine  MMBT09107
tatgtgggaaagagaagagggttaatgagttccactcgagtgttaggcatgcctttcaaattggaacaaaaatcatcccagagtaatgaagacatcttttccacctggtggtcagactgcccgctgaagtgcagttctgatcctgttactgctcagctcagaggtcccctgtgaccccccactgcctgctgagtgaagagccaggggccaggccagccttccccgtgcgggatctcgcacacgtgtccaggcctcacatcactagcctgtgaaatggacctattctctagataccaagcygctcagtcccatcccagcctctgtgctgtcccttctctttgttccctgctagggactggactgtgtcttccggcatttccaggtcatagctctaatcccccctggtgacttatttggggacagagcctgagaagaggtaatgaaagttcaacggggtcatcaggccctcctctgatagggtctgtgtccttctagaaagagaagccttcgtgggacttgcctggtgtccctggtggttggggcttcacctcccaatgtgggggaggcgggtttgatgcctggtcagggacccaggagccc

SEQ ID NO: 19718 - DNA, 600 bp, Bovine  MMBT10198
tttctccagctctgcactcttgcttttgaacatgccacactgtattatgtctggcatattaaagcgaggccaaggactttttttgctctaaacgtttttaaaaggtctttataattattattttggttctggttagcaatgaatgaatgactggctggacatgcttgggaattcttgctgagtgaggtcacctaacctcaaaaagaatataaatgggagctgaacaaattcttaatttaatgcttaatgaggctgacatagtttttgtgccctttgtgagtttttgtgtattttaggacwagaatattttattctccaagtctctaacagttttgtcagcccctgaaaaggcttgaggtcataggtactatgttgaaagtgcttacagataaagacttctttctcagggcacagtgggtgaagaggtgaagtgagaagcatttttttttttttctgacctcatttgagtgcctagatccagccacacctgaagccactaacccctgaccttttcagatagataagtcactccatccactctcyttttttaaaaaamcccacatccagagtattttattaagtcaaacaacaagagtgatc

SEQ ID NO: 19719 - DNA, 600 bp, Bovine  MMBT20822
gccgactctttgcaacaccatgggctgtagcctgccagactcctctatctgtggaattttcccagcaagaatactggagtgggttgccatgcccttctccagggcatcttccccacccagggatcgaactcatgtctatgcattggcagtcatattctttaccactgagctacctgggaagccccacacagttgatgagcacagcttaaagcaattgtcaggacatagcaaaggtacataagattgggttttataattctaaaaataataattctayacctgatggaaatgtaagtcgtyataaaactaatccctgtatttctaggaagtactgctcattcttcacatctaaggctcytgagttcaaacccrgattaacagtcactgcacaaactgtctgtaaaaatcagtgttcacgctgagaacagaacgcatgattagatcagtgaggccgtgatccagaagacagctgatgtgctatttttaaaacttctcactggtgtaaatcagctatcctccaatcaaattgaaaaaccagaaacttctcactgttaaaaataatccacattttgcagatattccttagaaggattatctcag

SEQ ID NO: 19720 - DNA, 600 bp, Bovine  MMBT18366
ctgaacggggccctgaaagtggcacaaaattggctgcctcacattcagggtcaccaaaatggtgtgagtgagagaagcaagcagggaaaggaaagggaaacttgtcaactccatgatggaggtacgagtctgcagggcagcaagagcacgtgccccccaggacacaccttccctgcctccccacctttcgagttctgcccattttaggctgtgccacaaagctgaatagtagaaggaacgatgctgccactgtgttgccatggcacgtgggcacttctctctaagcagaggatccagctrtggactgaacactctgctggctctgggcagtgggaagagctattctagagaaaggtctttggtatcaatttcctagtgagacaggcagcctctcaagtatagaaggcagggatgacttacactgctctgtataaatgtctgatgcttctgagattaaaagcattctgcccaggcacccgagagtcagaccctctctcatcttgttaaatggcagcaaaaactagcttggtagaaggggccaagggaaggagctggaaggcctaggcacaacatacctatagaaggttatcccaagagtgt

SEQ ID NO: 19721 - DNA, 600 bp, Bovine  MMBT08082
aaggctgattctctccacatttgatgaaaaccaagttggctcatatggccctgtagtttcaggctcatgctgctgttttgcagcctgactccttttgtttccccttccttccaagttattagggcaactatttgccaacctgatgccttaattcgccaacctgatgccttaattctaggatagtttcttatccacattctcagactccttgttactttctcttgatcatttctgcctccctagctatgttttgcatgttgaatgtagggggagtcttggaggtgaaatccataccagaayattcaagtaagttatccccaaatcctaaagcccttgggaaccatctgtccaagaagccatcatctcctcttcccaggtcccagatgagcaaagaagactgagggtgggagcttctactgaggtggaagggagcaaccgcagagaagggttgagaacctggagaaagacaaaggtgctttccatttcttaatctcttctttcygtttttaaattcattcttactggctgtccagttcattctttcatwtatttcctgagatccagagatgctaataatccttttaagtagggtttttctaa

SEQ ID NO: 19722 - DNA, 600 bp, Bovine  MMBT08299
agctaatttcatgaaactttcatttcggatgcccatatagtctgtaatgatatatgctctgtggaaacaaacacacaagacattgtccagactcagagaaccatacagtcaaagctttctggttcagcaacactcaaaagggaatttccccccttytaacaaactttcttgcttttgtctcaccagatgcgcttataaatctgaaaggctaggaggagctctgagggtgtctgggtcagttccaattagatttgaaaactgactgtggctacaccaattaccatgtgcctttcatttttkcgctgtaaggactgacaacagcttttggaaaatcaaacagaaatactcagcaaaggcatcattccatgctcactcaagtatgaggagaacagaaacaattcctgaattagwgtaactagaaaggaagagaagagctcactttcctccagttctgtcttctcaaagtcagaactattgaaaagatrctgggagtaagttttaagtataatgtcatatctgaaaaatgttcagaagaaagtcaagatttgggaaaaatttccacrtagggaagcgatgtaaaattttactcaaatacatgtg

SEQ ID NO: 19723 - DNA, 580 bp, Bovine  MMBT11409
gccttcttttcaccttctggtggctctcagaggttagcagctcttccaaacatgcctccctacctttcactgctagcatttaaaatgtggggttttgtttaaaggtagaaatttcattacaagcacaccataagcaaataattctgcctgatggcttgctgaacttctttgctccaccaaaaaacttacctttcacaattagatctataggctccttgtgtttcttttttatattaaaaatgtgtggctcactgaaagcagtccgttgtggaggctcctcagaaggtccacttttggaayggtccttgggaaaacaaatccttttgtatgctgcctgaagttcttggaccgcatcaagtgtttccttttttttgatctccaaaggtatgaatttggtagattttggtttctgatgtttatttctgaagacatttatggaagtacctggaactttattctataaacaaaaataaatttaattaaatttaactgtataaaactaggtaataaatttggtaataaattaataaaattatatccactaaatatattttacaaagtactttactgtataagacat

SEQ ID NO: 19724 - DNA, 600 bp, Bovine  MMBT01050
tcagaggatctctctttattctggaatatcaacacatttgttttatatttcaagcttaatctgttatagttaactatagacctgatttttcctgaatttagggataataatatcttgtcctctctgctgtcacgatagcaaagaccattttatacacagttttggttagcttctagtcggctttgtcaaatttagaaccacttgaacactgtggtttctaaatttagtcagagcctctgagctttaagttccgtttggcactggctgaacagaagctgctgctttgaaaaaaaaattccygtggtagtagtggggtcgagaygtgtgcacagcacagacctcctcttatttaaaagaaatacattcacttttatttgaaagttgggagctccaaggggataaataataaaatatgaaactttaaaaaatgggtcatattttagaacagctctcaagcagaattgggctcttgggtttagggcatggcwttctaaaaaagaatgaaagcaagcaagaagagggcctattttagtcgctttaaaacggacttgctttaacttggctctggagtagagcaaaatcagtccattaattgccaag

SEQ ID NO: 19725 - DNA, 600 bp, Bovine  MMBT11335
ccacagcactgagatgatgtagaaatgcgaaaaatacctgccaagggaaaacaggttagataatgatcaaagcagatccacttgaagctattatgctagaagactattcttttccctcatgctgcaagcatagttttgcttttttaatagaacctgaatcctacagatgttcagatttttgaaatttcctttcagatgataggactggttaactcataggaaaaaggtttcctgaggttaataagaacatgaatggccttgttaaatttagattaaagttaacgatctgtcttatcttcrggtaacaaaattgggctcaaattcaaaaatagagggccccagggcctgacagggagagcctagactgtgctaccacaagccaaacctgtggaagatttctaaatctcaagtaatattgctgcaatagccatacaacttacacaagatttgcacaatcacatgctcatagggctgcaagaaaccttaaataggtcttctgatttagtgtctttctaaattgtgtcgacctaaattacttctatgataacatgacaaataagaactcataaaactagctatcaactcctgatgggtacagtc

SEQ ID NO: 19726 - DNA, 600 bp, Bovine  MMBT19000
atgaagccaggacacagagtttctggcccctcaacaaattaaaagactcattcttgaaaggcagtcttttaaaaacctgaatggtcttttgaaagagttcccttgaaaatttaggtcagatcctttttactttctggcttaaaacctactaagcatttcccatctactcagatacrtgtgtttttctatcaacgcagaatcattctgtcctgatctgtgtagctatgtatgttttttgccccccatcaaagtcagttttaaggatctggagaaactgaagcacctacttcttgtccttcyctgccactagctgtgtagtatttcatccagtaatgaaaaaccacagctaattgatgcgtgaagttgttattgttcaataatatgaactaacctaacagctttgtgactgctccacatggatgtgtcctgggacaatgtgagtttacaagtggtttcacagtagtaaccttgaacattatgcagtttgcctcttcagactttcccacctaacaaagttggaaacatgcagaccagagaagtattaaggagcaggagctagttggggtggcgggcaatctgtgaaggaggaagggctgataa

SEQ ID NO: 19727 - DNA, 587 bp, Bovine  MMBT18999
cagaccctcccggaagctggcttgagcttgtcgcagactgtgaggaaccaggattccaaaccatttcaaagggttctggggagctggggaggagtctggctctggggtccttgggagacccttgcgcctgtgcagagctgcctcgcgggatcccacctcctctggagtctgggtgccggctctcaccatccagaacttctggagtccgtcctgagcctcgctggtgccgacgcggacctggggctccatgtgggacgcatactgcaggggccctactgaattggcacccatggcatagcrcgctttggagagcgagagccagccctcctccacccgggcgtttagccaggaaatctttcttaacactccttgttattctttggaactttgcattcagatgggtatatctttccttttctcctttgccttttgcttttcttcttttctcagttattggtaaggcctcctcaggcaaccattttgcctttttgcagttctttttcttggagacggttttgatcactgcctcctctacaatgttatgaatctctgtccatagttcttcaggcactctatcagatctaatc

SEQ ID NO: 19728 - DNA, 600 bp, Bovine  MMBT15510
tttgccctccagtggttatcaacaacaggtctgactcctgatgggggcccygggggcgagaggcgggattcctacacaggcacacacactctattcttttttttcaaaatggcccacagcaccattccagaccttcctctttgtgctccaacgaaaccactgctggtgcagaaccattttgataaacagcccttcggagggctgtcctcaccggaatgcttactctgctaaatgaagccttctgcggttttagacctcacccatcagtgttctcacgcttttcctttttgtgtccaaggygaatcttccctcttacacacagaactgtgtgtccgtgtttgatgtgtcttgttttcctgttcaattccattttgcaaggaggcccgccttttgggatctgttgcacagtctcgggcttaatacccctgggacttaacacaagcaccttttctactgaagaacccaagccttgattggctttcttgggtacctctggctgtgagatgagggacctgaagtcacaggtcaccatggcttctgtggtcctgtagcctccttggtggatagtctggacagaggagcgtggaaaagtttctcgaa

SEQ ID NO: 19729 - DNA, 600 bp, Bovine  MMBT17002
aaccaggagattgaagaaaagattaaggaagaacaaagcttgctatctacctatgcactcccatcctgttacccaacaaaagatctggctaatacttacgacataaaaccatttccaaaaatcacagatactaaaaagacagaagatttgtactggagacagctgtcattaaaaccccaacttataccttactgtaacccagatcattacattccctatgaacatttaaatcagtataatgtgtaccaaaatcctgttagccttagtaagcctggtattttacaaagtaaaccagacctraaaacttttgattttgaacactttttaagtaagccagaacagttgaccttgaatatggaggatgatgaagaaacaaaacctatcctgggttgggattcctagagctggagtggccaaacctcaaacggacctgctggagcttaagaacgctttttcaaaaactggtgcacaaaaacgtttccataaatcagttctagaagactataaagacctcaggggataaagagcactcggggaagaaacatcaattctatggccataattcctattatttctataattgagctattcatccttccc

SEQ ID NO: 19730 - DNA, 600 bp, Bovine  MMBT11749
atggcaattgatgtcttctgtgtgggcttagataactctgattcagtggggagtgtccaacaaatgcactgcagcatatatgtcacttggttggtttctcagttgactattttgagcatatttatcataagcatttctaatacataattccaaaaagcttaatacaatctgtaggcctttttaccatcaatgartcacactgagcatgttcctttggcctttgatgtcagtgacagagagtgtgacttagtgctcttgtgactaattttgtgtaggttgcttctatatatggaacaacaygaataaatcactccctgtatttcagtggctttacataaatacataaacagtgcatcctggtttctgactgtgatagtttttaaagtgatggtaacatgtagaccagaatatatagcatctacacaagtttacttcttagttttccttgctcttagaactgctttcaggttgggataaggccctgcattttagagggccttgtgtatcatggaaacacacacagagtacatttatctaaaaaagtgtggttatttctgtcacctgggatgtaggactcatactggcacagttcatactgaa

SEQ ID NO: 19731 - DNA, 600 bp, Bovine  MMBT17901
caaattcatcagaattattccaccaaggtgaggccactgtcaacattcatttgagggccttctacacctacctctctctgggcttctatttcaaccacaatgatgtgactctggagggtgtggaccacttttttgtgcaaattggccaaggagaagttcaagggcatggagcttctcttgaaaatacaagaccagcgcagcagctgtgccctctttctggacatgcaaaagccatctcaagataagtggggtaaaacccaggacaccatggaagccatccttctcatggagaagaccccraaccaggccttttgaatctgcatggcctacgctctgcccgcacagacccccacctctgtgacttcctggagagccacttcctagacaaggaggtgaaattgatgagttaccacctgaccaacctccacaggctggctgctccccaggctggagtgggtgaatatctctttgaaarcaccctcaagcacgatcaggaacccctggggccctgtggcctttgaggagccccactaatatcagagcttgtgcctaaacccctctctgctgccactgggcagctatttaacacactggaaacct

SEQ ID NO: 19732 - DNA, 600 bp, Bovine  MMBT20304
atacagagaaaagtactgaattccttaacttaggagatctggttttcctttaattaacaattatcttttgattttccgactacctgccctttgtcgcaaaacatctgtataacctgggtccccctcctcacctcctctgagcagttctctcacggttacttgagatgctgtctcctgggcttgaagtcctaaaagttcccactggataaaacaactctcaactaaaacaaaacaaaaccctttagatcttctttgcaaatcaacaacatcccttgagtagtccgtgcaggctccccccarccccgatcctaccmcgtctgggcacggtgctcaagccagtcctggtycctctttgtccgaaatgactctctcacaggccagccagcccacaggacccctgacaggctggatggccaaactcattaggggaggctggggtgcrggcagagtgcattttgtagacatggagaaagcactgtcaactagatctggggagtccrtgaattgtggcagatttggggcaaagtggaatcaacagggacaaaaataatttaggagacgccctgctgggagctccaaagcttctaagaagatgctgcc

SEQ ID NO: 19733 - DNA, 600 bp, Bovine  MMBT09045
cttaatgatctgattcttttatgcaactatttacaaactctaaagtaaaataaaaatatatagctaaacagtgaaattaaaaaacaaggttgttctcaaataattttatcctaagtaatctattctttggagtagaaatactcacttaatacaatatgttatttatatcaatttttagttacactttgttggtgtggctttagcccaatttaaattcctgtgtgcctagaaattacaactattccttttaaaaagtactaagaatttataacagtttaatattcagactgacatcccacyccaattaaaggtatagaatttaatgatacctctttttgataatggaacttattaacaatgtgaagcattttcctttctcaactctatagttttattcagttatctatataacaattttataaactagtaagcaaagcaagcagcattactttttttaaataacatctttaattaaagtttttgcaaaggtaaaatattaaacttaaaataggtcttagtacatcaaaatactaagttctctaattgtattccaagatggtctttaaaacataatatcccgtatatcacagaagagcaacc

SEQ ID NO: 19734 - DNA, 601 bp, Bovine  MMBT04494
  misc_feature (1)..(1): n is any nucleotide
nttttcttctttttgataatctgtctttcaatattttctataataaacatgtattacttttgaaataaggaaaagaaatgaggcaagaaagcaagcaaacaagaagagacaaatgatacatggagtagaaaggatttctgggtgttctgtaaagttctgtaaatggcagtcaatacatcacaattgcagaggcagattcaagttttggaaaaaaaaaaaacagctatgtgtgcagtccccagaaaatggaccattgtggaggctagaagcccagttaaggaggctatgtggcattgtgggygatgaatgatgaattcttgaaaggaataggacatggagatggtgcaaagttagcagagtagcaaggagctatagcaggagaaaaacgtaacccagtataaataagaattacatttaagacttataaaataaaaaaaaacaaagaagtaatgtccaaatggaatgagtttcagcctraggccctcaactggctctcgatgttaagaaataaacaaacaaaacacacacacacacaagaagaaataaatggttatgtgttaagaatcttatagtgaaaattattcatgtctctggaaatgtt

SEQ ID NO: 19735 - DNA, 600 bp, Bovine  MMBT13095
tgatgaaacttcttgtctttaacaagtgtattgagcaaactacaattctactgtatatggagtgtgttaatagtgtataatttggcctgcagaccaaatgataaatatggaaatacaaacttctgaatttttatatgacacccagtggttttcatagtaattagctttgactaaaaattaaagataaggacactttcagctgttggtttccgatmtacaaatgtaagaagwttgttcacctgttttgaatgtctgtttaattctagatcaatgctattattcaactatgatcatcaaagstactgttatttggcaggccctcaacatttctttatccaggtttctgagtaattacattggctttcattaacatgatcaaataccagctccctgcagaaaaatttgagtctacacacaccagttttcacttggcaacttgttctgatwacaaaactgcccttcaaatctaaaagcaacagccaaatttcatggcattgaacaaaatgatttctagagtgaagtgacctgaagtgacgatcaatcctagctgaaattttttgaagagatgtcagaggtttttttgttgttgttattatttta

SEQ ID NO: 19736 - DNA, 600 bp, Bovine  MMBT00926
tatgactgtgaatccttgatgtcatgacttatgtgatgactcctaggagtcccctgcccatggggtaggagcagggctggacccmaaatcccttcttcttccatggagagaagagtgatctggcttctcccgggacctctgtgaatatttattctatttatggttcccaggaagtgtgtttgaaggaagcccctccctgggtactttctgccagtaatggagtagctccctcttttggacctggctcagggggctgggattttgatatattttctaataaaggactttgtctcgcctcckctcctgctttctgcgtcccaggcactctttgcctatctttgctcacccacccccaccttctgcccttggatgacagaacagccaggccaagccaagctttagcaacttttattttcatgggtgagagaatccctgccaccaggggcaagaagaagtgggagctgaggatcaactgttgggttctgtgcccaagacacgggctgctgcctgacgcccgctctctatacagtcattgacagcaaccccctcataggaggccccagccagagtcaaaggcagcttctgagcagccaggaattg

SEQ ID NO: 19737 - DNA, 600 bp, Bovine  MMBT11951
actaaaatccataaatcatacactttatgggtgaattttatggtatgtgaattatattttrataaagccatacaaatcctccctcccagggtaaatgaataatctcatttatatttaaataaaaacatgtgtatatccctggttgattggccaaaatgttaaacatagttatttctgggatggtagtgtttttaccttgttatggtggccttaggtaagtattctacaatgaacataacttttacaatacaactaaaaatcctattaaaaacaatcttggatacaaactgtaccaaaaasttaaaaatatctatctgcttttagacagaaaattatttttaaatgtctgtcaactacctcataacctagatgttctatcatgtattataaaatctgtaggttagtctgcattccttaagaatattcttaacaatttatatcagaagcactatttaacatgtttcacattttagtgttttgattcttctactgtaattctcagaaaaaaccttcagttttttgtcactcaaaaaattatccccatattgctgtatagtaattctacatataatagtaaaagtttatatttaacatctgcta

SEQ ID NO: 19738 - DNA, 600 bp, Bovine  MMBT12776
ttcaattattccaagcttatataccctcaattattttttcttcctagttcacaaatcttgatttttcttttaaataatgaaacaaacctgttcatactaataggatgataaatatttctcaaataaggatgtttaatctcatgtaagtgtttttcaaaagtacatttgcttctctttccttagggagtagagtttggcaaaggatgttgctgagatacggtttgaggcatcatctcatctgctaacagtctgctcctgatgacacatatttattccatttttcacatgtggctgaaactrtaccagcaaaatggggaactcagttttcctattttaaaaaaagataccatttggctgcatcatgaaacaatccaaatgtacttcagaagaaacagccaagatggatagttacatggaatcgctggagaacactgggaaataagtcatcagacatttcattgctttttttttctttctttctttttctgattaaccaaaatgccagttttagccaggctgcgtgaaggatattttacattccagtctcttctatcagaaactgttaaatgtggacagtaggtcaaatgtaccgaggctaca

SEQ ID NO: 19739 - DNA, 600 bp, Bovine  MMBT04805
gaaagaaagcccaaggatgtggaggtaagcaggccagcaactgtgaagtgagctaccaggtagggactaatagagattgtcttgttggggctgatgcccttcccgagagcctgaggaaagtgaggtaggggaaaggatgaaacaccagcgagaggctgtctgagttacagctctctaagtcacagagtggactgattttttaaaagaatattctctatgtttaggaatgagttttgaagcatgtaaaggatatttgaggggataatcttaagtaccaaaacatatttctatcrtcaatgraagtgaaaaaccttcagatagttttaaacagagcagttgaagagatgtgcacagtgcctggcacattgcaggtacttaaatgaacttttggacaaatagatgagaaatgtagagggccttatcacaatttttttttttcagtttttggtaggttgagaggagttatgtttatcagtatagagattctgtgtttgggggtwaaaaaagccaaagaccaagaatctgatgttttgcaaaactgtgtgctgaaattagcaagacttaatggagaaaatggagtgagggtgagaggtgaccact

SEQ ID NO: 19740 - DNA, 600 bp, Bovine  MMBT19085
ctagggggcattagcttgttgtaaatactttctacagattaagcagctttggggatgatttgtgatcctacatgctgaaattctaaaaggcactgtctcataatacaatgctaaaatccatatctgtataccattctttggggatcacagaaaataccatatatttctttgctttcstttcagcttaactcttgttaaatgtttccagaagaagagcatcactaaatcaaaaacaagcaccttctttaagcacccatggatgccttggtcttacaggttggtttctctccttgcaataakgcgggccacaaactgatggtggatcttcacttatcatttactaaggagtaagatagttcyggctgctgtagaaataatycctcaataaaaggcttataatttcactgttctcagtgatccaactggtgtgtcagtgcttcatatgatgtagaactatatagggagtgtcaaaaccaacaattcataaggcaaacaaaatgcarttctcttaaataacttggcagatgctttaatatgaagatctaataagatcctgtcactgaatttgacacagtaggagtgtagaccatagctgtttta

SEQ ID NO: 19741 - DNA, 585 bp, Bovine  MMBT19083
tgtgatcctacatgctgaaattctaaaaggcactgtctcataatacaatgctaaaatccatatctgtataccattctttggggatcacagaaaataccatatatttctttgctttcstttcagcttaactcttgttaaatgtttccagaagaagagcatcactaaatcaaaaacaagcaccttctttaagcacccatggatgccttggtcttacaggttggtttctctccttgcaataakgcgggccacaaactgatggtggatcttcacttatcatttactaaggagtaagatagttcyggctgctgtagaaataatycctcaataaaaggcttataatttcactgttctcagtgatccaactggtgtgtcagtgcttcatatgatgtagaactatatagggagtgtcaaaaccaacaattcataaggcaaacaaaatgcarttctcttaaataacttggcagatgctttaatatgaagatctaataagatcctgtcactgaatttgacacagtaggagtgtagaccatagctgttttaggaaaacagattttttttgggggaaaaaaaaagctatgtacttag

SEQ ID NO: 19742 - DNA, 442 bp, Bovine  MMBT01792
tccagaagaagagcatcactaaatcaaaaacaagcaccttctttaagcacccatggatgccttggtcttacaggttggtttctctccttgcaataakgcgggccacaaactgatggtggatcttcacttatcatttactaaggagtaagatagttcyggctgctgtagaaataatycctcaataaaaggcttataatttcactgttctcagtgatccaactggtgtgtcagtgcttcatatgatgtagaactatatagggagtgtcaaaaccaacaattcataaggcaaacaaaatgcarttctcttaaataacttggcagatgctttaatatgaagatctaataagatcctgtcactgaatttgacacagtaggagtgtagaccatagctgttttaggaaaacagattttttttgggggaaaaaaaaagctatgtacttag

SEQ ID NO: 19743 - DNA, 600 bp, Bovine  MMBT16976
ttgaagaactatcttactgaaataatcataatgcaataaatatagataggctacttttcctaatagtcattaagcaaaattagacaacccttaatatcatacaaaactgaaataaaggtttgaaaagtgatatacgacagggttttctcaattattacttttacagattgaaatcaaatttgaattaaactttcctgttcaccaatagacaagtgaaatgatgatttatgttgctgtcaaagcaaaaatatgacttcatatggcattttatcagtcatactactatgttaaagcaaactmcagttttagagatagtatggtcaactgaaagcttcaaatatataaaaatatctttggagagaatgtgcaaaactattttccaaatgaggaaagctggaaagaagtagcaatttattcactttcagagagtgagtaaagaaaaagagggagggggactctaatcaytgttaacaacatgacatgaggaggtcactttacaccactccaagttaactagattttaaccttgttccagtctgatgagcaaagcaagaaggtaattagtaatctaaatggtgactatatcatatcctgtgttca

SEQ ID NO: 19744 - DNA, 600 bp, Bovine  MMBT16233
tctaactgatgggcttccagaagcggacactctttgctatttagtctattaacatttataacaattcctcaaaatggatatcatcccattttacaaagaagggaactatggatcacagagattaaataaatttggccacaaatcatacatgtggcagagccacagcaaatgggaatgcctctgcatctcctktcttatcctttcttaacctttctggagcctccagtatgttttctgaagacttaaagagctttaattttctaattataaaagcaatttgttgttgttgtttagtcgctragtcgtgtttgactcttttctgaccctatggattacagcccaccatgctcctctgtccacggatttttgcacgcaagagtactggagtgggttgccattttcttctcaagggaatcttcctgacccaaggatagaacctacctctcctgcattggccggcaggttctttactactgagccaccagggaagccctataaaagcawtactggattataatagaaaatatgtaaagtaggagggacattttcacatagctgcagccgtacggtctgtataaktttgcrgctttttttcatgta

SEQ ID NO: 19745 - DNA, 600 bp, Bovine  MMBT05690
gacctgtgctcctctgagtgaaggaaagatattacatctgggtgtttgctcagcgcccctccagtcaggactcctgcttcagcctcatggaatatgtgtatttgaagtaggaaaacagagcttggaataagtatgaaaaatgagataggtagtgtggatgagacctaaatcctgcaacgagccccaccttggttcctgaaagccatggartcagaaatctcagcaggcctgaaggaatgttcacactgacagttatccactaagccctttttggaagtaggtcaatgggttcaagcagtkwcatgtatagaggagcctggctttcacttctaaagggtttattcagatttgaagttcatcggtgtcaaaagttgccccaagtaggggacctatttcagattaggcagaggaagctcaataaactttctaactctgtaaatttgactttgatagagaaattgatggcttcttcattcctctctggattcttgtcacatatttctggctgatagttctgaattctggccctcytataccctgggcattatttttgttgatagctttatagccaaacttgactttcatgattatcttctaaat

SEQ ID NO: 19746 - DNA, 600 bp, Bovine  MMBT13805
ttgtggatcttatctttttcctgaaaggcgtgggacagtgggacctaaaacaataatacctaccgtccgttgaggcaaaaaagagcagagagaaggtagcctagcaggaagccgatgaaaggcatcagggaggaggtggccagcaagtgtggtgtcatgacaaataagatgctcttgcccacgttgatggcggagagcactacaacagccacactgcacaraagcaggaggatgatccctccctgcgaataaggacaagaagaaaaggcagttagaagggtgtggggatatggaggagcrcagagagctagggaagcgctggtggataccgaaggtggaaaacattttaataaacatatttgaagtgaaagggagtacgcaagacctttatcatcatcttggatttcttacctgtagctgggcagcttgctggcggtcataggtctgattacctttttactgaaagctcagccagacatagtttctgatagacatctctgagtagcaggttttcagtgaagtgctgtgactctgaaggatgagactattcagccctccggcaaagtgggtattgtaaatgaaagttctctttacgcatcc

SEQ ID NO: 19747 - DNA, 600 bp, Bovine  MMBT16920
tgaaaggtgctctcttcttgctgaggttgtgaagctggtagactgggggtcttaaacatccactggccatcatcacccctggaagaaggactcaaaagagatggagctgaaaattaaacctctgaggacagccatgtcagaaactagccctactcttggactgttcagttatatctgctaataaattatttttattgcttaagctcatttgagtgttctgtgttgctttgggggttttggtttggtttggtttggttactttcagctaagggtccaaactcaccaatgcccaatagaaayaacaagccacaatatgagtggctcaaagaagatctcctgaacacactatggggttcttcgccctcactttccactgccaggcccaccctcagtgatggtccactcatgctgtgagtagcctacatcctgtgatatgtcagggagctctaatctgttcctttctctagccagaatggtttcttccttccgctgtcttgaattctcaaaaagcacactatggatmaagtcagtagttgggataagggtttctgggagcccttgggctcagagtccagggagtggaagggaagtgtagggtgg

SEQ ID NO: 19748 - DNA, 600 bp, Bovine  MMBT05445
aattgcaacctccaatacacttatacgtgaaactcctcccaatctgctttaattttctcattaagaaatatataaaatccaaactatactataatataaaaacagtataagttataagacatatcttgtttgctaaacagtstcatttaacatattgcatttttcatttacatatcttgttcatgaacataaccaaatctttgagtccagcagtggtatttacagagctctatagttttagcaatatcttggatggtactgcaattttcctgaaaaggagtgttacttctctacagtttraattgttttccccaaggaaatgtggttctttgtgaactgcatttgaaggaatgactgcctagagggaagaactctctacaataaagcaatttatatttattcyttgatggctaattctaaaaaaacattccttacattatttattataaatacatgggtatctattatttataatagaatggggcaaagttgcaatacgcaaaaaaatttaataatcaataaaatgccttaaggcaactttgttccttagaggtagaagggcaaaataatatttaatttatattttagtgtatrtccttc

SEQ ID NO: 19749 - DNA, 598 bp, Bovine  MMBT13300
  misc_feature (1)..(86): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnagtacccaaagagttaatgatactgatgatttatacataatatattaagaagtggtgctccttcttgatggaaatttatcactatttttgtctggtcagataggatcagcgtcattaggaaaagaacaaaagttttcctgaaggaactctccagagttgagaagagagggaaagaggaagtgtgtgtgtgttgrgacwgggagkggggagatgmataaagactgggggccacaatgarttgtgagatagaasgttctggagagactccataaagacactgacacaagagaactgttttgttattctgaaccttttagatgtacgagggaaaagaagggacgtgtgtaactagttaggcacatcagcggggaacgtgtcagatgttcacagctttagaaagggcgcygactgtgctctcgagtgtctgaaggcacacctttgcagtgagtgaaaatgctaatgtatggacawacttgacatcttcttacttgtttgttctgtcctttctgtgt

SEQ ID NO: 19750 - DNA, 600 bp, Bovine  MMBT13913; identical to SEQ ID NO: 4730

SEQ ID NO: 19751 - DNA, 600 bp, Bovine  MMBT10118
gcccataaaagataattccaaataattttgttaatattcataagatgagcaaatttatcccattttagggaatgaacataaatcaaaataacattaatggtgaaatgtaataaaaataaaacataagtaaagaaagcctgattaattatgcaaggattgtacacaattcaggattatccaaatcctctgatcccttattttgttcccttactccatctctgcatattttaatccccagcttaaaccgttatctcctttccaaagtatcattctgaactctgccctccttccagccagcamaatttgttcttttctctcaatatccaaaatacttgactgtgtctttcttaaggcactcaaaacatttggtgttgcactgtgggtatcagggttttagctctacctgaaccatctctttgtaccacggaacacctggaatgcttttcacaggcaacagctgttgagtgaacaattattctgttatcccctggcagttgatatttctattataaaaaagaaaaacagatttgtagctatgtttattgctacaccagccaatgcatattctagtgaaccaaacaatataattcattgactcag

SEQ ID NO: 19752 - DNA, 600 bp, Bovine  MMBT13822
cactaaaagtcactatcagaataaaacatgaagtgctctttggaatgcacccgtcatggctggaaatatgcttagccctcacaagttacaaaaactgccccatctcaaaccattgcactacagcatgaatcatcttgggtaatcttgtccaatcttcgcttgggtagtttctaactcaactggcagaacaaagaaagtcagtgaatctcaacaatggcacacacagaaccacatgaaagcttgaaagccatgtgcagtggtgttattgcaagtaagagaccaaaactgattcactaaaayaagctcttgggttccaaatgtaatagctacatgtgaagttacagaaccacattagggtgaggtgaatgactctgagattgtctttgctgtgaacactgctagtcagagcacacaagtagtctaagtggttttggagaaggggctttcttacaaatggactaataccattcattctttttggatacaaatcgaagcagcttaaaataaaaaatgagccttctagttcaagaaatcaaatgatcaaatagcttattcctatgtatggatttgaaggtatttaaagttaaaacaaactgtttt

SEQ ID NO: 19753 - DNA, 600 bp, Bovine  MMBT07567
cacacgcagaggcaaggttcagaaaagtgacgtgacttgagatgggatcctaacgggagtagtctgattccagagcctgttcagagaaccactccaccgtgttgacttaaatcctcaaactcctttgcggtccccaggctgtgtccctggcacacaaatgctcaatgcgctttccccagaggggacaatggaaggggggctccagggtccaggcttgggtctggctgggatcactctactggtattaaaccccatcccagttcccacagctgtaaactatgagatgtttccagcttcttyatgcccagaactagcggtgccacactcttgagtctggctcacagtgacccttctaaaccaggccctgggggctgccgtgaggacagagcagtaaagggatgcatgcctttttcccaaacctggcttggcaacaccctccccagcagcaggcacagtgggcgaccgtagcacaccccatagggtacccagcccttgggccctctgtgatctcccagccaattctcttgatgccccacccccacaggtgggaggatgggcaagggcagggcaaagaggctgccaagcaggtggcagttgagg

SEQ ID NO: 19754 - DNA, 600 bp, Bovine  MMBT01911
tatcacattaatactcacatgacttttatttcaccttattaaagctttctcagccttgtcactactgacatgtttgatccagtaattctttgctgtggggggacggtcctgggcactgcagggtgttttgaagaatccctggcctctaccaactaaatgtagcagcaaatctctctctcagttctaataacccaaaatgtctccagacattgctaaattacacctgttaagaaccactaatcaactagtattatcctataacttttaaatagcattagatgtttgagtttcattctaaayattaatagtaattattaaggttttatttttacctcaattttgaacttttctctgccagtggatgcagtatccaaaactgcattctctcagtatcctaaaccctttagtaggcattgttgagttatgaaaaccataaccaaatagctgcatgagtatgacagtccaggtcatactggaaagtgaaagtcaactccagcatggtccaggcacctgccctgtagttcagtttattgtactggcttatatgatctgatcctagctgtcctcctctgtgtgtgtgtgtgtgtgtgtgtgtgtgtg

SEQ ID NO: 19755 - DNA, 550 bp, Bovine  MMBT20656
tgaccrgccgtctcctctgacagaagatacactccaggacatcgtcctgctccgttagagccccagctttccgaacctggcactgaactgttcctcgccaggggcctgttggatggagacagggaatgaagtgtgacgggggctcagagcaacaggggtctccctggtggacgagggccttcaccatctcatggacttcgaggcacgctcttctggcccctctccrtgacatctgtttagaattccacaagcagaggcctctccacttctgctccgtttcttactaagttttgaaattgytgagcagattaaaggattctttttgacacttttatggttaaactttgtagagtttaaactgcctcccttaactgttcctgggaaagattagaaataatttggaactggattggatttgccattctgtaagctcttcttatctaccaggctaatagcagacactttcctccctacaacagcccaggaggaaggcttattatctgcgttttacagatgaaaagtgagggtcagataggcgaaagctcatatt

SEQ ID NO: 19756 - DNA, 600 bp, Bovine  MMBT05390
agaaagcaccttattcaaaggatgaacctatgaacccagatttacactagacttcactgattctgaacgcttaagcagttatcatttagagaaagaacaaaatcaaaccatcttgataattgaaagcttcaaagttttctgatataaataacacactaaaaaacacactcttctttttacaaaaactattttgagtagttttaattaattcagttccgtaatgaaaacaattggctgtcattcttcaaccactcttcgttgtggagatcagatatcctgttgtcacttgagtaattcttyccccccatttctttctgcttctctggatccaattttgatgtggatcatatctcttttttaaaaatatttttttctgactctggtcccaccctaattcctctcctaaagcttgtggctcagattgtaacagacaacgaagcttaatagaggtcacagaaaatcccagttctcactttgcaatgcaccttgcatttaaagtacagaatcacacaaacttcctaattaaaatttatcatgtgaatacatattcttcaaaggcaaaggggtgaaatggctttgaaacaggcctctggcagtggt

SEQ ID NO: 19757 - DNA, 536 bp, Bovine  MMBT18565
gaggggcaaaaaataagctgcccctttcatatcagaagagactttgaacctattggtataagtgtaccacattattatgttgtgtgtgtaaattattcttggcatcagggtaagttttacccaggcatggtatgtggaaasaccagggattttggtgtcagaaaggactgggctcaaatcctagttttatgatttactaagctggtgactttaggcaagttaattgtgttaattaaatgcttcrcgtttccccaacastaacatgggtgtggttcctgcctcatgggattgccgtgagtrgtaacagagcacaygggaagcctgaagactggcctgctacttggtgctttcctgctgcatgtcacttgcctcccgctgtcttatgcgtgtggtctcgtgagttttctcatctgcaaaatggggatatgctgaacacagctggaggtggagaacaccagctctgtagccagggaaacttgggtctgaggcctggttctacctcttaccagtcacatgatcttgggaaattacttaat

SEQ ID NO: 19758 - DNA, 600 bp, Bovine  MMBT08925
tcagttactgttttacctgacagggaataacaatgtgtatccactaccaatcttttgactactatcttagtctcaagtctccatccataccctactttggatcaaggaggttctcatcatctacatctgacactaatggtcttgttaaagttaaaaaaaaaaaaraaagaaaccagcagagacactgatttcaacagatgaaggaaagtatttctatcaccatctgttgggataataggtataaagcttttcataataataatgccatcagtaacttccatcattaaaaagtattccccmaaatgctctacaacaatattttacactataaaatatttttaacaagattacctggcaataagcataatttccaagggctttatgagcttcatcgataactagacactttatttcagcagctgggcaagctcctctagaaagatcatttaccatgacttgaggcgtaaggaaaagaaccctcttactgctccagatttccttcctggtgaaagcctgagtagatcctgtaaaaaaaaaaaaaagtgacatcacacattctacacttcagactgttacctgtaacatgtaaacagcctagcc

SEQ ID NO: 19759 - DNA, 600 bp, Bovine  MMBT20583
caggcagattctttactgctgagccactggggaagcctgcaatttagaatctatgatggaattattccttgagttaatgtgggttatatgcatatgtttatgctagtaaccagttctatagagctttttccctttctattttcccggaartgatcaagttctcccaggtctgggataatgtgttattttgtggccaacaccagcaactacrttgtcccagatccttccctattacatttctacctcctcaagggaattaagctactacttaatgtctttattttcacctgattttctcasgcaggacacagttgattccttctgtagcaataaatctctgcatgcccctaccatttctcaaccaaatcactttgcaagtctcaactaacttaactattgacagctttctgttttaaattttctcctttcatcataaacttatgtaaatcactgtaatttccacctctgagataccagtttttcctttgatatcacacagaataaatggatttcctctttcagaatagcatactaagaatagaagttttagaaccagactgtgtctattaaattcccaatctgtgtctcttatgtctcctg

SEQ ID NO: 19760 - DNA, 600 bp, Bovine  MMBT03772
taactatkttaatagacaacatatatttaaaactcatctccaataaactgagttttatgaaactcatatgcactgtattataattagataaggaaatgttaatggtatcttcttagtttttaaatagtaaccccagaattaaatgtatttttgtattcctactcttgagttttttaatatacaccttgttatttccagcataatttaataagataaactatagggagaaggcagaattttccatcagatttcaattaactaaaacaagatattgttggygcttgaatgaagtagactatrwtacattccatttattgaccaacaaaatatttaaatgcgttttctttgtcctggtttgagaacagattttattgcaccgaatccaaacattgtgtgcgcttccctaactttccctgaggccttcctttaactataaaaccatttatgaccaaaaaaattaagcaaaccagttgttccattacttgctggttttcattatatcctgaaatatccattcagcatttttatctgctaatgtaacacaaactcatctgctcaatgagatttattacttgttttttttcccacatgttcacaaga

SEQ ID NO: 19761 - DNA, 598 bp, Bovine  MMBT16517
  misc_feature (1)..(136): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctgtaatggaaaagacacactactactggtaggtgtctttttcagggtttacctgatgcaaagagctgactcattggaaaaaccttgatgctgggaaagattgaaggcaaaagcagaaggggatggcagagaatgagatggttagacagcatcactgactsaatggatacaatttgagcaaactctgggagacagtggatgacagaggagtcacaaagagtaggctacgacttaagtgagtgaacaacagcatgcacatacatatatgtatgtgtgtgactgaatcacttttctgtacacctggggcactataaatcaactatacttcaataaaaaataaatgaattaatatttttaaaagatgtaggtctattaagaattttttacttaatcttataaaaatagaagatactgggggttttaagcaggagggaaggttttgagattgttttatttttt

SEQ ID NO: 19762 - DNA, 600 bp, Bovine  MMBT21739
gtgttctctgatgcctcactgtccatcagctcgtgtgtgtatctttcttttccccacccctgtttctgaaatgcctactgtgattaagaatttgcaagagattttcccaaagctgcctgcgtgggtgcatctttcagaatgttaagtaccccacttttgacatatgcccttggactgagtttttaaagatccctgacagttattgacagccagtaattagtctgtagaagcccgacttctgccaagagcctgacttaccacctctgagtcatcttctccatcagcctttccctccacgtyatcacttacaggaaggcaagctctcctgttctcaattccatgctgtgctcacccctggcccactttgaggatggctgcgtactgtcctcctgaatggaccttgagaatatcaacatgggagaaggaggctcasgccgttggcactatggagtgtgttagaaaagaattcaagccctgtattcagaactcatgagaattcaggtgagtgaagtgtggttatttttcaggtaccctaggcaaagtgcagttgcttaatttagagtccaaaccaggatagatcggagaaggaaatcgttcact

SEQ ID NO: 19763 - DNA, 600 bp, Bovine  MMBT00850
actcgacgctgttcaccactatgaggggcccctccckcgcaggctgtgagggttgctgaatgttacagccaccttctgtcaaaacagctgcacggcacaggaggcacatgaggttcatcatttaacttgaattacatttattcatatttgttcttgaccctaaacaccaaacatcatcgactctttcattacccctggaatatttcttaatttcaaaggaacaaagaaataaatttcttttaggtcatgggtttagactcagagccaggctgtggagccagttccaatcactccagtctyccaagataacatctcgttctgtccctgtccctccaagatgagtcaatttgctctggccattcccaggggaaggctagaccttgctttaatgaccatgacttcagctggkgcaacagaactctaggtcactgcaagatggcccagcccgtgttcccccctccccctactcccaccccgcgctgagtgcccatgactagggctttttgtgtgatttggcagttggcaccctctccctttcctgccaataatggtggctgttgtttctgagcaaatggaacaaatgaccaaygtgaactccat

SEQ ID NO: 19764 - DNA, 600 bp, Bovine  MMBT01345
gcctactaagtagagggagagaaatacagtacatgcaatgtaagttacagcttttttgaaaacatttaagggcacatagtcttgaaaaaacaaaaatacactgaacctcttcaacctcattcatttttcttatgtttctagtacagtgcccagatttgtaccccacatcatgtttataagaaaacaacatatacttgaattctttagagaactgactttattgatgttaatggaatatcagatgggagtttggggtgggaggtgctgtcctgagcagttcaagcctaaatgaagattggstttctgctgagaaaaggctccacctgggagaccagtatgttgaatagccagcaggaatagccagtttataaaaatgttaaaaatgttcttctcttcctaccacacctcgacctgctctgccacagctctttttatagtaatgaagmttacattaattgtttgaaattcagttgctgccttagaaacgggggcaccatagttatttaaaaagaaaaagaaaaaaatctgttgagtagagctgtcatttactggaaaattaaaaagaaaaagggtagagaagagagggatgagttgatgaga

SEQ ID NO: 19765 - DNA, 600 bp, Bovine  MMBT11412
agaaaaaataagaacaagcaatcatatcacaaagaatttcaacatgttatccagttctcaacatggagttaaacattaatcctataaaaactggatatcctagtgagaagcacttgaaatcattcattacacagctaaatgatggaaaatacctgtcatattgacaacgagtaaggaagaacaatcctgaaaatcagtcaggaacataattgccagtgcggtgggaaactgagttggtacagttttcagaacaaaaacaaaatacctgaaacaaaatcctattagagattcgttatttcrgccagcaaatccataatttgttagccaaagtaactcggttagcagaaggctcggtgtttgattctaggattctctgagcagttggtttaccataagattctgttcagacgtttgtaagttaaagctaaaggcaaaggtatttccctgtgagggacctttgtggtcgaaacatgggctagggctcaccatatttgggagtccttggcttggcttccagagtttagaggtctcaaagcttttttctcagtgagatcaatggcatcctgagacagagttcaaaatacagttctggtataaaga

SEQ ID NO: 19766 - DNA, 600 bp, Bovine  MMBT02787
tagctcttcgttttattttaaaaagatacttgtaacccagagttggttcatttgtgattcttttgtctgaatggctcagtcctttttggtgtggaaaaagggagaatcagctggaggagtctgaaattttgtttcatcttcattttttactttggagcatcaaacggattctttcattcagagtgattgtctccaggttttaaaaattaattaatgtatgtatgtatgtattcttattgaagtcctgttgatttacaatgttgtgttagtttcaggtgtatagcaaaatgatccaggttyacatatatatatgtatttttcagattcttttcccatgtaagttattataaaatattgagtatagttccctatgctatacagtaggtccttggtagttatctattttatttatagtagtgtatgtatgttaatcccaaactcccaatttatcccttccctacccctttcccctttggtaaccataggtttgtgttctatggtctctttcttttctttttaaaaaaaatctcttagatctgttattgaaacttgcagtgatcaaatgactttgacatgcatattacatttacatttcttatc

SEQ ID NO: 19767 - DNA, 600 bp, Bovine  MMBT02777
caacacttcacataaggaaattacaccatgaagacctagttacagagaactggtaaagatatttaatttccccctaatttatttgcctacatttcctgtttcagtcattgctaggaaaagacagcattaaccttcaccttaacatattgagcagaataattcttaattttgcatcactgtatgtagcatttataataggaaatttagcatccatgtcctccaaatgctaaatgctagtgttaatagcagctcttggccctggtcatagtagcaaccaaatatgaatccacacatttccaratgtcccyrtgtacagtatggggttgagtgraagaagtaataccactcatgaatggaaaccactgtaaatrtctttgcaaagacgtcttttcttgttatgtcattttctcagcagattcttaccttgttacatttaaatttatctggtgtgctgctgctgctgctgttcagtcgcatcagtcrtgtccaactctgtgcgaccccatagacagcagcccaccaggctctgccgtccctgggattctccaggcaagaacactggagtgggttgccatttccttctccaatgcatgaaaggga

SEQ ID NO: 19768 - DNA, 600 bp, Bovine  MMBT15055
ggactgtggttggcaggaaatgacatcactcacagccaatcagagcagctgtcccagcctcgctgcatctttggcaagcaytgggaattgggcatagagatacagaaggtcacgaagcagtctctcctgctgaacttagcactctcaaggaagagaaggctgggctctgtacagaccctacctgtcctgatcactggtggggaggggggtccctgtgacacttgtggaaacctggtgggccaggggaggtaggctgcttaactgtagcttctgctctggccagcagagggactcaagagycagggatccgattcaggtcctgcgacactgggccctggtatccatcctttcccacagggcgcggacagttccttctttcccctcagccgctcccaccctgctgcacagaatgtaatactttcacccgtcagacagacagacagacagacgcacaygccctcatgctggctctagaaaaataaacagcttagtgtcccagctcacrtttctgcaccccatttttctagggtccctcccttgcctctttctggtcccccaggaaaactctacagctgaaggtgttaaaatgactaactgaat

SEQ ID NO: 19769 - DNA, 600 bp, Bovine  MMBT09340
ttcccactctctaagggacsctccttctttgtctaaaaactcaatgaacagcctggtcaaagggatgccacgggacagaggcccctgggtggagagggcttggggcaggggaaggggaatcaacctggaggcaggaggcccagccccacctggagaggggcttccagtaaggcagggacacaggcacagctggctgtatctgtagacacctggcctgtgtgtgcaggaatctttgcccagactactgcccscaaggtcgtcaggccctccacccacacctccctcagacgggaagggagkgaagggtggcgagtacctttggaatggaaacatctctccagctgcccctccagtgccccgaagtgtacggtctgaggaytggatcatgaccctgtgctcggacccctcccctcctcaccgtagatgtctccttgagatcagagggctcagggcacctgcttcctactctctcttacctcctggtggtttgggtcctccctttgcacttctgctgagtctgctagggcctctcctggcccctggagccccggtgcctctgccctccctccggcaggtgttccccttgctgtgtccccaggt

SEQ ID NO: 19770 - DNA, 600 bp, Bovine  MMBT16128
gctatgcactgcaaaagtattatagactaaaccagttgtcttcctcattttagctacataacacaagagttactaaaaaaattcagtgaagaggtttggagtacaaaatatttctgccaaaaattaaactgctaaaaggaaaagaaactcatttacaaagtatctcagaaaatacccctgttagttaaccaaatagttgacatgatgaaaacattagccagtatccaagtggaactggaaatttaatcactctagttttagaattgagggaatctgttggttaaaagattcataaagacmaaatccaatctagcaactagaatcaagtttttcctgtattacccacaaactgacgaatatggcattttctacaatagagggaagagaatataatcaattactgggattcttctcttccccaccctcataagttttcatcctattgcaggacatacctgaaaaggacagtcaattaaattttagcctgtycattcacattaaggcccaaatcctgcctacaatttcacatatcttacccatttgtttactgttgaactatcctctcccaaatttgaatctaattatagaacctaattatag

SEQ ID NO: 19771 - DNA, 600 bp, Bovine  MMBT18962
tagtcatggttatcacctgtgcagcccagtgcaggttgtatattcattaatactagggtagagactgctacagtgttttatggacaaaattcctatcctgggtttccactgcagctttcatatgccaaggggagctaaggtctttcttaatatcaccctattcaggtgccaccaagacaataacagggcaagaggctgaaacatgggaaaagaaatgggttaagaccacatttgaggataaaaacctgagtgcaaacaatacactaggccaagtgtgatgcccttgttacayaaagtccrctatcctgtggagagagtggtgctcagcctgagaatcctgctactcaaagcccagacccactggtgaccttgcaacccctgggaggtggtccagtggccatgaattcccatcctygacctggccccacatcaacaatgtgcatgcgagtggtggtggtcctgagcggccctgaggtctccaccccttgagtctggggggcctctgacggctgtgacccacagagtgtcctcgggcttctgccctgagaaagcctgcttccacttcctgtcactggaacacctgccaggagccctgagctt

SEQ ID NO: 19772 - DNA, 600 bp, Bovine  MMBT18155
tttaggaaatagatatcattattccctaggtctcagggaggtttaggtggctgatccaatgttgcagaactagtgatgaggctgaaactaccgagggtgaggaggggctgaaggaggaaagcgggactgagaacaagagggaaagacagagaccaggaagaaagagggacagagatccagaaagaagggaacatagacctaaagacagagagggccagagaccagcgagaggtggggaagaattccaggagacagagattcagtgtaggacagggacagagactcagagaaaaggatacyaggagaccaggaagaggcccccccaccccaagtttactgttcccctcttggaaggtgtgtgggtggggaatggggctgtctggagctgtgcacatggagcccaatgtcactgcctcccatttctcccaggcttgtccttcatgcccttgcagatctggtccaaggtcctggccgtctcaggaatcctcaccatgggtcttgccctcctgggctgtgtgggggccctgaaggagttccgctgcctcctgggcctggtgagttcccctccacccttccacctctaggatcattcacatcttg

SEQ ID NO: 19773 - DNA, 600 bp, Bovine  MMBT07029
ccctttccatgcatcaagcactgtttcagacactcaacaggtaygttaaatcttttcattctcacagcagctatatgaacaagctattaaatctctccatttcrcaggaaaagatactgggcttactatcagagatgttaagtaactggcccaaggtgacccagttaatggtaagacttagatttgaacctagatctctctggctccaccaggaattccagctatgactactcactcagttttaagcacttcacctgacagatttcattgaattcgatcccatttccctttgacattttwaaaataattttatttatttattcttcgttgctgtccaggctttccctagttgcggcaagcaggcttctcattgcggcggcttctcttcttgcggagcgcgggctctagggctctcgggcttcagtagctgtggctcacaggctccagagcacaggtttaacagttgtggtgtacagacttagctgctatgaggcatgtgagatcttcccggaccagggatcaaacctgtgcctcctgcactggcaggcagattctctaccactgagccaccagagaagaccctccttttgacatctgaca

SEQ ID NO: 19774 - DNA, 598 bp, Bovine  MMBT05005
  misc_feature (1)..(58): n is any nucleotide
nnnnnnnnnnnnnnnnnnnnnnnnnnnnnnnnnnnnnnnnnnnnnnnnnnnnnnnnnntgactgggctactgccctggaaatgctttttaaaaattatactataatttatcattagaacgaaaagtcattgtgtgtatagaaaggctagaaactatggagtgggatgtctatttgatatcagtgaggtaactattactggagggatgatccccatatcttattttcttgcaaattaatgaaatgcgttggtgggtcctaaaaatgggaaatacaagttaaattacttgtgtaaggtgttrtgaatgagataatgcataaagaattgtctgtcgccttgctacaccacgtgtggttcctgaaccaagagcaccagcattaccagggaacttgtgaaaaatgcagaatctcaggctgcatgccagacttacaaaatcaaaaagtgcatttgaagatccccaggtgattcatctgcacattaaattctaagaaatactgatatcacatgctaagcccgtcaactagaggaaggaggaattgtctaatctctttgaagagatggaagaaatttcaaaacaaagagttgtgatcaattcattc

SEQ ID NO: 19775 - DNA, 600 bp, Bovine  MMBT05728
cctgttaattacttccgttagctcttaattgggaacagtgtggtctaccagaacattccaaacctctccctattggccacgtatctcatcctataagctttttaactggagctgtgacaatgcgcagtgactctgcattctttttcactccccaggtgaaggtctggactggcagttaaatgcccaaatggcagggaggaaaagacaaaagccaactccagatattttgatctccagaaacagtgagtctaggagtgaaggacttcagcatcattccactccatcccattcatttcctgytatttaaaatgaccaggtggacaatttctcgatgtgagtcaaggaatttaaatctgcctctgacagttctaccctgaactgggcatggaatacccacgctttggggtagctttaacgtcctcacagattcttatttcttctgtgccagctgatgctcttgtcttctgctcaggactgagggttcatggaggtctcagggatttattttctatatgtacccttcctagccaccgttttataagagtctctttgctgtgatccccatcctaacatttagacatgtggtgtctcccttgttac

SEQ ID NO: 19776 - DNA, 600 bp, Bovine  MMBT07250
tccttctccgcgatccactgaaggacgtcattcacagtgggcaccgagtcaaaccctcgctcgtcatcaccgctggctgcagagcaaagaatctgaaccatttgggagaggaatggggtcagggcttcacaaataactctttcccttagcttgctataattataatacaggggattactgacaggtgcagaacacacacggctttcccagtcattgtctcgtttgagctttgggaccactctggagagaaggaggcggggatactagcagtgacaggagtagtgtattgcactaggaatmgttagagtagcagtatactaatcgcagtagtgactaacatttactgaccacttattatacgccggacatcatgctgaaacccttcatgaacattttcccttttaaccttatactgtgaggtagaagtgattgtccccactttctaggtcaatatagttaaagtgaaagtgttagttgctcagtcgtgtctgactctttgcgacccatggattgtggcccgtcaggctcctctgtccatgagattctccaggcaagagtactagaatactggagtggattgcttttcccttctccaaggga

SEQ ID NO: 19777 - DNA, 600 bp, Bovine  MMBT00601
aggttaggaggtctaggaaaactgggtctggctctgagcaaacagacccctacttgacctctatggatggtagggagaaggccttgaggcaagggctagggatgagggttggcgaggaattcggggcaaggtcccagtccygatgcttgggatttcctctctaccccttcccaggaggggagcctcacttcatagtggcaggtccccctcttgaactctgatactttagctataaacctattttcatgtgttcattaggtatttattaatacttcttttgaaaattgcttattactatcmtttgcccattatcctactaggctgattttcagtacttttttaaagaagccttggtatgtttcttcatttcttcaaatctttaaaaaatatatctgttacaattgacccttggacaacatgggtttgagttgcactggtccacgtatatgcagattgttttcagtagtggaggctgcagtacaccgtgtcctgagttggttgaatttgcaggtgtagaccctcaaatacagagggaccacgtatagggaaaccgtatatacagagggctgactgcagctgcctggaggattggttcccctg

SEQ ID NO: 19778 - DNA, 600 bp, Bovine  MMBT08631
aagagcctggaggactatagtccgtgggatggtgaaagagtcagacacgacttagtgactaaacaacttttatgatataaatataatttaaaattatgcatttaattgaatagttggagcatccggatgagcaacttgtcactagtatgatggtgtaattccaggtcccacatttaggattgtcatcactccagtgaagggcaagtgacatcttgaagctttgcatgaatggaggtgtagccccaagtcaacctgaggaaagcggtgggggaatggagtcaacccaccacacaggatggygtgagcctgccgcactcacgaatgccaatgtctcaacactgtcattgtatttgcgctctgagttagtttcagcaaaatattactggtgccattactgtaatattgtttttagttttatcgacttttgaggtttggtttccatttaatttgtggccttttgctgcttttcagttatatttgcgttataagcagaaagcatttctgtctagactaatcttggtgtgtatttttaaatagcttcataaagaggttaatttataataaggtcaagttaaccctcagggtccaagttgccttctt

SEQ ID NO: 19779 - DNA, 600 bp, Bovine  MMBT21754
atgtgcaggcctatgtttgctgccaagtcgcttcagtcgtgtccgactctatgcgaccccatggactgcagcctaccaggcttctccgtccatgggattctccaggcaagaacactggagtgggttgccatttccttctccaataggcctatgtttattggcatccaaaaaaaggtacacaattcacttgctggaaaaactacttctgtgtaagacaatccttctttagtatctctctcttcctctcctttactctccagaatctcattctatctctctctctccgtatacttagagctrtatcgtgtgtgtgtgtttaagtccacagrtgattctatagatctggacagatagatgctctggatactggaaatatgcactatttctattctctactgtacatatttttgaaccatttgagtttgtgtggacatacattcctttcaaagtgataagaaaaaacagcagtttatttctattaaaataaaatcagacaatatctgcagttgacattaccctagaggatcaaaacatttcaaccgcagtttagttttcattatcaaggtcagaaacagaccccagcaaatcatgatcttggtg

SEQ ID NO: 19780 - DNA, 600 bp, Bovine  MMBT04536
aaatctcagaagcctcaactaactactgaggctttatatgcctgcctccaggttagctggagatggacatatcaacctccaaactccatggtggccccaagggtttccttttaagagttaacatggattgggccagaccctctgtgctgcatctcacgtctattaccctcaccgtcacacttagtagccacattttaaagaccaagccactgagattcaaaacaaagaacacttgaaagttagggagtaagtgagatgggcggtcagacgagctttccgtgtctcatgttgcctctcackcagstcttccaaagttctcrgaggatgggagagtgttgtagaaaaccattagccgccatcaccaatacggtcatcttaggattttccgctcccctttggacttcaattctgaatacacagacctcttcactgccagcttccagttgggagagcacctcaggttckcagatggaagaaggtagccctcatctgtttagttcaggagctggccaaggttttctgcaaagggccagatagtaaatattctaggctttggaggcacctgttgtcaccattcaacttttctgttgcagtaggaag

SEQ ID NO: 19781 - DNA, 600 bp, Bovine  MMBT21774
gttcccctccttccctttatctatttctcttggccctcttttacactgcctggacatttttagttggttttctctagatttttttccatacagctttagattatttcacacgtattgtttcacttcattggccaaagaggctaatgctttcaggggacattaaacaataactcttgggcccctttctgcccataatgtctaatgactggcttagatttttttgtcctttaactgcttggcccaacacttatgcacactgaccctcatagacttytgtgtgaggtggatccacgtagatamcgtgtagaggtcttgacaccatcacttcactcatgccactcagatgctgccatccacctcttctcccagaccactctcctctacagagggcaggtgttgcctcagtactgattcgaggaactcctgcctgagcttcccccacagctcaggaactgactgctgcctcctgcttcctggtggagcccccatgaacaacaagggctcatagaaccccacagggatgtgtgaccgagacgacgggaggagggaactgcgggctaagcagtcactgtggcagctcagagtggggtcctgggcacc

SEQ ID NO: 19782 - DNA, 588 bp, Bovine  MMBT02583
aagtaagacatataacagtttgctgccagaaaggaaaggaagatgctatgggcgttcagataagaaggtccaactccaagctgacctaagcagacagaaatcttggtgtaacaactagatgacctattagagggatcagggtcagggcaccatcccaaatgcctgaggacaaaataaggctaagcagaagtttttgagtgatgtcagagctagtagggactcttcagatcaccttacctttttacttgataagtgaggaaactgagagccagggaagagaaaagactaggtcacccaagrtcagcagcctagatgcctagataatggctaagccagggctgaaactcgggtttccggctctcaggtcaatgagttttctataccaccacccaccctcacaaggtcctgtcacaacaaagccataaaataggcagctttcattcccctgacgcatgcagcagtacccacgcaaacgccgaaaacgttcccaaaggacatttcttagctgggagtcctacagagaaccagaatgggacttggaaaagaactaaattccttcttggctatttcagccaatgggaatggagc

SEQ ID NO: 19783 - DNA, 601 bp, Bovine  MMBT17435
  misc_feature (1)..(1): n is any nucleotide
nacagaaaaggggcaagcrgaatgctttaaggatgcgggaggatctgcctcttctggttggagggataaaatgggatttcyrgaaaacatgacaattcagcaattttttttttcagtgataaattaaaccttgaaagaagtggagtattttgaaaaactcagttggagacacaaacattatagatagaaagaacaatagaaataaagatatttattcttaaggatcagcagactatgggttttggattaaatccagcttgttatttattttgtaagtaagattaattggcaccaagccatrtgtactctttgagtagttaaccacagggaccatgtggcccaaggagcctaaatatttactgcctggccctttatgggaaactttgctgatcccttagactaattcatgaatttatttggttttttcaacaaatacttcttaagtggatgctatatgccagaaatgtatcaaagcttgaatatagaatggtgagcaaaacaaagagtagaacagataaaagcaaaaagtagttattttggagggtgattttgactattaataatacaatatttgagagctgtaaagaaaataacaaagttc

SEQ ID NO: 19784 - DNA, 600 bp, Bovine  MMBT15283
gccctgtccatagatttcaagtgacataaagtgaattctttctttttacggctcaagttggcttgagttaggactgtatcacttgtaattgaaagagtacccgttaattcacccagatccataacatatctgaagcatctcttttatgtcccttcatgtcaacatgtgtgattctctcttcatgttatgatcctactctcatctttaaatttgttgccaggatgccctaacttggctactttgtgaacttgtgtttttagaataactgcaaccctggtcatagtatcttgctctgggtcrtgggaaaccagggtgaggactggaagtatgcttagggtggtctgtgagctactgagggtagagttaagataatgctgaaaaccagcatctgggctcttaagtagggtcgtatcaaaccaataaaagtgggaaattatcagacccaaggcaataagtagcccagacactggagcatagacagagagataaagacagttgatctaggatggtcagtctgaggatggagcctgagggctggggtctgtttagtgaacagaaaatagtgactcactaacattctcaggggatttctcaggagat

SEQ ID NO: 19785 - DNA, 600 bp, Bovine  MMBT01304
ctgtgtgcacagccctggtatctctttgggtgtccaaatttcctctgcttataagaaaatcaatcagataagaatagggcaccttgacagcctcattttaacttaatcatcggtttgaaggctctttctccaagtacagttacattctgatatactggggttaggatttcaacatacgagttggaggcggccacaatcctgttgaacacctttttggacgattgcctaatgataatcctgtggcgtaagcttcacttcccataggaggctaaacagctgtggcaagtgcctgtgagttaytgattatcacaatcttggactttcaaaggcagtccaccaggtatgcttcctgggggtttacagcacaaaatacaatatgagacacaaagaagaccttatttccttaagcagtgactagaagtgtagcatttctatgtttggttttccatcttttgaagttagaggtggagtctctatgtgatctacaggaagctcaggagattataatcttctctcttgtatgatcatccatgtgcaacttctagaaactatcttcaagcattggtcctctatgttgtaaaattttctttgagtcttttc

SEQ ID NO: 19786 - DNA, 600 bp, Bovine  MMBT03537
aagatcaatgttccacatgatcacggaaacaaaaagatttgctaaaagctagtcacatctgtagatctgtcatcagtaaggttgtacaggctgcatggtgaatgcaggtctcatttctgattctctgatatgtcaaagaacaggaagatgacttaagaaaacgtctgactccagatagaccagagttctctactctttacataatcccttccaccaagaactgtgacgaaaactgggtcttctgttaatggaaaaacaaagctcacttttcataaggtcttgttttttgtttccaggcargttgccatttagttaacatttacagaaagctttaattacacaataggttgcagcactattgctracagtaaatttaatttccatgacctcaaattagcttaactgttgatttcaccgtcattgaaattgacataatcctgttgactgaggatctttcactgctatggtaactgtaaagcacacagattaaaatgcaaattactgagttattggcagaaatgagcacatcattcctgcaagttgttttataaacctagttcccctgaacattttgaaggctaaatttctccatttaaacag

SEQ ID NO: 19787 - DNA, 600 bp, Bovine  MMBT06087
agttttaaaatatgtttaaaacatgtttctgaactgtcttcgcaaattaatcaaagataggtggaatattaatgttgctctgtgagttagactttttccttaattattaaatcctttacattttattataaaatttttagataaagccaaccatctgagcccagcacccacagctgaaagaacagtaggtttagtgtatttgaatctatttaacatgcagcagtttttagttcttagctctgcttctttcattcattaccctccccagcttccttatccgctgaaactttcctagagcamgataagaacgacatgcagcccccaacggtaggtaagaaaaagaaaaacaacctcattattcagacaggcaaagaataggaagatgtgcacaaaaagggagaaaaaaaatgattcttaagcaaatgaaaagtttacttaagaaaaacaaaagtgcaccagattaccattttttatttatttgactggcaaaaataaaaacacctcatcgcatacttgacaccaaagccaagggaaaccacggcctttcawatgctgagagcaggcgcgtgtgggggcttttcacccccagacccaaggagc

SEQ ID NO: 19788 - DNA, 600 bp, Bovine  MMBT18034
ggatcgcacttgcatttcctgcattacaggtggattctttaccgccgagccactggggaagcccctcggaggttcagaagtgggcctcacccttcctcacttctctgcttattggagtcacagcttctgccttgaccggaggatctgtcaagagccgggacagaagcttactggactgcacatcaggaggcgggttctccagccctgcctctggcccagggccatgccatggggggtgaccccctttccttggggtgactgagtcgtgccatctgtagggacctttgcaggtcccctgcrgtgctaattctcaccagagaccccaattctcaacagaaaccagtggtggctcctttcctttgctttggccagagcctttctaaatctgccatcgcaactcactggccaatcgatcaaaacctgtttacaccccaaaagggtcttattgcttgctctttccccatgaggtttttctcccagcacctggttcctggttggcagccggctgcccagaccagccagggtgacctggcagctttaccctgactacagaggaacagaccccagtgagtccgctgagctctggcacccgacgggcaa

SEQ ID NO: 19789 - DNA, 600 bp, Bovine  MMBT20922
tactctgcatgtaagttaaataagcagggtgacaatatacagccttgacgtactccttttcctatttggaaccagtctgttgtttcatgtccagttctaactgttgcttcctgacctgcatacagatttctcaagaggcagatcaggtggtctggtattcccatctctttcagaattttycacagtttattgcgatccacacagtcaaaggctttggcatagtgtctattacataaaaaacattgcgaatatactaacaaaagagcaattttttaaaaaacattgtaatacaactatgasaagacttccttctcttcctgaagacaggaatatggttacatttacatcaatctctgataacatttagaatatgaaattttctgaattatgtaagagtacacacacatttcttcacttcaccatgaagaatggaatcaaatgaaatattaacacaagactaaaacattgctgcctaaactctgatattataaagaagtcttttaataaatatctgtaattgaattttgttatctacacatttatgaattcttacagtcaaagaaatgggattaacatatatttgtttatattaaattaaag

SEQ ID NO: 19790 - DNA, 600 bp, Bovine  MMBT17616
atccagtggtccattggcaaacagatactcagaccttatgtattctgtgtgggggaataatgctcttggctatagtcaaagggaatggaaataatgctaatggatacagcatctcagagcacaacatgatcaggtattctgatttatctccttgcaccagtacaaaattagataaactggttaagctttcaaatatttccttttcaatggcaagtgatgtttcatgtactcatgttgtcttaaggcttcccagttattggatgaagtgtggatagcgaggtacatctgtaaacttgagcragccatacacattgaatgtctttacaagtcagtactgtaagccccccttacctacacattccatatccaaggagtcaaccaaggaagctcagactgtgttgttgttattcagttgctaaattgtgtccgactctctgtgaccctgtggactgcagcacgccaggctcctctgttcaccatctcccagagtttgctcaaattcacgtacgttgagtcgggagatgttctaatggtctcatcctctgccatctccttcttttgccttcagtctttcccagcatcagggtcttttccaatgaa

SEQ ID NO: 19791 - DNA, 600 bp, Bovine  MMBT07078
tgtcttttaaaggtcaaagatttaaagatttggtctttaatctaagaatcctttccctcctgcagtcatcactgcccacgctttctctctccccatgcccctctttctctctttttcccctcaccaccctttccctctccctctctctctctccatactgggagaaacagattctcccaattgtcactggcgccaggtatcgtcagttaaatctcaatcatttcaacagcattgcctgtagttcacacatcattgggcctgccagaggcagcatttcaaacacatgtccttattcagggsgagtcgggaataggagtgctctgaactgcacttttcaaaacctgttgtccacttgtgccaacagaacaggggaaatttcctttcagcactgccatgaagagcatccagatgttcccactgagctgaagtgcacctgcagtagaggctgcttgtaaccgcagctgcaggatcccttgggaaggcaagccagactgagagccacgaaatggtgtcatggacaacttggggccaagtctcaggggaaaggatgctggattttggatctgactttaacttctcatgctactctttcctggagaa

SEQ ID NO: 19792 - DNA, 600 bp, Bovine  MMBT07550
ttgtgtctttctttctctttttagtctagtggcaataccagtgtatgtgaaacatagcatcagtttcaaggagaacagttcttgtggtagatttgatattacaattggaccaaagcagaacatggggaaaactattgaaggaatcacagtgacagttcacatgccaaaagttgtgttgaatatgaacctgacaccaacacaaggcagctatacatttgatccagttaccaaggtacagtcacctaaaatcaggagtgagcaagtgtttctgcaatcctcattttgtgatctggggacatrggaggacagagggaagggtctaatatcttggttgaaattaaagctcttaacaacgtagaatgcagactgtgctgtgctctgccacaggagagaatcctgcatctgctgctaagtcgatgaacagaaaagtgagacattccttcttccttcagagtctgccttttcttatccattgataatccagaggttcactcactcttcaatgaggaagatgtaaaaactttttaaaaagagaaaagcattatgtgcatataataatctattaatggttaatagatattacaacatatcaattgttaa

SEQ ID NO: 19793 - DNA, 600 bp, Bovine  MMBT02242
taacaccctaaagctgtcttttgagatttcacacttcctgaaagtgtgataacaatttaacatatcactacttcctatgaatatttacactttaatgtgaaagtgaagactgtcaatgtataacccaaagtttccttagtagtaaaaaataaaatattttgacaacttgagagattttattactaaagggggttatcttcccattttctaaagatgaggttgactcaactctgattaatcctacttattctcagattgcctcagtctgcaaatgatgaaaacagaatgctgatttttttwaaaaatartctacttttattgatatataattttcagtggtgtagattgactctgattttaaatgtttctttctattatgatctatgagtttgtttcaggatgtattagacacttgagtaaaatggataattctcaagtttacacagggtacctttttctctgcaataggagaaatatgctaaataaagttgtattggcaaactgacttgtaccacaaggataatatgaattaaacccaaaacagtgtaataaaaagagaaggagagggaagaattctgggtgagtggaaagtttaacaca

SEQ ID NO: 19794 - DNA, 600 bp, Bovine  MMBT13733
aaaatttttcaatcagcataagagaggaaattttgagaatgagaaacggcttctaatgctgaccactaagaaatctgtggattagcagaaactctactgtgttggcaaatttttttcagcagcctaattcagatcctttgaaaacagtctcatcctttccatctgacccatttacttagaagtgataatgacagaaaataaagttactattcataaaacttcaagttcaaggagaaacttcagtcgtgcctaacacatagtagatattcaatgaatgtttattgaattgaaaagatggtrtgtgatgatctcaatattgtgtgtgacttgggcagatctggtattgcaagtgtgaaaggaatttaggtgatccattgaatgaattttgatgaagacatttattttagtcagttactggagtaaaataagggtctttggtgggttacacttactagaatgatatgtgctacagacatttgcagtcttttaaacattagaattacttcataccacatacaggaagggaatatgtgaactaatttccttatgagtctctagtggcctattaacctaaaatcaatttttatcaaaatttaattt

SEQ ID NO: 19795 - DNA, 598 bp, Bovine  MMBT10639
  misc_feature (1)..(37): n is any nucleotide
nnnnnnnnnnnnnnnnnnnnnnnnnnnnnnnnnnnnncacagataaacaaggagtgcacataacaacatattaaaaggcacagggacaactgtcctaatactcaaacaattattcataaactataattagaggggaaaggcacaggatgttcctacctgtttacaaaaattaacaaatctcagtcaaaccctccttcttttccttatcttcagtaattgtcaagcaagtccaactgcaaagctaaaaaatttgccaattctttctttcacgagtttacttctctctgtatacactgttcrttttcttcagtatttcatcagaagttccttagatctgcctttagataaattgcccctttttatttagctgcagcaggcctcacacacaaagcaaaaccaacatctatgaacaattttccttctacttttttcccatcaaattaagcaactggcctcaaaggagtgtgtcattctgtagatgctaaaaaagaggcatggcaggtgacctggctttcccaccttcaccctgtctatccatggtaaagttaaaattgccttccaatcctagaacaatcctccaatcccacctttcatccat

SEQ ID NO: 19796 - DNA, 600 bp, Bovine  MMBT04952
tgctgcagtccttggggtcacaaagagtcacacacaactgagtgaccgaactaaactgaaagatgaattagaacactgctgcagccaattgaaaataatttttacccatttctactcttccagattgcaaatattgaaatataacttcacccaacaacattcattgaaagtttgatatatctaaagaggtatttgagctcaaaaattgaaagtaagtattgtaaaaaaraaaaaaaaaacttaattacaatgcaccataatttcatcataactctcagggataaagcaaatctccatttmtagaacataggtatatgcatttggattactgaagtaaagactctctgtgttggtaattatatttaatgagctcaaatggatttgatatatagcatcagctaacacccaaaagattagcagaggttagtgctgatagttaagaatggctaaactagctctgagtgtgtaattacaattatgatttcttagttgcctcatttcaccaattgattcatccctctgtcttaaaacwattatttcctttagcatgattccctattcctgtaaagagcatttctttgacctctcatcctcatagca

SEQ ID NO: 19797 - DNA, 600 bp, Bovine  MMBT21336
tagtgagtcattactgctccgctctccaactgcattctgacttcagcccactcgtgcagctcaggagggctgtgccatatgttagtgccatgtagacagaatgtgactgggtttttttccctaaaacactgtcagagttactttttaaattaccttataatcttgatatctctgaagagtcatttctgtaatacacaaccttctggagatgactttataattattcttctgagtgctcaaaagagattcttcagcatttttagtccyatattccagatgagggaactaaagtgaagataycagattgagtgacgcaggttccacagccagccagtaaaatttgtactttctggagtcacggggctttatttggtaaaatacacccgtttgtaaaatgcgctttttttgcggggggagggggcacaatcaaaatattagtttgcttttattttctgaggtgattattaaactttaggtacagcaactacttggaattttttttttttttttaaactacttggaatttattggctgattcttgtgactggtctcatgacatccacctgagtaggtgaaagagaaaaggactgaatgagagat

SEQ ID NO: 19798 - DNA, 601 bp, Bovine  MMBT16473
  misc_feature (1)..(1): n is any nucleotide
ntggaacctgggctgccctgaaagaaaaataaataaaatgagctccaagttagcttgcaggagggtgttaaaatatcaagtgttgtggcgactgtaggggagaaaatccatcagacaaaatgattcacattcctctctcccagctagattcttttcagcctctcaagcagaaccaagcccagtttgaaacctacggtcaggactatttataatgaggctgagaaaaggtaaaagttctcatggtctagcaccgccctctagaaccttctgcagaggatggagaggttgtccatccacactstccagtacactagcccctggccatcgatggccgtcaagcacacgacaggagagcagaagttttcattttagttaacttgaataaatctgacatcctggagccagagccacggtgagacaaacaagataccaagggtacaacatttgggcaggcacccactctacatcactctgagaataagtgcttcagtaaattttgcaygccaggacctcactccagcctggaccctattacatccttaatgtgtcttttgtctgttgcttcatttgaaggcttcagcacttctcaccctgattacta

SEQ ID NO: 19799 - DNA, 605 bp, Bovine  MMBT07213
  misc_feature (1)..(5): n is any nucleotide
nnnnncattttccccattgggtccccccaccacccttgtaactgccacaagggagttcacaaatgtcccttaacttcttttaccagtcttttgttgacagatttaggtggttcccaggtgttttatttgctgttataacctgggctgcaatgaatcttcttctacatatatgtactttttgacaatatccatagggtacatttccagtagcgcaactgctgtgtcaaaagatttgagcatttaaaactttaataggtccaaactaccctcttcaaaacactttctctgtgttttaaatgatatamatctgatttgaaaacaggactcaaacaactaataagagttttgatgatttttcccccctttatgagtcctatccttagtgacccaggggcattttaaatgaaagaaaatatctatcatcttattaataactgtaagctgttcttaaaacacacttgggtgatctgtccttatcatagactactactctatgttttcaggtttaaaaaatgattttttacctcataaacaagtctgttatgactccatcagttttctagaaggaaccaaatttgtacttcttttccttgcactgttaatat

SEQ ID NO: 19800 - DNA, 591 bp, Bovine  MMBT07258
tgggtctgtgcatcatccatcacatctaaggcaaacttctggtgattagtattcaaagtacagtcttaaatttttcagacgtatgttgctgagagtcttcatgttttccagagtaggcccctcaatgttataaaactctctagaaggtttgatatagggtggaaaagaacaaaaagagcctggacaactggaaactttgatagatgctaattttttaaattgacgactctgttaatttcatttcattcattcattctgttaatagaaactcactattaattccttgttttcgagcctttktcatattgggatgcatttagagaattttactgttgtcatgtttcctggaggatgctgccggaggctgaaggctccccagggctgaaggcaactggttggtccagggctgtggtcactttaggacttgctctaccagcctgctccaagggtcagttgaaaactgtgatcacctttcattttcagatatgttacctttggtataattagattacatctttttgagtgattttatatcagttagtccttcaatccagtgttgcagtaaagtagatatcagtacacaaggctgaa

SEQ ID NO: 19801 - DNA, 600 bp, Bovine  MMBT07714
gcggctctttgtaatcagagtgctytgtggtttccataaaagaggaccagttcttctgaccatgggaagaacaaatatgaggcagtggttaagcatgcaggctgcacaccacttagacctgggactgaatccaagcactcacttattattagtgataacakgctactttacttaactttcccaagcctcagtttccttatctgtaaagtgggcgtgtgataacatcggtgcttttctyataagctttgggaggataaaygagttactgcagcacagtgcactgagcctaacaaaacttcytgctatcattgttgtctggtctcccagagccagtygggtgccctcctggaagtgaccttgactgcagaacttgaattcattgctctgcttcctgcactttgggcctccattcataatagctggttagatgagaacatcaacctctaaagctcagactcttctgatacgtggatgaaagctgtgaattttatacctaggaagaagcacacagccgtatgttttaagtgttcatggggctttaaagcccatrggtccatcggaccaggttttggaatccctggctcaaaggaaattaatcag

SEQ ID NO: 19802 - DNA, 600 bp, Bovine  MMBT18770
agatttctttacagctgtaaacagttggtcagtatttcccaccatgttggctctactctagaatccactcttcaataagaaagcgttggtgctgctgctagattacctgctgtctttccattgaatctctcaaatgcttttgaagtctttgaagttaatttctacttatggcattctacttactgagaatgtgwaagagagcatgrcctctttcttcaaggtagtcaacttgaaatgaatcttaattatttcacatatgctaccacagcttgaccttcagcaactatagaattttcttaygcatattctgaatggtggcaggtttcactgactgtgtcaccaatgaggttttaccatcttgaatgctgtactgttttctctctggaaaataacrcatgccatcattccaaagtggtaactaatacgttgtgtttgtattcaggtatctctgtcagttttcaaatctcttgttatggtgcccccaagttctactcttggttcttatttactgcatgtattctgaaaagaccattggaaataatgtcttataatttgttttaattaaaacctgtacttacagctagccatgtgtgagcaagc

SEQ ID NO: 19803 - DNA, 600 bp, Bovine  MMBT10279
cctaaccttgggctactgaaacagtgctgaggtcgataatctttctgtctgtcactctcctcaaaggggaggtaaccactggaagtggctttgctaggttgcagctgtcgactgaaaaaaaatgtacaatgtgagagttgtgggtttagttttatttggagcaaaaagaggactatagcctgggagacagcatttcaggtagctctgagagattgctccaaagaagttggggggtkggggcaatatatatgtgcttttggtgaagggagtacatgcaatcaagcacacgcgttttgcagmaggtttatgctagtcacaaggaacagatgtcaccatgaaagattttgatgcttttctagatatgaggagatgcaagaactgggctcataaaatcatctccagaaaatatctaaggatctgaaggcctgttctgccaggtttttccagatcacagagtgcctcctttctgatcttctttcaggaggtgttgaaggtcagcagctacagtggctcatagtttaacccttgtaaagatagaaagcaagtgtcaatttgtakgtgactaaggatacgtgtataatamtttgagtggatattgct

SEQ ID NO: 19804 - DNA, 600 bp, Bovine  MMBT11013
tggcctgagctgggtccctcttctttctcccaaagcccccaaaccccaaaggggcctctgctccatccctggaggagaaaccctcaggaggttttctctgaggtcaaggaaggtaggtcctgctgaaggagtcagttttaggcactgccgacccttttaaaggatccaaaagacagttgtttgaaagcaggttgagggacttccctggtggtccagtggctaagacttccacctcccaatacaggggcccaggttcgattcctggtctgtacgacactgtaatggtggatgcaagtcatyacacatttgtccaaacccatagagtgtacatcaccaaggaggaaccctaacgtaaactatggactttgggtgataatgaggtgtcagtgtgggttcatctattatcacagacatcccactctctggtaggatgttgatagtggggaaggctgtatgtgtggcaggagggggtggggtacatgcgaattctgtaccttctgctcagtcttgctactaccgtaaaactgctctaaaaaataaagcctaattttctaaagtatattggtgccctagtaatggcaccccactccagtactcttg

SEQ ID NO: 19805 - DNA, 600 bp, Bovine  MMBT12028
aaatgccactcagtactctgtaatgacctacatgagaaaagactctaaaacagagtggatgtatgtacccacatgaccgattcgctttgctgtacacctgatgctaacacaacattgtaaacaaactctagtaaaaagtttaagaatacaagtggctattaggaaatgttaagttacagacatgtgctcacgttctgttcctattgatgttgctgcactagagtttaaagggaattcacccctccaaacccaagtcttcactatggagcctaactgcttaggtacagaagagtccccatrtttcttaaatgcttctaagtgatgaaarttatacccaattgaaayatctgaaagtctctggattttgctcacttgtttctggatttttcatgttggtgggaaagaacagtacttcctacatgtgtacaaatatcacaggacatgctgaaccccaagtgcaccgtatttttaacgtgtgcgggaccttcagcccagtttacgagagaggacgtactaagtcctgagaaaacactcagcatcacccctgatgccagcagcgcattttctgccaagtgccccaagctgctgctacctgccctc

SEQ ID NO: 19806 - DNA, 600 bp, Bovine  MMBT22321
ctaggagtggagttgctggattatatggtaactatgttcaactttttgaggaaacgtcagacgggttttccacagcagctgcacaattttacattcccaccagcagtgtatgaaggtcctaattcctccatatcctccaaaacacctgtcattttcagtttgcttttaggggtgttrtctcactgtgactttgctaatgaccttttttaaaaatttattttttattgaagtatagttgaataaaatgacttctttttttttgaccagggatcgaacacaaaccctcatcagtaaaagcakagagtcctaaccacttgaccaccagggaattcccactaatgaccttttaacggaacatcttacttcctaacaaatatttctttgagtattatcacctaacaaatactattttgaaggcaatcatggctaaagcctttggtggtcgtcatagtagtcgtaagaatactaacagttactactactgccatgaacaccactgacactttccgtagcacatactgtgtggccaggctcattatactagacattgtatcctcacaataactggatgaactaagtggtattgttttctccatttca

SEQ ID NO: 19807 - DNA, 598 bp, Bovine  MMBT03404
  misc_feature (1)..(66): n is any nucleotide
nnnnnnnnnnnnnnnnnnnnnnnnnnnnnnnnnnnnnnnnnnnnnnnnnnnnnnnnnnnnnnnnnnattttaaaaactacaaggttaaaggatgaatgttttaagtagacatggcattaaatgaacactgctgtaaaacaaattttaatgtgatatttttctctccctctcctaaactcctatgttgagaggaatttaccagaaaaagggaaattttgttcaggcttctgtgtcctcattatttcattcatcactgaagtagtccattgcctgctgacaaacttcacacatcactacctrggaatgattgacagctgacattatctgcaagacttgattgagctaattgacattcacagtctgagcataaaaatgagagtgagggaaagtcttcctctttacttatgtgttcttgcttgaccttcatctgtgtttgcattgtgtggctttagattgtagagattatacttgcaaaatgttttcacaagtatttaggcatttttaggaatactcctaaaaygaataattctttaaagtttattctgtatatgactatatcaagcaaataattcttctgtatttaaaagctatgcctgag

SEQ ID NO: 19808 - DNA, 600 bp, Bovine  MMBT07931
agcacacaygcttgtcgtcatagttgcggtgtaacggaggggcgtgcacactgctgcatagcgrtcataggccattgctgccaagaggaaattttccrtagtggcaaaggctgcaaagaagaacatctgagcagcacacacattataggagatgaccccgcggcctttcaggaatccagccaggactgtgggaatgacagctgtggagtaaccaaagtccaccagagacaggttactgaggaaaaagtacatgggcgtgtggagatgcgagtccaggagcaccagcaggatgatgcccaygtttccaaccacattgaccaagtaaatgagaatgaatattataaagaggggaacttgcagatttttggtgctggttagtcctaggagaatgaactgtgtcacttcggtcgtgttctccatcygggttacttaagaatcagatgtctagagcaaagagaaacaaaggaacagagygtcaaatttagctaagattgcagtaacagcraaactgaaatgtttatatctcatgaacattttttcgttacagaaatgatacrtgcttcaagagtctccacatctaaagcatggacttatgagtga

SEQ ID NO: 19809 - DNA, 600 bp, Bovine  MMBT07229
tggaggatgcgatgattaagtggctgctacaggggtccaggcaagagactttagggcagtaggtgagtttgagagcaccctaggaggtaaccaggaccggagcaggtgacaggttggattgtggggtttaggggaagggaaatagcaaagacaccctgcaggtttctgccttgtgcagttggatggggtgatgtttccatttgctgagacaggaaacactagggggacaaccaggtttaaggattgaggctggaggacctttgagaccaccagaggaggtattaggtaagtatttggccstatgggggaatttactgggcttcttgccatcaccccatattaggaaaatgaaagcccaggggttgagatgacctaggtaatgggactcggtgagtccaggtctcgtgtatatgaagccatgacgtgtctttccagagtctgaagaagaggatgaggacagcccagaaagttccaacttgcctctcagctggctcccccagcaggatcctcaatcggacatgaccaaagaggatccaagtgaggctctgcaaggtcctgaggtccaggaagctggagagagctccccgaggttggggtatg

SEQ ID NO: 19810 - DNA, 600 bp, Bovine  MMBT00657
tggggtccaggccatggtgagctggcttgcggaaagggagagcggagtcgtatgcttggacccgagtccatgggggctgtgaacctcktcttttgctacatcatctctctgtgtcacctccttcccagcaccacaggtctccttactctgaaagcaacacactgcttctgtctcygcactttctcccatgctcttctctctgcctgaagggccctccccttctttatttgactaactgctgctagtcttttaaggctcatttcaggccctggggagacctgctctgacccccaggctggktcacagctccttctcggggcacctacagccccctgagcacccttttgcacagcctgcctcaccagtctggtgatcacttgttcacggtccatctcctccaccaggcagcagatcttgggcgtgaggactgtgtttactcctgtctgggtccctagtgcctttcatcaggcctggcacactggggaaagcttgtccaatttgattagtaatgatggtcccctcgtgtttgaaaatgtttgtttttcaaagcacgttcacgatccttttgagccacccagccgttgcagagggaggcaaggc

SEQ ID NO: 19811 - DNA, 600 bp, Bovine  MMBT13208
gatgtccaaattcttagcaaaaaawttttaatgttgtatttttatttaaatgcaatataaaaatttagtataagcatttctgcaccactggtacaaatactttataataactgccttctaattttttaatttcttccatttggtaacaagtatttcagttattacaacctaatgagcagatgscccactcctaaaaaaatgccattgttttccttatttatgaaaaaactgaaaccagagaacgttaagtaacccagtcaaggtgaaacagcttgtatatggcagagctgagatttgaaytagacatggtctatgttgaagcctgtactcttgatcattaaactgtactttcttgttacaggaatagactttctttttcatcttcctggttctcagtttcatcatctgtaaaatggttataatacatatctcataaatttgctcatgagtattaaatgagaaaattgtgtatcaagtgcttggaacataaacatagtaatgcttaataaatgttaactgttgtggttataattgtcatcatcattgtcattaccactattaaaaaaacaattatttgcaaggtgtatttcccaccttttt

SEQ ID NO: 19812 - DNA, 600 bp, Bovine  MMBT12703
tcctctgtccgtgggattctccaagcaagaatactggagtgggttaccacttccttctccaacagcacagcacaaagctagggataaacagagcttatgtctgaagtcattgctcagcaggccctagagtgagtcaccaagactctccacactctggatgcctgtctgtcaaatggagacggcactgcctgcctgcagtgttgacggcaggttggagttgaaatatttttcgttaaaggacctaacataccgtaatcactattcattaaaataagtaacatgtgaacagcacctacatgkgcagagtcctcatccatatccttacaacagccccaaacgagtgagtttactgtatatctgagaagaggggaacttctggggtcagagagcaaggcagcagtgcagcaggaattcaaacttttgactcccaacttcctgtttgttcactacactacactactctactactctcttccctgtgatacactgtcgtcttatatatttagaaatgaggaaatgcaacatggttcattctacctaaaggctccacctgtacactttatcacctccttgatacaactccacacccacagctccatc

SEQ ID NO: 19813 - DNA, 600 bp, Bovine  MMBT03589
tatgtttgggttctttgaccatgaggcaagtaggatcttagctccccaaccaggaatcaaggcagcactccctgcagtggaaggcgaagtcttaaccactgggccaccagggaagtactaaagagggaccactttaaagagttaacttccacaactaaaggtattcatctgtggttttacaaaatggtagttttaaaatttttatccctagaaatgaaaaatgttctaaatgtcctttggattcatggagtcaacactttaccagatagtaaattaccagatagtgaaatcattacttgmtstaaatgctacatggattatatgactatttgtaaagttcagcacctggttccccacagagagttcagttcagttcagttcagtcgctcagtcatatctgactctttgcaaccccatgaatcgcagcacgccagggcctccctgtcactaaccatttattagccatgaagacgcaaaaaagtcagttggatgtccccagatgaggagaggcctgtctcacagagccctgctgccctcagtgatggaggaaccgatgcacgatgctcaggccctcctacagcagccctgcaatgaacactt

SEQ ID NO: 19814 - DNA, 600 bp, Bovine  MMBT11107
attcgaaaacttgattaccatcactactgtcttttccccttctagtaatagtgttagttgtgcaaactacgtctttaaagagcctttctgttttttgatggatataaggacatttgtgtctttcctttactgcctgcaggacccagattagttctgaaaatacaggagggactgaacacattttttgtcactgattgatttattgagacttcagaatgtcatggatgttaaaccaaacacgggcaagtaattttgcaattctaaataatatgaaataattcaatggggacttggagttgrgggtggaaaggtagattttgagagaagtcaggaggaaaaaaaaagtatttggcttgaactatgatgaatggccaggagaaatatcaataacctcagatatgcagatgatataacccttatggcagaaagcaaagaggaactgaagagcttcttgatgaaagtgaaagaggagagtgaaaagctgggttaaaactcaacatttaaaaaaggaagatcatggcatccagtcatcacttcatggcaaacagatggggaaacaatggaaacaatgagagactttattttcttgggctccaaaat

SEQ ID NO: 19815 - DNA, 600 bp, Bovine  MMBT02941
taagggcaaagaatctggaagagaacatatatatatatatggatatcactatgaagtgaagtgaagtgtttgtccctcagtcatgtccaactctttgcaaccccacagattatagcccgccaggctcctctgtccatggaattctccaggccagaatactggagtgggtagctgttcccttgcccgcagattttcccaacccagggatcaagcattgcagtttcaattctttatcactggagctaccagagaagcccacacctaaaactaacacaatattgtaagttgattatacttcartaaaaactttagaaaaagaaattgccattttacaggccctattgacaaattggatctaggcaataattacaaagtctgctaaaacccctgggtcaaataataataataaaacataaccacaaaactttaaattaccttcacaaccaacttcatcttctcccgtgatacagtccagctcaccattgcacttatactgctttggaatacaaacacccgatttacagagaaaaccttcacctcggcagtctgtgcaaacacaaatagaagaggggattttttttcattcttaagatgcaataa

SEQ ID NO: 19816 - DNA, 600 bp, Bovine  MMBT03905
acttggtgctgcccatggattgtctacagaggcaactgtaaatgttttgagttgaaagaaatggttgtctcactaatcataggcgtggtgcttccctgaagttcttaaaagttgttctttttacctcccctctgaaggtagcttagtacagtgtctgtaaccctagagttggacataatgcacaatttcattcaacttactactttcacagattaagaaactgagactcagattttggtgatttgctcaaggacaaagcagaaaatcaggattaaaaacctggctcacaattcccagtcyagtcctctttctgttatgacattttytttttttttttttaaagcaatgggttgttggctatagaatgaagaaaaaagagcatgtgaaactttttttttgtttcaaaccatcaaactccacctattagtacatgtctataagttaacagatagctattctctgcctacaaaatagccaatatcttaaaaattcaaacacaaacagatagagcagtacttactttataacatatgtgccatggactttcctaagcagttctctgggtggactctatgcttctttaggatacaaacattgcat

SEQ ID NO: 19817 - DNA, 600 bp, Bovine  MMBT19231
taccacagaacattacattaccacacctcccacccacacaaatgtactcctttcaaatgtcttttaagaacctctatttccacaaaactcattactttggggaagcctttccatattagcactgaccagaggcaagaattctgtacttttctaattattatctaaaagtagttaaattttatatggacatctaaatctgcttttttgactgcttgtctgtctggctgtgaaagaagtgtttctttacttatgtaaataaatatatggtaaaaaacctagatatcacttatgtagtaatartaatttctatcatctatttaaaaatttctgtcaatcactccaagtaattatgtctgtggacctcctttatttctcacatcaatactctaaaataagtactgccatttccattattttacaataagaaaggagagattcacaaaggtcaagtaacttgctcaagggcatacaggtattaaatgacagagcagagatttgagctaatacaatctggtctagagtctatgtgcttcagcatttgctatatggtcttccatttgctatatatatatactttggtcaaacaaggtcttcttttgg

SEQ ID NO: 19818 - DNA, 600 bp, Bovine  MMBT01583
atggctccgttttctctgaggtagagagatggtgctccaaaaactagccttcttggcaaaaggaagctgacagcacttttcctctctactcgttcagctcaccaggttgaagcttcttgttgctacaaagccaagagcagcagctatgcagatgatgyccagcactgatgccagagtgtccaccaatgccaatgttatgggtatctttgcacagccaagaactcaggagctatctctcataggagtcaaagctgcagaagatggctgaactcaaagcccacrcagattttagcttccccsagttaaaaygatcaagctcatcaaatccaacccatgagtttgggcaacagtctgtgcatacttcagttcyttttttaggatgcatttgctttaggaaactctaagaacactgattgtcaaaatgtaatgtgtagtttctaatccagtagaatatgagggtggctcagtggtacagaacctgcctgccaatacaggagagcgggttcaatccctgggtcggcaagatcccctggagaaggaaatgacaaccaactccagtattcttgcctggaaaatcccatggccagcagagcctggtgg

SEQ ID NO: 19819 - DNA, 453 bp, Bovine  MMBT12541
cagagattacacctaagaatttcccttgtagtaaccccatgaagtaacactttccacataaatacatctattttcccctaggcagaaataatgttaaaatggaaattggcagcactccttgaaggatgatttagaccaaactacagtttgcataatccatgaaggaaagtataatagaatgatgatatctatgctgtcttgtttaacactaattcatttaatccataattatatggaatgtctaccttatgacaaatcctaatttacatattgacaatacaaagataaatcagacaagayccctayttataaggaatttatattctgctgaggaggcataaactattgataaaaataaagaaaaataatctactataagtaccagaaagaaaataaaacagggtgatatatggttgcaggtagggaaaacttttgatgaatgtcaaagagagt

SEQ ID NO: 19820 - DNA, 447 bp, Bovine  MMBT19793
ttacacctaagaatttcccttgtagtaaccccatgaagtaacactttccacataaatacatctattttcccctaggcagaaataatgttaaaatggaaattggcagcactccttgaaggatgatttagaccaaactacagtttgcataatccatgaaggaaagtataatagaatgatgatatctatgctgtcttgtttaacactaattcatttaatccataattatatggaatgtctaccttatgacaaatcctaatttacatattgacaatacaaagataaatcagacaagayccctayttataaggaatttatattctgctgaggaggcataaactattgataaaaataaagaaaaataatctactataagtaccagaaagaaaataaaacagggtgatatatggttgcaggtagggaaaacttttgatgaatgtcaaagagagt

SEQ ID NO: 19821 - DNA, 600 bp, Bovine  MMBT11269
ataacatcttgccccagaattgagttcagttgtttmaaaaccaggaactcgttcaaacaggcagtgcacacctggagcgcttaagggagargtgtgaggcaggggaggtccctgcccactctcgccygtgggattgtttcttagcctgcttwttttgcaggagtacctttttattcatgtcttccctcaccaaggtraccagcagtttgagctgtaggaaggcacaggggtgtcctcctgtccacagggaccttggcatcatccttggagggcagagacgccgaaacagaccccgaagtwcaggtgctggccaatgaagggagggcgactgtctgcacttggaacatctggccgatgagtgtcctgtggatgaaacatctgggaggttgcctgagagacttagtttccatccagatgttctttagacacagaccattacatgaaatcattagttgctcttggcaacacgcccaggagttccaaaccttgcagattcctaaatagactttctgtaaagagctggaggggtgtgtccatgaagatgacttacagggcctcagagagaaggtgcgatggagggatgaccctgccaagagccct

SEQ ID NO: 19822 - DNA, 600 bp, Bovine  MMBT03980
gtcatgttgctgggtagggtcacccaattcccagtctgaaagttctccattctacctggactctaaagagcaaaacaatatttaataagctgaccttgaacccagataatatcagtgggcacattcacaagacgagcacaaggttttatccagctctgcaccggcagaattctgaattctctctgattttccattttaacactgggcagtactttgagtcgtgagtggctttaaattattcagttgcaaataatacatattaaaagtaagtttttatgcatcgctctttgtgttctgggmataaacacctgtcagtgacttggttgtatacaggctgttacgggatgagtgggtcatatgttaccrctccagtaccactgctgggcaccagacagtgatgggaggtggatgccattgagggaagctgagaagcaagtgtctgtggttaaatattgatatgttttgcatagtccttgtcaattaagtgctccttgatagccagctagagatctgtttacaacccagtctcctgagcactgattatattttagtcattccaatgttgaaatactcagtctcaagtgaagaaagaaagaagca

SEQ ID NO: 19823 - DNA, 600 bp, Bovine  MMBT04765
gtcagatcatttatttcatgacatgattctgtgaaagcaaacaatgtaaatattagcctgaaacataaaaataatgatagctatgggaaaacaactctattttctaaatgaggaaattatatgttgagaacatcatgtttttagaggtataagaatacagcctaatgctattgcttatgtcacaccagaaaacaacaattctatcacaaatatgattaaggtctttattcttcacatgggatcctgaggctaagtgactcagacagtcaaacccatcacctgcagttgatttaacaaggrcaatactaataaaggacttacattcatactgctcactttaaatacatgtctctagaggaactcacaggcagaactggattgataaatatttcaaatagcctttatctaggagttctgagagtttcttattgacaatatcaaaggctttagggaggtgctctgaataataaatgtgcaaatacagttatagaaaggtctttgaaggacaatgctttttaatttaatagatgggttataggatgaggtagtgagcagttagccagggaatctaaytctgatgaaagagtgccaactctatga

SEQ ID NO: 19824 - DNA, 600 bp, Bovine  MMBT03089
gaccctgggtggagtggggaggctgataaaggagcagagatcattgcagctgggggggctcccctatctcctctggaggactatatctacctcttctttgatgtctcctttcttcctctctggtctcttcactttctcaatctccaaggtctcttcccttttgcttgtgagcactcacttgccttttctcttttaaagaaacaactggcccttctgcagcagaatcactggatttctcaacttccttttactaccaaattcctcagcaaagtcattgacattcaccatttccttggctcyccttaactccctgcagtctggttcctatcttcttccctttcccttccccctactgaactgatattgtcttcttcaaggtcacagttgcaataaccaccccgccaccagtatcaagatggcagcatttattgagcgcatccttgtttcaggcctggacccaggcccgatcagtagccatcatccatttgtagataaggaagctgaagacctaggaggtacttttcttgctctgcctaaatcaatggctgagcagagatgtgacccaagcctgtggtgctcttgctgttaaacactgtgcct

SEQ ID NO: 19825 - DNA, 600 bp, Bovine  MMBT07874
atcagctatatgtatacataatgtcctttccttcttggacctccctgccagctcccccctcaatcctacccatctaggtcatcaaagagcactgaagtgacctccccgtgctatacaccagcttcccaccagcgatctatttcacagctgctggtctgtgtatgtcactctctcccgattcatcccaccctccccttccccctctgtgtccacacaccccttctctatgtctgcatctctgttcctgccctgcaaatatgttcatctggaccattttttctagatttcatattcatgccrcaatatacgatatttgtttttctccttcygacttacttcacagtgtatgacagactctaggtccatccttttaatagtactttctgggaagaactccagaagggctggcctcacttccccttcccctcccatgagtgtccaggcaggagagttgatcccttgaaggacmcaggtaagtctctggacccagcccagcatttcagcaaggagctgatcacaggcttgttttcaccccaggtttcaggctttttaaaaatgaaccaggttctacttaacatcaaaacattttcagttctctcc

SEQ ID NO: 19826 - DNA, 600 bp, Bovine  MMBT12947
atgcaataaacatttaaacatatgtcatattttaatatattttcaaagctcctaactgataatttctattctttgaattaaatcatagagaagtcttgtaggtcaaatccctcccaaatacaaattcttgcttctttacaatccaatatcaagtttctcttttaacactgccttttaaaatattttggttgtttaaagttccttcttaattattgacctaatctctttctttgaaaaatctgcctctttggtttcagttcttttctctgtgattttaaggaaatgcttaaacatttcatrtgttatcaagacttactcatgaggatttatgctggagtgttaaccctgggagaagattacctcacagcatagtgaaatagttattgaaagcgaggttcccttctgtgtttgcgtgttcagatttgtttatactggattaaaaatttcatttggtgtgtgtatatctatacttttccaattcaggagagcctgatggactacagtccatgggttcacaaagagtaggacatgaaggaggactaagaactcatactttccaattactaattgcagtttatgtcttccttctgcccttctcat

SEQ ID NO: 19827 - DNA, 600 bp, Bovine  MMBT13817
gggaaagccagccagagtccaggaggggagcagccggatgaagagagggtgcagccaacttgaacggagatgaactgartcttggggggaggctgccttctctaaaaccaaggattgtttgtagacttcatcccttagaaataacgaggggcttaaaaatgaaacccccactctgccattggcagtttggaggctgtcttcttatcacagatgatgataatgccacgaagtgttaaccttgggttcagattgcggattctaccttccttctgaagcaaagtggatggggtggggaaataygtttgcagaagccttaatattcaagaagtgtggacttccgtcagccccatgtatcatataatgttcatggggaacatcagtttaaattgagtctttgaccctgacttatcctgattcctctagaatccacaatctgtaagccagcttgggtaagtcaatcacagatcttggcagggctacatgggtaacctactgcagacgattatttcatatggagggtatatcagtgtgatcagctaaactctctcttccacagaaggatgaatgtaaaagacgaaaaagagtagaaagtcttggagt

SEQ ID NO: 19828 - DNA, 600 bp, Bovine  MMBT22770
atcccggaagatgatgatgttggatgtcatgggtcccgggacaccatcgactctcagggatgctggggcctggtggcatcatggctgaattggctcctgggaggtgatgacagcatggttaaggtggatcctggggcatgaagacattgcggttggagtggatcctgggagatgatgacagcacaattgtgggggtctgtgggaaactggggcatcatcagtcctagtggatcctggtagaagatgtcaccatcggccatactggattctggaaggtgatgacatcactggtcatggtgsgttctgggggatgatgacatcatcagctgtggtgaatcctgggagatgatgacaccatgttggkggagaatcatggatgatggtgacaccattggctctagrctaccttagaaggtgacactatagttatgatgaatcttggatgagaacgagaccctagctgtggtggatcctgggagatgaacacgccgtagatcatagggaaccctgggaaatgatgtcatcaccagccatggttaccacgggaccccagstgcaatgcggccatgagtggtggaagtcttgtggtgccgatgatgt

SEQ ID NO: 19829 - DNA, 600 bp, Bovine  MMBT22771
ggtgatgacagcatggttaaggtggatcctggggcatgaagacattgcggttggagtggatcctgggagatgatgacagcacaattgtgggggtctgtgggaaactggggcatcatcagtcctagtggatcctggtagaagatgtcaccatcggccatactggattctggaaggtgatgacatcactggtcatggtgsgttctgggggatgatgacatcatcagctgtggtgaatcctgggagatgatgacaccatgttggkggagaatcatggatgatggtgacaccattggctctagrctaccttagaaggtgacactatagttatgatgaatcttggatgagaacgagaccctagctgtggtggatcctgggagatgaacacgccgtagatcatagggaaccctgggaaatgatgtcatcaccagccatggttaccacgggaccccagstgcaatgcggccatgagtggtggaagtcttgtggtgccgatgatgtcagtagcaggcacaccccaccccccaccccaacaggaggccaggactctgcagagttgatgatgtctgtagttgtggcagagagatgtggggccgcctaaga

SEQ ID NO: 19830 - DNA, 600 bp, Bovine  MMBT09461
gactgagtgtgtatatatatgtatgtgtgccatatctgtcagtggacatttatgttgctcccatatcttggctattataagtagtgttgctgtggtcatcacggtgcatggatccttttgaattagacttttccctggatatatctcttatgagtaagatttctagatcataaggcaactcaatttttagtgtttaaggaacctccatattgttctccctagtgaaaatcagccacatttaaagtcatttttcaattgaagacttcccccaagaggcagtctttttatcctgctcacctstgatctatttattgcgttgcctgaatactccagtcatgctgccctaaaccatttcattcatatctttgctttcaaacactgtctatagtatggctacagcagagaagttgctccttcactggttttaaaacctttgggttgtccaaagagggaagagaaagttcagttgcacttgcttttgccactttctaaattgatgcattctcatcaactgcatataccccatgtaactcagtaaagcattcagaagaatcttttctgagacagatcactaaaatccttcttagcagagagggcagt

SEQ ID NO: 19831 - DNA, 600 bp, Bovine  MMBT00837
tgaaagccttactgcaaagtgatgactagtcagatctagaactcagggtttatgactcttaatcagcgttgttatcactaaaccatatccccagtcatggccagccataagtaagaacagatagaaaaaatgtacctagagttcccccgaaaggccattagacaccagtctatagagtttcttctacacaccaggagctaatctgtagattcagttttacatctcacatctcaaaacttagtaaaacagccaccaaggttgaataaatgggttattattacagcccttcatctccctgcsgcaggctctcaaatgcctcaatcagagctgtgtgttgcaagcatgcctttgttattagcctgtttggtggaggttgttcactcttccacgtttctttgaaaaggacagaaacaatttggaatatctttccttcagcactcctaggcttgtttcaggtggtgaaggtagaggtcactttattaataaaaccatcaaggaaggctgtcatggtaacacattgccttgattccttgaagtgcaggagacaaagccagaaagagaaactttcaagtctataaatacaggcccagcattgctcaa

SEQ ID NO: 19832 - DNA, 600 bp, Bovine  MMBT21532
ttcgtgtgccaggcatttcacagtgggttccctcgcctccgtgatggagaataaacctgtgcttcttgcaggctccctgcctgtgcctctcagcctgtcttcccccagcgttacctttgctgaatttacctgctgcctctcaatcccagtttggtttctctgctcttttacccttcctgccctatacatttgcatagtagccaatagctactccagagaacaggaggtgagtttactgaagcttgatattagggcaagaagcagagtatgtaggctgcgtcttcaaatacaaaatgtgtrtgatggcttgttgggggtggtgcatgcgtgctggtcacttmagttgtgaccctgcgaccccatggactatagcccaccaggctcctctgtccatggggattctccaggcaagaatactggagtgrgttgccgttcccttctccaggggaycttcccaacccagggattgaaccctcgtctcttacgcctcctgcattgcaggcaggttctttaccattagtgccacctgggaaatccagctgggggcggggttgtcttttatttgttttctctttgtccttttgtcggttttctctctct

SEQ ID NO: 19833 - DNA, 600 bp, Bovine  MMBT03495
atcaaactgctctcatttcccccacaatatctttcattttcagggaaatttgttgtgcacattatattagattggcaaacatattaggtatgtaaattttggttaggccaataaggaaattactgtgtaacacagagttattgaatacaaaattcctattcagctgtatacaaaacaaagacttcagtgaatggataaataattccataaggttttcaaaaataatttttaactgcttctggaactgaacactatctttaaaaacaatagagggtctgaaaacaaaattaactgggtttmattttaatacatgggaggagaaaaacacaaccaaaaaaatgtgtgtctgtctgtgtgcctataaaaatttacctttattttggttgtatttgcttataaaacaactaacaaagacatactttgtttcagaaaaaagtctcagtttagaagtatataaaaagttaaaatccccccatcccttcctcagttatcttagttacctctcttcctcaaggataactattaatttgataaacattacaacagtctgtttctcatatacatttacaaacacacatatatatatagtgtgtacatgta

SEQ ID NO: 19834 - DNA, 600 bp, Bovine  MMBT03186
acttccaaaactagcacacaagatgcaaatggtttcaaaaaatagaccccaagccaaattgaacacaaataccaarggaagagaagcagacagacagaaagagctacatgagagtctaggcatacccagggcaggtttaattagctctgccctgcagactttctctgacacacacacaggtatcccatacaaaaaggcaactggaggtcttctagtatcactggaactctgcagatgcttccggatacttccaaaaacatctagataccccacacatgtactctttttgagagcagcaasaaggttcaccaaaggtgtgagacagtctgtggctggaggattgccagacatttattaagcacctactgtgtgccaggcatgtgccagccaggtactgtcacctacctacctactgacctgaatgcattcatttcccaaagtcccctgaggtagattgttagttctgttccacagtcgaggaaactgaggctcagtgtttatgatttatacactgcaaggggggagtctaatcccctgagctgcccaattcttagtttaatatacttcccattagccacagacatgtatgtgcaaatgtta

SEQ ID NO: 19835 - DNA, 600 bp, Bovine  MMBT19809
taatttcctttcctttctggcaatctcaagtatattttaagttcaaytgagtacacgtcctcctttctcaatgaaaccatttgacagttctcaccatgaaaacctctctccattattaattctcaaaactcattttgaacttcttgtttatttcagtttaacaattaagaatgtattactgraaaaaaaaagaatgtattactggrtttcctgaattacacatattttctccaaaatactgtttgtttcaatacagaaaccgtscccttgtcttctaatatgcctaagtgactaccatamgcatacagwgaaaactcagcagatgcttgttttttgatagttgttaagttggtgaagaaatggtggctccattatcaataacttaatggtcaaggactaaatgctactttaaaaattctagcttaatcttgaaatagaatactctgtatctggacttacccaagaatcctgccatgtattataaatctatttttatgaataattatagatgaaattgtagataaatggctcttgtgttcggttgttctgggaagtgcttaacattttcaaataatgctatttactttttcattgtataac

SEQ ID NO: 19836 - DNA, 600 bp, Bovine  MMBT05187
ttagtgttatttgtgaagaaatttggtatcatactttgcttagaagtaattatctggggaaactgaaatttcattttcccaaatctattagttactgcaaatttaagctaagataggccatttctgtttaagtaaattagtcaaaagccaaaagagaagttgagctcaatgagagattattttcagaatctctttgtatcatattcaaacattacaacttaattaacaaaggctacagctctaaaagcgcctgtaaattccgtttcttcaatgtacctctctccctgtgtccctattcayctctgaaaagtcaatactttctagactgtaacatttgctgagacttkaatttccaaataaatttattcttttcagttcttcattttattgaaactgtaagttgacattcaagaacaattcaccctaatgttggaaaaaaaaatgcttttccattattgctattttgaatracttccaggaaagaaaacagattacaacttttgataacatacgaagaaaatattattatcacagcttgaaatctgttaacagggactttctaaggaacaaacattaaagtacaacagaaatttaattaca

SEQ ID NO: 19837 - DNA, 600 bp, Bovine  MMBT05729
atggcaaatggtccagaagcactctgggcctgaccaggaaaggctgtgctgggatcccagacatatgctcatttttgtattggctttggtgggaaatagggcaatgcttattaattctaccactgggaagaaactgattagctttctcagttccaatgaaaaattaactataaataaatagataaatgatcagatgctagtgctggaatcagcaattgtgactagggagtggagctgtggtgggatcttggatggcaacaccttggcagtgatggaggagcagttcccagaaacagggaygtgttctcagaatgggcatgctctaaagaccaggtgrtaagtttccactgtggcaaagttcactgtccctttttattgggaaattaattctggcttttgaatacagagctattttaggcataactgatatggaaaaaaaccttgaactttttttccaattcaacagaaataggcaaaactttccaagaatcagtacaaatttaaaattatttagaattacactgggaaatatttggaatcatcctgtatagcacacaaaaaggtaaaataccatcaaatatcactgattccagcaaacct

SEQ ID NO: 19838 - DNA, 600 bp, Bovine  MMBT05035
aaccttccacctcctaagcagatactaatcagacaatatgtgagattacagaacagttaagtattgatgaaacattttctgagaaagtacaaaataagatttttttmatttattttcagtttcctggsgttgaataaaatcatttggaaagaatttatcatactgcagggaagataaagaatgaaaattatcctaacagatcactaaaaatatccagtcaatctcacaaacagaactcaagagaatatttgtgtattatagcacattaaatggtaggtgtttctttttgatgattattcyggtgactatctcaaagaaaatgtgcgttcactgagaaaatgtcctcactgcaaaacaacagataattcaataccacagttctgaaaaataatgtatttctgttttcaaaatgagaagtrggagattatatttcaagtttcttaactccttaaaaactatattatctgactgagtaggtgaaagaattataaatctacactcccaattcattctcttaaatgcctctttgcaaataagcaatgaagtattggcaaagtactaaattatgccatttattaattgcctaaaagcatactgaaa

SEQ ID NO: 19839 - DNA, 600 bp, Bovine  MMBT18041
ccagacccaccctcacgggcccccccgtagctccttgtgcagggcggtctccgggcattgtgccacacccaagcaccaatgtctccactcagctcctgccagcagatctgcccagtaggtgttgttaatgtacccattttacagagaaagcaactgaggctcagagagaaggcaatgactggtcgcagggctcgccgccagtgggaggcagagctgaactcaaactctgactcactctgggccccgcacctcacgtccaccagcacgtcctccaaggagccactcagctgctagaaatcycaaatctactgtgaggcaggtgtgtgcagagccctgtgtgtttcccatctatcctcctgacaaccctgagacaggcctttgcagaagcacaggaggaggccctgccgttgggtgtgttctgaggctctgtcctcgccgcgtcctctcctcctgcgggtccccagaaccagacagcaagctcccgggccgtgtggtacccactgagcccagcacaaggccaggcctcagcaggggccccctgacggcccagggtgcacgcttcactctctgaggaagcacccggccctgcattcgtggggc

SEQ ID NO: 19840 - DNA, 600 bp, Bovine  MMBT09035
taaagagtgctatacaagaattttaacacaggcagtctctttccactacatactgaacacctactatttgcaaggcatggttgaaggtgctgggaatacaatgtgaccaagactaagttcctgcctttgcagagcttacattttaatgggaggagacagataataaataaaacaaacgcatataactttaaaatcacaatctttatatttacatctcatttccccattaatcactggtacgaccttgagccattactaaccccctctgaacctcaactcataatcatatgtagaactggrctgatgtgggagcaaaataagaatacttgtaaaatggcttttcataccatctgccacatgctgctgctgctaagtcacttcagtcgtgtcygactctgtgtgaccccatagatggcagcccaccaggctccctcryccctgggattctccaggcaagawcactggagtgggttgccatttccttctccacataacaggggcttaataaatgttaatggttgaatctggatcccaacaaagtacragccccacgaagagaagcgaaaggagttttggaactggagaactggttgaaggagt

SEQ ID NO: 19841 - DNA, 600 bp, Bovine  MMBT10015
gcaaggcttctgaagaatgcatactgcattgtacttctatatccaccccctgctcattttattttgataaattttaacttaaaggcataataccttagaatgttctgttgacacatggagtgtttatttgtataatcaccatacaatttggcattgactacgtttacaacatgattataaagcactgtagggctagaaatgcaaatgccattaaatcaagaactgtaattttggttctgtctccacaccattgctttgtccaagtcccccattcagagtgacaaacaagacatagatggytccaattagtcatcaggcttgcactagaactaaaaacaatctgaaagggaaacaagggggtgctggatatggaacaaagtgtgagtttgacaggataaaaaaatccataactaaatatttgttgtcatgtgaaaagggcagcagagaggaatcagattctgactctgtgtgcccttgaacaaatcatttttctactctggatcttgagcttctataaaactaaggaatgggtttaatggactaaagtaactatacaatgactaaagttttaatagtcgaatataatgctgtttaaatagt

SEQ ID NO: 19842 - DNA, 600 bp, Bovine  MMBT13346
cagccctctttgagttgctagaatctgatgagcctttgccctcaccatccsctctgccctaatgtcctttctcccactcttcctggcaaacaccgaatagccttcaagtctttgcttaaatataacctccttggagaaaccttcccctgccatcctatctaaaggtgacctcctcacacttcctcagagcgccctgtatttttccttcagggtgcttattgtcagttatggttacacctttacttggggggttgttggttcatgtctgcctctctcagaagactgaaagcaccaccaagrgtgttgggtttaacatctgggttattctgcatccctgcgcttagcatggtgctagagaaataactgttgtgaagaaaagaggccagtgcggaggctgtcctgctgccatatttccagcaggtggcgttccagggccgaacttcatcagtcccctgactccaggagggctccccgccttccattctccaacctcctcccaccccctgcctcggagccctctgcactctgctcacgtctttgagtcttgaggttgcacatcatggttatgtttgccctcatctcctacagggggctagtggc

SEQ ID NO: 19843 - DNA, 598 bp, Bovine  MMBT06578
  misc_feature (1)..(191): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaataagccttacaccccaactgcaattggagattcaataaatcacatccaaagattcatttcaagccaaagctttttccctgactaggagaccttggattgtatragatggatgtctctattaaggcattatcacagagacaactgtacagcaatgtgttaaggagaagagtaagagaataagacgtgccctgcgagaaagtatcaacagactaaaaatacagtcatcattgtcatccttttaaacagtatgatctgaacgtactcaggtcagaaacacctcctagctgtcactggtaagcatacagatggcctctgagtatatgcatcactaaagcaccgagtttgcatgcccatctcaaaacaacatagccatggggaactacgataaagctgaaattttc

SEQ ID NO: 19844 - DNA, 578 bp, Bovine  MMBT12498
agattagaycatgaaataaataattttattcatatgatctgggagagaaaaagagacgaagaaaggacatatgcttagaggttatggaaagactgaaggaggaaacaggttctggaagaaaccagaaaatttgtcagttcaagacatggggaaattggctccaaaagctgagacagagaaagagaaaagagataaaaaatgccttacattttattgcagagtatacttcccagagcatctggcaaaagctgtctttcttcattcctacttccaacactagattttcaaatgaacctatcyccttccttactggaaaatgtctagaatctaaatataaatgacctcagtgatcccactgacctccagtcaggcattcagaaggccctctctggagaggattactgagaatgggggcaggagagcatcatggcctaggagtgtttccagagttggagctcagtgttaggcttgaaagaagggcaaagtcagggaggaggtggacattctggaagagtaaacaacataaacaaacactgagatggaaatatttcaatgtgcttacaagacagtgatggcgg

SEQ ID NO: 19845 - DNA, 600 bp, Bovine  MMBT07957
ataaagaatccacctgccaatgtaggagacaacaggagatgtgggtttgatcctcggatcaggaagatctcctggagaaggaaacagcaacccacgccagtattcttkcctgggaaatcccatgaacaaagaagcctggtgggcgacagtccacagggtcgcagttggacaygacttagcgactgagcatggatgagcacgcacacacactatatatatatttcttaaagtaaacaaaactactcaaagaaaagcatcttctacagctacatccttccctagtaaggcagargggcaggyargkcctcttaccattaaaggggttatctcctccaaagaactcatggaaaactttttctgggttgccatggaagacgtaaccagttgtccatggggtctgcgatccaaactccagaggaattccgcccttcagaccctcctctccaaacttgtcatagatgcctcttttcacagctgtggatatgtgtcaccttgagaaggggccagcatgggggctaagagagctggagggctgggaagccagaggatatggggcagggaggaagaagcagggtgaagacagccttatttctaaagtgc

SEQ ID NO: 19846 - DNA, 598 bp, Bovine  MMBT12839
  misc_feature (1)..(33): n is any nucleotide
nnnnnnnnnnnnnnnnnnnnnnnnnnnnnnnnnttcaaatgggaaaatagcaatattagcacagttattaagagaaaaattgcttgctcatattattgcaaaatgctctaagaaataaattgttatgatatataataataaaactgtctatgctgagaggctttggtgatattttaaattaattgatttctaaaatgttatctttactgtaatagatcagtttgttatagaaatctctgcatgatgtcttaaaagaagtgtgttgcaattatacatacaataaaccaaaccagtaaaagytcatagtctagacttgtagacactgtatgatgggaagacagcattgaatagtggaaagaacattaagttcaggtatgaactttggtgtaacctgattgtgaaattatcaaggtgatgaacctctcaacatttcagtaaactgacatggaaaattaagatattaagtctagttacatccaaaaaaatgcatgaaatacagcagatacttgacacttgagaatcatatgtccctcctcccgtccactacttccaacaccaacataatatttcagtcctcttgcaagcaagaggcaaccac

SEQ ID NO: 19847 - DNA, 600 bp, Bovine  MMBT04294
tccaatgcatgaaagtgaaaagtgaaagtgaagtcgctcagtcatgtctgactcctagygaccccatggactgcagcctaccaggctcctccgtccgtgggattttgccaggcaagagtactggagtrgggtgccattgccttcaccgtgacagtcactaaactagtcttttcccagaagccaagaattcatatacatataaattgttctttggagttattcaaggtactatttgcccttttatttcactgagctataattttcataagcttactttctagcatggaatggcgactcctygtttgttttcttcactagttaaaaacagaaaaggaactctccaaaactcaccatgaaacctcattagtatttgcaaactttattcacacatcatttaatttagtcatatattttgttggagcataaaatgcttccaaaggcttttggtattttggtcacattatattaggtgtctgttgccatacaacaaactgcccaaagcttaatatcttaaaacaacaataatttagtatttctmatgatcctctggttggatgagcagtcctygtctgctttgcctggcctcactcgtgtgagttt

SEQ ID NO: 19848 - DNA, 580 bp, Bovine  MMBT23268
acactcatcttcctctgggtttcttattatgtgacaccatagctctccttatcattttagccaatttcaggcagtgttgtctgttatctatggccaaaaccatgataactgaatgctgctgctgctgctgctaagtcrctcagtcatgtccgactctgtgtgaccccatggactgcagcccaccaggctcctccrtccatgggattttccaggcaagaacactggagtggggtgccattgccttctccgaactgagtgctagaacacccaaatctcaaaccagaaaaaaatcccctatakaaattctatatccagcaaaacatccttcagatatgaaggagagatttaagacattctcagataaataaaaagtgagagaattggtcactagcagatctgccctaccagaaattctaaaggtggtctttcaagctaaaatgaaataacatggactataactgaaatcaacatgaaaaaatagagtactggtaaaggtcacgacataggtaaacataaaagacagtttaaaatagttctctagttgtaactctcccatcttgttggttgtaacaactgcatg

SEQ ID NO: 19849 - DNA, 600 bp, Bovine  MMBT09003
ggaaaaggacttaagggaagaacactttactaatagaccttgcattaccctggcagcggcatttgcaccaaacactgatggaaagagatcctggggcaggcgaaaaaaggataaaccaacttcacgttggcattgcccccagaggtgcttttccgtaaatgaatagattgtgaatgtttcagctttctcatttgtcattttatctattcagcactcatctactcgtctggtacccatgccccattttcctcttggggaatcccaccgtgtcctctgttctcagtccatgagattccaggkcagctcaagacgaagcacatgatccaggcttaagccaatcagtgcagtccattctcctggggatagaggttagtttaagaactggcagctgatcaatcaaattcaattagataccttgaggttttctctaggatttctgggaaaaagattcactctttctcttaaacctcaaatctgggagatgtagggcctggaactcggctattttttgatcatgtgaaaactgagtctgaagccagcagagctgagagatggaaagtaatcacgtcctgacaatggtcctgaatccagttgtgtctg

SEQ ID NO: 19850 - DNA, 598 bp, Bovine  MMBT01602
  misc_feature (1)..(87): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnatctgtctgaggagaaaattatttgaactgggacttacgggacatgaaggagcccacacaggtctgtggccgaagtaaaccagaaacaaggaccaggggatgcaaatgccctggatgagagcctgcccggcgtagtggagtgacagcggtcgccactgcggctgtactgcagtgagaaagacgagagggaggtagaggccagtggaagccttrcagatcatggccacgcgtgcgaagggctagggaaggacttggtctcaagtctgttttaaggacattcctctgctaagtgcaaaagggactggatcagaatgagactcaatcaggaacatcagttgagctcttgaaacaatctaggatttagtcttgaaaggtagtaaaagaattagggagaaggagagaattatgtttggagatggaattgtttgagcttgccctagaggaaaagagatgaataataagtcattatacgtgttctcttggttgtaattcattttgattgagaaatagt

SEQ ID NO: 19851 - DNA, 600 bp, Bovine  MMBT04144
gcagaaaatgaggagtcctgttctctgactccacgtggaaaagagagccatttctttttgctcctttgaacacaagacatcctgtacatctgtcacgagtgcatttggcttcaagccacagaaactccaagtaagcaatggattaaacaatttaagggattttccttctccttgtgtccaactgcccatgatggagtagctccataatgttgtcaggtacggggctgcttctactctccgattcagtcattttagtcggtggcccttaccctcatgcttgttacactgtggtgacaagayggtgctgtccaagcagaaagggcatagagaaataagagaaaagcaaaaattcatgctaaggaagctgtcaccttaaaaatctttcttgcccaggaacttccactcatgtctcattggccaggatgatgctcatgaccacttcttgcagcatgggaggctggaaatacacttttttacctgagcacattatttccccttgctgaataataagaagaagtgtgggaaatggacaggcggcaatcactgtcttccacactctggtaccaacagtctgtggcatccactaccaaaagctgacag

SEQ ID NO: 19852 - DNA, 600 bp, Bovine  MMBT09787
gtgttgttgcttccaagttagaattctttcagtttctccagctgaactaagatctgtcaccttaggacctgtgcacacggtgtttccatgctggtgccattcttttcctcattctaccagctcctccccaccccaacatacatactcgacctgctgatcttggggtttcagatgaaaggttaggtctctgggagatctccctaacttacttccctctagactaggcgcatctactatgggtgtgtgcctccctcacttttcttattataactcgtatcacagtttattctaattgtctayttaagtctttattctttggtagactgtaaacttttagtttggatctgtcttgttcacattttcagtatacagcatataataagtgctcaatgacaatatttatggtacatttctgattttgtcttttctccttggtgtgaggacatttatacccagtgtggtagtgctcactcattagtcatagatcttgtaccatcgggtattatgtgcggtgagggatgtgatgtcagaggcacctctggaatgttgtcactcagtggtggttttcactctgggctttgtagttacagatgcctaagg

SEQ ID NO: 19853 - DNA, 600 bp, Bovine  MMBT09103
tggtgataagtccatataagcaatcatcaccactttcatacccactttccacttgggttgtaggacaaccctatcggttaagaatattgttcacattttacaaaagcaattaagatgcttagagaaattgtagtaaaaggaagcctgagtcttgaaagatgcttgcctctgatacagcttgcttaggcagagagaaggaccatcttgcccttaaaaacagtctcaaaatgttagagatacacctcccaacaccaactccctccaaaatatccattttcaaacactatcgtttatgtgctrctgtgtgctgatgagtctattgacctgtgagcataatttagagatctttgaatttataaaccaactctccatggctgtcatctcctctttgatagcaraaagctgagggattttctctcccagtagttccaacttccttggggattttcacaggtatcagtgaagcagactttgtctttgttcaccagctgctgtggctttatagagcaatttgctgttgttcagtcactgagttatattcaaccctttaggaacccatggactgcagcatgacagacttctctgtycttcgctatctcc

SEQ ID NO: 19854 - DNA, 600 bp, Bovine  MMBT09500
tccaagaacattcctcaggtaagattttaaagttttttatatgaaactagcaaagcttctgtataatggaggcaaagtttaataattttttgaagcatttctattagaagagtaatgcttgttccttgtaaagtgaaaacaaaagtacttgaagcataaaaatgaaatctccttgtcgccactctgccaccagagcatagttttatccatttgttttgcttttggctgcctcaggcctcagttgcgggtgtggaataattttccttgcggcacaggggcttctctctagctgtggtgctygggctcagtagttgccccttggcacgagggagcttagttccccaaccawggattgaacctcatcccctgcctcattataaggtagattcttaaccctggaccaccaggggagtcccctatacaattttctttttattgctataatgtatttgacatatgtatgttgtattttctctgaaagccatttgtctgtttttgaaatactgcagtacagaaattttcaagcatgtcctccaggtactccacagtgacttgtctgcgcctctctgataggtgccttttcgcttttatttttttact

SEQ ID NO: 19855 - DNA, 601 bp, Bovine  MMBT04832
  misc_feature (1)..(1): n is any nucleotide
ngtataacaaaaaagtacaagtctgcaaaatttcttctacatccaaagaatctttggaaagtccaaccccctgtgactcatttgtcctaccccataagtaacattattttgaaatcatttttagcatgaagaaggattttctccaagttgaaatgagaccatgagagaatgaaagttaaaaaaaaaaaaaaaaaatgaggcaggaaatgtttactccatgttcagaacatatagaaatgcttagagagaccatggataccttcaaagaaaaggaacggaatacaattcaccaagactcttycctccttcttagtacagtccaagaaacagcccattatggagagctctgactctgattttcaatttgtgtcatgatgttggggagagtcaatgccaagattttttcactctttagatctttgcagagttgtttgcagttggatagatagaagtgtttgtgacattaaaaggcagcgatctgtcctggactacagcttatggcaagtgactggtctgaattgccttctactcaggcaagcaaaagggaaagttgaaaaagaagttcgaggattaagtttccatgtgtgtctccattcacaac

SEQ ID NO: 19856 - DNA, 600 bp, Bovine  MMBT04543
ccccctggtggccacgaggagcggcagcgcccacactcccacgtggaccatacactctcaccttttctatggagtatatcaccgcgccggccgagcctgtgtctttgtccgtggcctgcacagataacaccagggagcccaccggcaaggtctgtaacaaaagaaagtgaaagtgaagtctctcagtcgtgtccgactctttgtgaccccgtggactgaggctcctccatccatgggattctcaagaatactggagtgggttgccatttccttctccaggggatcttcccgacccagaarttgaacccaggcctcctgcattgcaggcagatgctttaacctctgagccaccagggaagcccctctaatacaaaaggtttcatcaactctgagttccaatccattttcttcatgcccaagcacatgcccccacctggagttccagggcccacagccctaccacggggatagtgacagaccttccagaacctgaagcccagtgttccacaggtggcccccttttcttcgcccgggctgggcctcttggggcatctgtacatcggcaggaagcagagttcccacttctcctctccctgatgg

SEQ ID NO: 19857 - DNA, 600 bp, Bovine  MMBT06181
ctttaagttaatttaatttctgattatttaatttctttttgctgctgttcaaagtcacatttcatggttgttttgtagtcttaactgctggagcttattgacatcaaaactttctagcattggagacgaaagcattggcagttgtgtgaacacagtttcctaagaaatcagtgcttacatagtttcctaattttccttctctgtcttctccagatttggctgacagctaaatatcaaggcctgaagacaggcacatttttttggccaggatcagatgtgaaaatcaatggaattttcccrgacatctataaaatctataatgkgtatgtataactgtactttttctaggacctataacacagaacagtttattttcttatcacagcctgagttctagcatttgaatgatatgttatctgaaaaatgagacctatcaaaataagaactctatttcaaagagttttaaatggatggtagatagtaaaactagatgaggtgtttttttttttttttctggagtttttctagaaagcactggtggtaacatgttggagtttgtgttcagatctttggataggaataagaattgaagtcctggtg

SEQ ID NO: 19858 - DNA, 600 bp, Bovine  MMBT06253
accttgtttttacccatcttctgaaaatgtgttgaatagtgtatttactatttaagttagtagtgctgaaagtcagtgtcttacatacaggggtttcaaattcaaatggacactgaggtaattaaaaaacaagtgaagtggaattgcattttctttaaaayaccttggggtagcttttagttttacaaagaaagataattttcattaaatatgtggcccattgtttatcattttttatgaagatcctcttcttttagcagagaaatagtataatgataaatggcatatattgtgtggccrtaggtcrtggagacaggaggaaatgatgaggacgatggtggggttcaattttcacaatgtgagaatcgaacccaaggttcccaggtcttatgaatttgcaagagaaaccatgagcctgttttcttatgttgaaatatcctacattttatttatttaaacaatttttaaaattaatttttattggagtgcagttactttacaatattgtgttagtctctactgtacaataaagtgaatcagctatacatacataacccctcccttttggctttgcttcctatttaggtcaccacagagcac

SEQ ID NO: 19859 - DNA, 603 bp, Bovine  MMBT12383
  misc_feature (1)..(3): n is any nucleotide
nnnttgtatactttgccactgctgtatttttatttttgcacaatttttgacagcgtagcatgaaatgtttttagaggactattgcatattttctgtacatttgttttatgccactgaactgagattatcaacgacacccactcttagcacgtgaataagagcactgtttgtaatactttgtgtactgcaaggtacaagttgcattcttgcacagaggctaatttggggtttgtttttttttttttttctggggattttaaataattggttttgtgttttctgaattatcaatctttcaagaaygtttagaatcttttckttcttaaaaatagtctaggagcaaactgaatatattctgtgacatttaaaaccttcatagaatagaaaaaagtgttgacttttaaagcttgttggattttaaaaggaattggctatatttttcaacactgtattaccttaacgaaagaaagttaaaactctaaacaaatggaaagtactataaggcagtattgtaaagaaaaggcattacttaattaatttggtttttttgttgttagagaacaggcaagagagaggtttcttatttcagtgcaatacatctcc

SEQ ID NO: 19860 - DNA, 600 bp, Bovine  MMBT03198
acaccaagaattctgtggtatgccacagtttatgaccttttgatctctcttcagggaataaaccccagaaatgacaagagtaaacaaaggtgtacttcctatcccccgcaaccctgaccccaagatcctattcatacttgaactctctcctaygctaattagacactgctttcttccagattggataggcatattatggtatcaagaatatgtatctactgtacacaagtacactttaattggcttacttggaatcaaaagtcaatgaaatgttagtaacagctgagaacagtcttatastgagagatcatgtttagcttgaaggtcaacaaaggcagtagtttgaagatgataagtatcaaatttttaaattcagaatctcacatccagggagttaattaaacagacttccatagcatcttaggatgtgcatgcttagtaacactgtatattattagctcttgacagtttttaaaaggttgaattataggttctttcacagaattcacctaatcatctttcagttccaaggaaatagtctggaattgctataaaccaaacaacaacaaaaatcccattgacccaaagagtgatttcatt

SEQ ID NO: 19861 - DNA, 600 bp, Bovine  MMBT07176
taaaatgagagaatcagaccagacttctgcttcttaactttttggctgtgatccctttgaaaatagtgaatatctgataaaaacctttggactagtttaccaatttacacactctaactttctataggagatacaagactatcaatttccctgagttgggcaccagcagaaggagttccagattaaccaatatatgatttcaaatctctgatatcactttaacattcaggtaacttcttcacagctgctgctgctgctaagtcgcttcagtcgtgtccaactctgtgcgaccccatagayggcagcccaccaggctcccccatccctgaagccttcctaaacccttaaaccagattctactagtataagtccttttagcaccctgtaatttttcttcaaaatacttatcacaatcctaataagttatcttttttattatctatccatttcaacacactctcaacaccatgatgtcaaaagtatctgtcttatgacaaagattttctccatgaccaaactctagacaggttcctccaaaccctcttcttgactagggctcaaccatgggctgtaaaagctatagactcaacacaaatgatt

SEQ ID NO: 19862 - DNA, 600 bp, Bovine  MMBT13166; identical to SEQ ID NO: 4532

SEQ ID NO: 19863 - DNA, 600 bp, Bovine  MMBT00717
taatgggtttcccagacttgtttgcatagttcatatgaagtatgtattataaattgagtatctattagccctgtgaaatgtaccacctggcttaaacatttttaaacataggaatgcaatattgacaaaaatctggtataaaagcttacaattttcttttatttttaactctaaaaagtgttattatttttatataacaatgttggacacatcagacttaaaacaatttcctaacattcacctgtccccctgcttaagcaaggtctccagaaatggtccccaaggacaatatacacatawaagtgattgattaagaaagtagccagggaagagaacttctcagtcagataaagcacatccatgggtaaaattatacttaattgttaaatattataaagtatctcaaagattgggaacaaaagatggatgtttaaccacttctatttttaatttgttaaattgaaacatagttgacttacaatgtttcaggtatacataaaagtgtgtatatatatctatatacacacatagtgtgtatacactatgtatatatataaaagtgtatatatatacacacacatagtgaagtgaaagtgaagt

SEQ ID NO: 19864 - DNA, 602 bp, Bovine  MMBT13797
  misc_feature (1)..(2): n is any nucleotide
nnattgcccaaggggagtttagtttgatggtctcaaagatccttcccatttcatcacacctctctgaaaaccaaggtgaggccctcagagtctccattcttcctctggaatctgccttcagagggcatgttgtctgggcattcttcttgtgaacattataagttgccaggcaaatatttttaaaatatctgtgtattttatatacctttacataccacatttgtaaaaaaaataaaaaagtccttctggattacttccaggaataactggagaggattctggttttgcttaactttagaacyaatttttctctcaagagtaaatttctttggggacaaaaatagagaaagcgtccactgtagcccaaaggcaacactgcccaggtgtgatatatgttcacgatgccatgtacctgcaacacattgacaggactgaagaagtgacygtctctccgtgctcctacctgcctctcacctgtcattcccacatctacagagagaagacagggagcatagtagcttcagcaacacctgaaacttgaataaaacatcaattctcaggctacaacacagacttactgaattgcagattttgcaagtggg

SEQ ID NO: 19865 - DNA, 598 bp, Bovine  MMBT03077
  misc_feature (1)..(157): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgaaattctatacattattcacaatgacatttacaatagcttgtacacatattttagcagacttctcttactttatttcttcaccctgggtggtttttagagaaaaggaagaaagagaggatatggtttcaaaatgaagasaggtctcatgaaacaaaccataatgttcccagcactttaccactaaaaatgtttaagggtaatttagagagaatatttctaaatgtgatttctgatacatatacaaaaataacatacacataaatacctaaatttcataatggcaacatgtrgcatgagggctttttccttttataacaaagatggataaaaagaaaacaaaggttaagagaacaatagcagaaaatgtccaatattttcccttaattggtttagagttctagaacaaaataatagaatgtttattactaagacacag

SEQ ID NO: 19866 - DNA, 600 bp, Bovine  MMBT07462
gcctgacagggtggttgttactattaagcatttatatagcactttacattggccaagtgctcccaatcatttattagttaattctcccagcactctggagccgtcagtggactctggttgccatttctccaatctggagacgaggttgctgaggtcaggcgaggccagatgcctcgtgtagggttacctggctcaggtggcccgagtcactggctctgcctttgacccttgactacctgtgggtttcacgtcttacaatcttgttgtcaacccactctaatctccagtgaggtgccctgygrgtggatgctcagttgctcagtcacgtccaactcttctgtgacttcatggtctgtagactgccaggcttctctgtccrtgggatttcccaggcaagaatatgggagtgggttgccatttcctactctgrgggatcttcctgacccagggatctaacctgtgtctcctgcatctcctgastcggcaggcagattggatggctgaaatgcatgacctcagtgacactccagaggctgctgtcaatttacagcctcatgaagggatgaacactggcttcagagtcaaaatctggttgtataa

SEQ ID NO: 19867 - DNA, 600 bp, Bovine  MMBT21057
gaccaatgaaaaggaaagaagaaagagtacttgaagaaagaattactctgcagacaacattagagtcatgtactggtggcctgcaaggatgagggcagctgataattttacaaaatattttaacatggacggcatctaaagaaaatgtaaagacatgtggaatgtatcttacttatgtaagatataacaattttttctaattgcattagaggttggcacaaatgactttccataattgaaaacataaaatattttttccaagaaagatgtactcaatgatacaaaatccaagtataagartaacaggtagatttgctgctaagatgtaatctgtcaataatgggtctgaaaaattactgaaagtacattgcaaagacgagtacaaaatgcttgattaaaactcaaactctaggtaaactatatccaagaattackgagtctcacatttttaactgtccggatgttcactgaagtgcacatataaattttgatagtcatattctgtattttagtatttatgattattaatcccttcagtcagcctgcactctctaatccattagaattttcccaaaygtgggtttagccaatatgcagaac

SEQ ID NO: 19868 - DNA, 600 bp, Bovine  MMBT10450
accttttacagcatttctgtggtaacttcagtcttaattcatattaaacagtgaatggtatatctttaacaggaaccgactgcaaacartattgtctgttgacatttattcctaagaatcgttcctaactgaaattcttgaagaatctttcttttcatgcaggttataaaatttgatctcctgacgggttttgtttctggttagcttcagaaagttaatttggagaacattaaatggtagaggaacttagacaactactcattaagttttattttctgtctctttctcctaaagcataayggatgataagatatattcaagatgatgtttactaatttacattttcccttttctattcttttgcctttaacagttatatttcttgttgtggttaattctatgaatagaatttatgtcctatgtcttaaagttatagtttctaaaactattttaattttatttttaagtaaattactctatctcttgaatagatacattttctgcaaactagcccaaaaaagtacagtattatttaaggtaatgttccagcatttttctttataagatagtaaactcaacttatttttaagacccttgatg

SEQ ID NO: 19869 - DNA, 600 bp, Bovine  MMBT02119
attgtgttgaaaagcaatggacagagcttccccttgggagaggctggtgccctggcactcttctgatggcagctgtaggactcaacactgcacccctgccttcttctctaagtccttatggcctcatcagggatgaaaaagcctgagaagtaagtagcaggagaaggctttttgcctgagtttgaaagaatggcagcctgaaacaaaaatggaaaatctctctagaagtggttctgtgaccaagtacagattttttccaccctcgattgcttgtagatcagttttgtggaaatccacctrtgccttttgaagacccaccttttaagcttcaggatctgctgtggtttctaatcccatgttcctctgagtgctccccacccaccagcatccccactcctaagcttgtgtgagacgggcctattctgggttccttaccatgtatagactgaccagcagtgaggtcacttgagtgtggagccaaatgatgctgcaacttgtacttggcttttgacctgtcctcccacaggaggagtccctgctctactcattctggggatctgccccagagcctgtccccttcctcccctttccctaagttgg

SEQ ID NO: 19870 - DNA, 600 bp, Bovine  MMBT11616
tgcctggcaaatcctatggayggaagagcctggtaggctgcagtccatgggctcactaagattcagacatgactgagcgacttcactttcacctctcactttcatgcattggagaaggaaatggcaacccactccagtgttcttgcctggagaatcccagggatgggggagcctggtgggctgccgtctctggggtcgcacagagtcggmcacgactgaagtgacttagcagcagcagcagccaattaactaaaactgattgctgtagagctcagtcagctctatagtcagagaaaagayggcagaagccctcatcccagccacgatgcctccctgggaagtgccaaggagctttgctgtctgcacaagctttcccttaggtaacagctcactctgaagttttagaagcctttgtcattcctattttcaagaaatcttctgaagtcttattactctcttacaagtgaatctaatcagtaaactttctgagagtacacagtgctatggaaatgtactgtatgataaagatgacactagagatcagtggggagatggtagattgcttagaagatggtgctgaaaaaccagccaatttcagga

SEQ ID NO: 19871 - DNA, 600 bp, Bovine  MMBT11268
taccccaggtggtgagactgtgacccactattacaaccagactggtgtggtctagagttttggcaaatattaagtgtttgtaaagacagctcactgagcatttgctatgaatgtagtgygatcaggcaatgtgttaccacttggcactaagacatttaatcctcataacaaactacacaggagggctattcttaatctctttttatacaggtttagagagttaaagtaacttgtacaaggtcactgacccaggaagtgagaacatgtcacaataaacccaatgtctggcttgaaagtccktgtgcacaacggcttggccgccatctatccatccccaggaagactgacagctggaagcagtgtgtgcgtagactcatggtttgaatggtggtaatacacctactatgtgccagcattstgcagttcacatagttcatttaatcactaacaaggctcgaggtagttagcaatagctgccttttgcagataaagaaactaacactcagaaagttcaggtcatttggtcatagcagcccactaatgtacagctggggttcatattcaggctgtttggcataaaacccctctctctttccagcc

SEQ ID NO: 19872 - DNA, 600 bp, Bovine  MMBT04005
ctcatacaagattcagaatatctccctttggcatacttcacatgtctgaaaatatgctgcaattttcagggacaggaaattagttcaagtactttaaaaaaaaaaaaaatttgtacttatatattctttttcatattcttttccactgtggtttgttacaggatactgaatagagttccctgtgctatacagtaggaccttgtttatccagcctatagatataaagttagcctctgaaaatccctaacagtccatggggtcacaaagggtcagacacaactgagccactaaagtgaatamctaaaggccattccttccgtcctcaaccctcccacccccttggcaactataagtctgttctctatgtctgtgtagctcatgtacttttatgaaaagatcgatctattcaaaggcaggtagtgtcctgaagttctaattgttttagagaaaagggggcaatcgtctctcttttggaatgctgaatgacctcgattggtactgtaatccccacagagcttttgaacagatgaatggaaattaccacatttctcccagcttagacataaccaaaatcccttcttggagtcatcagtaaggaat

SEQ ID NO: 19873 - DNA, 600 bp, Bovine  MMBT09597
gaggcagcaggatgcatactccctatttcttgattttgtaaaggcctaatcagatatgatgaggctatgggctctactgggtcttcccatttgcattattgatctaaaaaaatataacttacacaggcaaattctgaatgcaaattatcagaattggtgcagacacacgtgaggagctacaagcacgactgtacaagcccctgccttatactgctgcaacacgcgacatgggagcgcacaggacgtgctgcagaagctgtggcgctgcaactgtgccctcaagatgggatctgagagtcrgagcttycaagtccccttattcaacagcacgcagtttaaatgacagatttttcttctggagttagaaggccaaatgactgcaactatggatataaaactacataggcagttgaatgtaaaataaaaggcaaaactaagaatgggggggaaaccactgcataaggggagtggaacttgggcaacttcccctttattctttttctttcatacagttgcgacatcttttgaagatgaagcactctcttccccatctcagccatcaattacgggatgctgagtctctcgggaggcattattaac

SEQ ID NO: 19874 - DNA, 600 bp, Bovine  MMBT06543
ttggatgccatcactgactcaatagacatgagtttgagcaaactccagaagattagtgaaggacagggaagcctgacatgctgcagtccatgggataacttagcgactgaacaacaacaacattactcactattagagaagtgcaaatcaaaaccagatcatgatatttttgagaagatgaagcaatataggtataaagcatagagctattcagtgctagggaactgtgagttttcctcttctttcttcaaagagaattttatttgaattttaaaggaaggagattttgagagcaaatawtcatcctctagcagctactgagattgcagacctaacactcaggagcagaatccactgtatttgcaaatccaaaagtgagcaagtgtcagcaaatgcctcttttcttgctccctaaaaggtccmtactatcccctaaccctgtgtcaactccactaacttctcactctgcatacttcctaagtaggatcagcatggagagagtgagtccaccaactcaatgcctttacccgctggtgctgccctcaggcctggcctaaagtagatgctcaataaacgtttgccaaattgaattttcttctc

SEQ ID NO: 19875 - DNA, 600 bp, Bovine  MMBT08911
gatttatcatactgaatttctgaatactgaagacaaagaaatcttgaaaagcagttacagagaaactgagaagttatttacagggaaataccaattcaaatagcagtggacttcttgtgtgtgacattatggaggccagaaggaacagacctaaaaattttcaagcactgaaagaagaattatcaatagtgaattctatattaaatgtaactatccttcaggaatgaatagggaataaagacattttcagaagaaggaaaactaagagaagggtcctggttatttgtctctacctctgcycatcaaaatagaattcacagtgaaaataagacacagtgaatattcagacttttwaaattattaatactatgttagtaaaaaggaaggaacttaaaaaaagaaaaatccagttatgggtagctaagctttgcaaacaggtaaagataacatgggatgggcagctatgtgtcagagtgcagaaaatccaggataaccatggaatattcttctgaagtatcaatttcaatcagtgaaactaatttgaaacctccattatgtaattttcatggtagatcaattacttccacagagttagtggtt

SEQ ID NO: 19876 - DNA, 600 bp, Bovine  MMBT02002
taggygaggattgtgaatataaacgctgtcgattttttttttcaggttcaagttttatcttgacttagcagccatcatgattaagcaaacatttttaagttcaactcatcttgagtgaaaccagctgccgtcattaggcaaacattagatttgggacatctgtcaatacaaaaatcatttgctctattgattgccacaccaatgtagaacaaagtctggaccgcctgagtctatcagaatcagcttgtttcatcctcacctcgagggctccctccccttcaaataccctgtccaccagasaaaatcctcagttcctrtgggtctctttccttctccccaaggactattatggtccagaaatgtagacctcacaccctttacttcagaaagtgttagtcgcttgggttgtgtccaactctttgcaaccccacagactataacctaccaggctcctctgtccgtgggattctccaggcaagaatactggagtrgatagccatttccctctccaggggatctatgcaacccagggatcgaacctgggtctcctgcattacaggcagattgtttaccatctgagccaccaggaaagtccactta

SEQ ID NO: 19877 - DNA, 600 bp, Bovine  MMBT13034
tcctaagccagcattgcatatcgcgttgcacaacactgaaacgcgcttgctttaaatagtcctcatgatgcttgccgttatcagctgggcagggcccaggacagcccactcggacgagcccgttcatggctgagctccagagctctggcctggccagctctgttctcagatgtattcctttatcaggaggacccgagggactctagctgagcccagcaatatggttggcagcctraacctagttttttcttgttgttgttctgctttgatccggtttggtttttattatatcatgataaygttgtcaaatgattaccctgccagacaaaactatcaagaccattcacaagattgatttaatggcggcgtacttgaggttgaagagaatattgctttccagagtatataatgaaggttttaaagactgaacagatcaagcttgttctatggaaaaataatatgaaggaagtattaggcagggtccctagtagaatttagatttatgcaaatcttcagtgtcccataatccaaaattaacaaactcagaatgacacaaatttgttaaaatgtaatgcaaactaaacatcttaatgcatcttt

SEQ ID NO: 19878 - DNA, 600 bp, Bovine  MMBT22276
agacacgactgagcatgcacgcagtctrttttgatcttgsgggagtaacttccatggggacacatgcttatccctgaagaccctacagcaagccctgggccccctgcagaccaaccaagtttgagaaggtacacggtgaaaattctagatgcagacagatttaaatccgcactcagtaattgctacttactggttatatgaccttgggcaaatgccttaatctctaagcccttgtttccttttctgaagaatgaggataataacaggatcatggtgcaggctgaatgacctcatgcatgyaaagtgcttggcacaggaaacagctctataaatgcctgctcattttaatattaaggcaagaacgagtcccagcctggggtctgagtttccagctgtccctccggggtcaacccttctgggtagagagaaccagccacaccaaaacctcctcttgaaaaatccacaatccaaggcgaccctggtggttcctctgatctgcttgcaattgtcactgggcctgagacggatttctaaaaaccactttacttctacagtagaaggcagtgttccttcccgctattcagctgagcagttaggaac

SEQ ID NO: 19879 - DNA, 600 bp, Bovine  MMBT08259
agagaaaccaagccttgtaggccacaactgccgaagccctcccaggctaggccccgcatgccacaacttactgagttcttatgctgtaactactgaagcccactgcctagagcctttgctgtgtgaaagaaagaaaccaccacaacaaagaatagcctccaactgccacgactaggaaaaacccacatgcagcaatgaagatccagcacaaccaaaaataaacaaataaagaagattttctactttattttcattcatcctcataaacatagttcacatacacagtatttattcaagcayttattacaataacaccaaagatttttccaaaattgccagatatttagcatctgccacttgtgaaatcaacttttacagctttcatttcttcctcttcactttgctcccaacttctatctctatcgacactgaagagttcctacttctgcctgggttatggaaaatcctgaaataaattgacactggatgctttcaatcagaaatcttggccggtttcaacaggcctttaactaggaaataattcctagagttttatcattgtagcctgtagctcacaatttagtactcatggttcctagt

SEQ ID NO: 19880 - DNA, 430 bp, Bovine  MMBT06633
ttcctaatgaaaaaaggaagtttttatcaatgccataaatcatttgcacatggggaaaataacaatattagaaaaagtaaagaagactcaccacttcttcatgtctgcattttcttacattaatcccatttatctgcaaaggaaagagagagagaatttgaagagcatactgtgaactgactgtatcttggtgacacatggaaaataatggtaaaatgtatacctggagaattgcgtccccaataaagagcagtcctgacagttcagctgtgaatggagaaggagaattgactatgcctygtctactttcttcacacagaagtaagagttcttaattcaataaagccaaaactgattgagggcaaaggcaaagatggaggaggattaaaggaaaaagtaattaaagcaaaaagtaagatggtctataagg

SEQ ID NO: 19881 - DNA, 598 bp, Bovine  MMBT03132
  misc_feature (1)..(41): n is any nucleotide
nnnnnnnnnnnnnnnnnnnnnnnnnnnnnnnnnnnnnnnnntttacacctggttatgtaggaaacctcaaggtgcctgcagcatgaaaccatatccgttgttattttagtggtggtgacatgatagactgctagtgacagaaggaagaaagttaagctaatagaattaagaaacatggtataatttgttatccatttcagagttcatgaatgctacgtttatcctgtggcgtctctgtggcgaaatccacagaggttcttaatctgcgatgccaccaactcttgttttactttcacggcrccactgaatacatagaccttattccagcattaagtctttttccttacttcctaaaactctacccagataaattcctcattctccagtcaatagtttatactcagacttgcctacatgtttcattaatattgcttcctctccctagaatgccttcctttgccttgtgaaaattgtatccatccttcaaggcccaggtcaaagtcataccccgtccttaaaccgtttcctagctcagcagtcttacacatggggaggctggtgtacttcagcttctgccttttgcatattaccatcttgc

SEQ ID NO: 19882 - DNA, 600 bp, Bovine  MMBT05606
tctgtaagaatcttcaaagaaatttctttttttgtgtgtttgttttgttactattgttgttgttgttattttggccgcactgagcagcgtgggatcttatttgcctgatcatggatcgaatccatgcacctgaagcggaagtgcagagtcttaaaccctagacctctaggggagtccctaaagagatttctcagaaactgttcaagttcctaagtgcataactattctttgcctagacagtcactgaataaagttaaaactattttaagaatatcttctgctcaacttgtttataattcrtaattttacctgttcagatggaactttctagtcattaaatacatgatactttcatgaaatccagttgcttcatataccaagactgtaatatatagtctgtatatttaaaaatacacatggttttgtaatcacgtgtttggctaaatgcttaactaaaatttacaraatgtttacctgtgctttatttggataatcaatgtcatttaaaactattccacataataactaycctaatttaaaaggakaaatgttctttaataaactgaaacaagtaattataaaaaggagatacatttttct

SEQ ID NO: 19883 - DNA, 600 bp, Bovine  MMBT06223
cgccgatggccccaagagccctgaggttccgtcgggatccgacttctgtctcaggcacgagtgcagcagcaggggcgcggcgtcgcgtggacggcggccccgcggattctccgggctcctggagcaaacggccggccgggggagactggtggagcgcggaccggggtgccggccgtgtccgttttcttggaagaagccgcggggatttggaagcagcgtctgggctcctactgtgttgcacatggcaggataaacatggccccgaaagagtctattagggataattaatcattctcgccygagatggtttctggaagggctcctataccttcactgcaggaggaatttctaaatgcctagcagaggcaccatgcttttttgtttttaaaaccgttcaacaaggactgcttcttcagaaagcattttctatctaaatgcactgatggctggacctcaagaaatgatttaaatgtttttctcaaaaacaaggccagcatttttcaaygcaactgttttcgggcagaacacactgtgctttttgtggactgggycttgatacttacagagattttaaaagaaaatatttgggctgtggtttaa

SEQ ID NO: 19884 - DNA, 600 bp, Bovine  MMBT08050
ttcacctcctttttaaactatcttgacttaacatgaagaattctakgtttgaaactctgaagtcctgagaaatatttttttctataactcctaaaaataattccaaattacatttttttctttagaaatgtgaaatagatatatcatgattgttttcttcctgattgagtttcatttgtgtgattgacactaataaaaatattctaacttaattcagttcattaaagaggtaaggatattttgcacaatgaagcatgatatagaagacttttaaactttctggagttttaaaataaaaawtttaaaagtgtacataatttataatctgtgtgtacgtatgcattgattctccctgccccccttcatctaataagcccctcttttcctgttccatcttgtaaacatgagttgcttatggcttgcatactgaaaatgctgccaggaagtagggtgagcaaagcttcttttcccatgaccctcgctctaatgttgttccaagggttccgtacttagaaatgccttgataaccacattcattcctgacataccccacccccagcacactcaaagctgctgagtgccatctgacccagagtccag

SEQ ID NO: 19885 - DNA, 600 bp, Bovine  MMBT07678
tttctatcatgcacatttcattcgtaattgatttagctggctacttttaaaaatgtcatgttcaagtttgaatttcagagcaaatgaacaaccattcatttcttccatcattcattcctctcttcctgccatcatcttcacacccactgcaagtgctttttattcctcccactccattgaaaagtttcaagatcaaggtcaaccattgtctatatgttgacaaaattaacagtcaagtctttgactttatcctacttgacctctaggcagcattacacatgcctagtcctgtccacctayttgaaacatgttcttttctagacttcaagataccattcttacctgtgttttcttgtattttcactgtcatctctcagtctacttgcttggctacacagtctttgctggttaccagacatttgaatagcagtacccaaggacttgctgtgactgtcttctctctctgtttacacccactccctagatgatctcaacttcttttacagcttaataccatctgttactgactcaaaattctgtccaatctagtcctctccctatgagcttgagccttatggatgcacaaagctacttaattcc

SEQ ID NO: 19886 - DNA, 600 bp, Bovine  MMBT11375
tgatggtaccaaacactgttataattagaaaacaggtttactttgccttcattctttagtaatagtcatggcagagattttttaaattttattttatattggagtacatttgattcacaatgctgtgttagttttaggtgtgcaacaaagtgamtcagttaaagattctggtttcaaaagcagggatgtctctaactggacacayacacaaagttctaatgatttctataagttatgacttttcctgagaacttcaggctccttatggcatgagacaggagggcaacaggaggactcacsattctggcaaggataactgacctgggttatcagcctgatgttacacaagagggacagggaggaaaatgtttggctccagctgattcacttcagtaccttttgctatttccttgctcaactttgacagtaaatggactaaggtagaaaaacagcctaaaaagggtaagctcrgatcccacaggaatgagtgtcacagtcacatcatctagtaagccacctagacaaagagaatcagctgaggatagaaaaaaactagaatgtatcaatagtataccttgtacactttgtagtatatagagt

SEQ ID NO: 19887 - DNA, 600 bp, Bovine  MMBT17406
gttgggctcttctgatattttgttttctggttacaatacaagatgcaccagctcagagcaggcaggacagtgggggacagtaggctgggggtgatacagacacattttctgtgtgccaggtggagtggcatcactacagtcctgtgcttcagtgcttcagcacagaatccatatatttctactacattaaaatcttttaattacttgcatacatttagtctaacatatttttctgttttggattagcacaaagcagtaataatcccccttcaattgttttacttaatgcccttctctacrggtaaatggattaaaagtataagtatacaattatttttttaaataattcttataaagaacttggaaatgatacccagaggagaaacaaactatagttggaaaaacattagtgttaatacatgcaattctctgtttaagactactcattcagaaaaggcatcccctcccctgcctccacccaatttataaattcacagatctggcaaaaagggagagttctgagggggtagctgactacaccctctcctttttctcttggcctcacaccattctctggttccagaaagaactgaccgtggt

SEQ ID NO: 19888 - DNA, 600 bp, Bovine  MMBT05186
tttgggaacacaggacatatttgatgatgatcatgaccatgctgatgatcaattttgaagacaacaaaatgccttcatttcttagcgtacaccatctggttttcatttcttttgaagatgaaaatgccctcctatggattggctcagcaggtgtgttgtttcctactactactttaaaaaaaaaatttactcagtaagtgatttcattcctgaatcaggaaaagaagatagatgctgctagaaatgacaatgtcaaactcatgacagtgattatttcaagctcagaatgaatcacttttmagacaggaacctttggtttatttgttttgcggctattaggcatttaatacttccactgagacagagtcaactttctaaagataaatagtaaaaaaaaaaaaaaaatttaaattgtcctaaaataaatgctaggataaaaaataagtatgaaaatgctgattggagagaaattgtctcccaggagaacttccacatgatcactttatatccatatggaatcttcaaagaatcctagtaaatccacagagctttggggaaatccttctgaattaaaatggtactgaattgttggggaagacc

SEQ ID NO: 19889 - DNA, 600 bp, Bovine  MMBT02537
agattttaaattgaccattataactgttgacttttcaaatcatttttaagactstactgatgattcataatcttcatttcaaaaactaactgttgccaaaatgacagaactatcccagtgggagacaaaagtagatttcccttgggaatctcttgaaactcactgtctagggaacaaaaayrttttcataaaattggttcatgagtaagccagtgtcatcaaaattgatatcttctttcttgcctttctttctgtactttggcctgccatggttttaagctgaatgcattatatggaagwatttgcaatttgtgattttctagcatattaacttgagagccaaaatcttatttgccttattgcatcattttacctagcattatttttgttgttgttgtttgtttgtgggaaatgagttcattggagcctttagtacaaaagtttttgctttaaaggctgttcttttactcatgattttctwaacagcagcttgtgtkccccccsccccccaatttttaagatgaatatgtgtcacttattttacatactttttgttttttctctcacaaggactcatactttaagttttcaaccagttgg

SEQ ID NO: 19890 - DNA, 600 bp, Bovine  MMBT04293
ctcctcattgtagagaatggatccgaagcagctgggcagcacccaggggcaattcccaccggacttgagagcttgaacttgcaactccgccgtgggtttcctgaccacctctgagcgtttggcagtcacgttcctttctgccttctgtagtcctctgacctgcctgccactacacagcatcctcttctgactcagtctgtacactagaacagacatggctgatgggatttaactgagagaagctgtctggacaatattaagaattgtgaggccaaagttgtgaaacacctccagtagccygtcctgcactacagtgaagaaaagaccatgggtgaaaactggttgcattaagtcattgtcttacaatgaacagtattcttggtttttagtgtttctttttcctctgttcttcattatttctctcttgatgaaaatctagaagcatggtgatcttgctattgaagaagggaaatcaagaaatatccaaattctggactagtatgtgttttttatttagaaacacttaggcaatgtgtataaaatgccaagatttggaaaaagagcagcaaaagagattaaaatggtatgccctttcccttc

SEQ ID NO: 19891 - DNA, 598 bp, Bovine  MMBT10698
  misc_feature (1)..(4): n is any nucleotide
nnnnctgcctaggaaggcaaagaaaagtcataaatgtaatagcaccaaccaaaaatattttgccaggaatggtaagactaaaagggatgaatgggcttattagctcagtgaaactttggacatggtagcatgtgacaggagagatcgatttttaaaatactgtgttactaggttatcaaacacttatctgtcatcttttatactcaaaactagggccagggatcttctgagagatggaactcacctggaataattatagcagctgacaaatgcactcacgctgcccgtggtctacttgcyttatttgctcaaacttttgatttttaggcaaactgccagattctcatggtaatatccgtgtcccagcggagactctggtgtgcacaaatctttattgtgacagctccctttggtgcttctgtggttcaatgaagtgaaaataatgatgagagatttcaagattttggaaagtagttttgactatttaaaaagtgactattttagtttctattttataggatttagagcttaaagtactgaaaaaaaattctggaaactctgacacccttaattttattttttcagattctgaatagga

SEQ ID NO: 19892 - DNA, 600 bp, Bovine  MMBT12533
aaattgaaaatcactttaaattaatgtcagctcagcagcttcatctccaggctgttgggttggagtgctgaatttttaaatatcatttgaatcatttcatatgatcgtaacaaaacaagacattttattagatcattaataagaatacttaccagaagtaagtgcccctggatggaygtaaatcagccttctggggccatttataactgatgagagaattgcactgcttgactttaataattcacccaggaacagagaataaacagcagcaaacattaattttattggacagtttcatayggtttatgttttgaaataaaagggatatgacttgactcctgcctgaaaccaaagcacttagaaaggactccctcgtgctgttggcatctccatgtggggaacttgttctcagatgcctttgttaatcagttgggcacccttcttgccataaataagaagccaaaatataaacactttaagtagtgactacagctttgtgttctatcatgtcctttggcatatggctatgaaatcctttctaaccaatcatcttacttgtctacaacagaagccacagtatctgagaaaggaaggagcctg

SEQ ID NO: 19893 - DNA, 600 bp, Bovine  MMBT21755
gaaccccttctccctaagatggaggaattcataatttaccagaaacacactgaagcgaatattctcacgctggtcaccagggaatttttgaagtttgtgatagatggttatggaaagttttgggaagcaagtgttcccggtccatttgatgcacaaatatttgccacatcccttccgcgtgtcaaactcacccatggaccctcagagagcacccctgcccacctccgttcctgctcrgcacagagcggtggttcagatcagggacctggtgggccggcagacctggtttcaaagtctcaygcaaccacgatgagccgtgggacttggtaagtcactttgttaaaaaaaattgagctaaaattcatgtagtgtgaatgtcacctttttacagtacacgattcagtggtacttactatgtccacatgttgtgcaaccatcctccccagagaaacccagcccccatgagctgtcctccccatttcctcctcccctgcccctggcaatcactaacttaccttctctgtggatttacctatcctggatagtccgtataaatggagtcatataatatgtgaccttttgtggctcaagtgatgtcac

SEQ ID NO: 19894 - DNA, 600 bp, Bovine  MMBT05200
agtgaaaatgagaagttaggacaaactcactaaaccctgttggcctgtctttctgctacactgatctcatctgcactctaatttaccttcacttaagaaggtagctcttgagaaatctcagggattagggagtggactttcacttcagcttgtcctctactcttgttggagctgtcacttgaaaacaaaactacgctgttatgtacaggaacaagaaagtcctcataggtactgttaccatagctatgtagtcctatgaaactctagaaacaccattcctaaaatacacatctaaaaccysagccatagggtctttcaaagaacgtgcccattctgaacaccatttcacaatrctagatgagccaaattctttgaagctctattatggaaggtggtaaaatttgcaagggtgacttaacayggcactagagacaccttcaggctttgtatttgaaacccataaaatcccatttttctaaatcaatcaagtcttgcatgacttttcacttacctggtgacccaaatgttactgtttgcctattgccaaatccaaatgaaggtgttgcttgattcactccatcctgtaaatcggacagctat

SEQ ID NO: 19895 - DNA, 600 bp, Bovine  MMBT23209
agcattctctgctgcacctactgcaaagaaaaaaaaagtcaactatcatgttattcaactccaaaattacttcctttaatgagagggagacaaaaagagaaataaaacagtcgcccagtgcaaatggatccacaagctcacacacatgctgccgtgccaacaaatcccttttctttaaaataaaagccctttagattttaacacaagagtatatcccctgtygctgcaatcaacattttgacagagcaacaacacatttctctgtagcgattacaggagcactcaggttccactggttasctttttgcctcccagctcgggaaggacagggaasggaagccctgggcaacctggaagctgcataacacaacatygacccttccttaattacagtctagtaggcagggctggtagcatttacagctcttcctacttacagtggggttaagtcccaataaatccattgtaagttgaaaatatcctgaattgcaaatacatttgtgctcagtcgctcaggggtgtcagagtctttttgaccccatggactgcagcccaccaggctcctctgtccatggcatttttcaagcaagaatactggag

SEQ ID NO: 19896 - DNA, 600 bp, Bovine  MMBT23210
tttaatgagagggagacaaaaagagaaataaaacagtcgcccagtgcaaatggatccacaagctcacacacatgctgccgtgccaacaaatcccttttctttaaaataaaagccctttagattttaacacaagagtatatcccctgtygctgcaatcaacattttgacagagcaacaacacatttctctgtagcgattacaggagcactcaggttccactggttasctttttgcctcccagctcgggaaggacagggaasggaagccctgggcaacctggaagctgcataacacaacatygacccttccttaattacagtctagtaggcagggctggtagcatttacagctcttcctacttacagtggggttaagtcccaataaatccattgtaagttgaaaatatcctgaattgcaaatacatttgtgctcagtcgctcaggggtgtcagagtctttttgaccccatggactgcagcccaccaggctcctctgtccatggcatttttcaagcaagaatactggagcaggttgccatttcctactccaggagatcttcccaatccagggatcgaacctgcgtctcttgcggctgctgcac

SEQ ID NO: 19897 - DNA, 600 bp, Bovine  MMBT15493
cacagcaacacaggtatgtgggctggtgtracagcaagggcgtgtgcccgcacacgtgctctcctgtgtatacttgtcatctttgctactcacgtgctctcacgccccctttctgcacggtcatgctgtgtcttctgctcgtagcccacgttggctgcacccccggcccccaccttgccctgaagggccagaccgcagccaagaaccacagcccaggtttctggcacacacagggcatctacagggccagcactggggctcccatcctcctctctgtaccctgggagcagacgaagtcargcgtggggcacccrgtctgctctaggctcggcgtctcagaagccaaggtgtggtactagggcacagtgaccggcaggtgtcaggcagaggggcagtggtgacctccgcacaggctttccgtgcaagagaaccaacaatgtgtcattggctggtggcctcgggaaaattacttaatctctgtaatccctgtctcgtcgtatgccggatggaaatgaatagcataccactgtatggggtgtcagggacactgagtgtcatgcgactggcatggacaccgggtcgtggctggactggctccac

SEQ ID NO: 19898 - DNA, 600 bp, Bovine  MMBT11649
gctcagttcctcactaaaatttatagcaaactttgcaaagcttttgacctgtagcatcttattaaacttttatgaaaaatcaatgccgctccatcctacggaggggctgttcctcacgccattgtcaggggtgactgaagcctatttacccccggatctgacgagagagattgaaactgcaggaagtcttcatctcacaggccaggtggccataaagaggaaattctcatattcttctaaaatatggcgtttccagaaatgccaccttgggaaaatgagtctggaaagaaagcaaaagcrtaagtttttaatcatttgtcttctttttattgttgttttgatcgcatcgttctcccccagaatagcatctctgggccccctggctcccctctgggttcctcgtgtgggacacaccagaccctctggacaaggacccgaccccaccatccccctgctccacagctattccagtgacacgccccaccggtcagccggtcagaaacccaagaactggcccagaaacctcttgactagtaaatggttcttgattctgtaccctggctccaatccactccccagcctccgctctgtccttacgtc

SEQ ID NO: 19899 - DNA, 600 bp, Bovine  MMBT01458
cacagatcttggccttggtgcttgctattgtttatctagggggacaacatgcaacatttcacgtgattatattcccctgggcttatttaggataattttccacctctttaccctattctgaggaagggacacttaccctgcctttttaacgaagaagcaaccacaggcttcttcaggccacttttccttagattactgctcactgtatctggaggtagcagggaactgttcgtctgtgcacctaaaccacaatcatcatagtgtttaacaagacgtctgcagagtataaatcaattcaaygttaatttctgaagtctaaaacatataaaatgcctgttaatttctacattagcttagcttcagtttctaaaaggaattagcattagcctttatatataacatttaaagtgtcttacactctttacaggaagttggtggggggactagaagtgaaaggaagaaaataaattcaccctttgttctacgtctcagacaatcactatcaattttctggtgaagcagtgttcattttcttttttataaatagtttattttgctggttttgtgattttaaggacctgtgattacatccgccttcat

SEQ ID NO: 19900 - DNA, 600 bp, Bovine  MMBT03498
ctttcgtaattgcacaactgagcgaccaagttctctaagcttctgttcaggcctgaagatttgccgtatttggcatgccttgtgctttccgtcatcatcctgattaaactaagtttatgagacaagcctcttatcactgctatcagcacttttgtttccccattttctgctcattttccctaaataatcagagctaagagctcttaaatagtcaaataatcactctaacagtcactcacataacactcactaacacattaagcgatgtggaaaatggaaccgtggatgagaagaccctawtctctcatcacttgaaccatccattcaacttctcatgaacataaacctgatttctgtgtgtgaaggattatgtgggggctttggaagcagaaagcatgaatatgcagatgatataaattcatttatttattcatccactctataaatatttattagatacccactctatgctctgtttcagggactggggatgaagccacaaaccacctatcgggtagtttcctttgtggagcttccagaccagatgcggaagatggaccataagtaagtgagcaaatctataaataaggtaaattcaaa

SEQ ID NO: 19901 - DNA, 600 bp, Bovine  MMBT07062
acaggaacactatccagcatgcatgtctaggctaccacttcagtctctacaatgtccattaagaagcatgatgaaacctatggctgatccatgttaatgtttgatagaaaccaatgcaatactgtaaagcaattatccttcaatcaaaaattaattttttaaaaaagcctgctgagctaaaaattggtgaatgtagtaaaaggtattcactatctcagtcttccaacttttcaaggagcttgaaatttttcaaaataagaagttggctgggaggtggatagacaagttgaaaaaattttraagttcacagtaaagataaaaatccagatatccatgtagtaaacaagtaatattttattataaaaagggactcagtctaatgatcagtggtttaagatccaattaacttaatatcaggccatgcaacctgatattagatcttaaccaagaagttgtaactttaactatgctgatatgatgatctttttttcttcttttttgggtggatgtgggaatctgatgattaaaaccctgaaagtaatcaaaataattttaaagtcctaggaagtaactaaaataagcataataacaataggaaat

SEQ ID NO: 19902 - DNA, 600 bp, Bovine  MMBT12968
ttagtagtatttatctctctctccccatgccctctcataattgcaagtataaatcaaccccagggtaaattgtggctgcaattaaaatggtatattagcttaatcacaaataaatagcccttctgctgttatctcaagatggaatgtatgtgattatggctagagtaccttttctcctctgtgccactctaagctatggcggcaggctgaaaagtaactgattggttaccatggtttccaaatggaggcaatgtagcatgtaattattgcatacagctatcattactaaattttgtatgrcatttgatgtaattcaataaataatttgagtcatagctctagaaggaggtgcaactgcttaaagggtaatgttttaggaaaattacataaactatttatatacagctgtgaggggcgctgaggagtaaaatttggtactggttctaattgatttgctcctatcacaagaaaaattggataaatgaggtttcaggtctgccttgataggtaaagtagtgttgattcaggtaagaaatgaagtaaaacccttcatttggtttttagcatggtacttagtgaatcttatttccctgggtttgc

SEQ ID NO: 19903 - DNA, 600 bp, Bovine  MMBT11478
cttgagacgtgaaatgtcaggcagaaaccacgtgtcagaccccaagtgaggacctctccactgagtccgctcaaccttagagctatcaggccactaagtcttggagcagctggttacacagggacagacaatcagcacattggcctttcctccagtgccgtcttcccaatgctaccccaatctaraccttccttggtcatgacacccgactgtcttctcctccccaggayacctcttccacctctgactacttataataattgtttgcaccaattatgatggcttgagatccctggaccracttttcttttaaaacattaaaaaataacctgtaaacagaaatgttttattatttctgaaaatggaaaacttgccatcaatagaaagcaacaaaataaattagatgaaacagatcaatgtcattctagctggacagtgttacctcccaaattgtctggtcccaaggcaggtcttctgtttaaaaagatggagtgagtgttgtagccagactctgagattcagaatccaggyagttacagcagaccagcgtctggatccctggatcacatgaccgtggtcatgtatccttaaattcagtag

SEQ ID NO: 19904 - DNA, 600 bp, Bovine  MMBT08017
ccccctttaatgcgccttttgcagacctgtccttccagaaaccatccagtactttgaattgttcttagacccctccctatggaaaaacgagacagaaggttctgctttataactgctcagacccttctgctccaattctacagccagaacccatgtatgtttaacatactaagtgggatcagccctctgartcccmaatgatgtccacagcgcaattttgtgtttccaaattttctcttcttccamgtatttgcattcttcgcaaggcaagtatgaaataggtgagcttaatcactttgyagtgcttaaggggctagacggacgtttggaggctctgcttgaggactggagtttgcgtctcctctttcctgcgcctttttctctccccgcccccactgccccatcgcccccaccttctcgcgacccagggcctttgaggcaactctatacccttctgatttgacttgcttctggtaaacgaattaaagtgtgagtgcagccgggctccatatttcctctcttaaaaggaaagtcaaactctgaaaaatcagtccacaggaagaggtaacttcaaaaataagggctcatgttccgcaagcc

SEQ ID NO: 19905 - DNA, 598 bp, Bovine  MMBT08880
  misc_feature (1)..(224): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtccttcttttgttgactttaagaaaaacactgactttaggacatgaatagctcggtgccatagtcccatgaagktttagcacatttgaaaattattatcatgatgacagactattggatgccatgataaattaggaagttcagatgccaatttatcatgtagtgagatttaaaaagaattgctatcagaactgttgctaccagaattccttttgtgaagagaactgactgctaagttccataaggataaggactatatctcctttctcttctttgaatacccaatgccaagctcagtgaggggcacaaaataggagctcgataaaaatttattggaaaaaatgaatgcataaaaacctttaatgggccattt

SEQ ID NO: 19906 - DNA, 600 bp, Bovine  MMBT08311
tccatgggattttccaggtgagagaagcatgcactactttagtcgaactccttatacttacctactttggcaaaaaatatctcagtactattaggaaacggccttgggtgatacataaattgggtgaaagatacccaggttatagatgcaagtccctctccctctaggatttctaaattactttacaaactcagccctttctccactctatcacttcatcctgatttcagaattgggagtgaaggattaatgtaggtttcatttaaaaggttaacatgagggacttccctggtagtccakcggctaagactccacgcacactcccaatgcagggggcccgggtttratcgatacgttgcaacttagagtctgcatgcctcgatgaagctcaaagatcctacgtgccacaactaagacccagctcagccaaataaataaataaaatattttaaaaataaaaagataatatgagaattagattcaaggcagctggagtggacacagcagcaaactcagagttctcaacccagttctggttgagaactggggtccaacactggaattcctggtgctgaacttcaytgggcagtgtctgttctc

SEQ ID NO: 19907 - DNA, 600 bp, Bovine  MMBT18941
aagatgacttatgtgtgtggsgacagcccaaaccatgccaacaaggcactcactaaacatgagtcatccagaacttagccccgccgtggakgcacccactcctcacagcctggtgccccctgcacccaccccagcagtsagccatcyaagcccattyaaacaaaactgattgttttttgtagtgaggggtgtggataaaattctgaaatggattgcctgagaagtcaatttgacatatgatcacctaaaatctcactttctcagaagaactataaaaaatttcattaacatcacaccaayctccaaggtcctcctaccagcatcccrtcatttaacagcatcgagtctcaggtggtttatacacaggaagctaaaatgactgcatcgcrgccaaatagtgagcaattacacgccaagtgtatcgtgtgctgctgtcatttaaacttaagctgcgttccacaggaaaggtattatgcattgcataatccaggggagtgccagcaacatgcagttatatctacccccactttgttttctacaaaagaaagagaatcaagtttgcttgttactcttctacactgttctcccttacgcaccaca

SEQ ID NO: 19908 - DNA, 600 bp, Bovine  MMBT18940
ccaaaccatgccaacaaggcactcactaaacatgagtcatccagaacttagccccgccgtggakgcacccactcctcacagcctggtgccccctgcacccaccccagcagtsagccatcyaagcccattyaaacaaaactgattgttttttgtagtgaggggtgtggataaaattctgaaatggattgcctgagaagtcaatttgacatatgatcacctaaaatctcactttctcagaagaactataaaaaatttcattaacatcacaccaayctccaaggtcctcctaccagcatcccrtcatttaacagcatcgagtctcaggtggtttatacacaggaagctaaaatgactgcatcgcrgccaaatagtgagcaattacacgccaagtgtatcgtgtgctgctgtcatttaaacttaagctgcgttccacaggaaaggtattatgcattgcataatccaggggagtgccagcaacatgcagttatatctacccccactttgttttctacaaaagaaagagaatcaagtttgcttgttactcttctacactgttctcccttacgcaccacacacgtggtctctggaagcccagagctt

SEQ ID NO: 19909 - DNA, 600 bp, Bovine  MMBT12939
ggaattggagagtacagtgtgggcagtgtttatctaatgctgtgctgaagagtctgaccttagcttctgaggaccagcaggattatctggttggtaatatctctagaatggagagcagttcatcagctcattcagggggcccagcttttggtagagttgatgaattccatgtgaaagacagggccctagcagttctcaacttttaagagtcatttagaaagaacattttaaaatgtggattgctagaaacaacatccagataatgtaaattcataggtcttgtaagactcaggaatttaygttttaacaggcttcttctggaccacattttgataagatgagatgcataattgaagtggctagaataaaaattaaataatcagtgacagtatcacccttaggcccagaccaaagggattctgctttggggtcttaggtttagaggagcctgctctgcccctgtgatgaggaatcagtcgacttaaggggatatacgaccgagagtctaggccaaactttctagaccatgttctgggtaccgggcccctgaaattttctgcccagctggcactgagctgcctcccaggttctgcatgaagt

SEQ ID NO: 19910 - DNA, 600 bp, Bovine  MMBT09927
agtagtttagctaaattgctgacgattaatccatctcagactccaaggccaagttgaaagagctttaaagtcttacatggaaacatgatagatactgtgtatcaccataaattaagctgatggatttttttcccccagatgattgccttttttccagacaagaatactggagtgggttgccatttactactccatgtgatcttcccaacccaggaatcgaatcctcatctcttgcatctcctgcaatggcacyccactgaaytgatcacacccactcatcatttactgaacagttasaayaagcaacattttaaagtgtacccrttttaatggtggcaattgaagaacttttttggtaacttgtttttctgttttgttcttcacagaaacgctccagaggccaagtgctgtttgataaagtctgtgaacatctgaatttgctagagaaagactattttgggcttacatatcgagatgctgaaaaccagaaggtgagtggttcaaagctatagagaatcttctggcttcagctgcccttcactgcaagaaagtgaactgacactgaatcggtagatcgtcttctccacctacccctcgcac

SEQ ID NO: 19911 - DNA, 600 bp, Bovine  MMBT13310
ctcttcatgcactaccagcagtgtgttcagaaagcaataaaggagaagaagattcctattgaaggactggagttcatgggccatggcaaagaaaagcctgaaagctcttcttgaccttgacagtcaccttgagagtggactcctcaaatcaagaaattgaggtctccggatcgtgtcaattaaaactgaagatagcattgatttgatgaattcaggagggaggagtttcctttcctccttgctatttttctctcattttaaaaagatgatgaaccatcactttgctttcagatttctggytttgacatctcagcaggaactccatgttctaaataatgggattatttgggattagggttgcaatacttggtctgggatcagtttttaaatatatcttgtaggaaaacatgcataagcttgtcaggatgactaaggttgcctgaccttgagtcattctttgaaggacattacatacactctaggggttatttgttcatggaagcaactggttaagatctcttttctctgaggaagctaattctccagaaagagtccccagcacaacagttccagtcaatgcttgggaacacagttttattt

SEQ ID NO: 19912 - DNA, 600 bp, Bovine  MMBT06398
ctttgtggtaatacccatgatattttaaaaagtaatgttttttctcaaaagtcaagagtatacaaatgataaagatgggcattatttactcagtgatgtgatgaaaaaagataagtgggacctttaatcctatatttagtggttttatgaaaatgtttttgatatttatgtggtcttctttattagaaaagattgtgtggtaaatgtcaactttttcaggtgtaataatattaattcaataggttttgtctcatttctttttcatagcatgattcttgtatttttttaatgagaaagtartttatagaagagaaaatttcaacactcttttggccccttagattagctttcctatctagcagtttttcttttactggaagagggaaattacatgctactaaaaagaagatcattacctttacttgctaggaaaatgaaactttaaagatagggcaagtacaasgcaatttaaatatgtttatttttcttctaagaagtttatttgtgagtatggtttcattctttctaaactctgtttatataagaaagttgtcttgttttaagctttaattgtattgggtgatggacagatgatgtatt

SEQ ID NO: 19913 - DNA, 600 bp, Bovine  MMBT21066
ataaaacatctctatctcagatccactcaaagaatatcactctctctaaatatgaatcctgaatcttttggaaaaagctaaaaggagatctgagcttgttctagcttggcaaacatccttacatctggagcaatggttctaaagctttactggtatgcatggaacttatttggagagcttttcaaaacatagactcagcttcttcacgaaagagtctcattaaagtcccaagtaactgagatgtaagcagtctatggactactcctcaacaaactctggtctaatggtttcaccccatgsgtcaggtgccacagacaactctgagtagacctctcttaaaagagaacctcataaaagcagaggccccactgccttctgctggggctctagccggctctgttgtcatctccctggtgtgctgcacaccctgytcccccrgatcacctggcctcagagctgcstaggcctcagcctctcgcctgttcctgctctgctaacgtgacccgtgttacccaggccatctgtaacacacgtgacatgctcaccagtctgaagctgttctggggaagctggctcttgttccaagggccacagtggctc

SEQ ID NO: 19914 - DNA, 600 bp, Bovine  MMBT04046
tctaaaaaaagtctacaaagacttgaaagttatatctacrctaggaaaatgtaaatatcacaaaagtacaaaaaagaaggaaagacaaaagttgatagtgcatactttatctaagaccaaaaattgttgactcagtttgattcactkaaatgagcagaggtgcacagctggctgcagtccatggggtcgcaaaatcagacatgagttagtgactgagcctgcagcatgcacctctcatattccagcaattcttcctttctagtaatttcctttyttttttttttttttctttctttttcrtctcctttacatcagacatgtttgccatcagtggcttycgttgttctttgacttacttttagcatatacaaccaaaagcgccatcaacactaactgggttatgtgtaggcttatgaatctccattaaactctgcatagtaaaggtacagaaaagaaaatcaggaatgcactggtctactttattattagatacatttgatagttaattgtatgggtcaacttggctgggccatggtaaccaaaacatttggttgaataccagattggatattattgtgaaggaatttttaagatgatatt

SEQ ID NO: 19915 - DNA, 490 bp, Bovine  MMBT00839
tttataacattcctacatgtggaacaattatcctctccattttacagataaggaattaagctgaaaggataagtaatttctgaaggtcacacaaccagtacaggctgtgctgggtcagcactcctagtcagactgtctggcttctatgggcagcagtcagtggctgtccatctcctgtactgaaatgaaaagctcaggtccttttattgtctgggttcacagttctggaaagtgtgtaggaagcagaatattcaggagatggtatgcagctggcattagtagaatgagacacagtaggawtgatatcaagtactaaaaacacagacaatatattctcctgatctccaaarggctctgcagcaattgagccccgccctgtttttctgagattgtcacatctgtagttggtgctgggatttgggtgcatacagaggtgtcctgtgcaaggatttcatcttgacacctcttacggtgggcagttccttcactc

SEQ ID NO: 19916 - DNA, 600 bp, Bovine  MMBT00640
gtgataagcctacagtctagtgttaggggtttagaaatagttctattttaaaatacacagaatcattctgagaatcaagtggtagaaacatactttcagaaataaattcatattcagatgaaagatcataataacatatgtaacagattctattaatataacagytactgctgtcatcatgattatctggttgtattgcatcytaaactaattggcatgtttgcttttgatattgtaaagctaatatgtaatgagaggcagcattttataacaaaaagaaggctgcttttggaatagggragactaaggtgtacattcctgtcgtgccaggtactatctgtgtgagcacgggtaagtctttagtctgagttttttcttcatttcttaagtgaggattcaagtacttaccttgtagagatgtgtgaggtatataattattcatataaaatacccygtgcaatgcctgtttataatgcaccatcactgaatggttactatggctatttgtttggcttataactaatgaagacactgactttgttattactaaatcaatccctttaggagactgaacacaaatgaaagataatagaggtcttt

SEQ ID NO: 19917 - DNA, 601 bp, Bovine  MMBT01579
  misc_feature (1)..(1): n is any nucleotide
nagtggggtggctctttggaatccaagaaaatgctctgagtccagaagccagtgagsggaaggattgrggagggagcggagratgggggagggatgggagagaaagggtgctccactgggcggcccgcagggctcctgtccagagcgragtgaccactgctgggctgagcctgtattagctgattggaggtaaaggacacagaacccgacagctgggggaccaaggggtcataagtcccttctactctcacctaacctctccccccagcttcaaggcaaggttttttccatcttggggaargaaggagcccagatgtcacctggatcatyctattgagagtgggttctcttttcaccccctgtttgggcacagagcctgtgccctgaggtgttgaaggccacgggaggccaggggagagcctgtccaagggggacagggacagcacgagtgtcacacattcagcccctactcaccataatctggaggctcacagcctagtctcaaatcctaactaccactgaccagccacataactctggtccaaaacttcacctggctccttgcctatgaaagaaggaaataagacggataagttttctc

SEQ ID NO: 19918 - DNA, 600 bp, Bovine  MMBT01113
ttctttatcttacttctaactcctttgtttagagtcagaagaaaaaaaagagacatatgttgtacacatgtgatgtatatcttataaatatttgtggtctctatagcactgaggatgagatggttagatagcatcactgactcaatggcttaaatttgagcaaactctgggagacagtggaggacagaggagcttgacatctatagtcaaagggttcgcagagagtctgacacaacttggcaactgaacaacctgaaatagcactgagcatttgacagcttctccagagttttatgtgcrgttgggttgctttgggagatgaggctcatgaactgctgcagagccagattgaaacaaaccatcatggatgcaccattcatgtcaagccctactttttatggcctctaccattttacttctctcagtccctaccttgggtttgcaaggtaatcagattcattgtaataccagagataaaaggttgatgatacagactacacagtcaatgtcttctgttctcactgaaggaactgaagtaaacataatttccaacatcattaatgtcagtggccttactacatccctaaagtgtgtgatgtc

SEQ ID NO: 19919 - DNA, 600 bp, Bovine  MMBT09738
gaagagcaagcagggagggaaaccctaaagcgggccctggagggtggaattcacgccccacagactgcaaatctcaaagataacaagacaaggagattagaacataaagatccataattagattctaacagggtaatcccactcgtggtacctggaatgcatcccctagcagtgatgatgaaagtcggagatcatcagaccttagcctatgacatgctaccaggcacgggaatcattaactgtgattaaagtgctacctactaagtggtgagtgggaggaaggggccagagcctattacyggtgccctcagtctctgcaggtcacagccaggtggatgctcccacctgagctcgtgcacacagacctgtgagattacatagactctcttactgcagacagtcagagggctgctgatgttgccgtctgtctgtctttygacagaatcttctcttgtcatctcaccatgggtgggagatgayggaacatggggaacgcaaggctggagagaggtcacaggttattcgaagttcaaagtgctccctgccatagtagagatgataaggaatttcccagtagtctattggttaggaccccgcgct

SEQ ID NO: 19920 - DNA, 600 bp, Bovine  MMBT12376
cctctgtagccaccttcttctcttgccctaaatctttcccagcctcagggtcttttccaatgagtcagctcttcacatcaggtggtctaagataggcttttaattttcttctatttctcactctcattatcttttgtttctcttctttctggaaaacatctgctcttgggactctgtgaaagtttaacagagtttcttaccagcagccagttattcccaccatatcaggatttcacatcgagataactgattttaaatgttgatttttwaaaataagattaaaatagtttcacataacarttcctactgtgagcattatttggacaacacctctaaaatagttgtcactcaggataatggcttttttactactgattcaagatctctttgtaattttgacttgtactgtgcactggccagagtgatgattacataagttaatcaaaatatttaacagtgcccacaaatataaaagtatccatgacaattagcttgaatgacccatttattaggaacataacacaaattctatatacacatgtcttggacatctctatgtaccactgcggatccacttggccttatccttcctcgcagttg

SEQ ID NO: 19921 - DNA, 600 bp, Bovine  MMBT08597
tctatatgtttgaacgtagaatcattgtagttcattgctatggaggcaattcatcttgtaaggacaaacacgactctgtttagaagctccaaaagtgatttctcacttaacaatctcttgccaactccaactgagccatacaaaatactgcaaccaattacagttggtgacctttacagtaaaagtaaccctgaaaatgtaagaaatttttttttacgagaagtaaaaatgcatattctaaaggctcaaaacaactttaagttttactttagatgtagaaaaatgcctgcaaaaatatgyttcttgatatttcacatgttataatatgaaaagatactccacagggttactggagaagtgctatcaaacagtgttatagatttatttatttctatgtatctcacctttggacattttaagatgaagtgcttgtccttttaattaatcaaaagtgctgttcccttccagttagctaggtcactcagatctctattcaacatttccccccagttctttggtttacttctagtactgaagaattaggtctggtaattaaatccaatatcagcagagttttgtcaagtttatttaggttccatg

SEQ ID NO: 19922 - DNA, 600 bp, Bovine  MMBT03308
ttggcaggctacagtccatggggacgcatagagtcagacacaactgaagtgacttagcacgtatgcacacataacttaggaaaaagatctacagaggaagcatacatacaccacatttaatgatcccaaagtaacagaatagcctgaacagagagcagcaactcctcctggcacagcgacacatactaagcaggggctccagaaacaaagaacaaagaggaagaaccacaggcactcccagaagtaaacctaattgtcagcaatccttagctcggagagctcagtacttcccacagatgyctatggcaagctaaaggtatggtcaaaagtgggaaagaaaaagaagaaaaagggtaactygtaaccactgagrgaaactagctgaagggtgaacagaaacactctgttactatttttgccacttcctgtgaatatataattattccaaaatgaaaaaaggaaaaagtgaaaaaaatgcacataatgtggacaggcttaagttcactgaacacctaacgtgccagccaatctgccagatgctgctgtcaatgagctccgggtccactagggagggaaagacaagtgaacaatctatttcaa

SEQ ID NO: 19923 - DNA, 600 bp, Bovine  MMBT17206
agcagggagatacaccaaacatagttataaattgtgatgctgtctcgtctgtgattttctataaataaaacaaataggggactcagtcgagattccctcttcctccttttctagagcaggggccattttatttttattttcatagaaatgtagaccagccactgggaaaagacaggataaatcattcatgacaggaggagacacgtttgcaagaacacagatttgttgtccacccataggcaattaaatgtcctggagaagagaaaaagagagaggggaaagcacagaaatgcagaggcytgtggattctgagtgggtttcatgtttgtaccactttccagttctggaacttttcatctgccaagcctgtctaaacattgagcacatctggcacttttaagattttagtgtcaaactaattttcttggagcccaagccagactcttctggtaactaagtaacatcccaaactgtgggtaacaagaaactcaagccaatgtgtaaaatcctgtttttggtctctcttttgcattattacttttaaaaactcaagagaagagtttctctggaagaraaaaacatgagaaaagaagaagatac

SEQ ID NO: 19924 - DNA, 600 bp, Bovine  MMBT14475
ctggtgggctgccgtctatggggtcgcacagagtcagacacgactgaagcgacttagcagcagcagcagcagcattttgaatgtactgtatattttatacaggctgaggacaaacatgggtttctgaaacaggaggtggtagagttgctaaaagttcacttcagtagccttgggacacagatctgtagcaagcacagaagtcagttaaggtgggaaaatttccccatcacatggtaggagtgtggtaccctggcaggagtgagagcttggggcttagattgactgcttgaatcctgtctscactatttcccagctccttgaccttgagcagcttgttatgcaagccaccccccragctttggtttcctcacttgaagaaacggggaatggtcttacctacctggcagggttgtgtgacgattgaaaaaataatgaaatgtcaagttctgggtatataataagcacacagttaatggtcactgttctgtagcttggataatcacttggtgagggatctggaggaggaattctttatggtttctgtaaaccccgagattctctgacctcagtgcctccttgagaagctcttggtaaggttta

SEQ ID NO: 19925 - DNA, 600 bp, Bovine  MMBT06720
gaaggggatgccggggagaatgtgagtgtgatgttgaatgaggttggagagataggcatgagctggtaaaccaagcaatttaggttttattctaggtgcaaagggaaggtcttggggtgatttaacatgggtagtgacataacctgattcatgagttacaaaaataagttagaaagagtgtgagaacgaaaacaatgagaccagataggaaactaatgtgaaaattcaaacaagaaacagcagtggcctgcaccagtggtgtcagtcaagatgaaaagatatgagtggattcagattacwttttggagttacaaacaccaggattcatgtgagaatgagagtgtgaggtggtggagaaaaggggaaggttaaagggtgttgttggattttctatttttggatcaagcttagagaagctccaccacttggttttaagcacaatattctaagatgttttagacaccaaatagaaacattaaataatcaaggaaatttacaaattctaaaggtcctaagcgattcttctttcctttttatgagattaagatataagttaaatgagaacatctgcatcatttcatcaaaaatgaaaaattaaag

SEQ ID NO: 19926 - DNA, 600 bp, Bovine  MMBT09416
agtgggttgccacttcttttgccagaggaatattacttctcccagagactgaaccctcatctcctgcgtctcctgcgttggcaggcaggttccttaccactgaaccacctgggaagcccccacctcttgagctctatatattaaaacgagcaaagatatgaaactcatgatacctaaaaygcatgtgtacrtttatgtctactattgaaagaaagaaataataggccagttatacttcaatatagaaatattacccaaaacacaattattattttcatatctattgaataaatgtcctaycccagtccaagaccatagacccatatatttacaacatggcattaatattacccaggtcattttgtgttctgctttgttcatttcataattgatcaaaaatatttggcatatttccacccagttttcataattatcrcttttaatatctgcaaaatatcctatcrtattgatggaggatcattcagttcatgattcccctatggatggacattttaaactatttctatgtttttgttgccattgttgtcattggcaataatgctgcaaggactaataaaagatgtgaatatagaaagtctg

SEQ ID NO: 19927 - DNA, 600 bp, Bovine  MMBT15257
aatgttacatggtgaagtatgataatgcaggaattgtatttgaaaacatgataattctaaggaaactccagataatctcagaagtgttagagtgatggtacagatgagtgcagtttgtctttctgcatttaccaggctagatttacatagggctcaaggttatcccatggacagaggagcctggtaggctgcagtccacggggtctcaaagagtcggacatgaccratcgatcgacttcactttcactttcaaggttattttgcaagtatgttgttaaagtttgtagggtaagttccatrtaattctgacaccctaatggtgaaatatcttatctagaactgatatatttacttcaccttagcttcccaggtggcgctagggataaagaacatgcctcccagtgcaggagacataggagacctgggtacagtccctgggttgggaagaccccctggaagagggcatggcaacccactctggcatttttacctggagaattccatggacaaaggagcctgatgggctacagttcatagtgtcgcagagtcgaacatgtctgaagcgatctaccttgcacacacagtacacattgaattgtt

SEQ ID NO: 19928 - DNA, 600 bp, Bovine  MMBT09431
ttaatgtgtccagggccacacagccaatgaggatttagaacaggatggcagatttgccaaggcgagggttgcttgcctgctctagtccattagtggtagctgcctggggaaggcagtggctctgtggaggaggattccaagaatgggtctgagctcattgagaaaggccgtgattgattagctatgtctgccatggacacggtaatggggagtggtggcacgagtgacatgcatttcacagtcctgctttcgagacttctggtggtcagtttacctatggaaatgctgcgctggcactckgatgtctacatstgcacagagggtgggagyggggcacacactgccattaagtgagatggtctcaggtgtgctgcyaagaatcccttctggctcccctgctttcagaaagtgggagctctgagactttctaagatgaagaccacctctaagcctccagaatctgaagctgtggttaggaagctaatgtgtcctttaggggaatgtggcgtggaggaatgaaggtgcacatctcrgagttttagcggctgctgccgaataaataaaaatagctgtaagtacttctgcagctcttctattcaa

SEQ ID NO: 19929 - DNA, 598 bp, Bovine  MMBT06780
  misc_feature (1)..(36): n is any nucleotide
nnnnnnnnnnnnnnnnnnnnnnnnnnnnnnnnnnnngggcagcactactgatggcaggtggccaagctccaggcctcggctcctgcgtcatcgtcataatcactcgcgttgaaacggtgctctgtggttaacagactgctccaagctcagtagccctttagtcctcacagcagcagaagccaaggcctctggggtttggtgacatcccaggatcgtgtgaccaggaagaggaaaggctgaggtttgacctggccttcctaacgctgaatcccctatccgttctttctgcccttgcagggrtcatcaaggcaaatgctctgggggccaggtagctaatctaaatgagagaagctgactggagtagaagacattagggagtagtcaggactctggggagtcagacaacaagctgtgcctcaaggcatctcaaggccaagcatttcgaaagcaataaaagccaaggccatttattggatcaccttttcagtgttcaggacatcccttctcgtggttttggtggaggtggaccgcactttatcattgagtagcactgacttggtggcacgaataagcatggccttggtggcagtaagtctcc

SEQ ID NO: 19930 - DNA, 600 bp, Bovine  MMBT20942
tttgactttttcatttcacatacctcatataagtggaaccagggttttttctgattgacttattcactgagcataatgtcctcaagcttcacttgtgttgtccaattttgcagaatttctctctctgaagtctgaatggtattcttttgcatgtycctgtcgcatcttctttatctgttcatctgtcgctggacatttaggtcattccacatcctgactgtcrtgagtgatactgtaatgaacactggagtgctaagacctctttgagattctgatttcaattcttttggacaaaaaccsattggtgggcttgcagagtaggattctgaacatggaggagaggagcccactggggggtgtgtgtgcagtgctccctccggttctaaatgctctgccggccctgtactgggagcacaggaaagtgggtatcaggtggggatatttttgtgtttgcaaactggaggctggctgtgtctcctgggccagggagttagccagtgcacctcgtctgctaagtcatcccctcttttcgcaggagacagtcttataaatttggctaataactcccatttcatttccccaaactccattagagggaaa

SEQ ID NO: 19931 - DNA, 600 bp, Bovine  MMBT03463
catccttccacctcctctgatgacctcagttactctcaaacaatcaagtactgcctgttggaatgaaaacagatgccactaaatgctactgtctggagcatggcatattttagtcaaccagtgaactgtacacagccaaatgcctctattcaccacaccaagaaaccatcttgcctactggacaagcacatatggtagataatttgacaggggaaggggagagtgggaccatttgtcatatgagagttcagttaggacttggaatttaattgctcactaagacttaagagagtccacacygggtgttacagaagatactagaaactcatgataacctaamggacattgttttaatgcctgtacatgtcagagcccggtgctttgaattaccacagtgtttcctggaaaccgttttgccaaatatcttgaattcagtccaagcatttccccattcatagccacatggtggggtcagtagtgaagggtgatgaacactgcagtgtccttgcagaaggctcagactatgcaatatttaaattaaaaaasataaacaccattctaggcacattccgtgccacatcagcacgacccagttcctgt

SEQ ID NO: 19932 - DNA, 600 bp, Bovine  MMBT18083
atcacagtatttatccctagaaataatgacaccatggcaaagcagcaatgtgactgcattgcaggaccaagcagtgtagcaagggagaccctaaaggcagtgcttcatatccagatacaaagggattcacaatgaacacatcaccaattttaataaacctgatgaaagttaagtagattggatatgaaagtcaactatacttgagatcccctgcttgtcttagagaccctctttaaattaagactttgccaggtgattaagaagaayaccagtgcttcaaagggaatcagagtcttgttrtctgtggctccacgggcgaccagttctctttcccttcggtccagacggaagctttgttctcccgaagttgttcaggtgctgagcctgtccaaacaagggaatcgagggaggctttacgaccctgcacctttttgaaaagcagtgccactccctcggctcgaaggccccgaacatcaaatgcctccctttgccaggcagcttggctattccccaggcattttcaatctagttgggtaaaacaaaaattgcataatttgtcattattttcaaggaatgagatgtgccttctacaatcccttc

SEQ ID NO: 19933 - DNA, 600 bp, Bovine  MMBT09287
ggactttagtggacttgagtggacttgagctctctcaagggaaggggagcagaccaaaggagaagacaaaaataacagagcctcatgcaatggacctacatactctttaggtgcatgagagatactccaggtaaatccagaaatagttgctaattgggaagcaactttgtagttagttcctgagttgcagttgggacaaattagaaaaatacagtttatcatcatcaaagtgacctatataaatcacaaactggaatggcatcagagaacatatctacaaaaggaaagagtgaacaaatkaatgattgttgacatacacttgtttgatgtaaaagacaatttataggtaaggaaagaacactttcactaagcacctctctcttgtcatttcccaaacgtttttcaaatctaaacctttcctttcataggtacagaagggtgcctgaaaatcagccagtttatttargagcagagtctaccaaagatatgagctgtgtattctgaatccctcagcaggttatctttttaaataagaaacacactccatgtttcactgaatcgaaaataccattgtttgtaagacttgccattgttttatgc

SEQ ID NO: 19934 - DNA, 600 bp, Bovine  MMBT00622
aaggaggccagagggctggtggcctaggagttatagctgtaggaaggtgcctctgctggccccttggtctcctgcccccagagctaagcctctgctggagctcgtgcctcccccagcgactctgggacagtcttcctaggatccccgtccgctcacacaggaacctgaattgctgagggctgccagggggtcagggtcccagcttcctgggtagggggggctgattctggctgtgccctagaccctgaccaactagctggaggagcaaaggcggcctgctgctggccacctcctttctcrgggccgaggtcacggcacggctgagactgatttattccggtcttaatctggtggttggtttggtgagagttggaaacacgttggttttcccttcccaagtgtaacaaggcctgtttccgcctccgcggccgctgctgcagtgccacgcggtgaagtgtccgggacgtgacaaaagggctcggttagctgcccgccggtgagaagatgaacagctcgcagcgctgcctgccctcacattcctcttgcccaggcgctggcctctccccttggccggccgctccctggggccctgcatacccc

SEQ ID NO: 19935 - DNA, 600 bp, Bovine  MMBT06074
aagagtggttctaagtactttattaaaaatgaagaaattgaggcctagtcaaactgcaatatcttattcagtacaagaatttataccagaatccaagtgggaatagcatgacttttttaacataatatataaaaaggatttcaagaactacaaagcttcgttttaactttgaaactgttggcaattaaaaaaaaaaatgtgaaactaggccgaaagctctatcaacatttgaactcttcctagtgtatggttattgtcattggtgagcagacatacaggtgagcaatactaagcaggttytgcctgaaagattaaaaaaaaatgagaagtatggttcccatctttccagttaactgccctcccttagcaatcagtactcttgtagttcccttaattggtactgtaaagggcttacagtggatgtctatcaagtaagtttgatttttgaacaaaatgagatacatgtataaaatagatggaactggatacaaaatgtgaacctataatattcgccatattgctcatcaagttactcagataataatacacattttacactatttactaaaatcaaacagttatatttggaaaattaccttt

SEQ ID NO: 19936 - DNA, 600 bp, Bovine  MMBT08209
ttccactgtgtgaagttgagcagtgctctctcctgttggatgagtttttcttgctgcttcattatagtagtggacatctgaaacacttcaaacaataacaaccattcctgataaaatactgacacataacaaaataagccttcaatctagactgaagagaactacatattactcattatatttgtgattaaaagctacaaaggatatctatytaggtgttctkccctttttttttattgtgttgttcgcttttttatattgagctacatgagctattagtatattttgaagatcaatccycttattggttgcttgatttgaaaatattttctcccatccttagggttgtcttttagtctcatttatgtatttctttgctttgcaaaatcttttaagtctcctctgtttattttatttttttcattactctagaaggtgggttaaaaaagatcttgtgatttatgtcaaagagtgttcttgcctatgtcttcctttaagttttacattgtccagccttacatttatgtctttaatccattttgagtttatttttgtgtatggtgttagagaatgctcttatttcattcttttacatatagt

SEQ ID NO: 19937 - DNA, 600 bp, Bovine  MMBT02227
ttgctgcagtcataccagcctccaccaaccaccaccctgatcagtcaggaggcatcaacaccaaggcaagtccttcaccagccaaaagactgcagctccctgaagcctcatagatcggttagaattttttagcaataaggtatttatttatgtatttatttttggccacactgctcagctcgtgggatcttagctcaacaatcagggactaaacctgagttygyggaacgaaagccccaggttgtaaccactgggccactagggaactccctgcaataatttttaattaaggttaagacrctcatttcaaaaaataaagttatttcacactcaataaactacagtctagtataaacgaatcttttatatgtactggaaagacaaaaacatcatgggattcaccttactgcaggatttgcttattgtggtctggactraacstgcaatctctgaagtycgccgctagtggtactactgacaattgtctccaaaacgtagtaaattttatgtttactattttaattaatttcttccctttyactttttycaaacaagaaacaattataataaaagctttaagagcaactgaccctttttgtg

SEQ ID NO: 19938 - DNA, 600 bp, Bovine  MMBT12841
actgtctaatataagaaaaaaaaaatcggataatgttttgtgacctcagtcaaatgttttgatttgattcgaggggttatccaaacgacaaagacaaacaagcacaaagaggaggcgagttaggtcaaacaggatgggctggggatgaaaatcgtgcctatcagttcataagctgcatagaagcagtgataggtccatcagatactgaaaatattaatcatggtgtagaaaatgaactcaagacrtgtgcttcgtaaataaagtatatgtcttgtgttaatttaagaaatgattaatccraaacagtagctctataatgaattaatcatagccagaaaggactggcagtgagcttcaaagtacattaaatactgagagataattctcaaccatcattttaaatatggttgcaaaattgattaaagtgtaagtacattatcttacaaacaatgccttctattattaaaaagaaaataggtttcatgtcctcattaactatagcagcctatgaaagataaaagaaattttctgtgataaagtttagtacaagaacatcttcaaaaagctttaagcagttgctgatacaagtagaatttgatt

SEQ ID NO: 19939 - DNA, 600 bp, Bovine  MMBT03430
ctagatacaatggaatttgacaaaaatggtttagataagttccttgatatgaaggaatttatgtaaaaatatttttttcccgccaggacactgttttctttctattccaaagccctgtcatgatgttacagttaagtccttggaattacacagaggtttccatttaaagctggattttgaaaatagtaaaacaaacaaaaaacaagtaagtttttctctggctgtttttgttttggcagttcaaagtgtagggtttgagaaaatgtttgctttatggacctatgtttctgcaaagaatckatggtgtctatattccgtgaacattttgaaacatgtgttttgctttgcaattaaagaccactgctaggcatttattttctttttttccctccctgaatactcttaaacaatcttgacttttaattcatacatcatagaagaagttactcacttggaataaaaagtgattaatgacataaatggtcaataaacattctatagtcatccctagggaaagaacacattcagracactttccttctattttcctcacttgaaaagattgacatactgtgaaagtctagttaatagttgttagca

SEQ ID NO: 19940 - DNA, 593 bp, Bovine  MMBT04554
gggagcccccgaaggctgggtgaatctgtggtcacagggccagatgaaggccccataaaggtctgtcctgcagacccagccctcacttgtggagagcctaactgttcctgttcaaaggccgctggagagaattccgtcttaatattaatgtcctgtgccaagggggtctgtgtggcagaaccagaagactctgggtccttcttctcttcaaagtcctcattgaacagatccttcatgtcttcatcaggaactgacctgttcagctcctcgatgagctccttccactcctgctcattgagrttgaggtcaggcatgaggttgccttgagagatggagcctccggcccctgcgatcatgcaaggcaggtcatccatgggctcctgtttcagttctttattcaggctcaggggaaatgactcactagtgttgctgcctccgttcaggtggaggctcgagtctgccagacacttcttgctgatggagtccagccccagtgcatgcttcccagtggcctgcagggcttcagggccaggcttgtcgggctggccgagcggggaagccgggggcaggccgttggaagagacgacggctcc

SEQ ID NO: 19941 - DNA, 600 bp, Bovine  MMBT09072
gggagttaaactcatgttacagaggagaaaactgtgacttctcccaaggcgcacggctgatcagccacccaggcgagtagacccagctgacccctccctccgcggccctgcctcccgagcggtggcattggattgcactgaagaccaacccagtcaattcctttctgccccaagccggaccggctggccttatgatatcaccaggatagaattaaaaacaaaagtagactgagagttgagctcagggggatggagagcaatgctaacagttcattcgccatcgcttgctgcagctacagsaacttctggattccgtcaagttcagacccttaaaaagagtggaaaaaagaaagcacatactttccagggcccgggtgctgcactgcaggccagctgggcgtagcaccatggcaaaaaggtctcttcagtttcagaaattcgagacccagagcttgcatacagggctgtggctgcacccgggcctgatctggcatcgcttctgcctgcggttctctcagacgcagctcctgtgggaagcccattagtgtctaaagaaagaaccagccctccaagttgacacaaggagcaggctgatgtgtg

SEQ ID NO: 19942 - DNA, 598 bp, Bovine  MMBT19132
  misc_feature (1)..(61): n is any nucleotide
nnnnnnnnnnnnnnnnnnnnnnnnnnnnnnnnnnnnnnnnnnnnnnnnnnnnnnnnnnnnncttttctgttagaagcataattgtaggcactcaaggaagccatggatcaattcaaaacagttaacattagaatgaatttgcaagcaggacttgataactaaatatactarcatatacttcctctttatttaatatcatttcccaacatatgtttttaaattctcttgcatatttaaaaatacagtgttctgtacaaattctactccttattaaatgtttaaactcatacacaatgtcayccttgatcaatctgttcaatctgtttctcactttttcagggtgtgaaagcacaaacacattttataagcttccagagagttcaaatygaaacactgcctgaaaccataacaaaaatgcaataaaaagaaagaaaaagacatgtttgttttatgtcccatcccccartcctcagggttttttttttttttttttccattttagatgtgttgcctttgtaattggacttattycctctaaactccaggcatttctggccagtctagcatgttgttttgttattttactttggagcaccat

SEQ ID NO: 19943 - DNA, 600 bp, Bovine  MMBT13385
gctttgagaattcctgtaatctgtgtcatcctgtctcatgctgtcccatctcatagttgtcctctctctgcagtgctctatgcccaggtctctgtggctgggctgctccagcctggcggacagcatgccttcgctgcgatgcctgtataacccagggactggcgcactcacagctttccaggtactttctctgtctctgtgggttatttgtgggcattagtatgtgtgtgttagttcattagtgtgtctctccttctttcccatcctttacttaagttcgcttttctccttcgtgttgcytgtatttcacgtcactcagttctcctttaatttttaatgtagatccagactgatccactcttgagacatttttgttatgattggtttgccaaaattgacagagcacaacttgatttgttggttttcatgtttagtagaagtatgataatgagttttaaagtaatctcaataaatagcattcaatatgtaatgtttgctctggacctacataaaaccaattaatataatcaatcaatcaattgcaaccagttgcctgggcactttcttatgtttttcttatgattactaaaaacataaagt

SEQ ID NO: 19944 - DNA, 600 bp, Bovine  MMBT11022
ttaaagcagtttgctaatgttatagtaatgttaaataacaatagtaataaaggcataattaatggtacataaaccagagagctaagggattcaaatcttaatcttagaccatttcctttgtgagcttcactgagttatttttgttactaattagtaagaataaatagcattatcgagtggaagctaatattatgaggcctaacagctgcagagaagacaggctacagttggccactaaatgtgatgacggtgagcaaatgactcaacttttattgtgtacttgatgtgcagtgcttcctytttatacaaacgttagccacctcaactttatcacaaggatatgaaaatagtttaaataaatatgcacaaaatttgttaaaataacaaatttaaataaaaaagacacaaactgtctaaagtttgtattagcataataaatagatggttattccataaactatactcaacaccttctcccgaatgttaacaattaccataaaaccatttccttgtacttagatggctcttcacttttttcaaagcactttcacaaatattagtcaaagattagtcaaagatcatacattatgtatgatctaa

SEQ ID NO: 19945 - DNA, 600 bp, Bovine  MMBT13193
ttacaagaatattttttggtagagcctaatcattttctaacagctgtgtgctctatacagtttttgaaggttagtacctgaaagaaaagttttcacttaaatctggtaaatgttacatcttagcaaagatgtctttaaatgtacataaccatttattctggcttaccctgtaataatcttttctcagactaggtgccattccttaaagaactgaataatgtttattaagttttagttaaatgtatgacctggtcaggtagagttattttggcaatataaatgtggagaaagagagagaayggaaaactggcagaaagcaatgatctgttctgacatgtgactttatcaagtttatatgagtcatcgtcatcattcacatgttttgtgaagagatggtttgttatttcaggagactgattattaattgaaaaagcttttgatgaactggtagaaaagagaatttacagaaaaaggaagggagcacacacagaggtatttgaacaaacctacaaattgaaccttgaaatccaagtgcttaattgccatttagtctacttgaatacagattgaggggatgcaatcaccaaatgtaattctagc

SEQ ID NO: 19946 - DNA, 600 bp, Bovine  MMBT10299
gagtatactagaggaaagttataagacatcccagtgccatatgtcagaagattgcctgctaatatgactttgctacagagattctcagcctctgatactactgtttaaatttcaaatctgattggtcaaactacattaagcaaatgagctataatgtggctggatgtgtgggggsagaaaaattaggaaatgggcaaatctcaaagtgtaggtagttggggaaattttctggactagttaaatagtaacttgcaagaccaaaaccatgaagaatctttgaaacatcatgtgaacataagkacrtttacatttactcacatataaatcatacacccacactgtgtatttgattgtaagacaactatgtttcacattttagttagctatgaagtcagaggtgtagtttataactgataactatgttagcattagaggatagttttaatacaaaccatttctttgttgtttctctgtgtcatataaaataatgaaacatttccagtttggcattttagtaacttatgcacagtgcaaaaaatactatttgttcctgaacctagtgtcacttatggatacattgcatatctggaactattttgg

SEQ ID NO: 19947 - DNA, 600 bp, Bovine  MMBT18312
cttcagtctggaaaaacagctaagaagagtcaatagcagcatcaacaacaatcacaatggctaaaatttactgagtgcttcctgtgtgtgagattattttataaacaatttgtaagtatcatcttgctcaatcctgacaacaatcttatcaggtaagtactattattattcccactttacagatgaggaaacagaggcacagtgaagttaagtaacttgtccaatctgccagtatttaaacccaacctgtttctgggggtgtggccctaaactcacctcttccataagcacaccgaaatyacaactatttgtgtggcaactattgatgagaaagaccagaaggctaatagaaaagatcttctacaactaaagatataaagaaggagccccaacgagacaggtaggaggagcagagatgcagtatagtcaagaccataccactgggtgggcaacccacaaacaaggataattacaactgcaaaggaagaagcaatgagtctgagccccacatcaggctccccagcctgggggttctgcacctagaagataagctctcagaatgtttgtctttgaaggctagtaggcttacttttgggagag

SEQ ID NO: 19948 - DNA, 600 bp, Bovine  MMBT21914
atatgatattaagagttcatagagttccccaaagcttatccatgtggactccaggtcaagtgactcttaacataatgtttttcttttttatcctctccattgttacataaagatgagtggaaaaaaaaataacacttaaatagtaataagtaataaataaaatctatcaaataaaagcctgcaaaagttctttggtggcttaaaaaaaygcatttaaggaatacattcccttgagtaactttaccagtaaccgttgcaacatcagtacagaaagcttgttgattaagactgcttgtttcygagtcgatgtgtagtgtggttagactagccacctcttgctcttcagcactctgataatggccagaacctgaatccatgtcagcagaggatgcattcccagtatccgctccaaaaccaaaatctacaggaagacgacatgctagtgaacagacattctgattacataacaaaaatatttacgagasagacagagctactttatcaaaataattaaatatgaacatcccccctaaatctacttcatatttacataccgttcaggcaagtataaacaatgttaacactttgaagtttataatt

SEQ ID NO: 19949 - DNA, 600 bp, Bovine  MMBT04280
atcattgtgtttatctgtaatttagtagctttgtttgaatacggtagtattttgccttaacagcattcatgttgaaactccagtgagtcatgtctttcagaagaagaatctcttttttcctagtatttagtatgggagcaacttttggagtgaaatggggtgttttttgagaggtcaagcctccattactggagacagggcagtaattggatttggagacattgggcagcttaaggaatagaagtattgaagatcaccaagcttatttattgattgtgttccacaaaagaaggaaaaagrcagtaaaagagaggtgattggaaactaaagcaacctttgaaagtttacctgtgaccacagtgtcaataactacctctgtactatttaaaataatttctaatgctatctctggtggcattgtttagctgaagacaataatttaggattgtgaacagccttcctacttctctctactctttttttttttttttaaggaataattacagttggttagcatttattcagattaatttgcatttgattaagctatatcacttttgttgataatttctaagattggtgtaccaacagactaaggat

SEQ ID NO: 19950 - DNA, 598 bp, Bovine  MMBT21240
  misc_feature (1)..(90): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgtaaggagtggcatctgcatctcaaccttaatgataaccttatgtagggaaaaaaatgaacttcagtagacctatgtattgtctatgtccactcttcccattatctgattctgacactcttgaagctgtcttgctccttgaagttgtagacaatagcaatgcaaaacacctcccttaccccaaaccccagcccacaaaaaactcarcttgggttccatatgcacatgcattttaatgttcctaatccatgaagctgcctgttctttgggttctcattaataagctaaaaaaactcctgttaatacatatttatatgtgtattagaatcatactttttcaactttggaaatggccttttaacagttttgggggtcctccattaaaatgcataatgcattcatctgacagagccaggtaaacctcatcaccaaagatgtggttatgctcaggcacatctctccttgactctcagaggggaatccaaagtgacaaggcatctttgct

SEQ ID NO: 19951 - DNA, 600 bp, Bovine  MMBT01894
atgctattgacccaaaatgctttttaarattctgaattggtcattgtcctggatatcttctacatgctcctgtagattcactctccaccattctccctcctccagttatgctaatttggatattccatctgttttctattagcaaaactgatgatatgattatcaatatttaagaattgagagattttgcatgaaaataaatctggattttcagattctcatgagaaattagaagatctggcaacagtgttggcaataatacactggcaattcccttttccactgggcgttagctctcamgttggccatgcttcactcaattactttaccaggctggtctctgcggccatctgagaatactacccctatttctcatgagatgatgtgatgagctaaaaggtccagatgcttggaaatctcttttactggctgctgtaggtgttgctggtaacagctcacgattgcaacctcttctggagtagtgttctatccttgggacaatacttgaagccacttggcttgggagtgcctaggaatttgcctccttcccaagacaagaccagcaataaattctaagatggacacctccatcctgcaagg

SEQ ID NO: 19952 - DNA, 600 bp, Bovine  MMBT13718
aattaagatcaaagtagtgagcaaaatacaaattagtgctaagactgagtatatttgtttttatattaattatttcatctaaaatttattctacttattgtttagggtgatgaatttgaaaagaggggagaatcttatgagaataatgtttgttagagtgcaaatttctatgacaggaccctgttaagatcttttaagaagataaatacattaaatagagttttgcttagattacagtaaatgctatagaataatactgaaacatgaaaaggsaatagaaacttttaaggacaggaaaayaaaatttaactgacttggttagaaaagacttcatggaaaaggtaacaacaaattatgacctaaagaatgaaagtatgttatgaagctgtcctcatttatctttcctgtgttatgttccacaaaattttacaatacatttcaccttgtttcacaatcacatttcaaaacatgataatttctttttcacattagtacttctcttacttagactgttcttcagaatttattgaaattatactatcagctatatctgattttatattttaccatgtaatgttattataaaaattacagccaact

SEQ ID NO: 19953 - DNA, 600 bp, Bovine  MMBT01848
taaattgattacattkcccctatatgtcttcctgttaagctggtattcttctcccatttttcagatgaggaaatagggcctcagaggcactgactgcctcagagacccacagctcatggttggtgaggcctgcacttgagcctccacagcttgtcttcaaatcctatgcactttctactgcataaataactgtcttcagcaacctgtaaaacaggtgtggtcatggaactcagctcaatgttatgtggtaggctggatgcgaggggagcttgggggagaatggatacatgtgtgtgcaasrctgagtgccttcaagctcacctgaaactatcacaacattgttaattggctgtatctcaatataaaaagttaaaaaacaaaacaaaacatgtcattcatcctgttgccaatagagaaattgaggctgatggaatgcaagtgatttgccactttcccaaagttttgccactgggaaatagcaaagctggaacttgagtgttttaactccaaattcagcactcttcctctgacccttgcagcagccctgggttgctggcaaattcagaaaggatagaaagctgagttcctggttcctccagg

SEQ ID NO: 19954 - DNA, 600 bp, Bovine  MMBT03836
agtttgaagtagctattttgtcaacacacatctgcatgatatcaagagctacatggtgcaattttacaatgcggttaggggactttcatttggaagagtccagtggaatgtgaaaaaggaaaatgcctctcaataagaggcataggatgtgctctggaagaataatgataactttccacgttagtgcacaataaatgtccattttattactgctttacaaacagtaatgaagagattagctgagatttgagaaaatagactgtagtcatggaagtgataaaacaaaggtttgcataagayttaaaatcaactttttccttcctaaattcacaatttatttgaaatgagtgtaggaatgattgctaaatagtcattagtgattaacagttagcaaatacttcattatttgggatggtagcaaagagtgacagagacagtagtagtaggagagtcataatttattattccataagtagtgttaatacctgtaaaaaaaaaataggtagttgcctatagcttaagtgcttatagcataggttaagttctatggaagattttttatattcaaagataaaatttacatacaagatacatctactg

SEQ ID NO: 19955 - DNA, 600 bp, Bovine  MMBT05771
ttgaacatatctctcagtgatacttacatggaagcctgcattctaatcaggcaaagggctagcagtcctttattaaataagtggggttttgtgaagtgggttggaaagttattctctgttactgcctagctttttttagtgtgcaaaggggcttcttccatgttgctaaattcatgctagtttctttcttgtgggcttaaggaagtgctctttctagtttagtagtttttggagaaagctcttctgagcatgcccatcttacacatgtctgcacgcagcagccatcacaagtgtgtcacrtgtaataccagcaggatgccaataggtagattgtaacctgtcagtcccaaatgaaatatgtgactggctcaagctgagcccaaattcaytgtcaataagtcagcagttaactccaggagaaatgaatagagatgaaggcatcagcttccttccattttctataatccactttgagtctactttgcttggactgacttaaattgaggtgtgtgtatatgtgtgtgtgtgtgcgtgcacgtttgtagtctgagaagaagttggctgaatgctatttgaaatgagattagaaagcacygtaat

SEQ ID NO: 19956 - DNA, 600 bp, Bovine  MMBT07219
tgtgtgtacttagtaagcaattcggggtggggagggaataaaagctttcattggccactgagtcaataactttttgcctaggtggacaatgcagtcatcattcttttaaataaatttttttcacagttgattgatagagattcagatctaaagtgaaaaatgtatttccagatgttaactagcatttctttttgcatgtctagtgttttgggtaacaagtgcccagtggtacctgggttatgttttcaaagtcattggtagaaattcagccacaattgagcgtgatggtaagattctcaygttcatttcatagaaaaatactaccagatcaaaactgcctgttacagctttcctccccaattccacctagtggtactgccctcatgtggctggtttcagttttatatacacttccctagtggttttccatttggcttgaaacttaagacaatttcctcccagatgctcctatatattaagaatggttttgttttgtttcagaattatggcaaaaagcttgaaggagggtgacatgatgatgggagagcaagtggccaggtagtgatatccttttgtcccactgcttggaaaatatgtctc

SEQ ID NO: 19957 - DNA, 600 bp, Bovine  MMBT08949
ttatttcacggctgcagtcaccatctgcagtgattttggagcccaagaaaataaagtctctcactgtttccattgtttccccatctatttgccatgaagtggtgggaccaaatgccatgatcttcattttttgaatgttgagttttaagccagctttttcactctcctctttcactttcatcaagaggctcttcagttcttgtatgtatttagtataaatatttcaaagtttcacaagaaactgatgattggtttatggaaatggaatgggaaagctaggatgggaagagagaattggargtagacttttcactcttcaactttgcagatactttttgagtcctacaaagtgttaaaatgtgcaaaataaataaaatttaaaatagaggtaagattataggtttagagtctaagaattcttagctctattttctaaaatatatatagtcaaaaagtttggtaactgtaaggaaaatttcacttcccagctttaagatggcattaagaaaggtaatatttagaaaaagataatatttagtgttacttcactaagtaacaattaatctttatttgttgattgagaaaaccttatgtaacact

SEQ ID NO: 19958 - DNA, 600 bp, Bovine  MMBT11901
ctgcttgggccaaagagaacttctgttcaccaccaccaccacctcccaagggccctacatagcggcgagtggaggagtcgtggaagagtcgggaaacaacttcaacagtgaacacaaggtctctatcctcagggaagttacaaactaatttttttttaaaaaaggacacactttccacccccatccctctccaaatataacggaagaaatgttgcaccagaagaccaggactccatcctggatccatctttaatcatggacaagtcttcaacacatttaaacttcaggatttkttctttyccctgtaaaatagaatatattaattttggccatgccttctatacaaaggttatctaaaggctcatataagatgtggtggtattttagtaaactgcaaagcactccacaaatgaaagytacatgggcccaatggttgagtatttaatcacatgctgccttatcattgccattaaaaaaaaaaagacagttataaacacacaaattcagaatccggcattgttatgtccggcaaacagtaagaaaaggggagaaaaggtgtgtggttatgacttgaaagtaaagcagtcttatggggcccca

SEQ ID NO: 19959 - DNA, 600 bp, Bovine  MMBT19061
ggtctctatcctcagggaagttacaaactaatttttttttaaaaaaggacacactttccacccccatccctctccaaatataacggaagaaatgttgcaccagaagaccaggactccatcctggatccatctttaatcatggacaagtcttcaacacatttaaacttcaggatttkttctttyccctgtaaaatagaatatattaattttggccatgccttctatacaaaggttatctaaaggctcatataagatgtggtggtattttagtaaactgcaaagcactccacaaatgaaagytacatgggcccaatggttgagtatttaatcacatgctgccttatcattgccattaaaaaaaaaaagacagttataaacacacaaattcagaatccggcattgttatgtccggcaaacagtaagaaaaggggagaaaaggtgtgtggttatgacttgaaagtaaagcagtcttatggggccccagagagctctggcaatttttctgtgaatatctgaatactccttgtaatcgttactccttgttgaaataacttccatgagtaaccacagagatgactactcctcaaacaaacccagatt

SEQ ID NO: 19960 - DNA, 598 bp, Bovine  MMBT02918
  misc_feature (1)..(30): n is any nucleotide
nnnnnnnnnnnnnnnnnnnnnnnnnnnnnnactggaaagaaacattttgatatcacagggggcgatcagccagttaaccagaatttaacaacaaaccaataatcaccaaaactgacttctaaggtctggttaacctgtgagctttttattctgctaaatggggggtgtcaggcccagcccacttgcttcgttttcttctcttccccccacacacgggcgcccagcactttccactgaactaatggaagtaaatagttaaggatacaggtttgaagaggcacctaaatataagcctgcccrtgtgtctccaccctgccctatttataactctacactatggactcaatccaatatagttaaaaatatcaggagaaagaaggtgtgaaggctaatgtagttgcaacacttcaacctgctaaagttcaacccgctaacaacctcagggatggctgacgaggcacaagactgcttcctatctcccagatccttgaaagaatcagcatgttgagctccagggggtaatcatctaagatacattttttctagaaaaggagaattcagatgttaaatatttcctatttcttgaaagaagcaaatc

SEQ ID NO: 19961 - DNA, 600 bp, Bovine  MMBT19032
tcaagttgtgccttttgtgagtctgtataaagtccaccttggaaaccttccatgcctttgtttcttcatctttaaaatggatgcagtaactattgctgtgtttaccctcccgagctgatgtgaagatgaaccatgagaccacacacatgaaagaatcttgtaaaccatataatgctttatatcaagtcacttgtcccaacacaaagataccagacatgaaaaatggggaaagaaataggatcttcaagatctgattccatgaatgttggaaggtacttgttcaggaaaggtgtgtatggytgtggatgtatggagtgtgagttgcagtaaaacatccaaatcaaagaacactaagctatggagagaaggcctgagagcctgaacagtagggtaagaattgaggtacagattttggagtcatcaacatgggagaagcaggtgaatccatgactttggaaaacacacctttgaaaatttcacctcccttttcatttttgtagccatataattctcataccaatcccagctgtctttcgttggggttatcaaaatgcacaactttattaagaaaaaaagattgctttcattgctgcaaaatgt

SEQ ID NO: 19962 - DNA, 600 bp, Bovine  MMBT00582
ttagcaargttaataaactacttgcagaggggctgtcttaactccagagcaggccctcatagcctcagctgagctgcctctgatgtctgtcggcttgaagcaggggggctcaggcttccgtctgtaatacagacaagtcagagatgagcatgtacagactggtgtcactctgggccccttcgggcccttagctaaacacagtagagacattgagagcaagcgatgggggccttccagctcaggggagcacccagagctcctgctgtgctcctgccatctcgggcgtctgtcccgttttcrccttggtgccggtcccctcgaggcccctgaactgctgtgctctgtggggctgatggatggcagtgctcacggcaggtttttgtctgctctgtgtgcccctcctctccagctctgtcccagatgggctacaacctgagcccccagttcacccagctcctggtctcccgctactgcccgcgctccgccaatcccgccatgcagctggatcgcttcatccaggtctgcacccagctgcaggtgctgaccgaggccttccgggagaaggacacagctgtgcagggcagcgttcggctcagcttc

SEQ ID NO: 19963 - DNA, 600 bp, Bovine  MMBT13885
acgtcacctctacccagttctgaagcattttcatcaccccaaggaaacccactaagcaatcagtcctcttactgctctctggtagccattaatctttctctcrccatggatttgactgttctggatatttcataaaagtgaaagcatttgataaatggttttttgtgtctgacttctctcacctagcataatgttttcaaaggttcatccacgttgtagcatatattaatgcattattttattttatggcagaattttaaaattataattttttaaaatgtatgcagtttttttcctatyctctaaaaataaagcagcaaatccatctcgcatacttctttttgacaattaatggatctccacatggaacaaaactttattttgatgtttaaatctttatacagtatatcaaataatctgatgtttaacatacttgccacatgatattcttgccttgatataatcaaagttaaggtcttatacaccatggatcactgttttggaggccagggattagcaggaagtgacaggtgtatccaaaaccaaaattctcatggtaaactcagcttcactggactagaatgccatcactgtacactt

SEQ ID NO: 19964 - DNA, 600 bp, Bovine  MMBT13537
tatttcaaatgagtgaacttcctacttggccttaggaatcttttgtttgatgtagattgaaaaaaaaaaaattattttttattagagcacctattctagatccacattcatcttcagtttccatcttcagctctggagattctcacatactcctatgctctggcctagtcccttgttattaaaagtgtggttagtgcatcagcagcaagggcttcaactggaagcctgtagaaatgcagactcttaggccttagcttgacttattgtatctaagtgatttgcatgcatatcaaagtctgmgaagcagagttctakccacattgaacttcttaaaattctctaaaggagtcatgaagcctttgtacatgctggtcttcccaaatgggaaagaccctcttccccatatgctaggaaaattggcttcttatttagtctccttatttaattagttagtgagggaaccagcaagatggtaagtygagttcaagaaggatacaggagactggtaaacacatagtctatggaaaaaagattgctggaataagattgaaaattaaatacaacactgctttttattgacacattgtgcttagtcactca

SEQ ID NO: 19965 - DNA, 600 bp, Bovine  MMBT03027
tttgtttttctaccttaatttcttgtttcagttttcagagtgtatgtttacaattatgacattttcagtacttcccggggtcttactaaggtgtgcaatactgaatatatctgttttctcaggacttcttaaaagatttgctctggaagcctgtgcatcccacagtcccccactgaaatgccacctcttcgatatgccagtttgtgtcttctccatcagaaattgagattcttccctggccctcacttttcacattggtggcaccttcatttgatgaaacamcacctttgatgaaactgyacttcttccattagactatgatcttcttaaagggagtaattccatttactcactttctcagggagaaaacttatgcagagcagaaatatatacagatatggaaacaacatagctggagtgaatcctgtgaatcaaatctccttattggctatgtgaactctgggcaggtttcttgatttcagaaagcttcatctgtacataggaaggtcatagcacccattagggctgttgtatgagatagatgaaaagtaatgtatattaaaatgttcatcrttgtacctggagcacagtaggtgttta

SEQ ID NO: 19966 - DNA, 600 bp, Bovine  MMBT03496
gataccttctttgggtctggtattcagttctttatgtacctgacagctaacgtttatttatgtccttgtgccactcaaggcattcagtgttacacacattatctcatgaattttttacactatccagaatgccaaggcttcagttctcctctcttactcaggaggaaatggggctcagagagaaaaagcaatccactcaaggtcagatttgctcaagttggagcccacagcctctgccgtgatctggcatgcctgctgcccatcactgccagctgtctgccccagggggctaacccagtmtgttacggtcactgaagtaccctagattctgtccaaagtgcctcctcctggaggcaaatgactcctttcagggtttgcaagaaattctacctttgagacgttggagatgaaaggaaaatatatcccaagtaacaaactgagggctttgttagaacacgtcacacttaataaaaagcagagagtgttgatcctttttcaacgacactctcccatcattttccgcctcaactgtttgttaagcctaattaattgtgataccgcaacccatctgggcaagataaaacaagagagatatatcag

SEQ ID NO: 19967 - DNA, 547 bp, Bovine  MMBT11238
cctccagaagatcttccagattcagagatcaaacccgagtctcctgtgtttcctgctggtyaggcagattctttaccactgagccacctgggaagcctattgaattgtacctcaagttaaccagattaatttagaagtagctttaagagtcataacactttatttaatttcctaataatrtaggagccataatgcatgaacatcaatattatttaatttattcttgtttcaaggcttaaatataggaggatagaaatgacgtttgtagagaagatcccatgttatcacttagaatcaaaygaactaaataacatgactgagaaagcaaaggagcccagggcatctcctggcctcagcaggagataagaaactgatacatgttgaatatttgctatatgtctggcactgttctatatattttaaagatattttctcatagagtcctcaaaacactatcaccaagtagggtgatttcaaagacaaagaagataggtaaagagaagtaccttgcacaaagtcacagagatactaagtagcagagttgact

SEQ ID NO: 19968 - DNA, 600 bp, Bovine  MMBT01253
aatacaacagtttaggggatcaaaagagaggccttaaaagtggttgtagacagttgtttattttcctctgaaatatctgagacacatccccacagccttgtttatgtgataaatttactctgtgaaatttgctttataaactaaaggtcagctgtggttgggctcctcagaattaatgagctttggccagacgtaggctgttgcagggtgcctgcttagggctcaattgtctattagatttttgcttgtttatagtttttacatgcaaattctggttgtaattacagctttttttttttmtcttttcctgagctcgtgtagattttagagagggcagggtgtgggtgagggtgtgatctggttagaaatctcagcccagttggtacaagcttttggttccttgaaactctcaaatttttattatttttgttctaagattcctgtgctgtttttatatataaatgacagaggctttttgcagcactcaagtctttatcacttgaacttctaagttcaaccttaattatctgyaaatatgcaccataatgaggggtgtgtttttgagtggggcagtaattgcatttccctcttgtaatttta

SEQ ID NO: 19969 - DNA, 600 bp, Bovine  MMBT18589
tctgttgtttatttaaaagtactttaagagyagagatttccttaagaaatatctaacawataatatgatgtcataaataaccagacatttagaaaatcattattaaaggctgaggggaaaagcaaaggattacagtgatggtcagaaacaataaattatgttctcatttgctttgatgaacttggttctgaatataacagtatattgtcactcactttgaacctaccatccatgaaatgaagcaaagggaaatgcatacagttagctacttgcttgaaatcctctctgatttggtaacayaggtttcttatggtgttgattaatggtgagcagaacactgtccaacaaatcaggtgtcccattgttgagcaaggggaccacctctcctaaccccaactggagctaaatatccagttggagagtgactgaaggtatagcaatgaaaaagacaaacagctagctccccttttgacttctgaaaagctggcaaccaaaataattctgacaaaataaaagtcattttaccgttcatcatacttccccgtgtttgcagttttgaaatggaagagaatttcagcaccaaaaacattcagcacagac

SEQ ID NO: 19970 - DNA, 600 bp, Bovine  MMBT09654
cgcgcggaggtcatgcagacgggggaggagggccgggagaggggccacagtccttagccccctgccggcagggtcggctgttggcatgagggcggtgggcctttggaggcgcgggatgagcgtgctgccgggcggccctgggcgcatgcggggggctcaggacgcagcctcgtcttcttggacaccgggcagctctgggcttttgcctccttcgccaaacccgtctttcctgttcaggggacaccaggggcagagggacctcagaggtcagaacatgcatgcaggaggacacgctcatayacactcataggcatttttatccacatctctcaaatcccccaagctcagctcagtctcgccaccctgcactgtggtcccttgctggttmcccacccatagtctcagcccacmaccctccatggctccctattgcttggaaaggaagtctagacttcccaccctgacttctggagccttgccagatctgaccagacatggcctggctcaggccccatggtccagggtaggagggctttggttttgctttttctttgttcacaggacagattctacccatcagtcttgggattctgtcccata

SEQ ID NO: 19971 - DNA, 600 bp, Bovine  MMBT20631
atataaaagatacagtatgttgaaaattacataagcagttgtgtgaatcactattttatarcaaagtasaaaaaaaaagtatgcctttaggaaagcatgaatggtctcagattttgttacgtatattgttttagaccggtctttaaagatctggccctttctttcagtatctacctgtgaaaaggttatgatgaccctcgctagcatcaggaaccatttccacttgtgttactgatgggtcttggcattgatattgaaaaccagtgtccctcccgaataaaggacacaaagacctggtgrtgattctcctggagaagtgaccatatttgcagctgataagaaacagttaataaggattttttgaatgtgcctataaagaaaagygggcacttggtccccacggaaggcttccttgtgcagcaggccgggtgactgatgaagtgggttttgtgwaaaatgtaaattcacattttgtggaaactggaagttcatccgtctaaatcatttctgttatagtctatgacggcttctgaaaattgccagggtaggtcttttatttgatctttcaacattattggaggtcatataaacaggattata

SEQ ID NO: 19972 - DNA, 600 bp, Bovine  MMBT20634
ctttaggaaagcatgaatggtctcagattttgttacgtatattgttttagaccggtctttaaagatctggccctttctttcagtatctacctgtgaaaaggttatgatgaccctcgctagcatcaggaaccatttccacttgtgttactgatgggtcttggcattgatattgaaaaccagtgtccctcccgaataaaggacacaaagacctggtgrtgattctcctggagaagtgaccatatttgcagctgataagaaacagttaataaggattttttgaatgtgcctataaagaaaagygggcacttggtccccacggaaggcttccttgtgcagcaggccgggtgactgatgaagtgggttttgtgwaaaatgtaaattcacattttgtggaaactggaagttcatccgtctaaatcatttctgttatagtctatgacggcttctgaaaattgccagggtaggtcttttatttgatctttcaacattattggaggtcatataaacaggattatatgaagtctttcactgtcaattagtgtaattctaaatcaacattctgtcaacgaggtgcagattttacagcacaaggaggaagag

SEQ ID NO: 19973 - DNA, 475 bp, Bovine  MMBT09187
atgtcacaagtcatggaaactgggtcaggtcactagaatggaattcaaagaaatagcctgtaatcaggaggggtgtgtatgtktaagacctgcggtgcacaactggaaatgttaagtctaaggagagcgttgtctggtggtggaacaacagagaaaagcaggtggtgaagactagaaaggtcaggatctgtataaagattagctgtggctttctaatcaaagcttcagagttcacgtgaagggtaaggatttaaaataaaaatacagaaaggaattattgaggactactgtacaagtctrtaagactaaatsattccatttacttaacggagtttgtggctttcattagatccattggtcagtatttctgagaacttttgcagaacgtagaaaattgatgatatgactcartttcattttgggagaaaagaataacaggtacttctattcccacgatttagtgttaacagatgta

SEQ ID NO: 19974 - DNA, 561 bp, Bovine  MMBT14993
tagaaaataataaaagtgccccagtattgtaaaataaggcttgctggctggtaacaacagaatgacttattaagattggaggtttattaactcaacgattcatttattcgttcaagtttttactgaccatcctagccctcttgaagatgttagggatagagtaacaaaacaacagcacaaaaaattccctatctttaaggaatttgtatgttcagttgagaggaaacacaatggatataataaacatgcaagtacataaagtgttagaaggtggtaaactgcagagaaaaatcaatcacrgtaatttggatggacagaggagtgaggagcttaattctaaatgaagtgcatgtggtaggcttgcctgagaaagggatatttgagcaaagaaaagaaggaattagtaaaaagcccggtggacaagtatagatgaaaacttcctggcataagtaatggacgaacaataagaaagccagtgtgactcaaaagggaggagctgagcagaggaatatgtgatgaattcagacaggtaaaggggagggggggtattgtttgggagga

SEQ ID NO: 19975 - DNA, 600 bp, Bovine  MMBT04626
gtccatggaattctctaggcaagaatattggagtgagtagctgttcccttttccagggaatcttcccaacccagggattgaacccaggtctcgtgcactgcaggtggattctttaccatctgaaccaccagaggttgatggtatgtatactgtgggacagtcttcgcttccacgaaacagagaaagcaggaaaattctcattactggatgctgcccccgattcttcagcatatgagtaatgagttagtactatttacctagaaggtttataatgattatttcatgttttaaattcaatcytgatttttctgcaaatgcagcattcagaggaaaagaaagaactcagctgtctgtacaaacatatggaaatcaatgataaatgggcagagattgcacagtatatttattaaccaagcttgtataaatcataatttttcaaccatttattaaactaataggattgttttgggaacatcaaagaaatctttattaggtaaataatcatgtttatccactcagttatggggaaaagcaaatcattcacactgcatttactctgcctcatcagatttcatttctcttaaatgtcagccgttgata

SEQ ID NO: 19976 - DNA, 600 bp, Bovine  MMBT08728
tatctgactccctcaccctcattctttctataattaaaactaatgttactttttttctccacaaacatataatttattggatgatcttcaaaaaatttctatacttgaataatcaaatggacttagagtcaaagtttctgattcagaagtatatttttattcatctcagaagagttttgagttgatacagaaaatgcctatgttctgtgagtgtgtttaactgataaactggcataacaggaacgattatgtcagaacaccttagtcctgaagtgaagtgaaagtgcaagtattagtcaygctcagtcatgtctgactctctgggaacccaaggactgtgtagcccaccaggctcctttgtccatggaattctccaggcaagaatactggagtgggtagctattctgttctccagggatcttcccgatccagggatcgaattagggtctcctgcattgcaggctgattctttaccatctaagccaccagcgaagtcctgtctcaagctttatcctgatcaaataatatggcctctttatatctccgatactgtagatacacaagcaaccctatatagtattgtatttttcaattattggg

SEQ ID NO: 19977 - DNA, 600 bp, Bovine  MMBT01761
ttctgcttttgagaaacatttgatgactccacaccaattactcaatgaagcccaagctccctactttcaaggccatttatgacctggcttcaacctagcttttcacatctctatctctttgccccacaaggccccaccaaaaacaaatgcaagccttatgtttaagtcacatataacttcatggttttgctcaaacatgcttcatagaagttcatgcatattcctttcacaagaaacatacccaccttgctacaaatatctctttacctgtctgcctcccacatgggacagaactattaraggacctcaccaactatctcggatagagcacattgagagataagtactccaatacctgcttcattaacagaagctcacgcagcaagcatccgtgtttttgcttactctgctttccttatctgggacacagaaaggaatcaatgatgacccagagtaatcagggctgggtgaataatacagtggtggcttttatctgctgagatcagatcagaaaaggatagaaaaaaaaagaaaatgcccaacagctagcaggagtaggggaattttatataaagaggaaacaaatacactcgagtctct

SEQ ID NO: 19978 - DNA, 600 bp, Bovine  MMBT06680
gtgggatgcatgcagaaatggtaaaaaggaataagagggagtcaacagtgtctgttaaacagatgatcctatgttacaaaaatgtataaaaatgaaatctggagttttcgatagcctggcctgcagtgcttcagaggacaactctcaggctgctggggctacctggctgcaggcgtaaaaagtgggaaggacctgaggggctgtgaccttcttatacaccctgagacagtcaagtgattatgtggtgacagagtatgaaccttcaacacgtaattcatattccagaggtcttctgtaggrctaggctgaagcccaccctttgggagattcttcctgagatcagtctctttccatggttttctcccccactgactggtttttcccattcctttaatgtttcccctggaagttcctgcacaggagttctgcttccaaggactgcgatctaagaagatctacagtctcttataatttattttacttaatttcagagcctaagttctcatatctcttcttttaaacaacacatgtaatgatacactgttttttgctgttgttgctgacaagatttcctaaggacataatgctgaacattcattg

SEQ ID NO: 19979 - DNA, 598 bp, Bovine  MMBT20077
  misc_feature (1)..(103): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgcttatggtggatgaaatacttgcaaacatggtccaagcagagacttgaaaataacttgcctattgtgtctttctctattcatgctcttggactttttcatttaacatgtggacaagcccaggctttctggaagataagggaccacagaatgtgcctccagtcatttcaagacatggccatcacaaaccaacmaactccagccaactcacttgctagcagyagatgcatgaatgagcccagccaagatcaactgagccccttctagtccagtagaacagcttagttacacccagttcacagcascaaccacactatcagggctaaagaaatggttattgcgtaaagccatgaaattttgaggaagtttgttacacagcaaaggttaacagaaactgttttcttagcctgttttgtttgacttcaaaaaacagataaaatgaagaaactcttaaaattctcctacctcaaatttttcaggtgccagcttgat

SEQ ID NO: 19980 - DNA, 598 bp, Bovine  MMBT00594
  misc_feature (1)..(41): n is any nucleotide
nnnnnnnnnnnnnnnnnnnnnnnnnnnnnnnnnnnnnnnnnataatgttacatttcaaagtattataatttcaaaagaaatgctataatggaatcacatggaagacacagaatataaatattcaattaaatatgtaagaaatacaaaattcctaaaatatcaacagcaataaaggaataccttgataactacatattaactctgaatgtatctaattaccagttctattaaccaagaaaaataccatttgtattaatgaaatattgttgatcagtaacaatgatggttgagcttaaaatmagaactgttttttcttgactgggttaaatcttagaagaaccagtttcaaggtaactagaaataataatatcactcatgatcctataagtaacttgagaaaagatgatatgataattgtcccagaaactaggaaagactttagaaatgccactgttctagtcctaagtttttctcattattgattttgtccttaagagacaaaaatatttagctttaaaaaaaaaaaagaatgcttatttatagcataatcttcactgaatgggaaacaagctactttctacaaatacttcatctacaa

SEQ ID NO: 19981 - DNA, 600 bp, Bovine  MMBT11273
cttccaatcactgcagtggaaagaggggcagcttgcacaaagtacagatggttaatttattggcactgagcaagtcacctccccttctggatggcaggcacttcatctgtaaaatgggaggattgtaccrgttgattttccaaggccattctttccacgtctgagcgcttattattctgtttaaatctgtttaccatcttatcataaattgaagagcaaatgtgtgtatgtacacaagcattcatatgggtcaatgtggcctgtgaaaaatctgactcttgattcctgctgaatatccaytagatcactttaaaaagtaattccaggacttccgtgatggtccagtggttgagagtccacctgccmattcaagggacgtgggttcgattcctgatctggaaactaagatcccacatgccttggggcaactaagcccatgcaccacaaccactgagcccatgagctctagagcctgtgcgcagagaagccactgcagtgagagcctgtgcactgcaatgaagaggagccccygatctctgcaaccagagaaaggccacgtgcagcaacaaagacacagtgcagccgaaaatcaatattttt

SEQ ID NO: 19982 - DNA, 600 bp, Bovine  MMBT07602
gtgccactaagaatgagatgaatttatactttatagatcaagttacccaactgcatgagaaactggaacaggatgtaggctttagcatcagacccctaatgtatttcacaatatgatactatgtgaagaaacttcttttggaattagaaatcttgttctgatgttgatctatttgataataaagtgcttatttgaagattaaaaaaaaaaaacctgaccatgtctagagtgaattattttcttttatctcaacgctctcttaatctcacgtctaatcatgttttcctctttgacttggtygctaggatgtgcctttagcaagactatggttatatgtttcatatactgatcctacttcactgacctactcctgactacatccccctttcctaacctggctttttgttgttgttgcttatattgattttttcctctttactatattttgggttgttgcggtcttacaccaatctttgtaagacacttagaatcactccttcgaacaagatagcatgtgacaaaagactctcagcacaacctagtcaaatggaaatacgcatcgtcaaggacacacgatacactggaaaatttcaggccctt

SEQ ID NO: 19983 - DNA, 600 bp, Bovine  MMBT18750
gttctgcttactacttttcaaatgttgaaaaattacataatcaaaggaaaaaattataaaatgtttagtagactatgcaaaacactttgctattatgattttacttacctaaagtttcactgaaagacaaatttttgtgtcttatttgcacacttatatgcacactcacacaaacacatataaaccattatttattctatccttaagctaaatcacagtgtaaacttttataatgaatttggcccatctattcattctttgtgggcttcccagatggctcagtggcaaagaatctgcccrcaatgcaggagatgcaggttcaatccctgagtcrggaagatcacctggaggaagaaatggcaacccactccaggrttcttgcctggagaatctgtggacagaggaggctgcctggctayagtccatggggttgcaagagtcggacatgactaagcacacacacacacattcagtatctcaaggttttcatgttctcaaagccaatctgtccttgttgaagagaagaagactatggattgagtccacacacatttactgggcgaatgcacggtgctgagggccaggaccagggcaaattcc

SEQ ID NO: 19984 - DNA, 600 bp, Bovine  MMBT02030
ctcctgaggaccgtgcacagcatcctggacacggcgcccagggccttcctgaaggagatcgtccttgtggacgacctcagccagcaaggtggccgcgggcttcctgcaggctctcttgggagggcctggaccctgagggcctccgtgcacagactggagtttggagcctatgtaggcgggagtccccgaagcsgtcccgcagacggggattcgggtgcaggagactcatccgggaagagccccagaggctccgccccctgtgacacccccagagtgtgatgctggctgcaggcgaggaaycagcagctggagggtgactgtgctgctctctcgttattggctcttttgatcgcagtgcagggcatgtgggatcttagtcccatgcccctgtattggaagtggagggtcctaaccactggaccgccagggaggtcccttgtgctcaccttttttgtaagggacttgagcactgaagcrtctgcagattttggtgtctgcagtgggtgggcggactcctggaaccaacgccagcaccccgactctgaaggatgaccgtacgttggtctttccatctctgctagtgctcatctgggcgctctc

SEQ ID NO: 19985 - DNA, 600 bp, Bovine  MMBT02072
gtatggtggccttacagtaactcagcatcagggggcagggaaggagtcaagaatcagcattgcatagcctttcaacaaatctctgatgcacacgccaggccattcacagttgagacaggtgacctcatccccactgagaaacaatgctgaacggcacgtagttactctgagaaatgcacccagaaacaaaataccctgcacaccaggaggaaagccttcagtacctaggggatccaatcatgcattcactattctgcacaggaaaataaaatcccggcttgtcttgaaaacagagtttgmgtgtgcaactaactcactataaactgacttgtcaccccaaggagattagttctttccatcaattttaagyacattagagctttcaagcagcaaaacacatcctgtgtcatcaaggacatcattagtcragtgtgtcaagccctgaaatgtcaaaaatgattctaacatcctcttagactgttcaaagtcctgcatcactttgtttactgataatggtaaagaacagtggggaaaaaacaagctaaagaggtgaacatataaattacaacgatatgtgtttatttcatttagggcttgaag

SEQ ID NO: 19986 - DNA, 600 bp, Bovine  MMBT08903
cactggctcttttagggcaatttgatctgcacatctgattcattttcctatactggtagaaagggaaagaaacacaaaggaacatagttctaactccacatggccccatctgtatgcacatcaccaaagagaatgcaaaacattcacaacatcaataatgtcagagttattaaagcaagtaatttccttttcctgatgccattttcatgaaccttgttgaaacagtctcttgcacatttcttaaggtcttttttccaagtgagttttccaaggaaatagcctcccatgtttatatagatmtcttccagttttgagcagagaagagctcaggggacaatctttgggtaaaagggtaactgtacaagcgatccttaactacttccaaaacttcactttgcagaactttctcattgtgttttccatgaccattattttgccaggaccctaaggatataccattctcctttttaaattctggcccagatttcaattcaaacaacatatcttttccttatcttttttttttttttcccagacatcttaagctgatatttgtaaagttctttacacaaaaattagaagaaacaataaaaaaaaata

SEQ ID NO: 19987 - DNA, 600 bp, Bovine  MMBT16809
aaagcaggatatgattaatgtgaaactaaactgtcatattcatgccctttcatttgacaatccatcatgtaaatgcaacagaactaagatacagaaatttgtcaatgttcatggtgtttggcttggaacttctttacagacccaatacttgtaagatctgtttgatgtttcgaatcactaccaaactcccaaatctttaagaaaggcaatcaagagtagggtagtcatacctgatctattgattttcacattcacctacaaagaaaggttctttgagctagtcatggtctatctttaccyaggctctagtacttgcataagagagattaaattacttttcagtaagtgacttaaacaggatgaaaaatacatayacacacattatgcacatatgcatgtatatatgcaaacatatctacttgcatgtacttatatatatatataaacatacatatgtatatggccattaaaaaatgacaagtctttgcctaataacaattttaagtgtttatatgagcaacaagccaaatggtacaggtgtcatcagcagtaaacaatctgatcctcatcttacttctccagcatggagacatactgacc

SEQ ID NO: 19988 - DNA, 600 bp, Bovine  MMBT02170
tgcattttaaatatagaaaataatataacttgcacatcaaaattgctttctgggtaatattgcttaagaccaggctaatttaaacagagaattatttaaggaaaagtatcaggtaaataatgttacaggtgacatgcaaatatgggaagagttataaaggcacaatgcaatggttgaaactttggaaacactgcataaaaatctaaagtgtatattcattcatacccttataagtactttgcttctcacttagatcccaaattctaagaacatcataaatatacctcaagtgagggtttkgggctataagcctaaacaactgagagacaatatgttattatgtacaaacacatatggtctttgtattgttgttgctgtttagttgctcagtcgtgtctgattttttgtgatctcacggactggagcctgccaggctcttctgtccatggcatctgccggggaagaatactagagtgggttgccattttcttctccagggggtcttcctgacccaggggtcaaacccatgtctcctacattggcaggcagattctttacaactgagccaccaggcaagtctagatgtataagatgtataag

SEQ ID NO: 19989 - DNA, 600 bp, Bovine  MMBT04033
cttttgggagtctcttggtatttagggtttgaaatattaatgattaaaaataaactaaaattggaaaatgagatattcctgatattaaaatgacctacctcacaaaaggtaaattaccaagtttaagctcttggggtttcatgtaaagatgctaaatttttcatggacccatgcaagatttgttcatttaaatgttgaacatatatctgcccttgcacacctgtgtatttgtgtataactgaagcttacatgtagcatttttctagttgtaactgttcatttctataataaaatagttcwttggacagtaaaaatttatagaactttttcagtcataatatatactaatatatagatagatagatagattcatggtaatatggaggaaagttgtagttcaaatttgccaaagttttctataggccagtgtgaatgggctagtttagcctgatgtactgtgatgtgaagcattatgaagtttctcttaggctgagttaacactgcagtcacttagattaatggttctactaaaagagaagaaaaactagctgtgtgtttactggtcatttgctaatcctattagggtatggtaattttcac

SEQ ID NO: 19990 - DNA, 600 bp, Bovine  MMBT00526
gtctgggcactggccaggggtccagccccccatccctgcgcttcccacacttgactctctccaccgccccactagcctctcctgagtctcagctctatttattgctcaagggtttctcctgcagccaggggtggctcagtttcagaggaagtgcagataaagtgtccacacttggacagaaacgagggctctggatctcggtctctggcagctcccaggcctgtctgggctgcagctcaaaccgcggcctgaaccgctgtctgcgtcaatcaagcatcaatcaattaccaggtctgggcyccygcccccagggggacagtgctggccgcagtgccggaggatcagccaccaaggggaggtgacagagagcagggagaagcaggtgctggagtgggaagtggggccccagaggtggtaacactggaccccctcccccctcgggggagtggacctccaccatgtgccctgggctctgggtcactggatcagctagattcttcctgggtaaaccctggaggtttgtgctcacagcacctctgctgagactgacccgagtccaagccccagctctgccatctgcgggctaggtgaccctgttca

SEQ ID NO: 19991 - DNA, 600 bp, Bovine  MMBT09276
tggagtagaagggtttgtagccacaagagttgtaaccaaaagagcttctaatcatttagaagacttggttccccatggggcttccctggaagtccagtggttaggactttgctctccaatgcagggagcatgactttgattcctggtcaaggactaggagatatggccagaaattaaaaaagaagaagaagatttggttccctagaatattccacggaattaatttctcctctggagtcctcttactacgtagcattgaggtcactcttgctgttaccttttattcagttatcacctctrtaaaaagaccaaatcctttaagaaactgtggctcgtgtccttttgtcttcctctccgttcctggtggagaacggtgacaggaaagtggagatcatccccattttacagatagagaaggctgtagagaggtgcagagaagggtgcagctagcttctgaccgtgccagactggagtgcagagaggagaggtctgcaggcattggtcctgggaagttctgtcactgggggtggacagagtaccacttggcctggccttgcaaagaagagccagctcagctgctccaaagagagccaggccagt

SEQ ID NO: 19992 - DNA, 598 bp, Bovine  MMBT12406
  misc_feature (1)..(4): n is any nucleotide
nnnnctgttagttcactgcctcactctaaacaaataataactgagcaactcttatcctgattcttaaacaaataataaatgagcaacacagaggcaaagtactgtgagtaattcagaagcaatatgtcactgtgcccttaagtgggatttacaatctggacagcagaatccaaaatactcacaataaaacacacacacacacacacacacacacamaaacaagcaacaaatagctcaggtaaaaggagtaatgaatctgccttctagtctttgccttcaaggtacagaatcaataagcartttctgaatatatggtattggcaatattctgtgctagatattaaatgtaccttctcaactcyagttttgttccttttcactttttctctttttycccttctttctagaactgaatatatctagtcagtgtataagtcaagagacaaatgcaaaagaaaccacactgtagaatggatattttaaaaggacatcttaaaatatctattttattaatgggtaaactgagattgagaacactttgaaaatttgtccagggtcagacagagaatgagttagggagaagggatttaactccagt

SEQ ID NO: 19993 - DNA, 600 bp, Bovine  MMBT01750
acaaaatctaagttctctaactgaatctttcaggtccttttcagattggctctagctgtcttttctggtggtaattcccaattttctgcttcatacaatttccaaatttccctgccaccagactttatttatttcattgcttctccattcctttgcagctctatgtattagagctgattctaacacatccttcaaagtttaacccccaatccacttctgtacagctcagtattaggagttaacctgctggtaaactctaacaagagttttctttctataactatgatatctatggacaartcttccctacttgaaatgcwtactgtgtttagagacacactgcgttttgcatattctagtattataattgtccagtataattccttgaataaacaagtatgcaataaatatttgttgagaagcctttgatctagtaaaccacaaaagtgtttgttaccttattgctgataatggctggagttgcagaaacatacatattcaataatagtaggatctttatatcaattcttgtttatctctggttatcttatttagagaagtattatgaaactttccaaaattctatttagtgaagtcgct

SEQ ID NO: 19994 - DNA, 598 bp, Bovine  MMBT01307
  misc_feature (1)..(101): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtttattgtagatagtccaagtttcataattggacattttgtagtcattaagcagagataaaaggtgataaatatacaatacacatgtattaagtgtatttagagaaacagttctaccataaatctgtatctacagatctcagaatgtattagacacactggcaatcatcactgatgctgctgctgctgctaagtygatctgagttaatgcagaaacagagcaacaattcacactgttgtgtcctacagattcctctaattctctctacacatggaagcaggatacacattcttcagttcggctctggtagccacttgtaagaatcaagagagatctaacgctggagaaagggcggcgggtgagakgactgccagaggaaactgctcacttgaagaactgcttggtttcggttaagtcatacatttctttgcaatggaaaacctccctgtcatttctgttctaaaaataatcaggctagttgaaaaaaaccctt

SEQ ID NO: 19995 - DNA, 600 bp, Bovine  MMBT10133
agcgatttctcaagacttcctaacatttatccccatagatcagcatgtgagccatcaatcctgcgaaggttaaaagggacattactcaaaaactggcatggagaggcagcgtttcaagaggctgttatgtcattgggtttaaagctttaaaggggagaggagatagttattttaaagttgataccaattgcttcccctgtcattccccccaatggttttataattgtggatccaaattcatctgctggattctctttttcatttcccaatttttacaaatgattctataatgagtccacrtaagtacaagtctttttgttgttgtttagaggttcttatagaattatatccctgtttgaaatggaaataacaagtcttcaacttcttatatgcatttggttatttctgatcaaactaaaatcacaaaaatgtctgcacgtaatctacagcagatgttcttcttatccaggaataaattacagcggctactaggcagaaaattgttttgttgtgctgtttccccaagaarggtccttaatggagaacagcagcaccttttggktcctttggatccagagttcttttttgatctttagcctt

SEQ ID NO: 19996 - DNA, 600 bp, Bovine  MMBT12990
aatcatttttctattgtaaattatattttatttcaatgtattttcatttagagtacaggtgttcaatccttttttgatctcataccatgttagctaaagaaaaaagcaaccaattcatgtttataaaataattgcaaatgattatcattgtgatatatatacacatttttttaagacaacagcaattaaaaagtgagataaagatgaaatggacagtattttaaaataatgttgctattatgatggctttcttctatcattagcttgaggcactgggcctctcaactatggccaattagsttgaggcactggccaatctcaactatgattgcctacaggggcttccctgtagttcagatggtaaagaatctgcctgtagtgcaggagacctgtgttcaatcccctgggtctggaagatcctctggagaaggaaatggaaatcctttccagtattcttgcctggatagaagagcctggtgggctacagtctggggttgcagagtaggacatgactgagtgactaacactgcagtacaatattagactcttttacaatgctttttaaaaaaatcatgacactcatgcccttctgcagttaca

SEQ ID NO: 19997 - DNA, 600 bp, Bovine  MMBT07866
ttactctcttgcaaaggagggaaatggcaatgaacaggctgcattttgttacatctttacttcaaaacaattaagcagccagtcatgatcttaactccttcttttaggggtgtattcatactctgggtctgggatggaactgatatgaactttaattaaacaaatcaccaaaatgcctgtgaggtggcattcctagtggagatttcatgttcaccccccactgctttgttggtctgtttttttttttttttccctctggtggcccctctctccatctaaatcttcaccctgcttggagcygcctgggaattgggtgagccagtcctgagttcagaggtgctgctgccaactggagggaagagaggcagcccagggccagctccccaagctggagccccaccagcaggcccaagactgtcaaggattccaaagagagatgaattccagcccagtattcactgtgaggtttgctttttttaccatttcttttttttaatcatctttttaaagagaatttggttctggcaacaagcatgttgcacttcatcagcctttgatcttgccctgggtcctctggcccctggctccctgggcagtcat

SEQ ID NO: 19998 - DNA, 600 bp, Bovine  MMBT21328
aacacttgctagatgtacttggggaagaaagcaagatgttcttttttttttttttttttggtcctacacagaatatatctaacaagcctccaccaaagttttttttcacataatagtaggtcagtatctaataaagattaacataaaggaatgacaataatcagaatgggagacctacttaaaccattctctccacggtaagttaaatgtcatctcaagcctttaatacaggtaacaaggcacatccagcaactttaagattctctgtcacacactctcactaacatgctttgcccccaycttctatgggtaaactatggagtttaattaacacagtcaacagcagcctgccacacggctgttagatatttgccactaacatatactcatgggatactctagagactgatttcaactgaaaataaaaatagataaacagagctcaaaaaaaattaaaactgagtctggctgcccacacttactttcacacatgaggaaaaatagcagttctcctagaagcctcgagcagacatatctttagaacacaatgttaaaaatatgccccccctcctttttcccctacctgtttctcactcaaag

SEQ ID NO: 19999 - DNA, 600 bp, Bovine  MMBT09533
ggttaaaagctcagcctctctggtcacacagagtaagttcaattctttcagccccagctctgcaattactagctgacagaaccttatcaaattgcatataactcccataagctacttatctgtacttatcagtgtactacttatctgtaaaatggaaataatatttatcccctaggcttatttctagtactaagtgaaatayataaaaataattacccctttttgagctctttctaaatgctgggctaattgttgaaggtaaagtaattaataattaccatagtgattattattgtaaamtagacaccattgcccatraacaagccaaatatatatatatgaagtgatttagcaagatatttttacacattttaaaggagtatttttcaacttagcatttatggctgccctggtacaaaatgggcatacatctaccagagtgacacacacaaaaatcaaatttmggttgctggtaacacagcttccaatgtcactgaatggtttcagttctgcagaagaattaacagattgggtttctttcatggggcagaggaggtgacataaggccttggttaaatagaacgaaagaatagctcctga

SEQ ID NO: 20000 - DNA, 600 bp, Bovine  MMBT02288
acaatggtaaacttagttaggtatgaatatggacatattagatattttttccttgaaaggagtcccagtttgggtgaatattggtaacaattggttatggaaaaatactgaattcgcttttataagcatacaatattaaaatactaaccagatatagaaaaaaaactactaaaagaatagcatgcttgtaactcagataacactttaattaaaatagaataaaatcggactgtcaacaattttatattttgtagttttttttctacagaaattgggagaaattctaaaatggctttcccytatttttcccatgaaactatgcttctttagtaggcttcttagactaaaaatcaagattatggtaagaagcatcctattatagaaattttgtatattttattttctatcctgacatggtccaatgttagtgtgaggtatcccttacataatttcaatagaaattaaactgtgaataatcataagtataaaaagttaaatggtcaaatcttaaacttaatttaaaactgaagtaagatacatattaattcacctttcagtaagacatcatctggttaaaaagaaaagtgggaaaatgaacca

SEQ ID NO: 20001 - DNA, 600 bp, Bovine  MMBT03354
acagctggattctgaataatttaacttgtgtatacagtgttggtttcagtagcttccttaccatgggagaaatattgatatctgcagcactggctgtttccttgacatgagagtaagaagaaagaaggagtaagagaacaatgaatacgggtacagggtggacaaagaggcaggggattgcttggaaatactaggatttaggggtcaaaatgatctctgggaaatagtacctgaaaagaattctaacttagatttcatcacaatttacatatccaattcaaggaatatttgacagtatcytatttccaataataagaaaaaatagatttcctaaaatgttaatttggttgggctacattctcattcccttgccctcatctcagtgttcaccctcagtaagaaaccttgctcgggctgagaaggaatggaatatgagagagagagattgacaaagattgaacatgtctgaagcaactgcacgaagccagtagttccaagaggactattcactgcttattagataacatctctgtgagttaaactataatcttcttctgaaagacagtgatagggttgtgcccactccttcctccaattctc

SEQ ID NO: 20002 - DNA, 600 bp, Bovine  MMBT16381
agaactatatatattgtatgattctatttagagcatgttgaaaaaggtaaaacagaaatcaggtcagtggtaccaggggatgagggagggaaaggggactgactgcaaagcgacatgggtaaacttttggggttggtgaaaatattttatatctttattatggtgttggttatacatttatcaaatgtatgaaatcgaaaaaggataaattttattttactaaaagaatagcaagaagcctgattcagggtttccctggtggctcagtggtgaggaatctgcctcccaatgaaggagacrtgggttcagtccctggtccaggaagatcccacatgctgagaagcaactaagcctgtgtgccacaatcattgagcctttgctctagagcccgggaaccacaactactgagcagcaactgcagagtagctgccaccagccacaactagagaaaagcctgcacagcaaggaagacctagcacagccaaaaataagtaaaattattttttaaaaacaaacctgatttaaaaaaaagggcaaacaaagacaaaagaaaagtgataaactggggaaaacattcataatgaatattacaacaaaggg

SEQ ID NO: 20003 - DNA, 552 bp, Bovine  MMBT03466
tggaaaattcactttttgaaaaactccagattaatcaagagaatttcagaacaatgctcctctaacaaatgagatgggatttgttgttgttgatgttactattgttttatttccattccaccatgggctgatattttagtaaaatgttatataaatgaattatttwaaaaataaaataaaaagcaaagctcaaacatgcaaaccctatttagttatagtactagattaaacagatattaaattattttgccaaccaaaatttccagctcttcactctcaatctctgcatctatctctttstgtattggtgacaaataatacacatggttggaaaaatatgatggctaggatttaagaatagatgacctcagtccaatcagctgaatatcattgtttcaaggaaacatagtttgacgcccactattaaagtacaacactaaatgtatcatgcgtacataaacaattccaaaaataattccccttaaaatactcttagttttataatggtctttggtattgtattggttttatggctttgtttttaagttgttt

SEQ ID NO: 20004 - DNA, 600 bp, Bovine  MMBT04277
ctaaacctactggttgtagattattctactcctgatggtttgagaacaccacaatttcttcccaaccaaatgattactcacccaaataatttgcttgtaaaaattaagtttttacacataatttcttaaaatgttctatacaaggtttgttttctttttttctgctttctttgctgatgaactgcttattaatctagaatattcatcctagtttcttcatgatttaactttcttgtccatgcaatagataaacagctaaatgtaaatctcaacaaaaataatgtactttctcctttttawgctaatgagtggtaaattctggcagataaaagatgaaaatggagagaaaaacttgaagttggacttaytgaacgtttagcaaattgttgacctgatagagattagaaattgaggtagggatatagaaattaaaagaaagagaatttactgctgagaatagggaaaagggtgggaagtggctataaaatagtgagaactgctttccataaaccatgtaaaaaccccacctcattaccgtatagacatggggtacacacacaataaaatctttgtaatctgacatttgagaggaaattaggt

SEQ ID NO: 20005 - DNA, 600 bp, Bovine  MMBT11271
gaaggtttttaaccttcagaaagttcagaggttcagtctgaataagcacaaaaacttttcagtgtgcttctgaattccttgaatttgcagaactgctcagaatcccaagagaactaccttgcacgtaggattcaggccccgctttgtagctaaaaggcagagctgcagttatgagaaaggagcaraattaaggaaagagggaagaggaatcagagaggggraaaaaaaagagtttggtccccatccaggctaagtttcagcctattcagtttcttcaattcaaagccatctgcttcccaygactctcagataacgtctcccctgccaggacaccctgttcctgcttaattgaaattagtttccaagaatagttgtccaatgcagtttccagtggagggactgttttgaaagtcacaataggagtcgaagctttgggatgcagatgtccacacatgagccagatgtttgaaaggcatcacacggtctatagcagccttcacatttccaaagccaggagttctctcagtggcctctgccactcgcaaatggctcctttgaaactgccaccatctctccatcagggacctgtaatcccacaag

SEQ ID NO: 20006 - DNA, 600 bp, Bovine  MMBT08380
ctcratctcttgtcctaatgattgttcctttcaacttagaagtcagagcctataggtaaggctctaagggctttcttttcacctctgttttaaccatcaagtcttcatcctttgtttatttgcatcaccctgcccataggtttaagacttgtaaagccaaacataagcaaaggaaagaatgaatgtgcccattcttaaacaagcttaaacaaagtatcttcagctaattatcactgctggacatacattaatgggtaaatagcataaattcaactcacatcttgggagatgcttctagaytcctcaaatmcccacatccgtgattgccatcrtgctgtgtgtgtgtactcagctgtgtctgactctttgtgaccccatggactgtagcccgccaggattctctgtcagtgggatttttcaggcaagaatacaggagtggtttgccatgcccttctccagtggatctttcagatccaaggatagarcccaagtctcgtgcactggcaggcatattctttaccactcagccaccagggaagccaccatttgtaagaggaggaatacctaaatgcccttcccagacactcttaagagaggagg

SEQ ID NO: 20007 - DNA, 600 bp, Bovine  MMBT22342
caacacagccttgaaagaggtgragggtgcctctgtataraactcctggtacagaatcaacactcaatattattaggatgctatgtggtaactcattcttagagttagtagagaacatcaccatggttgtctktctttcctgctgtttatttactggaaacatcttggaattcagagaggaatctcttcaagttgcaaaattacaggttaacagaatttgaagtaattttggcttaaaaaactcaagtgtgggcagagaccaactgatgaggctctctgctgactctcagaacaaatgcrtataatctcagctttcatatacaagcctgaaactcaccagatccacctgtctcctgagttacagaggcacggttgtacctccagccagagtcatgctcaggtaccacagagcattattgcttgatggctgtatacacataggcccttagaatagcacatgtcctacagtaagtgctgagtaagcattagctagtattgttaccataagcattaccctactctcatcacacccactagttatgtctgctagatcagctttcttaatatacaaagctagaaagattctcctgtccagaatga

SEQ ID NO: 20008 - DNA, 424 bp, Bovine  MMBT20495
taaactgcacttaacagaaaacatgaaaatatgtggtgctgttcttttagaaatgctttttaatttttccctcaattaaaaaaaaaggcaatgagcatttaggatctatttcacctgtgacattttgattgtattccaatgataatacattaaaaataaatcaaataccttttaatgagttttccacatgtattaaggaagcaaaattaaatttatggtttatggttggctaaatgctgaatgttggggcaaatactgaatgcagtgtgttctccatacagaggcttcccacctatggcrtccttgtgcctgtcggacgtggtccagtggcttttcaccaactgcgggaggccccagacggaatgtcgacacaagtccatagaactcttctataagcttgttcctttgctgccaggtatggcga

SEQ ID NO: 20009 - DNA, 600 bp, Bovine  MMBT06404
acttccttaaacttcaatatatgaaaatttcctccatcaggattaccatttattttgaagaaacagaaaccctcacaagctagcttatggagaaatttttttataaagaatcatgtatcacagaaacatgcaagaagaagacaagcttatgcagacagtggtgagaaacgtagtgtttacaaagaagctctaagtgcaagatcaacgctgccattccctgggatgtagagttttcctccaaagcgtttaccacatgaactgctccacagaaatggcagctagaacttagcttctgagtcraggtattgtcctagctcccgtcttccttctttctttctttactggccagaagtgtgggtgctcagtgtgccataccgaggacatttaggggacatcatctggatgcgtctcattgcccagaaatactcaactacattttgagtatttttgagtattagaagatagtactgtcatctgttttactacttcatgactctcaaggctgttgtcccattaattaatttgatcacttcagctagttagaacccaccatttttggtgatgttgctgagtttgacaactggagaaatacacaattca

SEQ ID NO: 20010 - DNA, 600 bp, Bovine  MMBT13483
cacattaaaattgagaccataggcttgcctttaagagcataaacatgtaagacacaccaaggaaagatgtatttacagtgaatatagctggtatacctgaaatacatgaataattaccatatatttttwaaacaagtcaggcaatctagtgaaaaaatgtgggcaaacgcttgaataactattggttatataaatgtcctgaaaatattgcaaagttgctcaatctcactagaaattggcaaaatggctggtaaagttccaaagcagcattagatttgcctttttcagtgaaacatctcycaatttctcatggaaaaatctgtatatacagtagaaattcttcacacattttgattttcagtgatttttttttgtccgtattggaaaaagacactaattaaaatgatcacaatgtcaaataaggtatcctgtggaaaattctctattataatgaactttagataaacagttccagaaattttgtcatcattactctgaagtttactctgtaaatagctaaagaaggaggtaagaaaaggattcaaacacagaaaacaaatattttgatcccagaggattttwaaaagcatttagaggcag

SEQ ID NO: 20011 - DNA, 600 bp, Bovine  MMBT02214
aaaaaaatgcctttatttttatggttttctaagtctattttaccaaatgtacacttactggattaaagatattaataatatttgtcaaaataataatttatacctaagccgtgagctggggctttaaacacattgcttttaccaggcttcccacaaattaagacaggatttatgaatttagacttaatataaatttgaattacttcaaaaaaaaatacatccctattatttttcactgttggttttaatacagagccagttcctggtcacaagatagtacaataaatattttaaaattcrgacatctcacactgaagtgaatgtggtcttcagatctgattttaaacttgtcactgatgaacatcttaatgtgctagtaaaattacatactatgatcataattttatttggcattcctaaagctacatctgtcttaattcttcttcccctttaattttactgatcttcaattagtaaaaaccaagtaaaacaattttgagaaatagggtcagatttttttcacctcttatcttacagcttttaatacagttttcagtttcagtgtctcagtggtttttactctaattgtttaattttatt

SEQ ID NO: 20012 - DNA, 600 bp, Bovine  MMBT07101
ggtcctgactttgtctggcagccatgctttacaaacccacggtccacttaaggataaacggtggggaatgtccatctatggccacacttaccatagaagcccagttagtcaagacacggcttctccctcaaatattgcagaaactcgtcagatgacatgtttggggggaaacaaggctgtgaccctcactccagagacattcctcccctgggcccctaattccaccaataaaaactgctgtgcaggcatgttctagacgattctcctccagttagcaattgtttgcaagaaatgagcccwaagttctgttgactgaagaaattcctggggttgcaacttttcagcgaacacagttttagaaatggaggctttaagtgattcggagccagcctgccctctgcttacatatcggctttcaggagccgctctgaggagggttcgcgttgaagtaggccttttccttgtaacccgagagctcggctaatgaccctcgagtgtttctctgagagagaacagcaacctagaggagcctttaaaggatagcttgcacattaaaaattgatgcaacacttcaaagtttaatatctaaacaaaatgctt

SEQ ID NO: 20013 - DNA, 598 bp, Bovine  MMBT19934
  misc_feature (1)..(51): n is any nucleotide
nnnnnnnnnnnnnnnnnnnnnnnnnnnnnnnnnnnnnnnnnnnnnnnnnnntctgttttgttcctgaagtctagcctctaccctggacttgacttaagttctaattcattctggcttctgccctgatctgtgttctgctggacttcactgattccagtagcaacctcttgcaagcaccaagcttagtctggaactgataaccaattgtacccaatgctactttcactgtggttttaataagggatagcctgttccctggrtggtttccaacaacagtggacacacttgtgcatgtgcgcrcrcacacacacacacacacacacacacacatcatattagactgtgcagccataaggtttgtatttttagatggatatttgcataagcacgtttgaacttatgttcaaaatgtcagatcttgctttatgatgatctaaccaaaaaaaaaaaaaatcagatctacagatttctctaatttagacacatgcaagtatatacagaagcttrtagcaatcagtacaaaagaatacatcatcagaaaagacttgaagaaatagagaacgaactcaggagatgctgtctaatgcctagtctggcc

SEQ ID NO: 20014 - DNA, 600 bp, Bovine  MMBT09545
gaaaaaggacagagaggagcagattcacgggaatacaaactcacaaagcacccaacatggaagtcttacatgatagatgtgctttttaagtcaaagggccatggccccatctaatctattcaactaattgctgatctatttttgcttcctctggcattgtgaaatataagctagtagtctttcctgcctcatctccactcaccccttccatatgtctactctctgatcaaaacaggtgacattttcccaaaggcccctctgatttacccttctgtttcctcactccagtatctctgtttrgattcccggttatatgcttgttggttaagtacaacccagaacttactgcttagatgccatttcttttgtrgctaccctcgactatctgtcaatcagtcttctcaaaagaactgcctgtacacgctgtctccgtttgcttatgtccttgtcacttcaatccacttggatatggctttgccatactgtaccactaaatgtgtccttacaaagtcagtaaagtgtccatgctgcccaatgaatggctttctctgtcctcatcatactagacttttcagtagttttcaaaagagtgaaccatag

SEQ ID NO: 20015 - DNA, 402 bp, Bovine  MMBT03515
tttaatctttctgattctcagattttccaccttaaaatggagataatttttctatcatatattaggaattattattaatataaaactaaaaagacatataaaaacattttgaatataactattgtttatacattatgtttcaagatttggagtaggtaaaattttcatttgcttctctttatgaaaatgtctcaggagtctagataaagaagaaaaacaaagaacaagaggctcatcactcccataagaagtcaccccttcatcagaagagggggaaatacctcctgaaacacaacgtgmtgaaagactctttctaaagctctgtttagaataccatctggtcccaacatgcttcataaaacacagagaggatgatggggtttggcacatctataactctct

SEQ ID NO: 20016 - DNA, 600 bp, Bovine  MMBT22805; identical to SEQ ID NO: 4693

SEQ ID NO: 20017 - DNA, 602 bp, Bovine  MMBT08175
  misc_feature (1)..(2): n is any nucleotide
nnctcactgcagcctcttggagacagctgttccaaggtgatttcaaggtcactcgaagtggctgctctgtcactttagccaaagactcctgcagcaggagtggccccaaccacacggcctgctgcagggacgcgggcgtgtggcccagttctaaggcccctcatagctaaggatcccactgtaacctctcgctggggccttgatcagagctcccaggaggtggtgatcaggagggacacactgcctctccacctccactacattacctctccttcctctctcccaggggccttcgccgtggygccggcctgtgtcccatgcmaaccccayatcagactaaggttggagatgccaacaagcagggtcctcaggatgtttaacaggaactggccctctggtctgattctctcccagtggcttttcagatggtcaaggtcacagtgaactgccacccacaggaaagctcacagacgaaacatcacaccaacagcactgacagctcgcagaccaggcaggcaaggcgcatggcagacacaggtgggtgacatgcatcggggccgggctccgagacgccgggggttgggggaggcagtggggacgtt

SEQ ID NO: 20018 - DNA, 600 bp, Bovine  MMBT16344
gtgggaggaagggtgccagccatgtgaagattatagaagagtgttctaggaagaaagaaggattagtatgaacactccaagaaggaatttgtttgtaaagtcaaggaaacaaactaaaatcagtgtgaatatcccctagtgcatgatgaagagatagacatgagacaggttcagaaaggtgaagcaaggaaagattacaaagsactgtgtaagtcaaggtaaggagtctgggttttagtcaatgcactcctggaagacattggaaaatttaaacatgggagtcagatgatcaaatttttstttaaccaacaaaaattctggctcctgccaggaattgaatggtgggagaaccagttctggaaggacagaggccagcaaggaaagtagggcgatgtatggctggccgtccatcacacccatcacccctctttccttggcacacaactggatagcccttctcagtctcctttaaagtgagatgtgactgatttctgtttggtgtaagacaagtggaagttatgagcaccacttctatctctcaaccctaatgctttctatatgcgacaatctatgcttttttcccactccgttggcttgata

SEQ ID NO: 20019 - DNA, 590 bp, Bovine  MMBT09548
attgaaacttggtagttgttcatataaacaygaccattccaggtacattcrgacaagaatattcagagagagcttgctagactaaggacctcarggagtatatgggaaagtttgggaatatgagataaataaggtagatttgggtgccaatttttccactgtaggaactaacgctctatttggaatgacttcttccatctgaaatatttaatagctgttcaacaagttggaactgacagtagacaaaatgttttactgccatgtgtcaggtagcttgatgcacttcatgcctggataaaygcaaaatggaattttagctgaaggagatggtatggcaaatggttctttacagagaagggagtaagggatatgtctcccatggagaaactcatggtgacaatgtgtctgattcatattttaattgccagaataaaatcaaatatccataagttcaggcatgctaatgaacaagaaggagaattagatttttctctgcctattaaattttctaatgttgagagaagcaaacagagcactgtggatccaaatattaccctggaggtgttataagcaccaaaacttgaagatta

SEQ ID NO: 20020 - DNA, 600 bp, Bovine  MMBT12182
agaagattggagaaccctgtgagccacagggactttggagggccttgccatggtcttcactctcaggcattcatatttctctccctttctattcgcctgattttgggatttgtttttactttgcttctctctgccagcctccttcctttactatttcttttatcctttgaacaggaacactttggaaaagacaagtcagcagaattccagctcttctactctcctcatgggaaagacctgytatttacagatgctgccattgggtttttaagagtcccacctaagatggatgccaagctrtacttgggatatgaatatttttcggtcattcagcatctggggagaggtgtgtagctcctgggaagacctgsagagcttgggcatagggcagggcggggccgtggaggctttcctgggacctgcaagccccacctcacccaacccacactggcctgcagggtccaagggagggccaactgtgctggattcttgtggggatgttctgctgaacttggggaaaggcctgaacctcgggttcacaaaagggtttgaaagaccttcagattacaggctacttaagtaataacgggggcttccctc

SEQ ID NO: 20021 - DNA, 600 bp, Bovine  MMBT01463
cttgcctggaaaatcccatggatggaggagcctggtgggctgcagtccatggcgtggctaagagtcggaacgactgagagacttcactttcacttttcactttcatgcattggagaaggaaatggcaacccactccagtgttcttgcctggagaatcccagaggcaggagagcctggtgggctgctgtctatggggtcgcacagagtcggacacaactgaagcgacttagcagcagcagcagctgcccaccagaaaaggcctcctctccccactgctgttctaatccctctcaccagccmcctcagagaagctcccctgatgatctagtccacactgaccctgcaggcccagaatcccagatcttggtgtccctgctaagtgagcattcacagctttgccatcactctcatcatctcatatggatccacagtaccaacctcctgtttctgcccaccagaggggagacttcccaagagctctctcttcctctttacccttcctcaggccacacacatccccccacccgagtccctggagactccaagaggatactcctacccatggtggtctctcagagcaacaggaaagggtcaccttga

SEQ ID NO: 20022 - DNA, 600 bp, Bovine  MMBT09393
agataccaagctccagccgaggagctgccataacgctgggcccttctctctgagccatgtaggtcctgaggtccccatcatgactgtgggctgaagcctccccactggccaccttgtctcggagggacagtacccagatctccgccttctggtccgaggtggccagggtgcycagactcctgcttaagtgtttccaggcctttctgctaacacatgaatctgcaggcccccaagacccagccctgccgtgaggacaggtccactctgcccagaggcccagggtctgcacagcctgcccascctggatcccctggcctctccgggccctggggctgtctgccggcctgcctggcctcagtccctgccagccagttcagcaaaggacaggccaatcgtcagggccaaggactccctggcctggccaagtggggccggttttcaggactcggggattttgaaccagctgctgtggcaggtgtggccggcccagctgagcagaggcaccggccgcccggagagttgccagccagctgctggagggtgcggggcagccaggctggcccctcgcccgggcagcaaagccaacagagggcggacggg

SEQ ID NO: 20023 - DNA, 600 bp, Bovine  MMBT17971
cttgtaacctctatttttacctagatcatcagcttatgtttacacgttactgaatgatccctaaccatttccaggatcttggcagtgacctcacacatctaagtatgcttaaaccactgattctgtttgattcttcccagttttcctcccagatgttagccttgtgaccatatggtcttcattctgagagaatgcaccactcactggctttttggctaatcacatttttcagaaagagaaaaggtcttcgttggaccacagagaaatgcatgaaggaactaagaatcagaagggaaggasggagatgtaaaatgttggttgcttggggaaaaggtctgttcaaagttttggactttttatttcctcctgcatgttgaacagagaaaaatacattgttattacttctggaaatccagattttcccgaacagtagtcagtaggcattttcagctccgtggaaactttcttctttayttaggcacaattaactttattcacagtatctatgacaacctatgctcactgttttgagatagactgaaaagtagcagcccacatctgtttgtccattttctcccctagtaatacatataggcccac

SEQ ID NO: 20024 - DNA, 600 bp, Bovine  MMBT04110
gatggaaaaaaaaagaaatataataaaaaataatttggaaattagtagagaaaaatttttaagaaaggactatttctcaattatgtataaggcataacaactggctatgtttgggaagtaattttatcatacagaagtagccaaaagggtaacagattaagaaggataaaggtattaattgtacattagaatatgtccgaattccaaaataaatttagaatatatacatagtgatcactaacttgctctctgacacttttgcacaaattttaattacacctcaagagcatcttacattcktcaagagaaatccatgaacaagatggtggttaacagaagcagattyctcctgaaattctgcatctgagcttcagccgagggaaaggctgttctattaataacatctttagtgaaatctatcacatttctctgaagaactgcaaaggcttcattatatctgacttctccattaacttccacagtggtgcattcycccactttaatgtttgagccatactccccttagcaaccgagratttattatgttgttgtcattgacacagttcagctttagaaaaagcagcactgaaccaacaaaag

SEQ ID NO: 20025 - DNA, 375 bp, Bovine  MMBT05912
agagttcagagatgttgggttcaatgtaagaaagaactatatgcaatgaaagtactaagagatattgtagaaattaacaaaaggagggattatgtgcttgagaagatttggaagctgtcttcccaggtggtgagaaggtggtcagccatcttcacagcccagtttggaccactttctgcctctcacatggcttgttcttaatgaattattgcagggtatttattactaggaacacaagcagtattttgacttggagccataatgcaaacccaaatttggcacaacatcactttaaactcrggaaattacgactttaattaaagattcagcataaagccaacaagataataaatctgaaattgattcttcggtatg

SEQ ID NO: 20026 - DNA, 600 bp, Bovine  MMBT16799
gtttaagaactctgaacttcgacttagtatgttttgagttctagccaaagagatctctctctgattcctggactccttctatgacagctggctgtagtgtcacacatttattgaccactttaactcttggattgaaaggaccaaaagatgtgacccacactggtactctgccaattgctagcactggtatatatggatccgggggctgcaataaggaatgatcagtcagagaaaatagcactgtctctagttcctgtccctgtcccttggccacacaataactattttgtcttagctggkaatcccagcctctgcctaaatcacggtctacttactggctgatgatggaggctttccaaatcttccatctgactttggaaatgtcattgtgctactcattctgtttaattgctccctcctgtggaaacactgtgatgtccctgctgctccttcgagtggagaataacaggtctttaggtttttcttggctctttcttgctgaggaaggagatgataaatgctcggtgctgagggggctgctttctgaaccaccctgaggcgacaattgcttattcagacttaagaaaaggaggcaggcat

SEQ ID NO: 20027 - DNA, 598 bp, Bovine  MMBT16749
  misc_feature (1)..(105): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaattgtattgaatcccaaatcatgaaaagttagtgacctgatttttccaggaagcaagcattatatttttattttttttctaattaagaaaaaatagaatgcaagacatttttctaagttgactgtaaccaactatggtggaggaacatttctaccattggttaaatggcaaagtgtatgggaaattgtgtayatcatccttatcaaaattcataagtaatcaataaaaacttagtacttattattatgtggcttttaataagtctcatagatgtaatatgtcacattttaaagcttcttctgctttaacttgtgttttatgtttagttctctgaggatctaaccctgggcacaacggggccttttctgaataacctgtggagtaatacatgctttccacaatgagaaaatcagggcaattctgttttttcaacagtccccccagcaccctgacatcacaggaataaactccactcttagagatggaaggc

SEQ ID NO: 20028 - DNA, 600 bp, Bovine  MMBT16711
gagattagatattaatttgtgactctttgtcacaatattccattaagtgttcttgattgttcttgcacaataaacaatgtctttcttccaatttttttgaaagttttatttatgttagttcaaaatgtctttaggagttgccaaaatcttcagtagccatgagacatttaacacaatattacatattccacctatttgttctaaataactcaaatgaagcagcagttttccagtagcttcccgcatcacttggctttttttgaaccagggtttatagtaacaaaatgtaaattggataayagttattaatggtacaaaagcaacattggggtgagcttcctggtaatattatgtcagtaacatgaaaagatgctgtgttgttttggtttggaacttttctgggttttcaatcaggctcagcagatttgagtaagtaggcagccattatggttttatttggttgttgtttttttcctcttttttgatcatcaaggcacatacaaacattaggctcaagcctaaagccctaaaacaagccattcttttgctggtgaaattctaatctcattttattacattgtcaatgagctgcagagattc

SEQ ID NO: 20029 - DNA, 598 bp, Bovine  MMBT10089
  misc_feature (1)..(16): n is any nucleotide
nnnnnnnnnnnnnnnntaattgcaccaggtgagataacagttggaatgcgatttcacccagcacaatgccgcatatcaaaggctttcaccttcggaggacatgaggatgaattgactaagagtcattatgtttccaagatatacacaacactgctgaagagtttatatgatgcataaaaccattaagacgaaggtttatgttaatcatagtgggagacatttctaggtcaggcccacatttccattgtcgtcttaccatgttctagatgaagctgtaagaaataatatacacattgagasaaaagggagatgcacagtttttagtcaatttctttttttttttcctccctccaagtttagttccttatcagcttgcgaaaagctgctggaaagaagcagggattttgctgccaggtccgaactgcaggggtgggactggcagtaggaaaaccaaaaagatcgagcaaataagagatagtatagatcgtctcctgttgtgtctgttttcaaattgctgtgtttaaatgaacttcttttttagcaaactgtctttagtctctttcttcctggcctccagtgacctttaactgatttttta

SEQ ID NO: 20030 - DNA, 600 bp, Bovine  MMBT12365
tacccttcttcagggatttgaggggtgcttttgtggttggycaaagacagacgacagttgtgagtgtccgttgtgagagccttggtttcagtcatattggttctgtgccctaaggaaatgctttggactttggacaatataaatattgtccatctctcttcgcacaactcttcttcaataaagtttttttaatgattgggaccaaatactgaattactgttacatttttaaacaatcgaatacttttctccttcttatattcaaaattcacattagcatattttagtgttcttaataatmctaccataaagaaacccatatcatttaattgaagacacttttttcacaggacacattaggattttgatgaacactaatatttcactattaaactaayrtttcatagaaaaattagtttgtttagtgattgtctcctagttatgcctatcgtttttaaaaattagaaatatacataaagggtaaataattgttctgagttaaattgttctgattttaaatgaataaattttcttatttacagtcattgaaaggagatagttcatgtttttcagatttactgttttaatataaagtatttgg

SEQ ID NO: 20031 - DNA, 600 bp, Bovine  MMBT04479
ggcaaccacaggccaggcactgcgctgggaggtgcagtgcagtgtcctkggtggtggagaggagacctgtcctgaaaagtgtctacacggaaacgatgtgtttaccgtcggagcaagtgctgtgagggacgattgccaggtctggagggaacacctgtggtgtggtcttgagggtgggggaggacctccctgagaagggggcctgaaaactgatcaggaactgtcctcatggagaatcagggacagctgttccgggctgaggggagagcacatagtgctttcttcatttgttgtcatggwagacagggattctcaccctgcaaggcagtttagaggctgaaaggaggtaagacatgaaagtgaaagttgctcagtcrtgtccgactctttgcgaccccatggactatacagtccatgaaattctccagaccagaacactggagtgggtagcctttcccttctccaggggatcttcccaacccagggatcaaacccaggtctcctgcattgcaggcggattctttaccggctgagccacaagggaagccccaagacatgtaaagtaagagctaaataattggtttgaattatgctaatggg

SEQ ID NO: 20032 - DNA, 600 bp, Bovine  MMBT01369
tcccttaggcagggcttgagtctcctggtttgccaccattcaccatcccctcactttattttttttaattgaagtgttaattagtgctgaaaagcaaagtgattcagttatatatatttttttcttttgatattccattacggtttatcataggatattaaatatagytctctgtgctatacrgtagtascatgcccaccttcctgttgagccccaccctgcctcctccactcattwatgtgcaccatcacaacctcaagcacttgtggtccaggtaccacagcactggcattatctggsaggtggttagaaatgcagaatctcaggcttcaccaaaaatctaacraatcagaatctacattttaacaagatctccgggagattcgtatgcagattaaagtttgagaagtcttgctggaggggatctccaaaggtcctcccccctccacacacacaagattctgaatgttgaccatgggccaaaccctggacttttcactttgttaataggtacagctctccgttttaggtgggaaatccaaataaaatcctatattaaagtaactgcccttataaggatggatatacaaatgaataaca

SEQ ID NO: 20033 - DNA, 600 bp, Bovine  MMBT18390
ttatcttacattcacaaaggataacagtctttaggctttgtcttatgacaaaagaaaatttttgaaagagatgccatcagtcacaaaattctatagaaatataccttttaggagtcaatacactacatcgtaatgcaaatctggaaaatccacaatcacttgagtccttgcctaaacaggtggtcaaatcctacagctctagattcaactctcagtatctgttaagcatctggaaccctaactttggacactggcgagctcccgtgacagttacaggggtttcatgtcactcaattcctkgactcacaaaacccacggcgagtgcgggcgtaggtgcaaattatcttctctttgcaatttaagatcaccgaggtgaagttgtacgatcaagcaacttttcatcatattaacaaatagtcacgctgacactgaaaaaagtccactctggctgaccgtgtcgatttccgcggaaacataagacaatgaacagaagttcagaattttagctatttactagcccccatccctccagcaccgttaaccgaaatttcacagtcgaatctgtgaaaatcgctttcttgaccttcgggtgtcaacccc

SEQ ID NO: 20034 - DNA, 600 bp, Bovine  MMBT04704
gggacaaagaaccattcccaaagccagaagatgtgggtttcaggggctgatcaacagcttgggtataggaaccatttctgtagaagtacacaccacagcccagggttgggcaggctgatagacccaagtaagataggctagggccagagaagctccttggatcctaacattcaaacatctccagactgcaagccagggaggcactgggagccttccaaggaggccctagagactggtcagtagctgtcatgggtagggraaaagaccatgccataccagctatcagggacaccccctcaycattagcacttggagctatgccagtgagagatggacaactatgctatatggacccaaagcccatcatcccctctgaaaaggtaccacaatcactgtacattccagaactgactcagccagaccctcacacctagagttggcccaggcagaggagacagctgctcctttccccatagcccatcccgaagaggcagctggggttctcctaggcctccacatgcggctatggggcactccatacctgagatgaggaggaggctggagacttggatcctggctctaacactaaaatcccatttg

SEQ ID NO: 20035 - DNA, 600 bp, Bovine  MMBT10252
cagcagggctcggggcacctgggctctcctcactttttgggtctgacccagtagtttggcccctctgagcctcaggaggtaccaaggtccccaatctcgcctgcttcttagggaaactgacggcagagggaaagaccctaggcggttagccggcttcagctctccctgcaatacaggcccaaagccacagggcaatcgggacatgggcctggtagccccgcccagtggccattcatggaacaattatcctaacatgagcaaatacttatacaatgaggaccggggcccccgagcctgtgytcatcccaggtatgaacacgctacccgtctcagtagcctgatgaggcagatccattttacaaacgacaaacctgaggaactgagaggtgaagagacctgcccaagttgcacagccggaaaagggcacggccaagagggaagccaggcgtgggcagggctgccccaccctcacgtactcactcttcagcaggacacacatccagccctgtttcaagacgaggagaagccagggctcggacgcactggcttcatgcccaggtcacagcaggcgcgcaccagcccgggcctgtctggccctgg

SEQ ID NO: 20036 - DNA, 600 bp, Bovine  MMBT19670
gaatcccatggacagaggagcctggcaggctacagtccatgggtttccaaagagttggaygtgactgaaacaacttagcatacataaaacatgtaactaaaaacctgctgtatatcacagggaactggactcaatactgtgttctgtatgacaaaagaacaagtggatatatgtataactcattcactctgctatacacctgaaactaattcaacactgtaaatcaactatactgcaataaaaatataagaaagtattaaaggaaggccagtaccatataaacagcatacacttaaatamaaagatgaatatttaacatamagggtaatgttttttttttttccccactaataagctaaaggtccatttcaagatgtttctttctttagtatggttaatttgttttattagcaagcaaagccctataaaggatggcatcatctagtccttagactcagattcatcttcatcttgtctaatctggaagtaacgaagctcataagtctccttgtcagatgcaaccacaggaagccaatcatgaagactgttctttttaaggtatttcttggtaaagtacttcaaataccttttagagaactg

SEQ ID NO: 20037 - DNA, 600 bp, Bovine  MMBT07139
aagctaaaaagtatcaaacatctaccttccccagcccttctgccagccccttcaagtatgttgttatcaacattatgggttttttagcacaaaaaacccattatagtaaaagagtatgcatgggatatacatatactaaaaaaatgattttgtttagttgaaatttaaattgagttgagtgtcatgtttctttgttcagcctggcaaattgacagctatgcaaaataagaattctatccttactggttttgttaagtgcttcctagcagagcaagacaagctatgatggttagcctccaytcccccactccgcccacccctcagacaagactcagtccattcgtgaggaactggaaacattccagctctgaacttcccacctgccaggcaccaggcgggcacccctatgctctaggacctttcacctctccaagggcatctgactcactccgcctcatggggggataaagaagctttgtcaaggccaggcctcatttgccacttcagagcaccatgtctgttgacattgcaaaatagcagaagaattcaacaagaggtcttttcagaatgttcattgtgaatgcacaaaggacagtccca

SEQ ID NO: 20038 - DNA, 600 bp, Bovine  MMBT08405
ttttttactttgtttctttgtaaatattgttccctttatctggaataacctttccatcttctccctctgaccagtgcctgtctatcctctaagattcaactcaggtaatttatcatctgctcagtttctctccaactggcttccatctctgtgcatttgaacatggaggacacttctctaatagctctttagtgtttggtcattgcccgattgtgtcttttccccctggactttgtgacacttaagaacagaactttgggtttattttttaattatccttatataaagatacatgttttycaataaatgttcagtaaacatttcttaattttaataaacacttaacatttaagaaaatgaatttctttgtattttgagacatgcaatgcatgcttgttatagctgtgagtagtttctctctgtaaatcaaaatgtgactctcaagcctgaaacactggagataaggtagagtgaggggttagaatggcagagaatagaaacactgttggtcaccaagactgcaaggctctcagtgactgactgaatcaggactccagtccaaggctgctgctgctgctgctaagtcgcttcagtcatgtc

SEQ ID NO: 20039 - DNA, 600 bp, Bovine  MMBT19910
tgtggggcaaccaagctcaggcgccacgaccagagagaagcctacacactgcaacgaaactccttagtgctgcacccragagctgacacagccggataaaacagcagatacataaacagagcgaacggcaagaaacacggcccccgagcgtgcgtttatgatactgttgctgtatgccctgcaccgtgctaggcactttgatgcgtgctatgtttctccctaatgcctacaagggcatatagcattcaacaatcaaaacatgactgttacaggatatctaccccagcccagtgaaacacracacctccgaatctccctctaggccatcctattgttgtcttctggcaggggattaataggtacagtcaactggccttctggtggcagttataccttacattttctttgctccaagcaaagaataccatctgtgaaaccccccagctcactgcagagccctgacatgtccttctaacaaatagccacaaaggcccaccgagggctgcgacccttgaacactgataggtacacagagccacacagagagagacagacacggagacagaggtgtgcagggctggacaaagaggaagcagagaa

SEQ ID NO: 20040 - DNA, 600 bp, Bovine  MMBT05336
cagtagatgagaaagcaatgttttcccccaaaaatagaagtgttctattggagagacattttgaaaatggacgttgagaaacatttccatgattaatgatttgtagctgaaagtgctggagtttgatttataaaaattcatatctgcacacttcaaaaacttggaaatggatctgtctagtcttttaaacattttccaaatgaagaatttcgacaggctttgaacctatttgttaaaaatattaaaatatggcacctttcagttagtttacaagaacaagtggctgacatcatgaaaaayggaaatttacttgctgaatttcaacaaaaacctttgcataatacatggatgagattgaaaaatgagagtcataatttagtaagcaccgtcatcratgaacttcttccagttggctctacacatctcaaggtaccttttcagctactgagcccaagaataagtgaattaaaaccagacatttgaattactgtaacacaaagtattaaatcaagattttgaaaacagtaaaatatatcgcctcacactgctctgattgaaaatatgactagtcatgatattttaatgagaacaaaaaggcct

SEQ ID NO: 20041 - DNA, 600 bp, Bovine  MMBT13658
acttacaggtgacacttcagaggaagtagaacaaaggggtcttcaaactgttattacttattttaccaaacaaaacaacaaaatacgtgtatccatatggataaatctcaaatagagcaaatgcagacaaatacataaactataatatgccatttatggccaaaaatacttaaatattgtctacagatagaaaactatcattcccgtgtatgttttctatactttcactgaacacccagtactgaatccagaatggtgctttccttggagaaagaatggaaggggaggaaagaggaagayaactagaacagctggtttttagcaacaaaattgttttaaaaactgaaaagtttcatagacaagcagcaaacgcaagcatgacacaatgttaacatcttggtgaaaaatcagatgcaaggaagactatgggagatgcttcatcaacaagctgttctcagagaacacatcaccagtaccatctcacttcaggcgaggttttccaagtgtgtgatagagtacggcgtagttaggtcctaaatcggcttttagaaatgtgagatacaacacatacattttaaccatggcaaatacgtcccctgt

SEQ ID NO: 20042 - DNA, 454 bp, Bovine  MMBT12784
tcagtgtaatagcagtagaaacattttcttaygacaatgcagtttccgtatcctatgtacaaaatttcagtaaaagaaatatctatagaaatatgaaatcaaaacttagaatagcacatgaatgggacgatccaaacacctgtcttcagagatgagatacaatgcctgattagagactttatgttaatgattcgacaatatccactgtgtgtttcgttaaaacgctgcactgatctcttcccaattcccatcatgtatacaaaatgacatttgtgatttttttaagcagtagagcaatayattctattcactaatactgtaacaaaaatgaagaatatattacttttaaaattataaacatccataaataacattgactcaattttacagtgccaaataggctactttggagagcactcacttagccatctacattaacactaaaatcaccatt

SEQ ID NO: 20043 - DNA, 600 bp, Bovine  MMBT04925
tcttgcaagaggaaagattatcaggaaaagaaaaatgaaggggagtaaagtcgaaggaaagtaccaaataccaaagctttgggtaagaaaatatttaggcaacaagcacacaaccacaccctttctgggaagatattactggccttgaagttgggttagtggatcccaaaatacacctcacaaaaagcacagttaccctcccaaaataggccctataattaaagtcttttcaagtggattgtcctatatcacaacttgacatatgttgctttaatctccctgcttcggcaaatgtagccrtatcgggctacacaagctcacaacgactcccagttaaaccagattgtactgtcactaggaaattgatgcaaataaacagccctgagtaccaaaatacccaatctcaatcatctgtaatgagatctctctcctccctaagcacattctcatcacaccagaatcacacccttgattcaaaaggatgggctaacccagattgaaatactgcctcatctcagaggtcatctgaagacaaacacatctgaagaagccgggctgaaatttaaaacacgagccaatctcttttgtgtgaatgccgga

SEQ ID NO: 20044 - DNA, 600 bp, Bovine  MMBT12859
gcaaagaacccacctgctaatatgggagatgtaagagacatgagtccgatccctgggttggaaagatcccctggaggaggacacagcaatccactccagtaatccttgcctggagaatcccttggacaagggagcccaatgggctacagtccatggggtcacaaggacacaaatgaagcaacttagcacacacgcatgccaagtgctcatggagaggcatagcacagtgctaagtcagtctctggacactgaagccagttttcctggggtcagatgctgactctagtacttactagctgygtgaccttgggcaagcaacttaagttcttagtctctcagttacctcatctataataataatagtgcctgtttcataagggcttttaggaagattaaataacttagtatttataaagcaattagaaatatacctagcacctagaaagtgttctgtaaatgatcagtaaatacactggaactcattttctagtgagggagtcagacaataaataaatatgaaaattacagtcgagtcatggggacaaacaccaagcaaacaatttacgataaaatgaaaacacacccagtcctgtgagtggc

SEQ ID NO: 20045 - DNA, 600 bp, Bovine  MMBT05906
cagttaggacagagcacaaatgtttagcaaaggattccaaactcttagcaatacttaagcaatactaaaagtatgtggaatgtaatcttagtttctcaattgcacacttatttctaaatataaaatccttctaagatttttttttctcragggttcgattcctgtaatgaagactgtagtttagagtcacacacagctgcaatgaaggctgggcgctgccacgctgctgtgtgtagtgacaggcacgtcgtctggcagcgtgaactgtccaggtattagtttcctcacctgcaaagtggrattagtggtaataccctttgggttaatttaaaaacgtaaagtaaaataatgcattccagggcttagcagaatgcacctagtaattcctaataaattgtaggcatttttctttgttactaccaatcattctttgtctccaggtcttgtttccattcaaaacaatttaatatttttatcaaccttaaattctgacagtttttgtgctttctatttatctaaaatcaactttagtggaatataatttacatacaataaaatgtatctattttggtatacattttgacagatttatacacacct

SEQ ID NO: 20046 - DNA, 600 bp, Bovine  MMBT12864
tgaaattggagggtccaaaaacagccgggtgttagaacagcaagttctgccrtgcagtggaagctgtttttaggtactgttaagattgaaatgagttacagcaatgtatggcataatctaatggtgccaccctttattccttactaggctcatattggcaacttattaacatcaaaattcttcagttacaaggattttgacactttattgtatacatgtgcagcagagtttgactttatggagaaggaggtaagatgggatytatccttttctttccttaggttttggtccattcatttytcataaaggtgctcctgttactcagattcttaccgctgtgctcrtatctcagtttgaaggaaaaggaaaaccttgcagcttaaaccragatgttcctgtttacattagcacagcctcatgaaatatatgatttcttctgattttgataatttagaaacatgcattcagtctagcaatagtttttaggatgagtaaacacagaagcatttcaagttgcttcctttcaagggtagtattgattcagtgaaactctcaagcttttcagtttccacttgctttgtgattatttgtttgaataat

SEQ ID NO: 20047 - DNA, 601 bp, Bovine  MMBT08819
  misc_feature (1)..(1): n is any nucleotide
naaaaaataaatgtactcaagagtgtgcagtcatttttatgtcatatgtatttgcttcattcccattttcatttaaagagaaaacatttttttttttttacattctctcattagaaaagtatgccctagtaatgggatggaaacccaagaaatcagttcttggtacataaatttgcaaatattgttgattttcttgagaagaattattttatttaagcttatttcttcatttttcagagcagtgtttcagtgcagggttacatgagacaggcattgtcgacctaaatcctgagatattttkgggcttggcatatcttccccaaatataatttctttttactattttttgctctgcaaatagggatatggacctacagcttgattactaggatgctaaaatctagcacttttaaaaggctttaaaggggtgttttttaatactctgggggagtatgttgaaattgattatactcgcctttgaaaatcctcactgttcctttgtttcattgtcattgtatatgcagtaaaaatatctctggaagcatgttgtaacaactgattctgaggatgaaatttatgcttggagagttgttgggtgcat

SEQ ID NO: 20048 - DNA, 600 bp, Bovine  MMBT17298
ctctcaaagctccatcagacacctgatcatcatcaagaagagacccatgttccaggtaatgaaagaaaccttaagagacagtggctgttgggaaggattgggctatgattattttcctctttgtatgggtctggcaaaaaaggggcatcattgggtgggtacattcatgtattagaaaggaagaataggggctatataactttctgagctgacttctagcactaagattctagtaagcaggagaaacacaaggaaataataaataattatatatatatatgatcatgaaaataccsaatratggatggtgtggtaaarcaagtacagccatatatgtagcacaaatatagtgtaacttttggaaaggtatctggcaataagtagcaagaactataagagtgtttattctgytgactgactaatcttagtctttggatatatcctaaagcagcattttggctgcttttgcagaaccctaggccttgagacagtgatttaaacattttgtacaccacggatccctttggctttctgatgaaactctagacaccttcttagactaaattttttaaatacataaagttaattacatatgattac

SEQ ID NO: 20049 - DNA, 600 bp, Bovine  MMBT18174
agaacgtccctcccctgggctgacattcagggtattccaaggaatcctttgtacccagacaacagcatgaatgactgctggtcttgggtgtccttcgtgcattctattcacattgtgtgcccttagaaagcaacagggctccagatagagatgctctcagacgttctactaaacatctttctgttgctggagggacaatgcctctgatgagaaggggaccgacttctgctgcagtctgtagatgatgacaccaacatgaggaactggggctttaaggcagaagctaaaatttaatcatgyttacactcacctcccccagggctaagaaaaagcaagctgcagagctgcaactaaaaacccaagagatcgtctaaaggcataagggtaaagcacactgaagtatgtgcatgcatgctaagttgcttcagtcgtgtccgactctgtgtgaccctatagattgtagcctgccaggctcctytgtccaggggattctccaggcaagaatactggagtgggttgccacatcctcctccaggagatccccccgacccagggattgagtctatctcttacgtctaacctgcattggcaggtgggttc

SEQ ID NO: 20050 - DNA, 600 bp, Bovine  MMBT10524
cttatgctgctgtctttactgaggccaaggaagtagttcattcaaggttacttctcagttatacattctcatgtttccagggaaggctctttttaacaatccagatttaatttttacatttgacgggaaatgaaatattctgtgccttttccttggcctgatttagtaataagctgctttatagcagaattcatgtgtgctcattccaaatgcctactgtaaactcttaggtgttaatgacaagtaaatcagaattcattctgtctgcctcctcctgaaacatctcagaccactaactgsgggtctataacaggcaagagggggcagctgtaggtgacttctgaacttaatggaagtttttctgctctgttaattgccaagagtcctgcatatrtgctctgctgattttctgaagcctaaaataaaacttgcttaggtggagagaaaaatggagttgtagattcaagagaatcttttgaaaatgaagggatagtcatggatcatgtggagggctccccttgtgttacatgccttacaggtgccttccccaggaatcctcaaaagggccccaagttcttacccccatctagtagacagcac

SEQ ID NO: 20051 - DNA, 600 bp, Bovine  MMBT21370; identical to SEQ ID NO: 4845

SEQ ID NO: 20052 - DNA, 600 bp, Bovine  MMBT07808
accttcagctgaaatttgctccaacagttccaccctgattgaaattaatctattacctctcccatacgtattacattttatacctgttcagcaatcctgggatgaaaagagaaatactgaagacagaagaaatccaacatttggaaaccctacagtggatggttatattatgttcccaactatctatttccactttttgacatatgacttccagtgcctcccagtagatggagtgtatttccctgccccrttgtcaggattggacaagcgacttggccaatacaataagagaagatgtgrcatatgctatatccttatggaarctttatttgcacctacatagttttgttcggtcttttgtactcttggcctctgcaatgagaatagcatgtcccagatagaggctgttccttcaacctggatcacaaattgaaatgacatgtggccaaacagagacaagaacagccacagccaatctgaagaccatgactgaaaaaccaacgctcattattgtaagcaactgtgactttggaattctttgtaactacagcaaagctgaaaaatacagaaattggtaacaaatgatattacagttgatcc

SEQ ID NO: 20053 - DNA, 600 bp, Bovine  MMBT08623
tagcaggcttctaagaaatctcatgggatggcattaatttggtaaatttgtcaaggtcctcagtctgctaggctcaaaatctgattttatccttacaacagagagcacacccgactcccaggagaatgttaaagacatatatttttatctatacataaattgatatataaagccagaactgcaatatattacattgcaatgaaaatggaaaatttcatatagactacatgatatatggtttctatatcagcattttaatcagaaggagacttgcatggaaagctaaatccttatcagaargctgtttggtgaacctcmtcctctgaacaggaggataaattacaggaattctctataagaaagaagatattaaagatgaatgggaccagataagtcaaaagtctcttagtttccttatctccttcctacacaaggcttagatgggaactgccagcactggcttattactgagattaaacaatctatcatttgaatgatgcaatcttttttctttttttttggatatgttgacggattcaatcaagtgctgttatgaatctccaagtcccagagttattcggtctctgagttgtctctgcg

SEQ ID NO: 20054 - DNA, 600 bp, Bovine  MMBT21326
tttgacattttaaaggaagagggagtcaaggagagctttcctttctttacctgcgttgttacgatggcatcttggcatctggtggaaagtctcgtactcagatgccttacttcagggcaggaarctactgatggagggaagctgctgctttttatccatcccctcttccttcagacatttttttgttttaatttgtttaaaccatttgtttcttaatccagcaaatagacttttttaaatggaatgataaaggtgccttgttcatgttttattggcaaggaactcatgagccagatcctstgatttaattaggagctgaaggcacacctctctgacccttgtctgctgccagcacatggagttcccaggccctgtggagtcttcagaggaagcagagagacccttggaggagctggcttaaaaatttccatagaatagaaagtgggctggacaagccggctgaggcagttaccctggtggttgagtagcagtgaccagtgtttggggcctaagatgtatgacatgactgggctgagacacagggtgtcctgctgcttctgggcagtctctagagaaggaaacaaagcagatgcatttttt

SEQ ID NO: 20055 - DNA, 600 bp, Bovine  MMBT05634
caaataccgtatccccacagctgcagtaccatataggcattttgtacaagtgatgtaagcatagttcttcttctttttttattttttaagcaacagtggggaaaatattttatactttcactgtatatgaggaaaatccttctaggttgacaacatattgagaaaccaagaataaaagaaagaagggaaggcaggtgttagataatatttgagacatttatagagttgatgactggctggttaatctgacttaccccttttcctaaaactcgctttgcatagatttgatgttgttcagtygctcaggctcagtctgtctgactctttgagaccccatggactgtagcatgccaggctttccctgtccttcaccatctcccagagcttgctcaaactcatgtccattgagttggtgatgccatccaaccatctcgtcatctattgtcctcttctcctcctaccttgggataggcttccctggtggctcagaggttaaagtgtctgcctccaatacgggagacccaggttctattcctgggttgagaagatccccaagagaaggaaatggcaacccactccagtattcttgtctggagaatc

SEQ ID NO: 20056 - DNA, 600 bp, Bovine  MMBT11014
acatgactcttgtgtcttcctttttcatgtaaaagtgtgttacaaacgttcttccgggtcagtgtgtgtgtgtgtgtatgtgtcctttgaatggctgcagggcgctgcactgggagcgccatggtttgtaatttaaccacccggttcagcgaccgtccaagttttcagcatcctaaactatattgcaacgaaaacctttcctcacactatatccgtctgtaacagcattaacagcctaaatgcttgtcgggaagggctgattaaagaaactctggtaccarctaagtggaacacagccascaaaggaaattaataaatggtgaaacaggcgtgtacaatacattaaacacgcaaaaaaaggaggggaaacaggcgtgtacaayacattaaacamgcacaaaaaaggaggggaaacaggcgtgtacaacacattaaacamgcaaaaaaaggaggggaaacaggcgtgtacaacacattaaacamgcaaaaaaaggaggggaaacaggcgtgtacaatacattaaacaccaaaaaaaggaggggaaacaggcgtgtacaacacattaaacacgcaaaaaaaggaggggaaacaggcgtgtac

SEQ ID NO: 20057 - DNA, 600 bp, Bovine  MMBT01922
gggaagatctcctgaaggagggtgtgggacccttctccagtattcttgtctggaaactccccacagacagaggaacctggcgggctacagtccatgggggtcacaaagagtcagacacaactgagcaactaagcacagcaccctatctgattagatacaaagttttatattgggcaagccacatggatcaacactttagtaatacacaagtctgagaaaggtaaccctcctcacttcccagtgcttcgtggtcacagaatccattttccacctctgcagctcacaaatgagatcttcccygtgtggacctactcttacctggcactactgcttccagtctttgtcctcacggattatgtccgctacaagccagtcatcatcctccagggcataagcttcatcatctgctggctgctgctcttgtttggccaaggagtcaggaccatgcaggtgctggaattcttctatgggatggtcaccgccactgagggtggcatactatgcctacatttatagcatggtcagcccggagcactaccagaaggtgagcggctactgcaggagtgtcacgctggtggcctacacggcggcctccgtgct

SEQ ID NO: 20058 - DNA, 600 bp, Bovine  MMBT07867
ctcttgaccaatgaagtgagttgacactgtcatattcataaataccacagtccagtaagattgtggggaaggcgagatgctaagtgtgtggtttgtctatttgggaaagacctgagaaagtgtcctggggcctctgcctgaaatcagaggacaagaaagttgagaatgaaacccatcaggaatatatctgccagagacaggaaattgaattggaggtgccttatcagatgcccatcttaaccctcaaagagaagcaccaacaacccaagatacagatccgcagataaggttccatttacractggaggcttgatagctccagacccctgggtagcttagaaccccctggtgaatctgtaatgtgtctgggtaataaaccaactgscagaaatgtcccagctctcctgattggggctctgagtaccaggcttcagtaggtctggtttctgagggctggaggctccatagcattagctggtcacagggagcatcttgctttgcttgctgcccccagattttcacaagcactggcacaagttgctgacagaaatagcaggcaggccaagttgatttcaggccttagtaatctttccggctgta

SEQ ID NO: 20059 - DNA, 534 bp, Bovine  MMBT19285
ttctctattcccctcagcctccagcctcatgtggggtttacaattaaacacctacacatcatctctttcactgtggccataaattatagcagaataagggcaatatacagcaaaaggaatgagtcattctaacagctggctttttgggacagcacgggatgtggagagatacagagctaagcgagggagagagggggaagaagcaacaaacttttgcctctcggatcgaaattagacaaagtcacgtctggaagcaagacaatgactggaagcttaaatgactgtttacaggctcttacrtagagataggctttgccaaggagcacctgtcatctcaaaggtcaccaccctgatataagcgttcatcttcctgatgaaagttttgctttggcttgacaagactggaacctcagcttcgaccctgcctcatctatgtaaaaacaacctggaaagctaagagaattagctttgtccaaatcctaagaaatttccctttgggggatgggatttctttacctctattctattctttgg

SEQ ID NO: 20060 - DNA, 600 bp, Bovine  MMBT07449
gagggaaggaggacactggagccgacgccaccgaggagcccccagcctgcaatacacagctctggtcagtgtttaggaggagccaggggaccacgaacaccacctcctgaatggcgctgggcctgctgctgcccacggctcagtgaaccrtgctcgtgttaggtccctacgagccaaggcaagaacagracaagcagcattcttcttttctcagatgaaggtaaaactgtagtcaagaatatctgagagcgtggagcagcagcatccaccttgtatggattcaatgggcattcatcttcwaagcagctaaactgaaattactcgtacagaagccgagaaaccgagcaccacaggtacaygcaaacacaaaaggaccgcgaggcgccttccctgcggccttacttcccccagctggcactctctacccccgtgtctggggccatcctgtgccctgcrgccttactcscccggccggcgctctctacccctgtgtctggggccatccttgtggaggttggcaggacacaacagccctcaccacttggcagtgggtccatgaacccccaagcccctgccagcgctccttacacagaggggaga

SEQ ID NO: 20061 - DNA, 600 bp, Bovine  MMBT13257
tccaccacatctgcgcttgcctcagccagggggtcctgtgtggcggccagcaggacggggcagggcccaccacacagcccagggacacacctggcgcacggtaaggactcacttatcacgtgtggaattataaagagacacacagcttcagcctggccgggcccagacccgagtgctgtctgcctccctgcaggaccgcaagctgggaagggacgatgctcctccgtcctgcgtccctctcacacagctgggcacaccccccagaggggacactagggctgtgacgagacgttcaccaaygtctcatctttgctttggaagccatgtcttctggagtccagccaaggtgagagtagatagagctcctggcatctcctgccttcaatcaaagtggcgggattccaagccrgcccacaaacaacgatccccaggacttttattaaactgagaaggagagattcggcagcaagaactaacaaagccaaggcttcctccattcccacctgcaggaggcctgcccccctttgaagcccatagccagctcttccctttttctgggttttcaaggtcagagtcacattggctgcaagggttctcttt

SEQ ID NO: 20062 - DNA, 598 bp, Bovine  MMBT05515
  misc_feature (1)..(100): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatggctggatggcatcactgactcaatggacgtgagtctcagtgaactccgggagttggtgttggacagggaggcctggcatgctgcaattcatggggtcgcacagagtcggacatgactgagcgactgaactgaactgaaccatacttcctaatgtggcagaaacccttctcagaagctctccagattaattgaatyggtttgaattgtatccacatgtccatatgctattgtaatctcactgtaattaaaatatattattgactatttaaagatttttctgcaactaatttctcataatctaatctagaaattggaaggatgaagtgatgactcctcaaattcattagccttagttggtatacacttaggaaagcaaaatttaggatctttagaaatcaaaaccaaagttcacattgctagaaagttgtacctctgtccccgccctcctccagaatatcttagtccacatttttttttaaacaaatagatttaa

SEQ ID NO: 20063 - DNA, 600 bp, Bovine  MMBT23233
gcctggttcgctattgtccatggggtcgcaaagagttgggcacaactgagcaactaactctccttttcttctttaaagccctgttccttttgacattcaagttttcattgtactacatttttcatgtaagaccaaatccagaactgcattttacagttttttactgtttttttcctctcagtgctgctaaaaagaaaaagcagctaacattttgaatttacaacatgccaaaaatgacacagaaattattacatttatttttgttcttgttaaaactctgtgagcaacatttaccaagayagcatgttaaattactggcattctctgggtactaaataaaaggctgcaactctctaacattaatgtatatacacaacattccctagcggtccaatggttaggattcttgctttcactgctgagggcacaggttcaattcctggttagggagctaagacccaacaagctgcaaggtacaaccaaaaaaatatagacatagaacaaaaaagaaaaaatactaaaaaaataaaaagaacaaagtactgatacatattacaatgtgggtgactcttgaaaacatgctacatgaaaaaagccaga

SEQ ID NO: 20064 - DNA, 600 bp, Bovine  MMBT13631
ggcatcactgactcgatggacgtgagtctgagtgaactccgggagttggtgatggacagggaggcctggcgtgctgtgattcatggggttgcaaagagtcagacatgactgagtgactggactgaactgaactgaagcttcccaacagtttttctggctgtgcatgtacaactgactgatcaaaaatcttaagctgaagatcatagctttaacaatgccaccttgtacctatagctgcagctttggctcaatatgtccaaggaaacaacaccgtatgttcaagccctgagctgtctgccrgagcagatccaagattacatggatcgctgccactgaacacttcaaggtcagaaaatctcccagagccaacttttctgcttcagactgtataattatcttgcatctcaggtcagcttctaccttaaaatgtgggttgagcaatgcccatttctaaagaagcaagaggaaatgcagctgttaatcagccaccaaatgttactcacccactaaaggacatcttatcttgatttttgttagtttatatgtatttaatgaacaattatgcctttctaatttcacaatgatatgaggtggcttgct

SEQ ID NO: 20065 - DNA, 600 bp, Bovine  MMBT02436
aattttgactgttaggtatgtcatagtattagcttctctgccttgtggttctttaccacgatctaacacatacttctgtgagtaaagcgaaccacatatttaggctatgaggtgtttccaatgatgtggatcttcaaaaaagcctccctgcttagatttaactggtgtaaggctttttgatacttgtatctaaaagcatcccaacagatacacctgaggatgtggctcagtcatgtgtcaggagactgtttctcagtcataggtggtggtggatcttatttccctactctgatcatactrtgyttttgatgtgaagtccattaactgtaggcaaataatactatgaaaatttatttatttaatgtgagtttaggagttactatgtagtagacccttaaactaccacatagtgtttgaaggtggttatttcctcactaatctggtggttctcaaatagtaccccaaagacctgacttctggtttcaccccaaacatgcttagaaactgttactgctttcctcacagtaagaagaaaatctgaacaaactggaaatcgataactcttctgagatccatagagaattgaggtgacagggcaaa

SEQ ID NO: 20066 - DNA, 600 bp, Bovine  MMBT08936
tttggccacctcatgcgaagagttgactcattggaaaagactctgatgctgggagggattgggggcaggaggggaaggggatgacagaggatgagatggctggatggcatcactgactcgaaggacgtgagtctgagtgaactccgggagttggtgatggacagggaggcctggcatgctgcgattcatggggtgcaaagagtcggacatgactgagtgactgaactgaactaaactgattgcattttctactcattcattatattgatcaattccaaaattctgtttggttctctatcrctatttctatttctctattaaacatgtttcgttcatgtgtttttttcccccccagtggattgtttttctgttttgttttgttttttctctcttgtagtttgctcagcttccttaaaacaattaccaggcaaaattaaggtcttgatttctttggggtcagttgctgggaaattattgtgttcctttggtggtgtcatgtttcctttatttttcatattcctttaagtcatctattgcagcctttgcatttaaataaggagccacatcttctagtctttactgactaaatttaggagaaag

SEQ ID NO: 20067 - DNA, 600 bp, Bovine  MMBT00787
gtaatttatgttgtttctcccaaagaacttggtgggctttcttgtgtgtatctggggtcttccctacattcccaaagtaactgaagagggagacagatattattggtgtcatttaacaagtacagtctcaaaaggatttatggaggttgttatgagtcatatattttaagccttgaagaactggcaagataagactgtagttaacttggatgattccaggaaagatgaaggcatacttttaattcccaggtgagttccttaccacctaacaccggcctagccagctgcttctttcctctmgtttcaatttttttgttttgctttgtttggccacacagtaaggtttgcaggaccttagttccccaaccagggatcatacctgtgcgtcccacctcaacagtggaagcacggagtcctaaccactggactgccagggatttccccttatttcgtatccccatggattttgtggcaataatagtttttttcaacttgtggcaataatagatttttttttaacttgagcataatagatgataattgccctgaagacagcactgacctttaaagttcagcaatctctagactttcaaacttttt

SEQ ID NO: 20068 - DNA, 600 bp, Bovine  MMBT11777
tgattccaactcaacttctacaagtataaaagcaatataaccaaaaacatgccttttggcaaagaataaaatataaggagatgcaattccgccagatggcaaaatcccagactaacaatttgtcgacttattgatggacataactaagcccctaacttactaaactataatggaaatatagaagaattctgccattttgtagatttagctgcatcattgaccaaattgcatccccacaacatgacatcagatagagaaattctgaaaaatcacctttacctcaccacaytggtctcctgkgcatgctaatggcattcttactgatttctctgctttccatttttttcttctccaattccmtgtacatttcaaccatgttatgtttctaaaatatacatgagaggattaccgttaccttttttaaaattttgcaatggctccctccaatggagacagtccaagctccgatgtaaataaagcttttcatggttaagacccaaacctgacccactagctttatgtctattatttcaagcatggccttggccctaggatgacaccatcccgttctttgtttggtccacaaacatggtaaacaac

SEQ ID NO: 20069 - DNA, 600 bp, Bovine  MMBT02912
tttttcaaactaaaaccttgagtatatattttaacaagtcattttatgtaacttccaagtaaatgcaacaacttgggagacatagtttagacaccgacatactagaatctccaaaacatcctaatactacatgtagacaactgaacatttaaatcagaagcagttgctcctcccaaaaagaaaaatgggagctatacagtcaccaaagtttttaacccttagaatcctggaactgacaggaattgtttttaatttaactgcatatgaataaaacattctttctgaatatcaaccatcatwcttctggtttcacaactgtagcaagtatctgaaattgacaaacgctgaaaggtagtatgtcataatctccaggcagctgttaacataaatctcgatttctactcatttttctcttttgcagagacatgcagaatttccagctgcaagggataaatgttcatagaaagtcagatagaccatcttttaaaatagagttgactatattttgctgtcaggcaaaagaacagactagggaaataaaaagaaaaacacaaggttccaatcttccctataatggtctcaaaaggaatccatccaatt

SEQ ID NO: 20070 - DNA, 600 bp, Bovine  MMBT13986
cttgctctgccctcaggccatcattatgaaccactattgatactggtgaggcctgggagatagctaataaagagatctggtcaacagaacacaggaaaacagggagtctgctgtttttagacatttatgtcagggtgtttccctttcaattttgatctctttatatccccaaggaagcttacagctcactattccctttcctgtctaggccatagcatggttacatcataagaaggatttctcaagatttttcattcaaagattcttastggcatctggagtcttctccttcactatcaygtattcagtatttttctattaaacacattcacaataatttttctccccattctcctttttyttcttcttcttacatgtggtcgcagtctcaatatacaactaaacagaatccttagaaaggatctatttgtgcagaattataaaaagagaactaaacacgacctgtgtcttctaagaggtactatctcagatgtgctgatacacgtacacagagaaaggctgtccagaaattctagagactgtctaaagacttcaagccagaggaaagtgccagcaaggagctagatgatatgcactagt

SEQ ID NO: 20071 - DNA, 600 bp, Bovine  MMBT15157
tctgcctctgtttacttttgttttgtgttgcttgaattatctgaaagcaacttaaartgttcagcaagattctggaaactctgcattatcagtctttataacagtagacacactaatatgggatcaaaactacttcaaagctcatggaggagctatttccaggatatgcaatgattgatttgaaataacatgrtgtgagagattctactaaaaatcttaaaagatgactgagtgtttttcaagcttcatgtaatttgatgaaggtgccttgtcaaggattgctaaaagcttgctcatgasaactccttaaatcaccagtgagaatgcagctgctgctttattgtttttgagtagcttcttggcagaatgaggtgacactatctgtttggatacaaaaaaaaaaaaaaaaacctaagtgactattgtgtgtactgtgcttgttagccagacatgtcatgtcacctcagacagaatagtatttacagctgagtaggatttaattttatttcaatatacctagattgcttttatcttttcattgtgtttgaaatgattaatagccagcagcaatccttagtaaaggaataacaaagactgctg

SEQ ID NO: 20072 - DNA, 598 bp, Bovine  MMBT11002; identical to SEQ ID NO: 4686
  misc_feature (1)..(210): n is any nucleotide

SEQ ID NO: 20073 - DNA, 600 bp, Bovine  MMBT05952
aagtttaagtatatttttwaaaaatgtttagcatttgaagaaaagaaattcaattattgtcttctgscccaatacactctatcttagaaacaagaaaggtactctgtaagtatcagcttctgacaaaaaacttttcctatacrctgacttttttccttttaatataatattttgtagaaggaamtggcaacccactctagtattcttgcctgggaatttccatggacagaggagcctggtggactacagtccatgggatcacaaaagagttggacacgactgaaagactaacaygcacastgccctacttgcaggacctcagctgcctgaccaggggtcaaacccagggcttggcagtaaaagccacaagtcttaacctctgaaccaccagggaaatcccttaacctttttaaaaaagaawgattcagaagtcagcaatcttcagtcaaattactgcctgatttgaatttcatgtcattttatgaactgaaaataaataaaaacatttaatgcttcatgattacatcaaattataaaaataactacataaattatgaatatccaacaaagttattgggggaagtgaatttttaagaatta

SEQ ID NO: 20074 - DNA, 598 bp, Bovine  MMBT08188
  misc_feature (1)..(74): n is any nucleotide
nnnnnnnnnnnnnnnnnnnnnnnnnnnnnnnnnnnnnnnnnnnnnnnnnnnnnnnnnnnnnnnnnnnnnnnnnnttgtgtgaaaagggggcagggggaaatgaagctaagtttggctgtgtgactaaacattatctctagaaggaggcgcttaaccactactgttgctgctccatgggaagggaactacgtggctagaaagcaggcttggaagagatttctcatttttaaaaaacrtatcattaaagaatgtatacatgtgtataacagttactctgctgtacagcagaaattagtgcamcattgccaatcaactgtatttcaattaaaaacatatatatatatatagtttcccaaaggtgaactctaaacctaatgggtcacgagagaatactgcattctttctcatacttgtaactagctttggctagcaactgacggatkcgtccttccacctcttcgggggtctctgtctccgcaacgccctcagacatcccctctccttcctggggaagcatcagcagctgctgcagggtagctttcaactctggcagcatggcctcccactcctcagcggggtctagctctgcggctgaacg

SEQ ID NO: 20075 - DNA, 600 bp, Bovine  MMBT21510
gaggcgcttaaccactactgttgctgctccatgggaagggaactacgtggctagaaagcaggcttggaagagatttctcatttttaaaaaacrtatcattaaagaatgtatacatgtgtataacagttactctgctgtacagcagaaattagtgcamcattgccaatcaactgtatttcaattaaaaacatatatatatatatagtttcccaaaggtgaactctaaacctaatgggtcacgagagaatactgcattctttctcatacttgtaactagctttggctagcaactgacggatkcgtccttccacctcttcgggggtctctgtctccgcaacgccctcagacatcccctctccttcctggggaagcatcagcagctgctgcagggtagctttcaactctggcagcatggcctcccactcctcagcggggtctagctctgcggctgaacgagaaggtttcagactcttgccttgagctccccactgtggggaaaagggtgtcaaggttgagagctcccccagagcccctactcacaaggcgctgtggctcgcctctgggccctcatctcttgtaatttctgggtctccttctgca

SEQ ID NO: 20076 - DNA, 600 bp, Bovine  MMBT22314
gaccatttactggaaagaaaaaggggcagtgactctggatctatcagatggaaaaggcttgaactggtcctgtgcaatccctcctggtatcagctgcacccttaggaatgagttctgcttgggaacacacataactgaactctgatattgctgaaagtgagatacgagcttaaaaatgagggtgtgcaattcctctcatcaaaaacaaacaaacaaacaacaacaacaaaaagacagagcagattggtcaaaatgctggagcagcaataaagtacaaccaaatggattggaccttggtcraactgtagggtccacagaaaaaaagaaatagttattctggaaagggcagtgcttccagaagtgatgaaatacctgaggcgcagcatatgtcatctgtcaattatttttaaaataagagctttgaagagagataagttgattatatttgctgtcatctgattggaaggctacacttgctttcaaatggctcttaactttgctccaaatactttcagaacttccctctgaaatgagtttcattactttttccttcaaatttgtaggatccagtttgatcatccatcacttctacatatatgg

SEQ ID NO: 20077 - DNA, 512 bp, Bovine  MMBT18944
ggccctggcctgctcagcccacttcacagagcgatgagagtggctcgtgctacagaggcaagaaacccagggccagacgcaaaggacactgtggagggttcgggagcaggacccgatgagtcggcctctggacgtcaggtcggggggctgaggagctgatggggatgggcccgagagccccaccaggggctgtgctgcagcacgcgcaacacccacagcagggcccccaccacagaaggaaaagccaaggagaacaggcgcccctaaagcyctgctcgatgggcactgcattcctgtccygactacagtctcttccccagtgcgtgaaatgactctagctcactgcagtggggccaaacagacccygcccaccatttcctgggcgtgggcgctgcgggcagatgccaggaggaatttaaaagaagctggctattttgggtgttagaacttgccagaatgccaaggcagcaatatgtctgcctgagtgcaattcctgctctccagacatggag

SEQ ID NO: 20078 - DNA, 600 bp, Bovine  MMBT21553
atgcattacatgattcatcagcaggtattctgggggaactatttgaatctgtcatgttactgaactagttaagtcagtggtgaatttcatttactcttgcagttttaactatcattacttccagtaagtttttgctaggaatggaaactgaatatcctgacttgcccagctacacagcagtttgatatttgtaggaaagttttattgcaatttttttttagctcagaaccaacactgaattttctctgaataggtatcatttttacctattattaatgaaaactgaatagatttgaaaaytaggtttgcagcagatttgacrtttcttagtaaatcaacttaaaaattgtaaggcaaaacagcacttatatgtgaaatttacacttgcaacaaaatcattatgacaaaactaatcttgtttaaatcacaagtaatgtcaagccactttatccacttcctatgctgtcaagttaaaacaagaagcaagatatccattcctacacaatttgcagtgggtatgtttttcaaactcaactgctgtttcagctacatttttggatccacttaactgtacaaatgaggagcatccatctaatcttc

SEQ ID NO: 20079 - DNA, 600 bp, Bovine  MMBT02532
aaaggtccttgccagaactcacccgtcggttcagtcactggctcctctcatcttttgtttgtgtaatattactactacttgtcagttttcatatagttggagggagaagattttaatggtgttgagccaaagctagcataatttgccattctagtaagtttctgtttaaaatgtgtcttgtattaaatgattatgtttgagtttaaaatataattatgtaattttatttcatttacttgtttattactcaggaggcagttattgagttctaaactaggtgcttaatgaaatattctatgytgttctgactttttttgcaaattcaagacatttttctgtttacttcaggggtcttttgctcatatttttgagatgttgtagagggagctgtgtttgccaccagactcctagggcaggatgtgacaatttagtcctttgctcctatctgaaatctgaaaaatgttaacaattggagcacctataggctatgtttaaaactaaatttatataagaattaaaggcttttgatacaaaccttgttttaactttttggaagatgaacttttttttataaaggcaaccaatcagaaaaatttgttt

SEQ ID NO: 20080 - DNA, 417 bp, Bovine  MMBT23329
cctatgctgcattcctaatctttgtgcaagggacttagctgaaaaatagacaatgctaattttaggtgtttaatcattttggggatccattcattcaaaactagtacaccaaaaggaaagtctaggaactttaaggaagatgcttatgtattttattttatattccacacaccttatctcccaattctgattgcattttcataggagacttggaaggaaatgctgttttccagctgcacagtctggtactcttcagatgcacaatttaagccctttttggcagcttctcttcctcagtarggtctgtccatattttatgactgcttttcttttccttatgctcgtttgaaaagtgaaagtggaagttgctcagtcatgtcagactctgcgaacccacggagtatacagtccatggga

SEQ ID NO: 20081 - DNA, 600 bp, Bovine  MMBT08304
gacacggaagcaacctaaatatccacgtataggtgaatgaataaagaagttgtggtacatatacacaatagaatattactcaaccttaaaaaggaacaaatttgagtcagttgaaccaaggtagatgaaactagagcctgttatacagagtgaagcaagtgagaaagagaaaacaatatcatctattaacaatatcatctatggaatctaggaaaatggtattggtgaacctactttcagggaaggaatggaggcacagacatggagaacagacttgtcgacacaacagggaaggcaacrgtgggacgaactgagagaagagcattgaaacatttacattaaccatatgtcaagtggatagctagtggggagttgataacacaaggagctcaacccggtgctctgtgacaacctagaggggtaggttgggtggggtgggagggacattcaagagagaagggtgtatgtccacttatggctgatccacattgccatacagcgggaaccaacacaacattgtraaacaattatcctccaattaaaagaaaaraaaaaaaaacaagcagaaatctggtttcagtgtaactgggaggaattaag

SEQ ID NO: 20082 - DNA, 601 bp, Bovine  MMBT07499
  misc_feature (1)..(1): n is any nucleotide
nggcatttcatctcaccgcaaaactgactaaataagaggtcacaatgccaaaaaagaaaagagataaaaatcacaaggccaataagaaaagtacaagatcaaatgaagtgccccgccaaagttgttctaacagagatcacctggagcctatttgctaggtaggactggacttcaagttattgtatacttaaygtattacaytgagagcctcccacatcatattcaatgtcaatagcttagtgttaaaaaaaaacaaaggtcacattaatgaagcacttatgtctccaaaactgcgttaggygcattacaagtacaatcttaaggctgggcccactaacctcccagtaagattaaaatgggttatattcatctctttttataagagagaataagttatttgaggggttttaagagttttaaaaatcatatttttttgctacctccctttacaactagaaaaatgaactaaataaacaaatatgtgtatgtagataaaacraattacttgaatcaagttggacagatgcttcattcataaatgtaaatatttgctgacctcaaagaaccagattctccacacatattaaaacagccacataca

SEQ ID NO: 20083 - DNA, 600 bp, Bovine  MMBT17990
gaggctggggctgtgccagagaaatgatggatggaagcaggggagacagcagctctgcttccgggcagacagccctttcctccaaagggtgactcatggcaaaggcagttttgccccagttacaaaggtcgtcccagacctaatcacgaagggctgatgtttgtttctgtgcgcctacagcttagacagatcccgttacacctaggggaaatagaaccctctgtcctacttcccctctgctttttcttctcgtgtcatgcaaggtttcagggtttggtttgtcaaggagtttagatgacygccttttcaataaacacttgtttatgtttttaaagcaaacctagaacaaggaataaaaacattcatccattggtatccacgggggattgattccaggaccctccgtgggtaccaaatctgaagacgctaaagtcccatctcagccttccgtatcctcatctccatatccatggattcaaccagctgagtattgcataatattaattgaaaaaaactccctttgaatccacacaattgaagcccatgttgttcagggtcagctgtataaacatgcaggcaggacataagattcatctaact

SEQ ID NO: 20084 - DNA, 598 bp, Bovine  MMBT17062
  misc_feature (1)..(102): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagactccccaagagtgtaaatcactttattttataaagtaatttgatctcttacaaatatcatttacgttcctctgaggagccctgtgagtttttcccatgttggaaatgggactgtcatatgaatgttccagcacagtagcgagggcttgctataacaataaaaagtaaaaagccactcttgaagaatttgttyagacacagagaaagttttggcatcgatcataaccgacctggaactgtaggcgatttcttgttttatttaggaacaagggagtttgatctaaaamccgtcagattctgccaagttgggtactgactctgatggggcagcaaatacttggagagtttaacaggaggccggctttctgttcaagcaagaggcaggcctaattttccatgcaaacgtccgggaaactcttagcacaaacaactgtgtccattatttccctaatgtgtcttgaatttgagccagggctgtgttaaggtctcca

SEQ ID NO: 20085 - DNA, 600 bp, Bovine  MMBT06122
tgcttttataagaagaatataatctttatagcatttcaaggattcatagatttgtatttattaattttatttttgccagttgtcacttacaagttgttcagaaagatgttttcttttctttttcttttgcaaatttgattatttgagaagtttcctatgagaaaatccagttgtaggtagtaccttgtgccctaagaggatcttatttttatttattggctctttgttaacctccttctatttatgttactgtatggttgacataattatatttggttcaactttataaagtctgatagygtctagcaagacttttcccaggtaattatttggctctcaagaagtgttcccaagatgatatmtgcatttattcctaattaccatgaatacctcttatgaaaatgtctcctctaattactttgaaaagtcatctttcattaaagtyacttttcttmtagccactcagtggtagatatccataaagtcatcatttttgatcatcttgaatatgtaaatgtttaagcagatactgctggtttttgtttcctaattctagcctagtgtcttctgtgggatgtgactcttactcttgtgaaatat

SEQ ID NO: 20086 - DNA, 600 bp, Bovine  MMBT09678
ttaartggctcccttcattctacagaagatgtcagaaaacgtgaaatgcagttgtcaaagatgttcaatgaaaatgattgaagtaagaaaaggtttccacatttgaagggcaagcttcctaaacaggcccattcaaaacagactagctcctgagacatcgtaattgtggagaattgttagaattataatatttcatctgcacatgttctcttgtgttagaatataaggaacttgagagtggggactggggggtatatttctggcttccgtgatacctaaamtagcctggctttcacagtrgcaaccacmtgttgtcatcgtcataatcacactcaagtgtcctcagaacaagcctgcagactggtcctgtgcttacccctactctgtggctctatgagctccctcctggctaggcaggactacatttcccagaattcccttcacagagtgtttcctgttgggatgggtcacagggtttgagggcagaagtgaaggagggtctgccattttgtttttacgctcccatctagcactagccttgggggagcctgagggttcttgtggctgctgtgcctttccctggaccttctgccagctctg

SEQ ID NO: 20087 - DNA, 600 bp, Bovine  MMBT12568
ttttaatgggttttcagtagatctgaccagttctgcaatagtccttcgttgtacaagttcagcatttttggttattgactcattgactgacatctattaagacctactcagtaggagtgctaggcttcacattcagaagttactggttactttcagtcttgaagtggacgtaagggtgatctgactgtgaggtctgtctccccacacataggtgagttgaccacactttatctccatggttgagatagacattttcccgccaagtccacacgagcatttcctgaagctgtcagaagagaracgtcattcccagatggatcactgcttcataamgtgcctgcacgttgtcaagtgcaagcactggaagtagagtttggtgtacagtgtatttrtgtccattgaaagagcaaaggagaaactaaatatatagaagctctggaagagtgagcaagaaaatgataacgtagaattcttctgaagaagggattctggcagcttgggagtcgggggaagaagggaaatttttcactgtttgtacttttgtaactttggaattttaaattctgtgaatattatggcttaaaaaaaaaagtaaaatct

SEQ ID NO: 20088 - DNA, 600 bp, Bovine  MMBT11325
gcaaagtaagaggttgtacggcatgcatcaaatagggtgcaagtaacaggcactggatatataaaaagcttcttcatccgagccttggaactttaagaacaagggtttatactcaataggcaaaagtatttacaaaataccaatctttgtgaataggtaagggacaagcatcaaacctacaggagagtggcacctagaaatatgaattttttacaagatccctgacagactctaatgtgcaaatgtgtttgggaaaaacagaaaaagcaggcaacataatgttatatatttatacttttsaaatccttgctggctaaagcatatcatttgaacagataatccttcctttcattaacttttcctacatttaagtacagtaatttttgtaaggcttatgttgaaaagctattttttaaagtagaaagcagagttattttaagaataagcatggccttttaattgtgggggaaagaaagaggattatcttccagtttaggaataatttacctttaaaggtgctaaaaagaacattcatatgattaatttattaaaagtaataagaatcagaacactttggatattttttaaagtacttagaga

SEQ ID NO: 20089 - DNA, 600 bp, Bovine  MMBT08742
ataacactggaggacccagyctggctttatcatgatgcctttatgtctcactctgtgtatcccactactttgcaattgtgtttactgcccagaactgacagaacactaggattttccccagaaaccacttatttatcctgaatttatatcttgcgtcttcccctcttgggaacttttctttctcacactgttaattcccatacagtgtgttttatagtgcattttacctgccataatcagagaactgtaatatctttattatactgacaaattttttttccctctactttgtcaattcayggggcctgtatcgctttgtattgtatcttggaatatcacgtagtattcactcaataaatagttaattattttatgagtttgtgctatcctccttacatgtcatatactcctatcttaaagtatccatgcttttgacacactgttatttatgttatgttcatttttcaagtacaagctcacattttcctccatcactgaccacttcaactcattattccaatcatccttgatgattctgtactgtatttttagatgtatctattttaaacattccagtgcttagcatttatacattatcgt

SEQ ID NO: 20090 - DNA, 450 bp, Bovine  MMBT01802
taccataaaagttgaatcatttcatcaagtgcttgaataacataatatgttttaagtaagtatatactcaaatatttttcacatatagaatgatttgtcaactggaaaatgcatatcctttgtgaattgttatgcttcctggctaagtaaacactatttcttcttttatttcactttcgcaatcagtcttcatatcctcttaggcatcaaacccgttcctaaaaattttctatgccgtaagtgttctggttggattctactgagtaaactacctgatgataaacagaaaaaattattctyacaaatccattgtgttgtttgctatatttccacaatgtacatttgctaaaagaatttttaaattaacaatatttaatatttgttatgggatattttattttcttatgatcaggagacacatttaaagtgaaatatatcagatcagatcag

SEQ ID NO: 20091 - DNA, 600 bp, Bovine  MMBT14449
gagctgggaagagagatgcaatattgttgaaatttcttttaaagcacctctgtaagtcatatcttctagttatccaaagtcaactagcaaattagcaggtgaaatgaatgttctgaatttaatgatgcctaagatctctccttatatgaactctaattccagatatgaaatcagttctcatcttacaaaacatcatcccttctttcastcttctaggttctcattttgatttggggactaaattaggaaatttctctttaagtgactgagatatatttaatggcttatgagactttgaamaacagatgttattctagggaagaaaagaaatcctcaagtttaggcattttgcctatgattctaagttttttgaatatcatgaaagtgaaccacagcatttatttatgattatgtcatacacatatggaatatggcatggctgtgttatcaggttctctatgaattcttcttatgatcttgcaactgtatctgattacctaagttagaatggcctacattaagcaggaaagaagtccacgaaagggcagcgagaggagagaaacgtgaagtggcatcttcttgtttaagactgaaattttg

SEQ ID NO: 20092 - DNA, 600 bp, Bovine  MMBT01754
agtctctaatgtaatattcactcgtgagcattattaatactaaacactgaaaattcagtttatatacaatttttaatacacttacatattctayagttttttayactaaattgaagtatactttctattgatctgtcaattccctttttttttcaatattatactattaataattactccagttttgttttaatatctggtaaagcmagtatccattctttattttctttttccaaaatatattgaatattttcccacattycaacatatagatgatattggaaaagtctcaagggtccrttgaagycccttgatagctctattgtatgcatgagtgctaagttacctcagttgtgtctgactgtgaccccayagactgtagccttgccagactcctctgtccatgggatttccagacaagaatactattgtgtatttacctttaaaattaacatgagagaccaaatgaaacattctaggtttagtctaaatatttcacttaatcactagatttaaaaatttttattcacatggcacaaaatcactttaatatttgagtcatttaaaatccacatattgtttttgtatgtgctatacctt

SEQ ID NO: 20093 - DNA, 600 bp, Bovine  MMBT16448
actgtttttgaagaaaatatttgattgttaatgtcataatttagtaaagcattcatttcttttataagtatcatcatcgtatcaagggaagaaaagaagatatgtaatttaggtcagaccaacacatcttaagcattaaaagatgtgtgtttgaaagatgtcagtctccacatgttctggaaataaaaaccagacaaacaatacaataaaacttcatgcatcccatagaagtctgaataaccaatcacttaaaatttcaccatctgctcttactgaagcagcaagattgaggcgttttcyggccatgatgatcagaatgtaacagaatgagaaacactaacaggattccctccacacaccctttcttatttactgctgtggttcttaatgaaaacctgagctctacaaagaaaaggggaggatgtcccccgccccatctcctaattgagtgcgtatagccagtaatagctttttgctgccctgggcagcatgacattacctcatttggcctcgcacagctattatttcaggaagcagctagtgaagtgccccaatccatctgcttgcttttcatgggctgatgcttttcttgatgttgac

SEQ ID NO: 20094 - DNA, 600 bp, Bovine  MMBT08740
tagatgcctggagtatctacagtagtgaatcatctgaaaacattactacttttggcatttgactttagaaacagttatagctcctataattactcttgatatataaaagaaacttaacactcgtcccaaagttgtttaactataaaattaatctctagtgtattacctcatgaagacgagttaaccctgtttatctttctgtgccgagagataacatgagtgagtagccaactgaatgttaaagatttaaaacagttgtcaaacactatattcccctcatctggttagggattgctgaamcatcagcattagagatcatagatcatttattttgattttaacattcatctgggatarcattcatgattgacaatcttataattgctgaccatgttctcagttttcttcctacaaccagaatcacatcattgtgttaacagatatcaggcaaatcacttactttgtagacttggtcaaatatcattaatgcttcaggtataatatttttacagccaatttccttgtaatccctgggatgtaccctatctggtcttccatatttttagccacacaatattgtagtatcaaatccctcttcct

SEQ ID NO: 20095 - DNA, 598 bp, Bovine  MMBT17449
  misc_feature (1)..(31): n is any nucleotide
nnnnnnnnnnnnnnnnnnnnnnnnnnnnnnnattgactttctgaatgtacaaaatcccagaaacaatataatcaacctggcattttattatgctatcatatgatggcataatgtaccatcaccttttttttcaatgcaatattggcttactgcaatatgtgctcactcaacaatatcaatatttttatctcaaataactcattcaggaagataagcaatttaaataagccatgaattgaaacatgcttcctccaccacacaccacatagtatctttgtgatttttagcccattgagaagygggttggactttttccccttcactgttctaaatactgtttatacatgcactgacctctgtctagctttctgtgccaccttaagtcagagactgtaatgaaggaaatttcacacaaaagctatgtaasccacacctttaagaaaagtgacaagaactggtagttagcccctttagcatattattagtttaaatatagaaggaagagaggttcaaagtgagctagaaagtgaaagagccattttataagcacaaggagataaacactggctccctttctttctcaaacaaaaagcacagt

SEQ ID NO: 20096 - DNA, 600 bp, Bovine  MMBT02470
tgtctgactcttagtgaccccatggactgcagcctaccaggctcctttcattcatgggatttttccaggcaagagtactggagtggggtgccattgccttctcctattagatacttagccataccattattgttgagagttgaaaaacacaaagactatagaaatgagactggttttcgtatgtgatttgaggtactagtttctgtcccttattcatggagaattaacacagttctctctaatttcctaagtttctaatttctctaataacctgttacctcccttagcccaaaccatacytggaatatttaattataaagaattcttttatttccaatgaataattgaaaaaatgcagtgcattaaaaatatttcacaaattatttgtttgtgattatgacattcattggaactaaaagaatgagcgtagtttaaaaccaaactcaaggaattatctttttaaatgataaagtatgaggagatgttcatattgttttacaaaaggtttaatagagttagagtaaattttttccagaaatcagaacatttgcagagcagaaatgcagagaaggatggagcatgtttatcaaataatgcaaa

SEQ ID NO: 20097 - DNA, 600 bp, Bovine  MMBT00915
catcatgccctcacctgtcgtcctgtgttcacacaggaatcccrgtgtctggagtkctyctggagacacagccccagagggaccaggtggttaaaggggagacgctcgtccttgtctgctctgtggccaaaggcaccgggaaaaccaggttctcttggcacagagaaggcacaagagagagtctggggcagaaaagtcagcgctcccagagagcagagctggagatccccgttatccgggagagccatgccgggcgctactactgcacagctgacaacggctacggcctcatccagagcraggcagtgaacgtcactgtgagaagtaagtagctagttctcctaattagccggagagtcccaactgcaattggtttccttctgtgacagtgaggatgttccaaggataagaatcagggccgtgaagaggttaggaaaccattaacatgctaggattgttattgcaacgatggtggcagcggtagcagtgacaacaggggcagaagagccgaaggacgatggcaaggggagacaggaagaaggctatgaggctcggtcagacgtatggtctccagaattcctccccggaaattgtcaaagc

SEQ ID NO: 20098 - DNA, 600 bp, Bovine  MMBT05984
gttacaacaattcatgggggcaggcagaggcgcttgcttagcccagggtttggtctttaagctccatagttataaggtgccatagggaacaacagttgttataacacaatggtgactaatgaacttacccaccactcttaaaaggtgtcatgcaaatacctcaaccctaattaaaccagcctgcttacgatgcaaccgccgcctcctcttagtcagtaatcctccagctgatttccagtgtgctaaaaatgccaaataagatgcagatcaaattcactttcataaagttggagggtaaayccactaacaaaggagctggcagaactggagcccattaacagcggagggaaaattgacaaggatactgacatagactcttcaaaagaagatgatttgaatatcaaagatgggagaaaggccctagcaaactgatgaaactctgaaatatttttgcaaaaatattcctctttatcttcctgtcattgaatttaaaatggaagacatactgcattatataattttatcaaacagttcatgcccaagaaacacaactcactcttttggttagtctaagaattagtgcacaattacacaagtata

SEQ ID NO: 20099 - DNA, 598 bp, Bovine  MMBT15396
  misc_feature (1)..(17): n is any nucleotide
nnnnnnnnnnnnnnnnngcttccctaaacctgcccttggatgagaagacccccatgcccctgcccagattctactgtgctcaggatctgtgtgggtggaaggaacgagcactcacgctctttcttaggcaggcactcgagggctcgctgcatcacacggtgactggcctccgcctttcccctccgcagaaggaaggcgccgtatttgacccagacagctttctcctgcctgaaacgcttcagcatccggttgtagagttcgccagcttcctgtgggaagaatgatgtaagctgagagagyggatgagagcagagggggcaacgacagagacagatggctacgctcgtgggaagctagccctgggctcaggggctccctcagtgaccaggccctgatccactatgtgaggggaaagggcaggcacccgggatgacgagagcatgtgctggggagtctccctcctaatcccatgccgcgaggaggtcgagactagaagagcgcgtgagcacgatgagggcgaggagagacgaaaggggcgactgggctacatcrcctcccgtctgtgacacctctattggtggctcaagggtgggggaaa

SEQ ID NO: 20100 - DNA, 598 bp, Bovine  MMBT02318
  misc_feature (1)..(24): n is any nucleotide
nnnnnnnnnnnnnnnnnnnnnnnnaaacattattttcccaatagttttaatctcactctggttaatatcatattaagtgttatattaattatactattatatatcattatattaatgatatttcaaattgataaattttgagttttatcttttctcacctcagataattttctagatagatatttagagatttatccttaaaaattaaaataactgagtggtaattacattttccacagcagtgtttagtagtcaaacaggctgaacttccaaatgagtttgctacaggaatggcaggcrgaaataaaaataaaatrtttaaccaaacctctccactccccacaaaataccatcaaacaaagcccagaaacagttcaaacataagatcatcctttacttttttgtggttatttactttgccttctggaaatattgcacaatctgttagttttttctctttagatgtttgcaggatatgggatgtactactaagttttttaaaaatgaattgattctcacaacagtacctgtgtgtacttgttaaccacataactacattattaactatagttgcttcacaaatagtaaaataaaatga

SEQ ID NO: 20101 - DNA, 600 bp, Bovine  MMBT07748
gagacaacaacagagagctgtgtgcctgacagacactgcccttccacagccctaggaccaaagaaccaaaataaaatcctgccaaatcccagatttctcttcagctgtcttactggcaggtgccccaagcaaagcaactccagggacacaagggagcggatacacagacagacctttgtgggcagagatccccggagggcgatttgacctaagatgagaaggtgatgagaaggtgctgggctgagggcatggccagcaccacggctgacagtctggccacttggagctggaaaggagccrgtggcaattctttaggcatgcacacactcctccagggcccacacgcgaagcaggacacaccatgcagcccgaggtccgaggaggatcaggagccactgaccttcgaggtgggcaccaggccagggggccccatgcctgctgtgtggagtcccagcctctgcagctccctgcttccctctgcaggccagccttcagctgtactgcctccggggacagtcctggaaagatgcccacactctgccgtggcagctgtgagactggccattgccaaccccacctgaggcctctgacctttccttg

SEQ ID NO: 20102 - DNA, 600 bp, Bovine  MMBT12240
aagacattactaataggggaaactgagggaggttgagagggagtattatgggaactctcagtactttctttttaayttttatgtaaatttaaaactgccccccaaaatagagcctaaaattttttttaaggagagagataaagataaaccaacgggggactataaaatctaattgtttatctgttttggcatcattttaactgttttgtataagtttcctctgtcctaaaccctctattttttctctacacaactcccaacctgtacgaatgaggctcacatctctctgcacatctccaytggttttttttatttaacactcacttattgagtaataactttgtgccaagaactatgataattgttagagatatgaaaagaggaataagatcagacttgaggatatcacagtcgagtgatagagacatgttaattacagtggaacaagwtattaagtgccataaataaaggtaagaaaaaaatctcttggaaccacaactcagtactttgaactctatatggcattattaaactataataaagtcacatcatctgcttttgatactgccctatcttacttttgccaatatgtcacattta

SEQ ID NO: 20103 - DNA, 600 bp, Bovine  MMBT01806
ccatttctcatgatgtactctgcatataagttaaataagcagggtgacaatatacagccttgacgtactccttttcctatttggaacaagtctgttccagtgaaaattcagagttgatttcctttaggattgattggtttgatctccttatcaaaatacattagagtttttaaaacaaacaaacaaaacctcaggaattcaattaaagtttgtaaaaaggctcaagaattgctcagaaatacatttttatttgtctctactgtatttattaatctaagaattaaggtgtcatagttttaytggatgaaacaatgctaatttggggcactagaagataaatataytcaaatttctcaaaattcrcttagttcaaaagttattattgctgattctgtttgctaggtactatccaaagatcaatgcaagtgggaaagcaaacttatactgagatttgagagattctgatactgcttttcttaagctgtagccctatagggcatcacataatatgaaacacataatcagctttcagtatatatttaccttcattaatcataaactgtaggcaaatcctgagcttgaaaatttagacactttatt

SEQ ID NO: 20104 - DNA, 598 bp, Bovine  MMBT12903
  misc_feature (1)..(12): n is any nucleotide
nnnnnnnnnnnnccttaagaactcttaatttatccgaaaaattttagcatttcagataaagggaaattattttaaggtacattaaaattatagacaaaagaccagaagcatctgtaagcccatagaaggatttactatttactattcaagtcatgcaaaaaggtttttaaaaatcatcatttgtgccagaaataattggcagaggaactaatcaccattcaagaaacatttagtaaatactaatgcaagacatggtattaatgctgctcaacacaggtttagtttctcttcaagagtatrcattatcataacttattcatagtacaatgtaggacacattttaactgaaagcaacaataaaaagcctgaatggttaatgtattcatgttaaccattaatacagactgtattttaacagctcattcaattcaacaacaacaaaaacaaataacccaatcaaaaaatgggcagaagacctaaacagacatttccaaaagagatatgcaatcacacaaaaagattttcagcatcactaattattagagaaaggcaaatcgaaattacaatgaggcaccacctcagaccagtgagaatggac

SEQ ID NO: 20105 - DNA, 600 bp, Bovine  MMBT12104
aagtctctcttctctcctcccttctccactaattcattggggttggggaaagagagcaaagacagagaaaactgtttaaaatgtctgactccacaggccttccytcactgtttcagctattatctctaatggcctttgaagctgaaagcagagttgagtgtatattactttttgcctttacggtctgactgatgacatttcatgttttaaaatagttttgttccaatgatttcttctcgtagcagtggatgggaaaatcctaatacaygaggatatcatatgataagtggataataatcrgcaggcattcgggtggtgggcaaatcaactgtgtgttatttttagagtgttcacgtgatatgattcatcttaaaagcatttctgagtgttgggatctgaaactatccccatgatttactgaagtcatggagaacacatgtgactcttgttttgaaaatgacagcctacggatcccatggcttttttcctccccttttggtttcttagagaattggtgggcaaaaccaaaagaccaatataaattccccctggtaccctgctgtccatgttcaaagactgggagtatttggtgtacatgat

SEQ ID NO: 20106 - DNA, 600 bp, Bovine  MMBT18116
ctggatactattaatagtaggaattacttgggctttcctggtggctcagacagtaaagaatctgccagcgacgcaggagacctgggtttaatccctgggcaggaagacctcctcaagaaggaaatggcaacccactccagtattcttgtctggacaattccatggtcagaggagcctggcaggctacagtccacggggtcacagagttggacatgactgagactaacacacacacacattggtggatttaactgcacaagtggaagcttgaaatgtgtctccacagttggctgccttgtygaacttctgcatttgcaatgagaaggaaatccttgagctgccacagccaacccctctaaacacagagtccagggtcagacttgtgaagagagccaccccaactaactgttggatgagtgaacaaggaataattcttggaagtacatgctgaaatttgcttgcttcctagcaaagctgtctaatcaaccgaaaactctttaagtaccttccttcatgtttattcttgcttgtgacatcctcaccctcctgtgtggtctgaatgtttgtgcccccgaactcacatgctgatttcccagtccc

SEQ ID NO: 20107 - DNA, 600 bp, Bovine  MMBT05353
tccacacttcaggaaaatattaaatagcaaataaatccagttatgcattgggtcaatgcaattaaatgcaattaaatccagggctcagaataaattctagaaggaacactgtttctatattactcacagtgactatagaaaacaatttttagtgttgaaacacctttgtactgtaggcgtgcaaaactatgtttgctaacctgaactggcaatagtcttaaaatagaagcaaaagctattgctaaaaataatcgaataaaacaaggatataagtaatttatgtttccaaacatctcattygtaaaacttacccatcatactctagatctcccttcttctgcttttcttgagattctaatctttctaactcatcattttatttcctacatcacattaacacttcactaactctggaatttaacccaaaatccaacttttgcttttccatcccaaactcatgaaggctatatgatggatgcttgataaaactaaatctctctccctctccctctctctctctcaaagtaaacatgtaaaactactgtttctgcaattatcatcaaacacttttctctctgctcccagagcagggactgacat

SEQ ID NO: 20108 - DNA, 600 bp, Bovine  MMBT22491
ataagacttttgctgttgttcagttgctcagtcgtgtctgactctttgtgaccctatggactatagcccagcccaccagactccactgtccgtgggattctccatacaagagtactggaatgggttgccatgccctcgtttaggggatcttcctgacccaggaattgaacccgtgactcctgcattgcaggcagattctttactgctgagccaccagggaagccccaatctcactaatagggctgcccataaaatggaaatggacatagggtttgcagccaaattgcttttgaatatgcragtaccaatgacaaaaagcattcaaaccagaattttagtctgatttcattaaatattccatttttctagctctatagtttgatttcaagctcatcaagtggatttctggttggaatctgattttccgtgtaggtctgcctccagggaagaaacattctcccctagattttctggtatttttagcctttctaccaaagatctctctatggagtgatatattgcttgtcatgtagttttctacagaaagaacaacgcccaaaaatgkgcttcaactttttctgatcactattatagggtgaa

SEQ ID NO: 20109 - DNA, 600 bp, Bovine  MMBT09293
tgaacctcatagtcagctccatgggtagacttcaaaggggctgatcccaagctcaaggatatcaagctggtaactttgaaatataaagtgtaacaaaagtattccagctgaatactgctgttgttagtactgttctttttttaaaataagcaacacatgaactaccttttctttgctatgcctgtgtctctgtaggtattacccctaacacttgtgactgtctactactggacaagtggataatgctgtaatgttaaatgtccagttcccagatctcaagaagaaaagaaaaaacacctytggtctcccaccagttttaactgatcccaagaggtaatgagacatgcacaaaggggtaatgggctggattacaggagaatcctgaaaggagaggggagccccaggaagtaaaacagatactgttagaagcgacactgttggactccagaaccctactgataagatcaggatcactgctcttagctcaacggctcaggccttggaagcactggagttatcattatcagatgcacaccttccgctgtcaggtaactttagcaggaaccagaaagtgcttccccacgttcttactggcaacaa

SEQ ID NO: 20110 - DNA, 600 bp, Bovine  MMBT11650
aactgatcatttcattatagtcagtatgccagctagtgatagggctcagttgctcagtygtgtccgactctttgcggccccgtggactgtagactgctaggctcctctgtccatggggttacccaggcaagaatgctggaggggttgccatttcctcctccagaggatctttctgacccagggatcaaatgtgtctcctacattggtgggtggattctttatcactagaaacacctgagaagccccatagttggtataaggactattggaaagttcaaggtaccacttcaacaggttaaytggaataaatgtggctttgtctgaaattccaaagattcaacccatttaatcacagggggaaccagaaatgctcttataagcaaaacatcttctcacatttgagaaaaaaattaataaacaagaataaaatctttttgaatttatcagttgaaattgaggttcttcttactctcatttccttctctgaagtgtttcactaggtaaatctctagtctgtctgaagagatcaaaatttaggtggcgaagtgattgcagattgtgttttgtttataaaaatgcttctaccttgtgccacgaggc

SEQ ID NO: 20111 - DNA, 600 bp, Bovine  MMBT22850
agggcaggtgcagaccctggagcccagacaacaagcccacctggagacccgcagccaggcacctagtcctgtcacctgctgggtgcatcccacctgcactgccccccactgaaccacctccccacctgctcccctccacacaagagtgctactgccttttaaaattattggtcccaaaacatttagtcaaaaaatggcttgtggggctaagcaggctaggtgcrtgcaggggtcgcccaaaccagggagtcagtctgagtagggagctttcaccctggaggagaggccatggctccaagyaggggagatggtgtcctgcagcggagtggctggcacaggccgtgggcccccaaggagacagcaggcccctacacgtggctgggaggagggagaaactgggaggagggagaagggctggcctrggtaccagagccctaaccagggccgtgtgatgctggggacaaaggctacaaatgtggacactggggaatygatcaaacaggcatgagggagcacgggacccaggtttctcacccttagagaaaggaagtaccaacatggatggtaagaagacaggcacagatcctgtggtgttggact

SEQ ID NO: 20112 - DNA, 600 bp, Bovine  MMBT22847
agggagaagggctggcctrggtaccagagccctaaccagggccgtgtgatgctggggacaaaggctacaaatgtggacactggggaatygatcaaacaggcatgagggagcacgggacccaggtttctcacccttagagaaaggaagtaccaacatggatggtaagaagacaggcacagatcctgtggtgttggactagaaacatcagtcttacttagagttttcagtttaaaggaacagataaagatatatgaatgtaggtacaaaggtctgtccatgagcacatgtgcacagactcaytcaggaaccgccgcctggcaccttctaggaccttagattacaaacagttcagtaccagtaccatgggcaggatcccatggagggcatgacgaggctccggggaggcagaaggaaggggcacctaaaccacgtgaggaagagccaaaggctgggcgtccaggggagagcaagaggaacaagcaggacagaggcccaacaggtcatgatggtgagggtgacaattccagatgaggaaacaaggagggcaagagtcagagggctcaaagatgtaaattcacattttaaggcaaaggataagtt

SEQ ID NO: 20113 - DNA, 600 bp, Bovine  MMBT05589
agcctgcacacagcagcgaagacccaccacagccaaaaaagaaatatgaacaaatctttttttttaaaaaaggaatttttatagactccagttgaaatcttcaatctagtaacaagagtgattgatagctcatgttttcctggtgccatacctgttattccggaaatactctaagtgaatgaaatgacttcagtttatagaagtgtcattatactttacaaaatcctataaggcaataatctatcccctcttaacttaccctttgtcctcttatccaccacaaaactccaaaaccaaagwgataagaatactaagtaaattcttttaactggaatgattaaagtatcctctagaacttttgcataattgttttaaaattattaatcacttaaataagtcattgttaacaagtaataagacttcccctagtggctcacacagtaagaatctgcctgcagtgtaggagacctgggtttgatccttgggtggggaagatcccctggagaagggaatgccaacccactccagtattcttgcctggggaattccacggacagagaagcctggtgagctacagtccatggggtcacaaacactgag

SEQ ID NO: 20114 - DNA, 600 bp, Bovine  MMBT20554
aggtcaggtggtctgatactcccatctctttcagaattttccacagtttattgtgattcacacagtcaaaggctttgacatagtcaataaagcagaaatagatgtttttctggaactctcttgctttttcgatgatccagcggatgttggcaatttkatctctggttcctctgccttttctaaaaccagcttgaacgtcaggaagtttactactatactgtaaatgaagactttgtattctttcattttttatttctgttgttgaatgctctcattgaggtaagaaacacggaaaggaakaaatcagagaaaaaccagaaattggtaagtgaaagaaaacctattatctttcatatttktgcatgtgtaatcagcattgggggggggtggtaattacctcacatagtttagatttaattttccccaagaatctagaagtcttctactctagaatgaaaaaaaaaaaaaattgagagggtgtatctttttcacaaaatrccttaatatggatattattccaggaggaaattagattgaagccaagggagcaaggtgtcttctggcaaacaccaaatttagagcccattattattactaaac

SEQ ID NO: 20115 - DNA, 600 bp, Bovine  MMBT20555
acacagtcaaaggctttgacatagtcaataaagcagaaatagatgtttttctggaactctcttgctttttcgatgatccagcggatgttggcaatttkatctctggttcctctgccttttctaaaaccagcttgaacgtcaggaagtttactactatactgtaaatgaagactttgtattctttcattttttatttctgttgttgaatgctctcattgaggtaagaaacacggaaaggaakaaatcagagaaaaaccagaaattggtaagtgaaagaaaacctattatctttcatatttktgcatgtgtaatcagcattgggggggggtggtaattacctcacatagtttagatttaattttccccaagaatctagaagtcttctactctagaatgaaaaaaaaaaaaaattgagagggtgtatctttttcacaaaatrccttaatatggatattattccaggaggaaattagattgaagccaagggagcaaggtgtcttctggcaaacaccaaatttagagcccattattattactaaactctaattatgttttcaatgtcttgcttttggtattgtgggaagaactgatttaatttta

SEQ ID NO: 20116 - DNA, 600 bp, Bovine  MMBT20843
cagtatctattctccaaataatcactgcagttcagttcagttcagtcgctcagtcatgtctgactctttgcagtagcctaagataaaaacatatgatttcgttcagagttgagttttagtcccagttttgccatttcaaacaatgtgaacatgagtgattcttctcccttgcatgcatctgttttcccttctctttaagacaaggggtttaaatcttagctcttcccaactttgagcttctaaggggtctgaatgattggggtcactgtctcgataggtgccacagtttggcttttatcyaggagtaagagaggyaggacagccatgtgtcagcatagagaagtcagttcatgcatgatggcttttctcatctctctccttggtggatgagcaacatgaaacagtaagataagaagggccagtctcaggtatatgagctggggacctccatgcccaggttgttggaggggctcgccttgacacaaaatatctatgatgagcctgggaaggaaagccaactgcataatatgtctgccatattttagcaacaaaatatctaataatattcagacgcaaatcctgtggcacaggcattctcat

SEQ ID NO: 20117 - DNA, 600 bp, Bovine  MMBT11341
  misc_feature (1)..(153): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgttccttgagtgaaatatggacaaaaactaagacatcatttagttcatgagtaaagaatcaaactgtgattcaatggcaagtgtttatgtagaagagctagaaattgaacaaacatctaaaaactgtagggcagttaatcctgygaaatcatggcaactatgaagtagttcatctttaaaattatgacaagattagagatgataagtatgtgaactctggttgtacatggaaatagatctctgaaataatgttgactgaaaacaattagaattcaaaatagkacagttatttcaactatggaaaaatacaagcttgcctactggcaaagatggggacttaatttaaacctatgtaaatagtgcttatatttacaagggccttattttctcctgagttgtgttaatgataaaagtcaattgsagaggtagacagtttggggaggg

SEQ ID NO: 20118 - DNA, 600 bp, Bovine  MMBT13509
tcagagccactaaagctgtgtcaatttataataactgtgcctgatatttatatgacaattgccattttcaaagcactttcatatctactaactcattcagctccgtcattcaataactcattaatggaagcaggtaacattattgccacttttcaggtcaggaaaatgagagttggagaggtcaatggctcacctaatatgacaagcttaagacatttcagatgtcagacaagtcacataacccttggaggttagcaactctaggtatactttttcagaaaactcctaaacagaacacaygaggaagccaatgctccctaagtgctctatttcttctcattatctccttgccctcacctaccattgccaggagcttgracttgtgtttatcagtcactctgccacccttctcagccaggcagcctcacatactttcagtccaacagtatatacttttatccccaatgatttttttttttctgtgcctctaagcttctcattcaacactcattcttactctgtgaactttacccatcatatttgtcccatttctaactttgaaaaacattcttatctcacttattccaatatgtctgctca

SEQ ID NO: 20119 - DNA, 600 bp, Bovine  MMBT08178; identical to SEQ ID NO: 4768

SEQ ID NO: 20120 - DNA, 600 bp, Bovine  MMBT12542
ggcttccctggtgggttcagttgtaaagaacccacctgtcaatgcaggagacataggttcagtctcttggtcaggaaaatctcattctcctctgggtcaggaagtaaatggcaacccactctaaaatattcttgcctgagaaatcccatgaacagagaagcctggcatgtcacaaagtgtcagatatgacttagcaactaaacaaaagaatcaagttcaggccttgattaagaatattttttaawtctctgtaagagggacagaaatttcctacagaggtcaggattctgtttgatattyatattcatggactaccagattttcaaaacaggcatgtagctgcatgaacatacataaggctatttcttcccaaacttgtcagaacattattmtaaatattagaatctctgattatcacagttttctttaaacactgttatttatgcatttcatcatatttttcctcctgtttaaagtcatacatttatgacttagtctatcacaatcatgttaccacaaataacgcttaaatttatgaaggaccattaaaactagatctataattcgtctctcacacctatgttactatagacaacttaa

SEQ ID NO: 20121 - DNA, 600 bp, Bovine  MMBT08087
ctttccactctcccagccgcctctttgaccagttttttggcgagcacctgttagagtctgatctcttcccagcttctacttccctgagccccttctaccttcggccgccctcatttctgcgggcacccagctggattgacactggcctctcagaggtaagtctccccttttcccggacaggagagttcattctggaaccttctggaagcatctccatccaytgtccttttcctcctggcytaaatctatgcctaagggtcctacatgtcttaggcacttgtgtgtcctgcagtgaagacrgrtgaggcccctagttcctctcttccccagtcacctatttgtatttrgtgtgctcctctgtatcctatttgttacattttccatgcactatgaaggccattctctattccttatcttctgggtaggatgtccctttctggtttggttcataacaatctacagggaaagagttgccttcagactcctttgctcaccccttctaacacctcacactcctgacaaatactgtcatctcacgtttcagagccaggaagacagtcttgcctcatcctgagctttccacccctgctgcatggagct

SEQ ID NO: 20122 - DNA, 600 bp, Bovine  MMBT05749
gcaataaaaaggaattagctactgattcacattacaggatggatgaacttcaaaaaaatatgctatgtgaaggaagccagacacaaagggccacttaatgtatggtcttatttacctgaaatatccagaaaggcaaatctatagagacaaaagtaaattatttctgatctgcagctccaggcaggaagaagggttaactgtaaatgcacagagagattttgttgcagggaacagaaatatcccggaagtggattaaggtgatgattgctcaactcagtaataaaaaacgctgactggtasactkaaaacagagtgaatttmatgaaatgtaatttatgcctcaaaaaagytttttwaaaaaaacttaatggaaaatttggtgaaagttcagaaactaaaagatttagaggttttgttgtattctggtgttaacatgaaagaagaggatgragaaagartgattagagacttcacaactgcaaaagagagaatctggctttatacaccgtggttatctgtccagatatttgggatggatatggttttttgttttgatgccagggaagaaagcttatctagatttagacacaatgaatcatg

SEQ ID NO: 20123 - DNA, 600 bp, Bovine  MMBT12007
agagtgtttatgaaagttttcagtrcagatgggcacttctcttcaagagcaggttcagctttctagcacaggcatgaggcagggaggggcggggggagagcattgtgtcctgttgtcatttcaaaccacttaagtgatcatttatggcaggacataaaaatgatcactgttttgaaagacaataagctagtattccaggtaatgatacctccaggctaactcattctttttcaggagttttaattatcaggatgggcacaccggtgtttattcaattctctgtatactagagatggtgtstgggaaagatgaatgccacccccttttcggctatgctcagctgaatggattgttctcattttscctcttccctcatcagttgataaaatcaagaacaggatccaaaacaatatgtacccacacaggacaatgtatcctggtgcctgtgggcaggaacagggcccccacttacagaacccaggttccaagccagcctccatcccattcagcacatcgcaccactacttctgggattctcgtgtcccacagaggtgacaataataactatctccttggggtttgtctacaggcgatgtggca

SEQ ID NO: 20124 - DNA, 600 bp, Bovine  MMBT16810
agaccttaaaccagttagtaggaatactgaatggagtgggtcttcatgttagcgcttaaacacatttcagaaaggttgtggatttccatgtaattgggatctaaggtgtaataggtttaatttgaggtcctctttaaaagaacaacaggaaaaggcatcttcagcaacgtctaatagcyagtaagaagagacaatgggcttccttaaggatgaaaaagtgawtatcttagtacagcagtcatttctttgagtgcctccatcatcagcatggcaccaaaaatgccttgtgtgtgctaccawtttatccttggaaacatcacagaagaaatgtggtagtgaagacagctggttctcaggagcagagccacaggccaagcccattttaacaaactctgagggattatccaaattctcttgctatcttgcaactatgttttattgactattacttggaatgaatggtcaatcagccaaggctaggaaatctgtttttgttacataaaaattgttgatgtaatgtacagcgggacaacacagtcatattggaaaagtatttgacttagttgacctgccaggaacattgtgtgtgcaaagaacact

SEQ ID NO: 20125 - DNA, 600 bp, Bovine  MMBT11030
cgcccaggctcagacagggtcaggcctaagagcgaagcccaggagagcagcagatgcggcccacgtccagggcctcgcagaactttcaacgtcgacaacattgcatcccatcacacaatcttgaacaggctccccggggcgtgacgggagcaggggcggggggcaggatgcagcccacacaaacagagggacgcagtctgagtggaaaggggtcattgctttaattaggtcaggacccaccccggggggcccacccaccccatcctgaggcagaaccactggccctgtgtcaacatgatygttacaaaaataaatatgaaaaaagcagccgctctttagtgatcatggaattaatcttgacagcaattaaatgtgtttagcatctggcatgtctcctaaattgcaccaaaagaatctggaagcacttggtttggcctcagaggcaacccggaagggagggcacaggggccctggcccaggcccggctaagcgcagtgcccgcctggcccgcaggtcacatctcggagtcggcatacatgccgttgatgagatagtccacctgcgtgtagtccttcttcctgtagctctcgtaggcctgca

SEQ ID NO: 20126 - DNA, 598 bp, Bovine  MMBT08359
  misc_feature (1)..(103): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttactgttatacaacaacaatatactgttatacttacaaagcagaaggaataaaaatataacttctcatccccagaagtatccccatgggctagtgaggacattatttagataagatagtttttctgaaggccctgaagatgtaaatagctgcctaaggtagcaaagtctctgagaaaaaaaaataatatgaaaycagaacctctgaaaaggagaaacctcaaacgtggaattctgatagaaatgaagcctcaatgaattttagattcctccaggatatcagtccagatttaggtgattaactttctgagatatttaatataaatgaaaatattgcatattcttctaatcctagataattatttataaattcatcagccataaaaagaattattcaacactagataaattattaaactcattaattaccaacctagagaattattgttggctgacttgattaggtctctctttaaaaccaacagtttaaagaa

SEQ ID NO: 20127 - DNA, 600 bp, Bovine  MMBT13743
gggctgatctgaggcacgtgtattgagagctttaggaaaacgacttttcctctctaagcctcggttttcactagtatcaaagtgacagattcaaatgtctctcagaagttacttatatgaacaaaatgaaatattctttattttcataaagtacttagcctcacacctggtatacagaaaatgtagaatatatgatgattaaatatccatccccagagtaaaggataaactcatattttcccaaagcagtcttagatgacagcatgaattcgatgatagtagccaatccctttttatatygagaggaaccgtagcgttatggggctgagaagtcwtatttagactataaattaggttacaaacactttgcagtcagggaccaagtcatatatgatttctttatccccagtgcctagcaaagtgcccagtaaacagtagatgcaataaaactttgatgaatgcagctattaaaaggkaaaaggcagagccaacaaacactttctgcccatcaactgtggcaaatgggaatagaccagtttagataattttagttgttgaatgagaagtgagtctgaagggcttgacatagccggctttgaa

SEQ ID NO: 20128 - DNA, 598 bp, Bovine  MMBT20429; identical to SEQ ID NO: 4757
  misc_feature (1)..(21): n is any nucleotide

SEQ ID NO: 20129 - DNA, 600 bp, Bovine  MMBT16956
atgctgagaggtattcacttttgttagtttcaacatgtggagttgatggatgatagcagtacacttgagcagctggccatgtaggaaactgaaataagtttggtcaaaaaaccagaatatctgccttaagaatacccagaagcatagtttgcagcctaactccagacttctggaaaacagaaagagcaaaacaaattaattttaggaaaaataatcacaaagaagtctgtgcaagccaagttctatgtagctaaatatcaaacatgggagattattaacttaaaacagagcaaaggcatrccatccatgccaaaccaatgaagtcaatgaagactcatcatacaggcggataaatttgtcaaagtgttttagattcttcctggtagcagacaagactgactgactcttacatatggaagcataaagctaatagctttactgggaaatataataccctatttctttttggttttgtatttatttagggatcaacctttgttatatttaagatactagattgcatttaataagttaaacttgtcatgtaaatgttagagtccagatttcaaaagtaagtgctatttttctgaacaaagccaa

SEQ ID NO: 20130 - DNA, 600 bp, Bovine  MMBT04526
ccacattcctcatagatgtcccctgcctggcccctgagagtacctgcctttgcatcctggcaggcctgcaggcaccctctcaggagagagacccagaccatagtgtgaaggttctgagccccttcctcagcatccatctctgtgtgttaagtgcatattctttaaagtcaggcctggggcccatgggatttctctttctgagcttcagttttctcatctttaaaacaaggatgttagtacttatctaggactatggagagaatgacttgcattttcaatccctgggtttgggccactcayaactcctccttccccctttcgtggaacaggataagttcagggggtctagcaatcactcaggcccaggcaacacccatcagagtggaatgagaacaggccaggtttgtgggtgttccatgggctagatgaggcactgcctctaggctgtcacagaccttgggccctttcctaaaccaaattgagtggacccgctgattccttctgtgtctgttgccctctttagaatgcacactctgcaaggcctataaccacattttattcccatctgtatcctgcaagctcaccatgtactaataaaat

SEQ ID NO: 20131 - DNA, 600 bp, Bovine  MMBT05637
tatttcgtattacacacaaaagccgtcaacagtagtacctttgtccttccaaccccaataaacagtaccgacccaatggctaacattgagcattaatgtctactatctgctcataagatgggtccttttttctgctagatatctgatctggaacaatcaacgtcaatatgttagttctcacattaaaggagtttatacttctatttttagggcttaatattggttctaaagttttacctgtataggctttaaaaggtctttagaaagaaatactctttgttgatctcctaaaaagcgaayagatgttatggaccccaaaccagctttgtccagtagagatttgtacatctgaaacaaaagaaaatgttttggcatcataactgctattagtatcattgtgaaaatggggactggcaatgttccatacaaagattaaaccattcatttgttttacttactactagtatctcaataataactatttatgcgaccaaaacaagagcacacaatttttatccagaatcaatcatataaacccgatacacatttgagagtcatgttaacatataggtctgggtttacagatgtatggcttggccc

SEQ ID NO: 20132 - DNA, 600 bp, Bovine  MMBT08765
tatcatctataaatatgatgcttttatattttgaggtacaaaggcattttctgttcaatctctcttaccagagtcattcgtttttcctaagagaagtaaaaaagcaaaactacttaactactgttaataagttaactcttcttccatgacttcatccagtaatctctggttttctgttaattgtgtggcacctctcccactggtctccttttttgctcacttttctttaaatatagatattctctaagatttacttcctgtcttttgcttacacactatttgctttcactgtcacatttrtatagctgatacttaaatcagtattcatcttttcacccacccatccatctatccaaatatttattcattcaacatgtattgagtgctactgtgtgtcagataagtaaagcaagtggtgggaattcaaaatgatgaagaaacagcccctgatttgagggataaacgaatgttggaaatttttatctgtatgtagactgacatccggcaaagttcaacatctaaaattaagcctttgcttgctgctgctgctgctgctaagtcgcttcagtgtgtccgactctgtgcgaccccatagacagc

SEQ ID NO: 20133 - DNA, 600 bp, Bovine  MMBT10908
aataaattccaagaatgtttctaattctaaaaatgtttgattcaatagcaataaatatttataccccactgtatcgccccttgtactaattgttgaagatagtgtagatactgattactctcagtaaattcagtttactggaggaatcagtaagcgaatcattttaatacaatatgttttctgcaactatagacatcagtgcccggtgctttaggaacacaaaggaaacaatgattattctggggtgcaaaggactcttgttagttattttcccattatccactgcctcttttccacttyccagaatgtctcattacaaattttccttgatttatgatggggttacatactaatatacccactgtaaaaagaaaaatatcttgaattgaaaatgcatttaataaacctaagctaccaaacataactttgcctagcctaatgttaaacatgccaagaaaatttacattagcctgcttttgggaaaaaacacctaacacaaagtctgtttataataaagtggtgaatgtctcatttaacttattgaatgctctactgaaatgaaaattgggatggttgtgagtgtatcagttgtttgccctt

SEQ ID NO: 20134 - DNA, 600 bp, Bovine  MMBT00838
gctgggagggattgggggcaagaggagaaggggacgacagaggatgagatggctggatggcatcactgacttgatggacgtgagtttgagtgaactccgggagttggtgatggacagggaggcctggcttgctgcgattcatggggtcgcaaagagtcggacacgactgagcaactgatctgatctgataggtatataatatacaaacaatactatgcagctctttactataattaagcaataatccagagaaattagaacagtgtacagagcacgctgcacaaacatgtccttgtttgrgtgtatctctttctggaggaatacttcagaagccaattgtagtggttgcttggaggaggagtcacagagaattagagaatgacctagaaggcagacatgcttggtatatttggattatttaagatgtgcttacaatgcttattttcaaaaaagaataatttaacatattttttaaaaaatatgtccataggaaccatacagtttgttccatctctttggaacaaatacttaaagataattttaagaaataaatttcactctgtgaaaagagtgccaatgttcagagaaagctatatttag

SEQ ID NO: 20135 - DNA, 600 bp, Bovine  MMBT10441
aaaaaaagaggaccagggtgcttgtcttctttttcttccttctcggtattgcaagcacaaagcactgcgcagaagctgcaccaatccttgccgtccctggcagcagaatggtagaaggtgggagagaccaggaatccttccaggctctgctgactttagaaatgaggattgcacacgtttgtctcctgaaccaaaagggtgagaaggcagggtgccagtttgctacactgctgcaatgatctcacgctcactgctgctgccgtcctgtttgcccagttcaaatgcctgttcagtacaaaycaaaaaaaaaaaaaaactacttggatttttcagcaagcaaaacgggtattaacattaaaaaaaaaaaaaaaaagaatcagcagtaagaaaaggcaaaaaacaaaaagcacatacaattttaggattcacttgttatgcctcaatattctgtttatatgttctttctttctcccccccccccacccccatttagagataagcagcagaatttatcaggcgtgaaagggacagcctcctggtggcctgccaaaaacccagaataaaggcgaagttgtgcttcaaagctcagtcgcttgctga

SEQ ID NO: 20136 - DNA, 601 bp, Bovine  MMBT13338
  misc_feature (1)..(1): n is any nucleotide
nttctaagtatataacaaatattaaatggtacttacaagaacatgtccctttcttcagtggatgggtctagtttctcagctttgattctgcttgttaaggagtacacagaccagtctgacttatccctaagtccagttattctgtgatgtttggttaatacctaaattctactgatatctacttcaaaattattctcagaaagcaaacatttttggttaatttacttcttcccaccctaactgctaccattgtctttaagcctgcaaacattgtagattgcacctgatcaaacagatgctktattcaaatcaaaacaaatggaaagtgctgtgtattttggcaaccttcctttcttcctttgcctatttttaaaacggagctttcctaggatataatttcctgcatagtgtggcagctatggcctacttaaagtcttgcagtcttgcagtaattgaaatgtaaacttactgaagaattagtatggttttgcaattttttttaagcctagaccgtctcacgacttgaaaatagagtgtttacttccaagttgtgtataattgctgtagcttttctaggaaaccagtgttcttattctaagaa

SEQ ID NO: 20137 - DNA, 600 bp, Bovine  MMBT12610
ttcctcagtgaaatagcaactctagagagtatatagtctagtgtataagtaatataggagttgatgagcatttaagaatgcagtgatgcagaggtacaggtggggtgctcaagagtgatggtgggaggcgggggcacacggggtgatgattttgtggtataatcatgagagaaggtggacctaggtggcagcaggggagcatgtttgaaagatacctttccttttccccaggagagccaggtcctcctgactctcacgaatccagtggagaaccttacccacgtgactcttttggagtgygaggagggggaccctgataatatcaacagcactgctaaggtaggagtgttttgcttcattctgagtgactctgacttccctagagtggcctcatttgacctgctttaaaggattccacactcattattttcacatccagtcttcaggttcccttgatttcacctctagggttttctacttcatccgcaggcacactgccactgccctttttgagggtttcatcatttctcacatggactaggacagtaactttctaactcccttttttagttcacccccacttccactccagcccatctt

SEQ ID NO: 20138 - DNA, 600 bp, Bovine  MMBT03828
catatgacagctttgtaggtcagaaatccaacacaagttctgctgggccaaaatcaaggtgttggcaaggcggaattcctttaggaattaccacctagagcaaggtgatgctctggggaagaatctgctcctttctcgacttccccagcttttagaagcagcttacatttcttggcttgcggcccccgtctgccgtcttcaaatccagcaacatggcctccctctgactctgataccgttgtcacatctttttttttttctgaccacagttgggaaaggttctcttctttcaaagacccrtgtgattagattgggcccacccagagaatctccccatctcaaggttcctaactgaatcatgccttcagagtcacacgttttcgccgtgcagtcacacgttcagagcctccagagttaggacgcgggcatctctgggacaggggcattgttctgcctctgatgtgttagtatattcgtcccagtgttcagaacagtgctgagctacaaacgctctacaacaggaatatgtttaaattacagtacatacagatgttggagtatgaggaagcctctaaaaatcattggaagaggatgacacgg

SEQ ID NO: 20139 - DNA, 600 bp, Bovine  MMBT02837
agcatgagccaggaaccctgtaatatttcttatatttcttacatgtggatgctaaacaattactaaatagccttattttttctatgagtgtgggtttcaaatatatttttcagtagagaatcattggttgcatactaaaaaagatatctgtttagaataagcatttaaggtcttttaatactacaattgtttttgagatatgttgttaatttgattctctttgtctctaactcacattaaaatatgctattgaggattaactaaaatgatgtatatgattagacgcagtggggagtgagyttgctttattgctctctcttaatatccctgaaggctgggattaaagatcttatattaaaataagtaattattggataactcaattaaactttgtgatagtaggggaactcttgtattactgactttttaaagtttcccaaaatatattctgctgcatgaccactatttttaaacccatgcattttctaaattttgtacttgccttaaatgctcacattctttcgtttattaagatttattgcttgctggacaaacttcttagatgttaaaactagctgcctaggctactgcacaatactt

SEQ ID NO: 20140 - DNA, 600 bp, Bovine  MMBT04305
agtaatgcaagtatacaacttttcttttaagtgccccaaatagttccattaccactgtgaataaaccattcgcattgtggttagaaaagtttgttttagcaatttccatgcttaagggctttcactaaacaataattctatggtggtgacttttgggtgtgtctaattgtctacaaagtaagcttgaaactggcatttcatgtcattaagaattaagaattcaaaatataataataataaaataaaagatttacaaggctggtcattcaagaaaaataggaactttaaaatgtcaaagarctttatatacatacacacacacattaaaataacatgattaaaaatacaaaaaaataaataaaaataccataaaacatattgatttaaaattacctttgctgttatagagttcttttttagcaatcagttttcatcaagtttattattttaacattcctaacgcaaatggcactagcaaatatttgggaagtgaaagtgaggtctctcagtcgtgtctgagtctctgcgcccatggactatagcccaccaggctcctccatccgccggattttcgaggcaagaatgctggagtgggttgcc

SEQ ID NO: 20141 - DNA, 553 bp, Bovine  MMBT17619
ccatttatcaaaacgtagtttggaaattcactaatcaaaacattttccatcagaggatttaaactcacacaccaaaattatctctagttaagcaagcaggaagtttaccaggaaccccctaaaaattaataattgtttttacagctttgataaatccatgccagctcatgttagtacacggtgtggcacacacaatctccagtgagtctgtcacttctaaacaggaaagcatgaaatccttagcataaggcaagaatcacagatgttctgaagtgaggcgttttagggtttgccccccayccacaaaagctggtttctcagtctttgagatggttttcttagagtgacagttaattatgccaaactcatcatattcatcatcttgtttcatcttcaggaacctacaaggaagggtgtctcatcctcagccctactgaygtttggggccrggtatttctctgttgctgatgcggggagaagcacccgtgcattgcaaggatgtttagcatcatctctggattttacttactaaaagccagtcttgcctccaccc

SEQ ID NO: 20142 - DNA, 600 bp, Bovine  MMBT16401
cgcctgcaatgcaggagactccagttcgattcctgggttgggaagaggagaccccagttcgattcctgggttgggaagatcccctggagaagggatagtctacccactccagtattcttgggcttcccttgtggctcagctggtaaagaatcttccagcaatgcgggagacctgggtttgatccctgggttgggaacatcccctggagaagggaacggctaccagcagcatgaatgtgtgagtggcagatatttaattaaaatagaaaatataaactggtaccaggggcctggctgctayggatgatttctatctccagaggctgtgaaaaatctcttcctcctgtcactgtgactccccacctgccacccccgccctcagttaactcttggcatcttgattgacgaggtattctgcattcgggtcatcctcaggggtagcgcattgccagaaggtcttgggcactggtgcctcagggtggcgagggtgtgcccccaagctgtgtgttttggggagagagagggtccatccgtgcttggttcttgctgtggttgttcagtcgctcagtcgcgtccgactctttgcgaccccgtggactgc

SEQ ID NO: 20143 - DNA, 600 bp, Bovine  MMBT06055
aaaagcctccatctgctagatgtaatcttttcgtacctgtggaaaaaatgaataaaataaraaggacccactcgcttytgaccttgactctcygcagattatgcacctaagatagtttcttttgttccttgacaggtcttaattccaaaatgatagtgctgtagtattttgacagtttcatccttttacctaaatggggaygaatttggcttcctaatattcctggttggcatatgttttgctgcaacagagggagaggattttcctttaatgagcaataccctgtgtcccttcacagcrtcttttcttgttgtaaaaatgytcaagcatcctttgcctctctagtctatttgctacacggaattgagaaatcattataaataaaagaggtattaaaacatcctcactgtgtcatggatctgtttatactttggaaagaaggggaagggggcgggtaaacagaatgaattgctgtgaatgtgctgatccattgggccccatcttttccaacccagccccgcagggcttcctacctctcttcccacctgctcgccgtcatcgctgcaacgttattctcccggatgctatgtttctttccca

SEQ ID NO: 20144 - DNA, 600 bp, Bovine  MMBT09222
cctgtgtggtcccagacagcatgaagggcgacctgtagtccaggccaggagagagccaagtggggaaggagggtaagccaacccttagtgaagagacatttttacccttcacrtagtgaatccttctgaggctgctttttaaaaatgaaaaaaaaaaaarggaagagtctcttaggattcaagtgatgagcaaattccatttcagaaatataaggaacaagcaggcttccttcttaaaatttagctattgttacaatggaktaaaaaaaaaaactgaggctctgtggtcctcaggatttyggttggttggtcaatgcctgtatccccccctscaccccatttaagcatcacacaaagcaaaccctccgtccccattcacagatacatgcaaacacacactcttcaaatcttctataattttttcaagtgaatcctttgtttgctctgctatatgttacagcatcagtcactgactccctggcagacattaagggtaagaaagcaattatactcttgaaaaagcacatttatggacactttacatgtccattcaaaccttttccccttgcaaggcttgcctttggctgcctctagatacag

SEQ ID NO: 20145 - DNA, 600 bp, Bovine  MMBT04328
aagtaagtctaaatacccacatatcgataattaataagaatctacagaacagcacagggaactctcctcagtgctctgtaatgacctatacagaaacagaacctagagtggatatatgtataaactgatcccactttttcacttgaaactaacacaactttgtaaatcaactatactccaataaaaattaatgttaaaaatcataaacaaacagataaacaaatacccacataaaaaagtaaagatcagatgcacaactgaatcaaaacgacaaatctataatcgagagtaggcagagayttcttagtggtgaacagcacacacacacagattcataaaaatcctgtcaataaagcaattcaaaatgccttgacaatgcccttgccccatcctaaaaagcatgaactgcctcagcatgatgttaactcttaccaccaagggattctgttgcttggctggctggctgtggaccccatttggttttttctttggattaggtgaatcttgatactgttttctgccatttccccttatactttgattctgtttttccaataagaaataaaatgtaaacatacagcacaatgtaacaggataaaa

SEQ ID NO: 20146 - DNA, 600 bp, Bovine  MMBT02587
ttattaatatttgtttatgtatatttattttacattagcagtaatctttgtcttttttttttccttttctctctcctgctttagggtactactagttcaacagcttctcctccagtctccacccctgtcacaggacataagagaatggtcataccaaaccaaccccctctgacagcaactaagaagtctacaatgaagccacagcctgcaccccaggctggaccaatccctgtggcaccaattggaacactaaaaccccagcctcagccygtcccagcttcttacactacagcatccacsccttcaagacctaccttcaatgtgcaggtgaagtcagcccagcccagctcycattacatggctgctccttcaccaggacaattttatggttcagggccaggggcccaaggttataacactcaaccagttcctatgtctggccarggtccacctccttctacacggggaggcatggattatgcatatgttccaccaccaggacttcagcctgagcctgggtatgggtatgctcccaaccaaggacgctattatgaaccctattgcrcagtrgggcctggctatgggggcaaaaatgactct

SEQ ID NO: 20147 - DNA, 600 bp, Bovine  MMBT06817
aatacaggagacctgagttcaatccctgggttgggaagatctcctagagaaggaaatggcaacccattccagtattcttgcctgggaaatcccataaacagagaagcctggcaggctatagtccatagggtcgcaatagttggacacgacttagtggctaaacctacctagcgaaacaacataacaatgattaattcaagaaacagcaaaagttaaatatatcttttatctatatatctttctgacttcactggaatgtctttagaaaagtaaaagtatgttcagacattacttaatacrtatttgttgtttgggtctattttcatccataagttaaagatcttcaagacaaatgtgatttttgagtttatatctatacagtgaatggagatataaattaaatggccatactttccagtatgtgctagctgtttgcgtgtttcacaagacccaaatcaaccggactgaaagctgcagttcttaaacactcttgtgttagtaattttcacaccaacgaagtgtttccactaatagtagcagtagtggtagttgccggtaatagaagacctactgggtatgcactgaatgagagctttgctt

SEQ ID NO: 20148 - DNA, 600 bp, Bovine  MMBT11363
gttatgtcttggcttactcatgagtctgaaagattataagcaaacttgagatatttactgataggatttccatacttaaatatcagccagcgagaataggtttgaggcctcaaccttgtttttctaaagccttctgatwaagttgtcctctcgccatggctaagcctggctctgatgctacaccaccatcacatggaaggggactcagcccccagactaaaatgacatatgctgtggcttttgtcctagctcttttgcttttgtaggatgaccttgagtggcctccaaaacttcttgttstccattgtaaataagagatagtaatatgtattcctgcrtaattcacagattaaagtcattgtagacgacgcagtgcatttgaaggcatttgggagacttgtctggtaaggcattattcttatgtcttccagtcacccaaaaaactagaacatttctatctgccagctacccttttttcagcacatcctgccctcaaagtatctgctgtatttttagtaaaagttaaaaggaaaaagttgaccgtaatcctgtgtatttctttctggtcttttttctgtgcatttaaaataagatgaaaag

SEQ ID NO: 20149 - DNA, 598 bp, Bovine  MMBT18225
  misc_feature (1)..(28): n is any nucleotide
nnnnnnnnnnnnnnnnnnnnnnnnnnnnttaaatatttgtcattcaaagcatatgatttgattgtgcaaatgttgttgacacaacagcagtgaaacttgcctgtgaaggcttcactatgcctaatgaaataaaagatttatgagacctttgttgttggtgttgtttgtggttaatgcacaataatctgtattgaagacagcaatacctgtgatttgccacacctactattaaggaagtatagaagatgatgtgaagatggtgatgttaaaactcaggaaaccatctaccttttctacaayggcactgtctattcccgccaccatgatctactatggcaacaactacggggctatgaatatgataggcttagctgtggctatcaaggatatggtgactatggatatgactgctgttgcccctattactatggaaaatattggtcataaacattctactgaaaaactctagagccactgaacccattatatttgtcctcttgtgaaayagagattctgctgttgggcttactcatctcatcctgtctcttcaaaaagcaacaatcaaaattgaaatctaaaccatcatgaaaataattca

SEQ ID NO: 20150 - DNA, 600 bp, Bovine  MMBT00972
tgttcaattgaatatcattttatgataagttcgtgttctagtctttgttgatttaagtatttcttgcataggaaagctgcttcccacccccacagccagcctctctgattatcactgattatctcactggtctaagcctctgtgtcctttctccctgccacagtctcaacagccagagggacggccgggtctaaggctacatgactgcacaagctacagagtagtggtatcaggctttcccaaaayagcagcaccaatatacatctcacccagaatatatcagtgtcccatggatgcagrtcatgtctcctccttggtaaattcagacatcttatttcctggtgttagacagatatcaagttgggggtcttgatttccatttaacatcacaaatggtgaccatgactttattcattgcattcccactgtgtgaaaagtttatgaagaaggaagacagtggaattgggcagagggcaagggtaaaccaaaatggcccatcagagtggccctgaattgggctgaagtggccgaggctgacatcctgcctgggtctgtcttaggatcagttgcccatgtgcaggcagctctgcagctcaaacc

SEQ ID NO: 20151 - DNA, 600 bp, Bovine  MMBT21987
ctctcctggaatgcttgcgtgggggaaagcaagctgccgtgtcacgaggcccctccagcaatctgtggagaggcccccgtggtaaggaacygaggcctcctgctgaccgtgrgccatcttgaaggcagctcctccctccccactcaggccttccgatgcctgcaccccagctaacatcttgactagaacctcatgaagagactgagccaaagccatccagcgagtcatccccaagttcctgacccgcagagaccctaaaacatcagaaccctgttgttttaaggcactgtgtttatgggkaatttgttatgcagcagtagctgattaatggaccccaagcacaccctgccagacatcactaatcaatcacagcttcactcctgctgggtccagatgatgcctcaaaatctctctcaaccctgagctccaggcagccactaccaactgaccagagttagcatatgagatgaaaccatctgccattccttagcctaagatagagggtgagacagttggatggcatcattgactcaatgcatacgaagtggagcaaactctgggagatggtrgaggacaaggaagcctggcgagcagcagtcc

SEQ ID NO: 20152 - DNA, 600 bp, Bovine  MMBT13771
gccaagaagattgacaatgtactttcctgatattaaaagcttacaatcaacttgtttctgttgaagtcctttaggcatgaataatacctctctgagcttacaggaagtcatgctagttttgcatgaacaacaccaagtaatgttgagtttaatggactgatgactggggacctgggggataggatgaaggaaacaggagggaaaagggtgggaaggtgctgaacccattttggagaaaggaagataggaagaattgttgtgtacagaaatgtgagagggaatactcagagtaggatggayatactacrtggaaaaaagaaatatgttaggagagacttagtgaccagtattgttttaygcaatgactgtcctgtgtgtgactatatacacatgtgactaaatgcacatatgtagtttgtatttaaagtctaatgggcacccccacacacacatgacagaagagggaaacactgaggaagtcaagatcaattttctctcattattatatgaatatatcaactttttcaaggcaagccattggttcctcttttcttgtttcaggaagaaaaggaaacaaggctgtcagtggtctgtcttggg

SEQ ID NO: 20153 - DNA, 600 bp, Bovine  MMBT04514
tggccccgggaacagcctccagagccaggctgaacctaatccctcaggtaatggaaaacctatttctatttctgaggcctcactactcttcataccgaagagccttgtgcctgtcacacatttattgaagcttattactcatcgagacagcggggtccagttagtatttggaattatattttaaatcacaatttttctcttatttattttgggattccaaggctatggtgaaagcatgtcagagttattcttcatgtgctttcaaacaccttaaagcccacccctccccctgaaattctyttctacgcagagaatctttacgcatacgtggaacatcttcagccaagacacaggggtcacccctgtgctctgggacctcaggactccaccagatcacagggttctaggggagagatttccagtctcctcactcagcattagagtaatcttccccaggccactggctttacttctccctctcacaccacgctcttttctttggctttcaaagataaatggatgcagtctctgaggatgctggggacggaggtgggaacagatgggctaaaactgcagtctcatcatccagtggaaaaataa

SEQ ID NO: 20154 - DNA, 600 bp, Bovine  MMBT22720
cccctaacccgtctttaggacttggcttcaaaactagctccacaggggacttccctggtggtccagtggttaagaatctgccttccaatgcagggcatgcaggtttgattcctggtcggggaactaagatcccacatactgcagagcacctaagcgctcacccccatgccacaagagaagcccgctcatggctacaaaagatcctgagtgccacaactargaccggtcgcagccaaataaatgtttcaaatgggtaactacatattctccatacgtctgtgtgtgcccatgttcatcctygtgtatatttaatgcaatacttcatttattaaatatttgatcctccactgtgtgacagatctgcataaatgtgtctgggtgtgtgtatacaactaccatgtatctggatgagacattcattcacttacttcacatgtatttaataaggactcttctgtctactgggcttttctgatagctcaattggtaaagaatctgcctgcaatgcaggagaccccagctcaattcctgggttgggaagatctgctggagaaaaggataggccacccactccagtattcttgggcttcccttgtggct

SEQ ID NO: 20155 - DNA, 600 bp, Bovine  MMBT08089
agaggggagaccaggcaccagagaacccagatacagaaagaagttctggcctgtaccatgtaggtcccacctcacaaggaatcagtgggtctatgtgagtctgtgcatcaaggaattcaccttgttgacatcaaggtctatcacgagaagccctaagcctggtataggctggtagccaagtcacaaacaacagcttaccccgtttctctctgctttctggcctgtggatgaaaaaaaatccagcgctttgcttttccaggccctcaccaactgccctcccaacccagaaaggagagaggytgagccctgctactccagaggaagcagacatgaggcaaaggccaggttactgccatagatagcctgacaacccagactgagcagcaggcagggaggcactgttcatgtaatgagtgtccaccacagctcacaggaacctcatggccttcataaacactcacccattcatccacccatcatgcggtcactggctatgttttttgttagaggaaccagcaggcagcccagccccaaaagacaactgatgacccccaggagaggtgggacacacaagtcctccacggatgtgtcccctcctca

SEQ ID NO: 20156 - DNA, 600 bp, Bovine  MMBT06489
gtagcaacatattcaatcttcacagcaaccctttgagggacargtattattgttcctgttttacagagggcagatattaagtaacttgtccaaattcacacacaaatcatgtggagacagaaactgaacccagacratttatctgcggattcagtgcccttagtgactatgccatagcacacctcaagctgtagcaaagtgcttctttccaccctctccaaaagggaarccagagtactgcagaatcagcctcggtgtgcaggttggtcagtgggccttaatcagtgtcccaggtctagmccaggaccttggactttgaccttgaaacaacatggaaggacctagaggacgttatgctgaatgaagtaagccagacacatgaagacaagcaccgcgtgatctagctcgacatggaatctaaagcagccaagcccagagaagcagagcaccgaccagggacctggaggtggggaaaagggaagacacgggcctaagggtcttgtaatctttccgttacaacatcagttctggatctaatatagacattagtgactggagttagcaagactgtactgtatacctgaaatttgctaaggtggt

SEQ ID NO: 20157 - DNA, 567 bp, Bovine  MMBT20828
aaagaaaatmaaaatattwaaaaattttagcttcatctctatatgagaagaatatgctaattttttcttacactcattaacttttaaatcctggatcaagaatttaaagcctgcctttaaaatttctcacaaagaagatttagagagttttagaagtgaacagacgttacttcttgtgatttattcacctcccaaactgaaaycttccaaacctttttgtatccctgagttaaagtttctgatgacttaatttttcaggaaaagtagggcaaagtttgatcacaggacgttttcagaaaycaaatgaggtcagagatcactgaacagattcataccatctgggaggccagagccaacagagacagttaaatcttgaaaatgcaatttaccagccgctttgaaagttctctgagggtcacttacagctttagggatttccgtattaattttatcccaagttaaatgaagttactattattttaaattttaaaatatgtgcttgttttggaggatacaaaatatgggaaaagagaaagatgaataatgataacgtttttgctccatgaa

SEQ ID NO: 20158 - DNA, 602 bp, Bovine  MMBT01899
  misc_feature (1)..(2): n is any nucleotide
nntttagagtcatgattacaattaatcagatattcctataaatcagaatgtacatcaaaatggccaatttggaacacttaaaaatggataacaatctcaaagaactttcaagctgaaatggtcatctcggaggaatgactttcttaaaatgatgcttccagctcagatggtgactcgcaggtgaggcagcctaactgttygtgctattttgtctgacagagaaagcartggctttagttttgtgtgctttcaattcacttgagtaaaaaaggcacacaaataaacacatgtttacctttgcmactaaatagaaatgattttccttttctgctttatagagtttagtaaaaataagttggggacttcacaactgcarctttcctcagctttmtagaacagctttatcttcttcaatgtcttttaataggtttacagcatcaaagctagcaatgtttaataaagccaataaataactgcattataaacttgaatgtttatgttgcaaaaaaggtaacaaattcacccttggtgggaggaaacattttacagtacatgcctgaaagaaaggagatgaaaagcaactatctcttaacagttttaag

SEQ ID NO: 20159 - DNA, 598 bp, Bovine  MMBT03325
  misc_feature (1)..(29): n is any nucleotide
nnnnnnnnnnnnnnnnnnnnnnnnnnnnnataaggtatctgggcattcttggcctccgttggctgcttcttggatgataatcctatatcgagactgttttattgtagcatttcctgaagtaaaggaaaaataaaataatagtgcccttttatgtggaggcaaagaaaagtccagggatagagagcaatttaataaagaaaaaaaagaaaaaagaagaacctatggaaagactacctgggaaatgagaataataagaaaagaccagagattaatactcaaccttacttctatgagaaagamacatcacacttactaactgtgatttcaaatctgtatgttctaatatgggaagattgtttcccactgataatatattttaattaatcagaatctatattatattttgcatatayttcagcataatctgaaaggcccytgaaatactctttgatctcaaagcaacagctcagggggttaacrttttactattagcaattytctccctcaggtggggtacttccttctttaggctactttttactatgcaaacacttattaaaattaatacattactmacatatttattaatgggaattag

SEQ ID NO: 20160 - DNA, 600 bp, Bovine  MMBT19030
aatagtgcccttttatgtggaggcaaagaaaagtccagggatagagagcaatttaataaagaaaaaaaagaaaaaagaagaacctatggaaagactacctgggaaatgagaataataagaaaagaccagagattaatactcaaccttacttctatgagaaagamacatcacacttactaactgtgatttcaaatctgtatgttctaatatgggaagattgtttcccactgataatatattttaattaatcagaatctatattatattttgcatatayttcagcataatctgaaaggcccytgaaatactctttgatctcaaagcaacagctcagggggttaacrttttactattagcaattytctccctcaggtggggtacttccttctttaggctactttttactatgcaaacacttattaaaattaatacattactmacatatttattaatgggaattagtttattagatttcttattcctcacaacctgaggtaatatgtgtacaattggaatttagagaagaggcagtaaaattacaacagaacaaacattatcttcctggttattttgctgacccacagaagtagtaataggcac

SEQ ID NO: 20161 - DNA, 600 bp, Bovine  MMBT06037
cttgtacttgattaaatattccttggtaccacccaaggatctgtaacttccctggtggtgaaaaacagtctttaaataaaaataatctcacatggcaaaaaaagttttctaataaagtttctctttaaaataggaaagaagacatggttatacaggtgctgtgaactgatcccagaaagaatttagagtttatctttttgaggtattggttsttagggaaaatattcaccygtaacaatgtggatagtattaacttactcagtgttatattatgtggcctcaggaacagtttcatacaayacagtcaagtacttattaagcattgtataagatctggtctcttacttttttttttttggtctctttttgatgtgaaaataaaattagaagattttagagcaagaaggattttgagatgatttggtgacgtctctgcattttgttggttgaggagacagacccagagagtgacctgccctgtgtggcgctagctaggagcagcaccaggacagaaacccttatctcctaatctttccacagccccgttctgcccatccttatactgagatttcagctgtctttgaaatttagattttctgc

SEQ ID NO: 20162 - DNA, 600 bp, Bovine  MMBT19602
tatattatttctaaagctaattatggaagagagagaatcaccgtttctagttttgtaatacattctttttgacacttctctgtcacagttgctaggaatggggagttcattcatcaaaccaagagtcctttgtccacagtgacctaagctttctgtgacttttggaagcttcaaagttagaagaaaaatgttgaaaaagcttagaaaaagaaagcagtaatgggaaaccttttcaaaataagacagttkggtaggttgacaactrgagtaatrgaagcaaagaatgtctctagagtgacrgaagaaaccataaagaaaggaaaagggagaaaacaaacatttaaatrtttgtactgggtgctttggtccttatcagtacattttctatgagatgtctcattcagcctcaggccacaacccagggagggaggggggggtcgcctgaagagtaggagaaggggagagccaaggcagggaggaagggaagatgaaccttatttttttttcagtttttgtgttttatttatttttttaattaatttattttaactggaggctaattactttacaatattgtggtgggttttgccctacattgac

SEQ ID NO: 20163 - DNA, 600 bp, Bovine  MMBT19601
tagttttgtaatacattctttttgacacttctctgtcacagttgctaggaatggggagttcattcatcaaaccaagagtcctttgtccacagtgacctaagctttctgtgacttttggaagcttcaaagttagaagaaaaatgttgaaaaagcttagaaaaagaaagcagtaatgggaaaccttttcaaaataagacagttkggtaggttgacaactrgagtaatrgaagcaaagaatgtctctagagtgacrgaagaaaccataaagaaaggaaaagggagaaaacaaacatttaaatrtttgtactgggtgctttggtccttatcagtacattttctatgagatgtctcattcagcctcaggccacaacccagggagggaggggggggtcgcctgaagagtaggagaaggggagagccaaggcagggaggaagggaagatgaaccttatttttttttcagtttttgtgttttatttatttttttaattaatttattttaactggaggctaattactttacaatattgtggtgggttttgccctacattgacatgaatcagccatgggtgtacacgtgttccccatcctgaaccccctc

SEQ ID NO: 20164 - DNA, 600 bp, Bovine  MMBT12112; identical to SEQ ID NO: 4590

SEQ ID NO: 20165 - DNA, 600 bp, Bovine  MMBT03477
ccctggagcttgtgacagcaaccagatggggggccttcgggccccttgtgccccttccaccccctcagcagggggaggaggacaggacagagagcaggactgagcacgtggagccgggagaggatgtcagattaggagcctgttagctgaacctctgtggctggcccggctgccctgcccacctctgctgcccttctacctctagagcttcttccagttaatcaaagrgatgcttctgaataaaagaaaaactactggggggaatattttgtttcattttgtgtcacctttaagatttgygtaaatgcgtatttctcttgtatgtgctaagctttgtgaattcatgtgagttgaaaacctttgcacatttgatttgaaggttgttgtgaggtttagtcacagctgtcataaactgacttaaagtgtctcccagttctcagaactcagccacatagctcattaaactcatcagtgttgtctctttaattcttactgtttcacatgaagtaaaacagccaccacctcaaagtggagatattttgttctttgacttttttaatacatgtctggacagaaattagcagcgagttcagtgtcctg

SEQ ID NO: 20166 - DNA, 600 bp, Bovine  MMBT12386
actaggagtttataaaatgtgagctgcgtattatagaaatactaaagaaaaccaaaatgttacttcttgcaagtcttacttgtataagtaactgtttaaacaactgaatatactgttaagtctatattctattctacatgcctttaaaaactagctttcatctgtttgaaaatagtttgaatcagtgattcaaggtcaaatctacatatctaatttcttatatttcttttcctgaaagcaaaattactttcaaatacacttctgtaggtccttatggaacatataaacttttctgccttyggtatattaataagaattctcaaaattttgttcttcccaaaatgttccccaaacaagagagctctttatgtttatgtacttaataaatatgcattacatatcatataaagtccacaggaaatagacgagacataaatccagatcctaaagaacttaacaaatatcagtaacacacacataaataaccatagtacaatgcaaagtttactaaccacaatgacaaagaaacagaaaaatcctttgggcgttcccaggaagaaaagattatttccagctggaaggtaaatctgagagccaact

SEQ ID NO: 20167 - DNA, 525 bp, Bovine  MMBT05024
gacatcagtcattcttggtccttaaacagtgagatggggaatcaaccaagggattggatgagctccagtttccatggcagggcaaaagttgaaagtgatctggttatagagatgccaaggaatggggactacttaaacaccatgtctgtagcagtgcattactggccatactttttttctaatccatgatggacagaagcatttgtaaaattgaacggaaatcaattactaaaaaaaaatggtcatgcatttaaatgtaatggcaatgtcaaaatgctctaaacttttccaaatacttakattcatctgctgtgcttaatcccgaggtagaaatcagtacaatgtcctgcattagttcatgaaccacaacttgagtagtattggtctataaaacatattagtctgaatcagtgataagtagataagaaagctcttttaaaaaaagtgaacaaaaaaacaaaacaaaatttttgattttgtagtgcttgccaatttttcataacaacctccatccatggctgattt

SEQ ID NO: 20168 - DNA, 600 bp, Bovine  MMBT08196
atgtttggggaaggctggagggagtggcaagaaatgaagctatgcaggtaggctgaggctagaaagaggccagatcttgaagggcttggaatgttaaaatgagaaattcccagcaccgagcacagtgcctgacagacagcaagtggtccagtgtatcaacggagagaagggatgacaagctcttaatgaatcacaggaagccactgaagaatactcatcagaaagaccacgatcaactctattgtcaaaaccattctttgagcacagccactctggaaaacagtttggcattttgtcctraagttgaaatattcacacatgctstaacccaggagtcccacaagagaagtgctcactgtagacaatgggaggcatgtgtaagaatggtcacagcagcacgagtcatcctaacaaaagcctaaaaaccaaccaaatggccaccatcagaagagaggatgaatgaactctagtatattcacacagtggaatattacatggaaatcaaaacaaagtacaatgacatgcaacaatacagatggattttgacaataagtcatttaatgaaggtattccccaaaggattatatacaaggtaagtac

SEQ ID NO: 20169 - DNA, 600 bp, Bovine  MMBT11721
caataatttgaatgaacatycatcatctcacatagctatggaatcaaagaaatggattttctttgtgtgtggtgaggactcaagatttactctcctaaaaacttttgtatttaatatagagcagtgttaattttacatattttgttgaagagaaagtcccaggtcatcacagttttaatatgcactttataactggaaatttaagtactgtttgacagtcttcattcatttcctcctccctttactccctgtctctggtaaccagaaatttgcttcatttttttctttgtttttgaagtrtaattggtctgtactatgttagttcctgttatacaacytastgagttttttttctgtgcattttgaaatgatcaccacaaaaggtctagggtgctcaagggaggaggtgagatcagtgtcttcctactccactatcttgatcacacttttgtaatcattccactcagaaagcatgttgtataccttttcagctagatcctctagcatttttatcctaggaattttcaagartcagtctgacatttcatcatctagactatctctggttctgctttcattgactctttccttattgttcac

SEQ ID NO: 20170 - DNA, 600 bp, Bovine  MMBT13834
gtggggtggagccagaagggggagaaacactaggttacacaccatcagtctacctgcaggtttactttccatgccaaacaagaaaatgctacgaatatgactcccagcaacggactccacagaacgccacgcctccggattgtcaacctggaagtgatcgcagcaaaacggttgagtgcttgttgactgaataaccactgtcagtccaaatccttcatttgacagggtgaggaaaatgagacccagagctggaaaaatttgtacaggacagctggaatgggatgttgagtatgaataggytttggagtcaaacgtgsrttggaattcaaatgaccttgagcaatcccctcaactccacttcctcctctgataataacagatgtaagtgacaacccaatagttgatgcagggaatatttgctacgygaagcaggcataatgctaagcattttgcattttagtagttttcttcatctgttaaaaggaaacaatrcctctttcttggctgttgcaaaaatgacatgatacaatgtatataaaacagccagcacaaagaacttggccaaaaaggtgctctagaaatctcagctcatttgctcca

SEQ ID NO: 20171 - DNA, 600 bp, Bovine  MMBT21995
gggggagaaacactaggttacacaccatcagtctacctgcaggtttactttccatgccaaacaagaaaatgctacgaatatgactcccagcaacggactccacagaacgccacgcctccggattgtcaacctggaagtgatcgcagcaaaacggttgagtgcttgttgactgaataaccactgtcagtccaaatccttcatttgacagggtgaggaaaatgagacccagagctggaaaaatttgtacaggacagctggaatgggatgttgagtatgaataggytttggagtcaaacgtgsrttggaattcaaatgaccttgagcaatcccctcaactccacttcctcctctgataataacagatgtaagtgacaacccaatagttgatgcagggaatatttgctacgygaagcaggcataatgctaagcattttgcattttagtagttttcttcatctgttaaaaggaaacaatrcctctttcttggctgttgcaaaaatgacatgatacaatgtatataaaacagccagcacaaagaacttggccaaaaaggtgctctagaaatctcagctcatttgctccaaggtcataaactccacc

SEQ ID NO: 20172 - DNA, 600 bp, Bovine  MMBT15261
accttcgaagcactgtaggtgcgatgagtttatttctgccatatttattggctcaccaaatatgttcttacaatctaggattctgagctgtggcaaagtctggagcataactgctctgtatccttggaaacaaatcattcaaatgaaaactcaagcataaaaaaaaggttagttacgtttagaataaagtaaacttatcagctaccacatatatcacctgaatgataaaattagtcctggaatggaactaataaactaacaaaatctactcatcttctccagtgtgcaatcattaaatayagaacaaacaaaacattatgcccaaatccctctaaacaatcatcctgatgaaatcagaaagttartatcatttctgcattgttcataaaactgccttaaaggtataaatgcacgaaacaagtggcaatgtaytctagacaggaggccaaacatacctcttccttatctgtaatacaactagtacacatgtaaatcaggatgttaagaataacaatcagagatcaaaattttgctagtgagtctataagtattaactaccttaaacatttccactttctcctcttacatataactaggatg

SEQ ID NO: 20173 - DNA, 600 bp, Bovine  MMBT04116
tctctaaacaaagatacatactttagatgaaaagtaattaaattctatgctgtgttgagtgatcaacttacccaggtggtgctagtggtaaagaacccgtggctaaccatatacagacttctttgtatatgggagagagggttaactttctatgattaaagttttaagatttcaagcaaagttcaactaaagagaaaagaaaaaatcagtcattgtttcagactatttatttttttaggcagcttgtgggatcttagttccctgaccaggcttcgaacgcgggccctcagcagtgaaagygtggagtcttaaccaccagggaatccctgaacaatttayggataatctctattgctttcttcatagtcaaagactttggcatagtcaataaagcagaaatagatgtttttctggaactctcatgcttttttgatgatccagcgaatgttaccaacttgatctctggttcctctgccttttctaaaaccagcttgaacatcaggaagttcacagttcacgtattgctgaagcctggcttggagaattttaagcattaactttactagcatataagatgagtgcaattgtgaagtagtctga

SEQ ID NO: 20174 - DNA, 600 bp, Bovine  MMBT17843
tagcatggtcttgcctccttctgctggatacagagttctctttaataatcagatttagcaaacccctaagcttcgccccttggttttctgtagccttcccactgtgccatccgcttcctggaagaagagcgtggtaagagcaagtgagtctggagcttccgagttctagaccgtacattgccaccttgcaattcaaccctccttctccaggcctcagggttgtttttttttttaagtttttgagccaatggcaacattcattgggtcccttacgacctgaacgtttaacgaggctgggcrattgcccccgcttgccaaggagcctggggtggaattaggagttttttagtacttttcactgggacaaaggagtgtgctgtccctgcccccacccgagggcagggtgtctgtaggagctgggtcttagatgaggaaatgcaagtgcgaaagctctgtcctgcagtgcgtgatggctttactgtgagaagtcacagggactccagggtcactccgctccagttatgcagcgggctttcggggagctcaccccatgggacggggcctcttcctccagctttccgctcaatcccaagacgctcc

SEQ ID NO: 20175 - DNA, 600 bp, Bovine  MMBT07590
ttattattttaccttgttttactattttcccatctttctgcatttctttcctttcttttttgcatttctccaattaaattttttctttgattgaagtttttctacagacaaaaggcagagagaagacatgagggtgcgatctgttctgggaagaccccataggatcctgcttggttaccatagcaattccagccaataacatgaggagaaaaagcactccacctaagctcatgtgatctgcagaattgtgagagatagtatttttaagctgtctgtgtgtgtgtggaggaggggtgtggwtggtacacagcaataggcaactgacacaagagaaccatatacttggaaatgcatcaaaaacgtctagattataggatttagcctatgatctcagatgttcccaatgcacatccttctaaaagtctacttgcctcctcccctgtccaaagaaccaccttcctctaaaaggacagccacaactcaggcatttagaaggacgcattgaatttctgtttggactgatctcatcrgtcctttggggagttttgctctcccatttcttacaacagcagagacaaagaaatattcttaaaagaaaca

SEQ ID NO: 20176 - DNA, 598 bp, Bovine  MMBT10313
  misc_feature (1)..(136): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttgtaactactggcatcctgaccaatggagttaaaaatcagagtaggcaagaaagaggcagaggctgaactgctamaagggaggaagacacatgtctctttaggaggctgtgggcatctgaggccagtgctgaaacttggtttgaaagctgcccaagctcygaggcctttaggtagtgagattaacaagcttagctgtataaatcaaacctacattattagaaaagtttgacatttgctaaattacctatgaaaacttaccctggttgttaagaagaacccaaaaaaagtatattcatttccaagctaaatgtcaagctcccttaaagatctaacacctacagatgagggaaggggcaggggaggaaatgccatcaaattaagggcaataaactttccagacatcttcatctccataactgctcagagatgtctcctggcatttcttactgggtaattc

SEQ ID NO: 20177 - DNA, 604 bp, Bovine  MMBT08379
  misc_feature (1)..(4): n is any nucleotide
nnnnataataaaaagcatttgtaatcccattgctctgactcaaaaccaagaataattttttgacatccttctgcaacaaaaatgcctgtttttatatatgcttttgtgtttggaaatgtgaagtctactctgtctttgaaaaccagaaaaagcaatatttattctgtgccgcacctgatattttctttgcccagcaaatgttaccccaaattacatgatgtggtaatttataatgttacctgactaatgctttagctacctggtttaccttctatgaaatgtagattgaaaaataataggtttyctcacaaaggtgaaaatgtttctcttagacataaattagtttctatttacaaagctgctatatttattcagcatatctcaaaggaaaattgttttccaaaatgattgttatgagacacacatttcttcatcattccgtcagagtcctgtaatggatttgatgcagatttcttttagagaggcttatcttttggtcctaatatatagggacatgctgggaattgcatgtctgcaaatatcggggtcttggggaagggwcatgagaagagactagyatagccagaccaggcagtgcagttgt

SEQ ID NO: 20178 - DNA, 596 bp, Bovine  MMBT18831
  misc_feature (1)..(1): n is any nucleotide
natgaatttacctatcccctcccattttgcacacatgtaaatattctatacatgctagtcacaaacttgctttttttttttttttttttgcttaatataccttggaatatttattaaacttgtcacctggtatgtgctggacacccttacaggaagcattaagtgaaatacacaaatattctacttctaattttcatcaaagcattcttctagaaattgtcataaactaagacattaattggactgcatttctccatattaacagtactgtaactggaggattgcatctctgattaatgamcaacatcaaataaattatagccatgaccaaaatattaagtcaaagatagaaaagaaacttttatattagtattaaatagttgatatttccccaaatcataaattatacacatataaatacaaatttccaaatgattatataagcctcagtgcatgtaaacagcagtatatatgcttttaccataaattttatctatctaaaaatgtgctcatgacaaatacatttgatgatatttttcttgtcttcttagaatttttaaggggatatattggaggggcagatttgatgcccaaat

SEQ ID NO: 20179 - DNA, 600 bp, Bovine  MMBT02682
gtgcctttcaaagaagtcagcaaggctggcctccaggaaatattgcctttgatgtaacatctggttttcagggaatttctgtgtagtgcccaatcagagggcggactaaagggcagagaaaccaagtgacttgcccagagtcatgtaagtagttactgacttaacctggattacctgcagtttctatttgttgcttaaagtcctagcctgcttatttccattctgtaagttgtatagagactgtacacatagatatagtcattcccctcccttcatgaatagatgtgtgtggatctttaygactaattacagatttatttgcatctttctttttgatgtttcctccytgtaacttgagaagaaaggaaaatttcctgttatcctctgctttgttaaaaaaatgatttgaagtaacagtgagttgttattgattgcaaaatcttctttagaagtgaactgatctttttccttgcaaggaaaatggagagttaaattgtatggacaactcacttgatttgagggcaactggaaggcatcatcactggcatcatcaatgttcaacctttcccccttgtcttggcttctccattttyccctcct

SEQ ID NO: 20180 - DNA, 600 bp, Bovine  MMBT14001
tccggtttctggtagcgaagccagagcatgccagcaatggccagggccacgcagagccagttgaagaagctgaagaagttgatgacggagaagatatctttggagaaggcatagagcagggtcatgatgcactgcaagcagagggcaggccatgagcctcaggatgagccagggggagggatgaccgcacgcaccccttcttagcagaagaagtggtccgcaccacgcgagggccctcagagcaaagggacgtgctgatggcaggtggctgaggtcctgggcttcatggaggtggcagargccatgtctaccctggtcgagaggtttggcttcaagtgcctctatgctgattttagatttttttttttaacaactaccgtgtattaattctggagaaacaaaaaactgtcttatgctctctggcatccaggggcgcatgtgatgaagggtactacacttgtgataacctatctacatctcatctcagcctctgatccccagcctggctgacaccaggtggaaccagcaaaaggggtccccagacagggcatgcaccaccatctcaaagcccccgtgatccccaagggacacacctgtcct

SEQ ID NO: 20181 - DNA, 600 bp, Bovine  MMBT16797
gataccttccccagtgtgcgtggtttcggagccaggcgctggggttggcttctagtccatgcatcactgtatccccataatccataaagggcttattgaacctgcagaagagagtgcatacagttagcgggaggcagtttaacctaagatcacatactgaaaagtcaggagacacatagcaaggcagaacccagctggaatggaaagaacactggggcaggcacccaagttctagttcagacttttgacacctggtggtatttccctgatggcttgttttccttacctgtcaatcggggyggtgactacataacaagggtaataacacacatattgcataggtacaggtgttctcatatccatgattctattggatcctcacgacaattctctgaggcacrgttaggcayggattgtttatgtccaatttacagatgagccagctggataagcacaatggtctgactgagatcagctaatgagtcacggaagagcctccttaggtccctgccccaaatgcttttctgtttttctgggccttgttgaaggacattaagaagtgaaatcttattacctgggatgtttctgggatgtctctga

SEQ ID NO: 20182 - DNA, 600 bp, Bovine  MMBT13286
ctattttacacttcatatatgatcagtgtatttcacacgttcaattagaccccaataaaactgtgtctaaaaaaaggaaaatcaggttcctatttacaatagagagaactagttacagaacatacacaaataattgtatcactgaaaaagcagaaaaagttcaccagcaggacatttttatattatttgttgagaatcaattcagaggtagaagacattagtaatacatatgcattgtagaaaatgattttattttagcaaatatatgagaacttacccacttagccaaataaatgctgytttccccaaaacaagactgtgagaataaaaagtcttattctgacacgtggcccccgctcaacacaatttttggactgtctcctggatttgaaattgccttcagtccccacttatgaggaacataagaaaactacttttattgttttatgatcacacctggtaaatgaaatccgtattacatttcccactttaaagccaggatttataaaatatatctgaccaacaacccaattttgccagtataaacttctgccttttgacaactgccttcatgactatttttttttaaagccaaccact

SEQ ID NO: 20183 - DNA, 600 bp, Bovine  MMBT08320
cattgccagtcatcctttttctttttttaaagccttcctttgatgtagaccatttttaaagtcttcattgaatttgttacaatattgcttctgttttatgtwttttggctgccagcacatgagatcttagttccctgaccagggatcaaaccccatgccttagaaggtgaagtcttaaccactggaccaccagggaagtccctctgtcatccttaatatttattttttccagcttatttgaccttttatcttttgttgtttctttttactctacgcttctttggcacctcttgatctccyccttttgtaggtgcctccaactaagcagagtaacccttctctccctttgcttcttggcaggttcccttctaagcagtatgcgtacgtgcatgctaagttgcttcagtcatatccaactctttgtgaccccatggactgtagcccgccaaggctcctctgtccatgggattctccaggcaaaaatactggagtggactgccatttcctcctccaggggatcttcccgaccccgtgatcgaacctgtatctcctgcattgcaggcggattctttaccactgagctacctaggaagccctctc

SEQ ID NO: 20184 - DNA, 600 bp, Bovine  MMBT08338
tttcctttctccaggggatctttccarcccagggatcaaagccaggtctcccacatygcaggcagattctttaccaagcgagccacaaaggaagtccaagaatactggagtgggtagcctatctcagttgattcaagagggactgtatgwaaagtgctttactaaattayataaaggccaattgtttctatattaacatctcttttttggttgtgccataggctccagcctgaacttatggctaaagaaaatcagactttgcctgaattcctccttctgggattctccgacctcagggcmctgcaaggccccctrttctggggggtgttgctggtctacctggtgaccttgctgggtaactctctgatcatcctcctcacacaggccagccccaccctacacgctcccatgtacttctttctgcgccacctctccctggtggagctactctacaccaccgacattgtgcccaggacactggctgacctggccttccygcacccccgtgccatctccttctggggctgtgcagcccagatgtatgtcttcattgtcctgggcatttcagagtgctgcctgctcacagccatggcctatgac

SEQ ID NO: 20185 - DNA, 600 bp, Bovine  MMBT09998
tgatgaaaaactaaagcattaaataaaaatattgtttttagaaatacagagcaccatgaaaaatgatcttttgctaagtgaaaaaaaatgtattaaatgttaagtatacaatcattacagctttgtaaaatacagatgtagcaggaaaagaatataaagattcattcatacattagtggttagtgagttcactgatgacttcttttttcagagtaatttcagtaaagacttttattgtgtgctaacttgcttcagtcatgttcaactccttgcgaccctacrcattgtagcccacctggyttctctgtccatgggattttccaggcttaattcatataacaacaaactatggtttgtattctarttggcattatctgcttaacaaatttcacttgtatatcattcctctttgtcttctattttctgtcatcacacaaaggaaatatacacaagtatggatttataaagttaaaaaaaaaagtctctttttcccccmaaagttttcaacacagaggtatagagcaatgtttaccaatcaaattgtttatgcaaataactgcatctagattggcctgtaastawgtgcagtggaaacgatca

SEQ ID NO: 20186 - DNA, 600 bp, Bovine  MMBT16347
caaaattttattttgttgcagttttctttagaaaaaaaccttttgtcatgatgttataatgaattcagaggaaatagctgttttatagtacagagaaaaatgactccatctaaatattgccctttctaaattccaaattcacttgaaaagttatttgattccattttaaacagccactttttggtcattttaaagcttgattgaaaacaaagattaagtgaaaaaatagaatttacttaataaattatgtttaaaattattatttgcagtttcactattaaagacaataatgaggactgratactggcaaattttgaagtcacatgataaggttatcaccttcatagacttgcagctttaaaacaggcttccctagtaagtcagacagtaaagaatctgcttacaatgagggatacctgggtttgatccctgggttgggaaaatcccctggaagagggcgtgacaacctattccagtattcttgcctggagaatcccyatggacagaggagcctggagggctagagttcctgggatctcaaagtgtcagatgtgactcaccatagcacagcacaactttagaataaacatattaacaggc

SEQ ID NO: 20187 - DNA, 598 bp, Bovine  MMBT18628
  misc_feature (1)..(46): n is any nucleotide
nnnnnnnnnnnnnnnnnnnnnnnnnnnnnnnnnnnnnnnnnnnnnnacaggccttcaagaatttcaacagatttggggtctggaagaagaaatgggaggcacatgtccaggcagagacaatttacgcaaatgagttagctgctttgtaaaaagttggtaggaaatatagcaagcagttcagttttgcttgagaaccagcactccattatgtaaaggggcagtgcagggtaaggctggaaaagggacattcaactggacaaatgtcagattaagcagttttacctaatttgacaggaaacyactgataatttttaaaatagggtggagctgtgatctggccactgctttagggagatggttctggcaagaacaccaaatggaytgaagggaaagcaactaagcggaagaccaaataggaaactacagcaaaagtctagatgagaggtaaccagtagctgacygagggcagtggcaatggggacacagaggcaggggcggatggaaaagacactgggtaggaaaggtctataactctgtctaattcggtaccccccagccccatgtggctatctaaattgaatttatgtacactaaagtt

SEQ ID NO: 20188 - DNA, 598 bp, Bovine  MMBT10434
  misc_feature (1)..(10): n is any nucleotide
nnnnnnnnnntacaggaatgccctgcatgtacagatgttacaagttctctaaatgactgaggtgaaaattctatgaactgttttctctggagatggtgctctgaagtataatgtttttatttcatttttttgttctttgtagtatatggaatatggcatttatcataatttaaattttaggggataaaactaaaaaaaatttgaagaaattttacatgaggcaaaatggctatgactagaaatagatattaaatgcacatttataaatacataaaagcaaaatgcccatgtgcctcctcyactctgtctgtggagatagcatatattttcttaaaagctgcatgtttcttgaatctcaatccaaatcatatggcaagcrtgttggaaacaacaggcacgcatgtcaggggctaaggcaccaggcaaccctggcacactgtcaggccaactgctggactgctgcttggcatyrctacaaagctcccctgctggcagctcatgttccaggctcctggctgggctttgccatttgccctgcatcgtcgtgggcaggtaggcaggcaggaaggcacaagcggggatagttgagcaatgtggg

SEQ ID NO: 20189 - DNA, 602 bp, Bovine  MMBT12717; identical to SEQ ID NO: 4540
  misc_feature (1)..(2): n is any nucleotide

SEQ ID NO: 20190 - DNA, 600 bp, Bovine  MMBT04400
tgaaagccaggtatcagcagggtcactcactctgggtgaagcctttcctgcctcttcgtagcctgtgacagtgctgtcaactcctggtgccccttggcgcacagctgcatcactccagtctctgcccttgtcatcacaaggtgtttcctatgtgtccacattttcccctcgtcctgtaaggccattggtcaggctggactgggactgccctaatgacttcatcttacttgataacatctgcaaaggctccatcatcaaataaggtcacattcaagggcaccaggtattaggaccatgacytatcttttgrgggaacacaattcaagccgttacagatctcagtgacaaagcaagaagatacattttctttgcaaatgtgcttgtggcaggagaaaacttatcttggattttttcagatacatgtctgtatctgcatatttatcatataaataaagtcaatattctcctcaaatcttacaaatcttttttatattatcagttgtatctcatgtttcatttctggttctattgcttctatatatgttctttctttgatcaattgaactaatggctttgtgaattttttcaaaggcttaaata

SEQ ID NO: 20191 - DNA, 600 bp, Bovine  MMBT12866
tatgtttttttttccaaaccttcagtgaagtttctagaactatgcagtgaacaccccaacacacctaccgcccacattccacaactgttggcgttttaccatatttcttttctcacatatttgtccttctaaccacctaccaatccatatatgcatatatatattaatattattgatacatttcaaagtaatgctacagtccaattatttgatttctgatatttcacacaaaggctggcctcaaaataattcttcctctcactttcaactgacccactccctgcagaccccaggtcccaktgtgaaaccccagcctctaacaccactgcagacctgatgaatgcctctccttcagggcctttgtctggggctttgtctgaggcttttgttagccctttctaccctggatgaaatcaccattcaccctcaccctctcctcttcaaccatctaatgtttccatcctaagcctgtcaggctaccatgaaatgaatatttctaaagcccaactttacatttgatttcagccaagaagagtggtattttcacacagttctcagtataaatgatccctccagctgttcttaaggaaatgagcctgg

SEQ ID NO: 20192 - DNA, 600 bp, Bovine  MMBT18761
tctgggctgctgaaagcacatctctctgcttctttttgaaacatgcagccacggactctaagggaaaagaacttccaaacacctctgtaaaacacacagagggactctgtagcagtcaggtaacctgagcagaatctgggcwtttaaatgaagtggggcagtttctcacaagtttggcagatagacaaagccctggttccgagagagygtggcctgtagcagagaacaggaagcgatggtccaggatccgagagaggggtccttcctgcaggcatgggatgagcctctastatytgatcrgacactgacaatgaaaggtaacactttctatgcacactagaactttacaggttatatgtgatctatgggcttcccatgtggttcagtggtgaagaatccacctgccaatgcaggagtttcgggtttgatccctgggttgggaagattccctggagaaggaaatggcaacccacttcggtattcttgcttggagagtcccatgggcagaggaacctggcaggctgcagtccacggggttgcaaagaggcagacacgactgagcgactgaacaaagtcatctatgctttacacctcacacac

SEQ ID NO: 20193 - DNA, 600 bp, Bovine  MMBT22451
ctgaagcaacttagcttcttaaaaaaagaaagggaaagctttttttttwatggatrcatgccagttaatgaatgtggagggaatgatagagtcagaaatttacattttacagcttccaacctaaccactgatttaggcgaggataatcgataaaagctaagatcacagccaaatgatgaggttcaggaaggaatctcagccctacactgatcctcaagcccccaaatcaggatcccacacttcactgaagcccagacaaaggagaggaccacagttaagacaggttccagataggcttaktaggttatttaaataaaatcaggtgaccgtttctgcaggtaaaaggccaggagaattaccaggggaggaatttccctttcctcacatctgcctcactgtagccattcccctggggatgccaggtctgggcagtgatcagaaccaggacagcacctgccagtggygatgtctgcagtcatcccagcccccaaagcctacctgcagagtcctggmtacggaacacgtggctctcctccggtggctatcctctgggcacggaagaggggrttctctgctgccaggcctcttggagccgagata

SEQ ID NO: 20194 - DNA, 600 bp, Bovine  MMBT22455
acagccaaatgatgaggttcaggaaggaatctcagccctacactgatcctcaagcccccaaatcaggatcccacacttcactgaagcccagacaaaggagaggaccacagttaagacaggttccagataggcttaktaggttatttaaataaaatcaggtgaccgtttctgcaggtaaaaggccaggagaattaccaggggaggaatttccctttcctcacatctgcctcactgtagccattcccctggggatgccaggtctgggcagtgatcagaaccaggacagcacctgccagtggygatgtctgcagtcatcccagcccccaaagcctacctgcagagtcctggmtacggaacacgtggctctcctccggtggctatcctctgggcacggaagaggggrttctctgctgccaggcctcttggagccgagatagaagggacagcaacagagagtccagcacagccagcccctcccaggaacaccgaagacccctggaacaagaggcctggctgtgactgccccttcttactagtttcaatcctcaccctctgccaatgccaaggccctggcgccagaggcccttccttgtcaatctt

SEQ ID NO: 20195 - DNA, 600 bp, Bovine  MMBT11854
gattctgttttacatctcccccaattcccaactgaatgtcttttatccatcaccagtggtttagtcattaattcatgcattacatatttgcagcagaagccaaatatgttcagttacaatggattcacaaggatctgttcagactgtgattatctgtggggagwatctgaaacatctcaaaagaagtctaggactttggtggtagggtatctgaaagccaacgcccatgcaatctgtattatataatcctatacaatgttaggcaaaccaagaattatattctccatgttttggagatgrtaaaactgaatccaacgaggtaaagtgattggtgcaaagtttagggcctgcacagagactggaatctgagattctgactcctggcccctctgcttcccatacatcctgtgctcctctccccagagaatcaacagctcttggagaggaattttgattccttgagaaagggcaagcttgtggaagtgctggactggaaatgacaggatctctggaagagcctttagagaaaactaggaagaagctctcattttattcataatctagttatcccctggatgcttactcagcctccagagactt

SEQ ID NO: 20196 - DNA, 600 bp, Bovine  MMBT10616
agtttaaaaaatagggtgggaaatcccgtgacatcaaagtgaagctaagcgttcctaaatggaactcatcatacaattttcgtatttgagtgtcagaaggaaaagctataatctgctttatcattctttttatgtcatgcaaagcaaacactttttctaaatgatgctcaacacggactttaaaagttttttctttttttttttttcacatcattcaaactggtagaagctttctttaatgcccaggccaaatcaaaaatgacttaatggccagaccaaattggtcgttcaatttcaagrtctaccaaaacaaattgactgtgtctttttatccagatcgtcagatagagacctattaggatggccgatccacttcttaaaaaaaaaaaaaaacttaatttcagctttgtgtgagctctaacttacccagaagcagattcaactgcctttatccgcaggttttctttcttttttttttttttttttgcaggttttcttaaataaacccacagtacagcctttcacgaccatgcttccatggactgtatatggatttatttgggaattaagcacttgactcttttagcccatggtttaccc

SEQ ID NO: 20197 - DNA, 601 bp, Bovine  MMBT02629
  misc_feature (1)..(1): n is any nucleotide
nacctccggcctccaggagcccctggaaggtgtttgctaggtgctggcccgttcacatttgcactttgccgtatctctaggctgtagggagaagactagttgcctctctggctctggaatccctatggggcacaagcctgaaaactgcttgcctcctcagtagctttaaatcacggcagtacaagacagataccaccacatctcttttgatttcacagatttggaattagggctcctcttaaaaaaaaattgcatttagaatagtgcgatcaacatgtaaatttattcaaaacatggaagygcgtgtttggattttcttgaaagttatttggggctggctgatcttttcccgcccagcgcaggcctccctgggccagccctgctgtcttgtgggggtcccgagcccttttcatcgaatctggccagctggacagccccagccctgcacactctggggcctctgccgtggagagtgtatttcccacaattgggtctccatccgtgcagaggagaaagaggccctcacaggactgacaggtaggcttctggttggggaggcccaaggcagtgggagccccaagcccagtgggcccagagggct

SEQ ID NO: 20198 - DNA, 600 bp, Bovine  MMBT02678
tcaaatcctgtgaccagcacatgaagctataaaacactgttctgctgatgcagtaattgtctgacatggctacctggttccaactcctgcttagtatgcaaatctgctccaagaatgcatttgacaatcacttttctgtccgcagaaactgccccttgacagaaaatgtattcctaaaatgactttttttttttttgcctttaaaactaaagcttgcaagtccagtggtagctgagagcaacaacatatgcttataattatgattaccatcagggaattcaaccgtacagagggaagggraagaggcccggcaagggggagcacaaaagctctgaaatacggcagaggaagcacacccagccaggttggctattctgggtaacgggagaaacttgattgtagaaaccaacacyggtttccctccagactcgaaagaaatgttgcgtgggcagaatgagaaatgctgacagacaaaatcaagccttagggatttgcctttcatggtgggctaaaggagcctgcataaaaaggcagccttgtcctgtacctgcccgcagcatggacctttatacccggtggccactcactccagccctgtac

SEQ ID NO: 20199 - DNA, 600 bp, Bovine  MMBT00596
ttttaaaggggcttttctgaaaagtaaaatgtaaatataggacatgtgggaagggtggggccttctgcagatgtcctgcaggtggacaaatagccttttaaattttactttttaaccatcttaaccgtgtgtgcctatttgtactgcagatgtgaaatatttgggggggttaatatcagtatgttttgaaactgaattattacataaaatcagagtaacctctttctccatcctccttttccacactgactattcttgccaaatatttctactgaaaccaattttcagcatggtaaaackatggacactcaaacctccttcttcatcttccctatcctgtcttacacccggtctggccttatatttttttgttggcttttcataagtaagaacaatttactgtagtttagagactgcagaatttcaaaatgtttatctataagccttcctttgttaatgttcggttacacagtcatattagttaaaacagtggagtcagtggagtgagtctgagttcttaatatgctgtaagataaaatcttgactgatactaaacttgacggctgcatactattaagaggaaattggattacatggtgg

SEQ ID NO: 20200 - DNA, 600 bp, Bovine  MMBT05893
aacctagctaacctaggaaaataagtttttattcattcagttaatacacatgtatactctagattctaaatccaaactctctttaggattttctctatcatttgataacaaaytacagctatggtaaaaacagtattatgctactaccagctttactgaaaagctagtcctaatctaaaaatatttctctctttatccctttcttctttaattttctatttcctccctttccctccttgccctaacaacaacaacaacaaaacagctaagactccttagtatgatggttccacagacaamatgtagacctcagagttgctaggtgtctgtaaagggctcaagtcctttgagaaacaaagaccaatatagtcagactttctgctgactgtactaggatcagacccaggaggctttggggatttttcataactggaggtttgtacactttttcactgccttcatccaattcccccttcctatacccacccgcccccaactctccacctctgataaccacaattctgatctttttttttttttatgcatttgttcatttgattgtgtttgaagcataactgacctaaaacacggtgttagttt

SEQ ID NO: 20201 - DNA, 600 bp, Bovine  MMBT08168
cctccatttgcatgtgaagtcaaaagcttccgttttactcccagagtccagcgcctgaatgagcttgaggtgagtgatttcttcatgtcaggacttcaggtggagacctttgagaaactcatgaactgaggctcagagttaatgtgaatcgtgactgaatggaaggaagcttctgatttttaaaaaagttgtttataacagttaaagttttttctacttaactgggattatggggaactatctgctttcttcggtgcttattattctgctaaacttttttgttgttgttagtgttggaarattctctatcctgtagtcttttgggaaatatttttaaaaaytattctattaaaacctagtttcagaggggttttttycccccctctgacagaacttttctaggactcgattgatttattgagatctttctttaaatactcctgatctgtcttaactttccagtttgaaatttgtttaaatagttgttccyttcgcttgctagattttcaaaggatgcttcaatgtggataaaaactgttctagaatacaaaagagagatcttaaagatcgttaaggcttaatgtgttatgctgtttgttt

SEQ ID NO: 20202 - DNA, 600 bp, Bovine  MMBT19989
atgtaattttaaaacatagcatatccaactatgggttataaggaaataaggatgtggcaaattctaaagtaactttagaaagtctctgctttgagttagttagggattattttgttagtaatggaataaaaaagagtgttgacagtataaataactgtgacatttatttaaaaaaaaaaatgtttcttgaacaggcagaagtatcagagattcctctrtaaattttgtatatttgaaaaatatcacattcaataaaaagtttctgtaagtacactttcacaaacaaattctgtgaaataytggtcttgttctacagtaatgtgtataaactccaagtaaaacctgattaccagttgagtatctttgtttatgataatataactatgtgcaactttgattagcaaagaagaaaagtcaagttcttaacttctggaatgagttttcttcaccaggtaaaatgctttaaatgaaaacaataaaataggtattaatatgctatgaaaattagaatataaaatgtatattatagtagtaaaaacttctagctttctattttttatgtcacatggaacgattacgtatttttatgtgcaaacgact

SEQ ID NO: 20203 - DNA, 600 bp, Bovine  MMBT04176
atggcgttaataaatcaccttcattgcatttatccaggtcgagagaacaaaagagatggtgaaaaacaggagagataaaaactgggggaaattttcattcaaagactgtcatttctagattggattgtgaaaaagaaaatatttcatggtagaaaaaaaaaatatatatatatatatataaacagcagagtgcctaatatgggtctgcaggaatgatgctggctgctggagatacagagccaatamgcttggtcctgagtctctcagtcttgaggaagaaaaaacaggcaaattgcaackgtaacattgtataaatattataatacctaaagcacagatggctgtgttttggttgttttgtttctttttcttgaatctgyattggctagcsagagaaatctccttggagaataccaagaaaaatacaaccataattaggagcagaagcccaaattctggaaataggaagcagaagagaatatacattctttcgcctgctctgtgttggtacagatctggcaggtgtgaatttgcatataagtaaccacttcaggtagacacaggtcagcacctgcattcacaaacacaggtggttgggca

SEQ ID NO: 20204 - DNA, 600 bp, Bovine  MMBT03173
cctaagggggctaactcactacttctcactcctctttgtagagaagttatccaaaatccttagtagatattcaaagccttccatgactgttcccttcctacagttccagcctttccttctatctctctccctaatgtcaaaggtgtagctaagctgggcaactgagcatttcctgaacatgcccactgctttctcatcctgtgcttttgtgtatgcagcgttctcccccatcagggatgccagcttctcacattccacctgttgaaattcaacctatccctcaaaatccaattcaaattygagtttatctattaatacaaagtcctacctggctctacatccccaaatcttccctactgtaatgaatttctctttccccttggcaatatcaatatacagaattatcagattttgcctaatttaattaccagaaagtatttctctcattcaaaaaatacaatttaagggactttaactttttctctatgtttatcttcgttcctagaaagtcatcttgtctagaatacttagcagatttatgtgataaacttctggttggtaggacccaacctccagattgcatgaatatttaatgagaag

SEQ ID NO: 20205 - DNA, 600 bp, Bovine  MMBT07878
tttttagatataaggaaagttttagaatatagaaagcacaggtattctgacttaatttctcatgcaaaatattttcctaatcctacttgtatttttactgcactttttggatcaattttaatttgcatgactgttgaaataaattagatgagaaaagaaaatcggcatacatttcctataaaagtcagaaaatttgcatcagtttgaaattcttgcatgtctatcctaggagaaaagtatcattartaatctcatttagcaagtgaagaaataggtttggaaaagatgaagcctttgctsaagttcatgtaactttaagtggcaggaccagggcgctaaccagtgcagccttaatctatcaactgctctgtgttttttccattaaccaggtgaagtgatggcaatttgcaagtaacatcttgcctatgctttcctcaatacacatttacacccacagaccactgccctgtctcttaggcactgtgtgtgtgagtgagcacgtgcrtgtgttttcatatattcagtacaagaattgtaatatttagttcttattcaaaccagtttgtttgataaaagttctagggtgaaaatgttaaaaac

SEQ ID NO: 20206 - DNA, 600 bp, Bovine  MMBT12370
tatgatattattgcttctacaccaacggactcctactattactatatgattgcttcctttaaatctgactaaactggagtggtgaaagttggagtgactttattggcttctgagaacatgtatgcattcaatgaagtcagaaacaatttcatccatgtgtgccccgatggctttgtaaatagggtttcagaatcataattcaaagtatcaataaaggaattgcttagttatccagaaaggtttactctataaggcacataggtatccttgctgaatgaaaacttgacccaaagtggagtyaacagggaargctgtgggtcagactgyttggattcaaatcccagttctgtcactcacccgccaggaaacttggctgggacatttctctgtgcttcgatctgtcctgtgccacctgagggttttaatggtgtctgggacttggcggtttttaacacatactggtgcttagaacagtgccgggcacctggtggtgacttaataaatgccaatgacgatgattaatatttcccmaaaatgttagtgcttttgaaattgtacccattaaatattacttggcgttttccttcagactctgggtca

SEQ ID NO: 20207 - DNA, 598 bp, Bovine  MMBT14223
  misc_feature (1)..(38): n is any nucleotide
nnnnnnnnnnnnnnnnnnnnnnnnnnnnnnnnnnnnnnatggaagcttgataaaaagatgagatttgaagtactcaacctgttaggaataagtagttttattgttgatttaagctggtagattgaaatatctcagaatgctaaagaggcagagcagcaggtttcaggtgattaaagaaaatccctcatcttggaggaacttgaagggacatgatgctatttaagtagaatctaatcagaaagaagaaaagcttgaaagtaaaaagacggaatgtttcatgtcgttatttgcaaagcaacygaacaaaaggtgagcaagataattaagtgccttgstgctgagtagaatttttcaaagtgggttgattagaggtctttcttaaaaaaaaaaaawttaaacatctaagtctaggaaatctagttgaaacagctaactcagttataaaggtggagaccagtttgggagaaaatcgacagtattgtgtgtatggtggcakatgttcacaatgatgagtttaattgtcagcaaaatcctgatcagttctgaatarttttagcattaatgatattttcctgtgttttaggtttttgaaaaatgg

SEQ ID NO: 20208 - DNA, 600 bp, Bovine  MMBT05935
gaacactgcagtgggttgccatttcattctccaatgcatgaaagtgaaaagtgaaagtgaagtcgctcagtcgtgtccgacttttagcgaccccatggactgcagcctaccaggctcctccgtccatgggattttccaggcaagagtactggagtggggtgccattgccttctccaaaatgctgttggcaagggtataaaaagaaataggcagtcacatgcattgttggtaggagcataaattggtaacactccaaggaagtataataatgcaatgacagccatcaaaactacaagggcrcattccctctgatccaacaattccacttctgggacttcctcctacagcaatacttgcttacatgcaaaataatgcatrttcagacccttagctataaygctgtcatagcaaaagtttgtaaagaatcttattctgtcagtaggagacaggttaatgtgtgacatccatacagtgggactcagctgatcacaagaaagtgatcgccaaagtgcgctaagaagaaaaatagcccagacagtagtccacaatttgcagagaatattttgtatttgttgaaatatgcactatctggaaagatac

SEQ ID NO: 20209 - DNA, 600 bp, Bovine  MMBT12520
acataaaattataaacttgcactgacaaccagcaaaaaaaaagcagacatggcataaaatatttaaacataaaaccaatgaagcaaaatattgcagggcaagatatagtctcccaccccaactccaagcagcttagcctttctttgctgatttcttttttctctgtttctctttttggcacacaataaacactaaaaattaattcagaaactattgtgcatctttgaactcaaatttatttggcttctgtgtgctaatatgaagtttcacctataaaatgagaagtcagagttaataaasagctattgaactgtgcccaatgmgagagacaaagctgaggctgatggttcttattacttgccactaacaccagggttgatctgaatgtctatgacagagcctttgagtgtggggaaatagtaatgtgttattcaggtacagatccagtctttttaatccagacttctgagagacagtctttatgaaagaccccactaaaaacagagtggaatcctcttcattttatgcctaacaagcacatacaagaacacacaggcatccattttacaccccacttttaagaccagggctttcctggtg

SEQ ID NO: 20210 - DNA, 600 bp, Bovine  MMBT15475
ttaatataatttagcaaagccatgaattacatgtattccttatctcactcaaaaacatgtattaagtgtctagttttccaggcatttttgttggagctgggaatacagagagacacccaaaactttcctactgtatcaaagcctacattacagtgggacaacagtcaaaattttaagtgcatacaggaaatattttaggtggagataagcgctatgaagaagagtagagtgcggaaaagtgagtgagtttgcaggcaggaaggaagatgagggacttttagctagggtggggcgaggatrctccggggaggtgatattggtgcagggaatggaacagaataagggagggagccaggcaagacctaggagaaccttctagacaatgggaacagcatgtgaaaaggtcttgaggcaggaatgaattaggtgtgttcaaaaaagaacaaaagaccagggtggctggagtgagctagggggtgaatacaaggagatgaggtcagagaggccgaggccaggacatggagtatagagtgacaaaaataacatggtgatgcccagcctgagaacaggagtactgcagattaggaaagcttctgaaca

SEQ ID NO: 20211 - DNA, 600 bp, Bovine  MMBT09028
cgatatgctcgaaatgtcctctatagacttcaaagcccagctcaaatagtagatgctcaacatttgtcccaggagaagcatcagtaagttgggcaggtggccaggataaggagccagggttggctcctcttcctgagccattgccatcaagtcctcacaccccgccacccagctcctcatctccaggagtaccaggaagggaaatggtacaagtgcctggaaagggagagactttcttctgcgtgctgagcacaaaagcgggactttggggatacaccgtggcggaggtttagcctctcmcattccayggtttaatgtataactggtcacctttcctgaatgtccgtttcttttatttgccagtaacacgttcaccttgttcrgtctccttggttacaatgcacagttccagatcccctgcagatactttaccagcctggccacctaggcgtcattttgattgacagggactttgacaccttgtctccagccccaggagcctgatcaaggctagatttccaaatcccccagatacgcccccccaaaccaccctcacccaggggccagcttctaagagccttggatattctttgagggtaa

SEQ ID NO: 20212 - DNA, 600 bp, Bovine  MMBT14070
ccggcagatggccttgccaaagggccagtggaccagagccacctgcatggccaggaagggcagacccagcatgaagagttcatctgcgatggccaggttgaggatgtagatgttggtgatggtcttcatcttggcatagcggaggatgacgtaaatgaccagtgtgttgccacacaacccaatgatgcagaccacgaagtagatgaaggtgaggacgacgttgctggccaggtcgtagtacggctctgtctggtttgaaatgttggctgcccccacggagccattgaggtcgaacggagyggtcagccaaggttgggtctcrttgagttcagacaccagatccatggctgccttctagtcttaggctagatccaacccgccagaggtcttattctcagcttcatgggtcccagaggcaaaggatccactgtgacatctgcaaggaagaaaagaagattgacttatctgccagaggttacttaagctgtcaccagcttcccgtgtttcggtttgctctctcagacgctcttcagttgaaaagtgtgttgtctttcacaccagtgtgagcactaccagctcattctcacacgcaggccattg

SEQ ID NO: 20213 - DNA, 600 bp, Bovine  MMBT10226
tctgcccccagttttagtgctaacccccactttccctgcaggccagttctatgtcatgatgacgccccaggacgtgcttcagacaggaacgcagaggacaattgcacctcggacacacccctactccccgtatgtgcaggagacctggtcccaggaataggggacgctgggagggcctgtcgtgggcacccaaaaagaggaggttttcccgggatgggaaccaggcagttgaatacacagcaggcagttggtgtattttttggtcagcttttgcttttctagtttaagtaaagaaaatamcattttctccctctctttgtctctgcatatcgatttgtcttgcagagatcatttttaagtctgactccttaataaatgtttggacacacaggctggaggtaacatgtacccatttttttccatactcttctaggaaaatcgacgggacgagaacgccacgggatgagagaaggagagctcagcataatgaaggtaaggtcaggcaggagctgctaggcctcatgggctcaaccccagctgggtgtttggagtcacagatcagtggccgggttattgatccaagtactcgagaggtgttgg

SEQ ID NO: 20214 - DNA, 600 bp, Bovine  MMBT23097
ggctgtcccagctcaagtggatgtgcagaaatatgctacagggaagaagcctgtcagataygaggagtcacaaccaacccagraggtactaggtgattctgcagttggatgtgaggctgcctaccaatcccaggcaacaaggttgaccgtcaggcagccaactgataattcacttgccactggaaatgggtctgagaatgaagccacaagggagagagagccgtgtctgccccagccctccacagatgaccagttcaagagtttcctgcccaggccacagrctgatgctgggagagtggkcagtcgatccgagcaactggtccagaagagcgcccagtgtccagtgcagatgtcacccagctccagtggctcagcccatctcaggcagccttctccagggacacrgtcagcacagcctagggctgcatccatccggtcctcagtgccagaccggggagccagacctccacccccactcaagagacgtccctggagcctagagaagagctcctgcagtgacagctttacctcacagcaggcgggcagctctcaggcccatccatctgctggccctgctcctcagccacccagtctttccca

SEQ ID NO: 20215 - DNA, 600 bp, Bovine  MMBT10469
tccatgataactttccttcttctgaagtatgctttatttggaatcaatacagtactttagttttcttttgattattgttagcacaatgtccattgctccatcctttttaaccaattggagattttaattttaaagttgacttccatcagacaacataaattgagtcttgcttttatacccattctgacaatctttgaatttaaattkgtgctctgaccatccacgttgagagttattcttaatacagttggattaatatctaacatgtttgtaactttgttctattcattgaatttattstttttccccyttttctgccttatctgctactaaatgaacatccaatatgattcccttttacttcacatcttagcacataaattagttttttttaatgttgcatttgccttagattttccaatatacattttctttaactgccctgtctgatagtctttatatatatataaagcagcaacaaccacaaagaattatatataattttttttwatgtatttacttctggctgtgatggttctttgtggttgttgctgcttgggcttttctctggtttcggtgatcgggggctactcatggggc

SEQ ID NO: 20216 - DNA, 600 bp, Bovine  MMBT09297
tgggtgaatggcgtcccattttgaccccttaactaagatccactgagtactcacttacacttggaaggacttggaagtctcgaaggcagggaagccgtgtccctccacccaggtgacaggagatgtctcctctgttgcaggactgacagctcctttagcttcatggcattcttcttcaccttcatggcccagctggtcattagcatcatccaggccgtgggcatcccaggctggggtgtctggtaagagaccagggtgtctgggactgacccagggctagctgggcggcaactggggtgkgtcctttgcttacttctgtgggctaagctgcctggcctgtgggaacaccatgagttattggaagtgtgaagggattcaggataacttagtagatacagcatagcatcagaggagaataaggcagtggtttttaggggtgatgagggatatcaagcatcatgagataacccaagagaaggaagccttatgctctgagaagcttgtttcctgagccaagggttcttcctaaagcactgacacaggccctgtccatccattgatatggtctctctctgtggcaatgagaaggtcccttactct

SEQ ID NO: 20217 - DNA, 600 bp, Bovine  MMBT07960
cagctagtttgacctcagtttcacaggcaggagagctggcccaggagccccctgaagcgggtgttccaccatggcctaagtgcaagcacctgagggcggtgggcacatgtatgcacatgagacaggacacgaggctggggcttgccattacacataaagactgaattcctagttgtagcttttactatgaatgggagatttttctccttgcttctgtcattaagaataaaaaaaaactgtgatctatcataaaataaactcctaaatctgtcaaacaacaagccattctagagatcaaakatttttctaagactcacagaatgttcctatgattcaaggaatagggaaaaatcagaccaccatcaggaataaagcaaatgaaatragtatttaactcaatatatgggctctcagtctattcaccaattcctacccactggacatttgcaggtgaagaaactttgaagttaatccaaaagcctgccttttccattttggttccaagttggactacaagtttcagcaaggaaggtgatagggcaaaatttaagaagactgagactctctgtgccatcctaaaccctccctttttagtttctc

SEQ ID NO: 20218 - DNA, 600 bp, Bovine  MMBT06961
tcaccattgttaggataattgaaacttgcttcactaaagaaagtttagttaaacctctttacaacattaatgttaggtacatggagatcacttgtctaataatttaacttgacatcatatatcagaattgtattatatttgaagaacaaaattgaagtttttttatttggtgaatttaatgtctttccagagttctaaaamgataggttttttgttttttttttaatttaaattgataaagactataatttagcagaaatagggccataaagtagaaaaatagtcatatagctacagtcrtaccatacttcagcttccatgtaggaatagaagtggtaggtccagttttgttagtggaagaaaagggatttatggaaaagttatgagatgtttcaatattgagtccaccaaacactttgcacaatgttatacttcatttgtcagtgaatatttgttaaaatgtatgtctggttatcatgattgcgacagcctcaaggtagaacacactgcagtccctagctgaacagaagttagcctaataattcatgacagaaaattgattaaatgccttatccttttaattaaggctgcagaactgtt

SEQ ID NO: 20219 - DNA, 600 bp, Bovine  MMBT04565
cggggaccggaaacgcagccagatggttctgctgagggaggcacttttctttataaaaccaaaaaggcagtaataggtcaaacacaaaaatgcagatacggtaaaaccgaaagctagtgtggagactgatgtcaataagacaagcacagctctctgcggtgttcccatcgacagcagtcagtggaggcagggagacaaaggaaggaaaagcaaccccgtcggtccagaccagagactggagtggttcagtggggccaccaaggcctggaaaccaatcacacgtgagggtgttagactggrcacttacgaaggatcacaaaaacagcagaaacggacccacgtcccaagtctgctcatgggttgctggcctgtccatctcacccctgtcaggaccccaagaagccctcctgggaaggcactggacacgggtctgggggcagggggcacggcggggacggcagggtgctgggccgagagcttggagccgcccaggctggtcagaaccaggcctccagcgagcaggcacgcggcccaggcaggccctccggggagagtcttgggaggggaagacctgcccccacgagccccagcagagcagag

SEQ ID NO: 20220 - DNA, 600 bp, Bovine  MMBT04436
gtgtgcatgcttggttgtgtccaactccttgcgaccccatggactgtrgctcaccaggcycctctgttcatgggatttcccacggaggattactggagtgggttgctgattcctcctccagaggatcttcccaactcagggattgaacctgcttcttctgcatctcctgcattgacaggaggattctttaccattgggcaggtagaataagtattgatatataaatatgcagagctggatttgagatctgtcagtaggtctgtggaaactctgtgtatctcacaattgtcatctgtgagytaaagggaytgtcctagatgactttgtaggtccattctatccttaacatttaatatgtgtccccagtgggtaaatgtgtgtgaaaaacatttcacgcctcttggactttttggtgagtttaaaagcaatccatccatttactagttatagaagtcaatctgtagaaaactagtagaaattttatacactgtcatttctttaatgtccttctagttatttcatctgtattttcttctctgtggggtcagtgctgtatagtatggtaaaataaatctatcttctgattgatagtatgaaaat

SEQ ID NO: 20221 - DNA, 600 bp, Bovine  MMBT11557
catccaccaccatgatgagatgagaaaggttgatctttaaaattattttcaccatcaaatgatttttgctttatattccccaaagagtgaagtagaatggtgacatgttgtacacagaagctttataaaacatatcttagatgaggtcttcattttaagcctccccactggtactatctgctgttatattaggattctgaatttcaccgtaaacaataggctaatctaagtaagaatttctgagtctccatctgtaaattcagatttggcaaaggagaaatctactagagatcctgggtrgtatgggacaaaggattaggggagagaggcagaagcaaggattcagggcctgtaatccaactattctgggggcttccctggtggtccagtggttaagattccaagctcccaatgcagggggcctggattcaatcccagtttgcatgctgcaacaaaagatctcacacatagtaactaagatcctacgtactgcaactaagccccggcaaagccaaataaatgtttttaaaaatgaactactccgaaatcactaatttttaccacctgtgctttccagtgaactgcctatgagtattttca

SEQ ID NO: 20222 - DNA, 600 bp, Bovine  MMBT20034
gawatgggggaaaatccttcygtgctatccaaaaaaacaaacccaaacatattttggtgagctgctaaatgtggcgacgctgatgtcagaagcacccctgaggcaggtctgctttgcaaggctgccacagaccccgctcacgccttccacactgggcccatctgcttgcacatttggttgtaccaaatgcagtttacaccataaagcatacaatatgtgcayagttcttaaatgagatttgtcatttcactgaatttcggtcagcattttaaatagatacatttctttgtgctctagtckaacttacaaactgcacccggctgactgcagtgctgtgttttggtctcagtttttgtgtgtgtgggaactgggagttaccagttggaccatggatcctggacaaatcaacctcacagacagacatgagccaaagaagttgcccttgttctccctgaggaagtcstttgtgagagctgggaggagtggattccttttctctgagactgccgatgaaacccttggcttgtaccacagccatcatattctgacaagctcgcgtcactgaagggctatgggtgaacagagttgttgtgaacccaa

SEQ ID NO: 20223 - DNA, 600 bp, Bovine  MMBT08805
aaaatttctaataagttttgctttaattctgtagttgtcattttttgacactgcttttcaaggcaaatagagtctagtgcctgattccaactttataacaatattcctttcagtctgtacactgtgaactctcagttttagactctttgtgattaggagatgctggccttcatgtggggggatctgcaatgacccaaaggttcctctcgttagaacggactctgtgccaacgagtttgtgatttgtaaaatcgattcagtctcaatattggtactaagtgacagtgagatcctaacagtwtggtgtgttctatcgtgttccatcatgactctgtgtgactccatgaactgtaccccactaggctcctccatctatgggattgtccaggaaagaatactggagcaggtggccatttcttagtccagaggatcttcccaaaccagagctgaaatctgcatcttctgcattggtaaggaagactttttaccactgtgccatctgggaagccctcctaaaaaacataaaaatcagcacttttaaaaacttattaacagacttctcttctcttgaaaagtcagcaaagtaattaatgtttcaact

SEQ ID NO: 20224 - DNA, 600 bp, Bovine  MMBT09673
acacgccctgagtgtgagcacagattgtgggcagtgtgttatcagtaacaggcagaccagaggcagaaatggatttagccaatcagcagaactttttcagtaggaagcacagaatgattaaataactgtatttaaaaggacttccagccaaaataatttttacgtgcgtgctaaaaactcgctcctgtattggcaggtaggttctctaccgatagcatcagctgggatttttcgtgtgaaaattatgatggaatctcttttttcaggatgaaaaccacgttccccataattggaatgacygtgttttctttgtaagsgaatagggtgatttacatgttctagaaaccttgacagcagacacgtactttccagcagtgacaaacatctcgtcgcggcacttggagaagatgactgtggtggcgttcccgacattgaggccggctgcggggctgccacagatggcctctctcttggctatgctccagacwaccacactgctcagacgaaaggacaaagagaatcagggggaaacrggctttcaaaataagaaatggctcttttagccgttctagaaggaaagaaatacaagaggttactcac

SEQ ID NO: 20225 - DNA, 598 bp, Bovine  MMBT10997
  misc_feature (1)..(5): n is any nucleotide
nnnnnacagagagttgtacatgtctcccaggggtgattaaatgctgaggggaagttgaataactatagaattcattgggtgcaagtgcattccaatggcaggagcattctgtttgccggttataggacaggtttctaaaaagatacacacagcatccataagcaaacatcctcatctccctctagggratggagaacagaaactactgcatcccaggaatgcttatctatctaggagcgagacttgggaatcagaactctcttacactgcgggcatgactgctaactgacacaactttgraaacaagcggtagggtaaataaaactgaaagtacatattactgtgatccaataattagggaasttttcatatacgtgcacagagacacaaagacaacaattctcactgcacagtgtttacaagagcccaacactgaaaaaaatatcaatayraaaataggaaatagataaaaatatgacctctttacagaaaggaacactatatagtagtttaaaagaatgacgaaacaaaaacacacaaaactacgaaatgtcatttctagtggagaaaatgtacttattacaatattcytctcttt

SEQ ID NO: 20226 - DNA, 600 bp, Bovine  MMBT07988
attatattagcaataacacacaaaaaattgtggtgcttagcaaatagttgttgttcaataaatggtagttactattacatttctcactagcttccataaactttgaatgtttaaaggaatgttcttatatcgctaaaaacaaaaaaggaaaaaaagaggcatctaagattttaacacagaaaacctctgtagctcctagtttcaacttccctttgggttttctcactgttcagttgtgaagtgctgtgttccctttttaaagccctgatcgcaatacaggcaaaatattcatttgttccygttagcatacaagagacagaaaaagattattccttaagagtcagcacgttctttagactttttctacagtcacttttatataagaccatccttcctaacctattctaagagttatcagtactcagttactttgctttcaatgttacttccctcctttttgtagataagagttgatcaaagttttactatagaatctaaaccgaatttagagagcacagtaaataccaaatatcaaaacaaaatacctaacgcttatgaatttataataaatttagatttctaaaactctgaaagcctttc

SEQ ID NO: 20227 - DNA, 600 bp, Bovine  MMBT02708
gagctcatatgtgtgtctgtgtggaatgcagccctgggtccccttggacrtgtggagcatgtttttggcccaaatggaaacatccttaggcactgatgcctcaattaggggaaagataaagaygcaggatcagatatggcatctgtaaaatgttaatatcctgggtgatgcaccctagttaagtttatttttcagtttcgtttgatggctagtttaggcaaaatcgtgacacgtgtgaaattgcctttatttagctccctttggggatagcctctcaaccctgcccctgctgactgcctygttgctgccttaagctcaccccagccccacggagcactcctgcgcatctctttggagcacctattatgttctgggtgtaggggaaggggaagaataagagcaacttcacttgcaggatgtagaggaaggcacagaaatgggagcagatgcttgtcctactgcaggataaacgtgtgatcaggtgctgctggagcaggtgaaggctccaggccgctctgagggagggcctgcctggagaaagcacctggggcagaactctgaagaacacccaggagttagggcggctgctggccccgcagg

SEQ ID NO: 20228 - DNA, 557 bp, Bovine  MMBT17229
aacaaaaacaaacaaaaacccactcataaatcatccattttatatataagcacagttgtaccttctccttggctgcttctgatggtgcgaactggccamggtaagtccagctgttactggcataaagaattcagctgactccagctcggatatgtcttgggttcactaggtgtatatgtgtctctctcccactagaaagaaaagaccttgagtgcagggactgactttttttgctgctgtatcttcagcatctagttcagtgcctgacatacagaggtgcttgatcaatgatgaaggaaygaatgagaatttgagttttcacaacaggacacacagccagttttcttccccatatgattatccagttttcgacagatttttttcctctgctgtgagtatttttcaaaggccacaaayactaaagcatcatttttcacttttagataacacagctccacataagacagttttgcagtgagtatgaaatggatttacacatgtggggattttagcatttacatcctcaataagctaaagattgcattatttatttataa

SEQ ID NO: 20229 - DNA, 600 bp, Bovine  MMBT09887
gattgaataaattaaagaaagagaacgaaacacaaacttgcctgtcttaatgatatcctaagtccagaaaggaattcatgagcagacctctttccacatctagctggttgatttatccaaagagcaactgggaggctggctgcctctccccaccttgccctgcccccaggagctctttttcatggtccctgttattttaattggttgcaatacttccctgtcccatgtctactagtttagctaatttttctaaatctgtcacttcttgtggagttggcggaatgagattttcttaaaaaygggagaaaatggcgagcaggagagaggcctggttgcagccccagctggagccagagagtaggtacagaggcaggggtggggctaggtagggaaactgagtcagggagaagaagtctgtctgccctcctggggcttctccccggcctgggcagagcctcctgagacaggagagcttcctgagctctgagcatcacagaaacaactcctggcctccagcccctccctatcccccacccccaccgccacccccaagcctttgaaaccctagtgtgtgcttagctgctcagtcatacctgactc

SEQ ID NO: 20230 - DNA, 600 bp, Bovine  MMBT11212
cacctccaacctgcttaagacgacccaatggctaattaatctcttggcttactttttaaaactgcttaaaatatatgtttcctatgaataatcaccctcagttacccaaatatatgaacaaggggaggatttgtgcacaacagtatttccaaatgattaatttaatatttctacaaattgctcatagcacctttcagctcttttgtcagaattcgcccaaactaaccactcagcattttagccttttaaatgcatactctctctcccctcttatgtcctaccatttttaaaacacagagrgccaaaaggatcagcttcttgccatgatcatatataagaaagtgaacagagaggtgaatcagaacgaaaagcaataaggcagaaagatgtattttccagtatgttcttaaatgcagtatttactattattaatatcattgtttaccaaaatgctttgttctcacagagtaatattgctttaagggattatagaaacttaaatagagtttaaattacatccagctgatgattggccatgggcatcactcagctctctgaatttaggctgcataactttcctagcatccctagtcctcaccc

SEQ ID NO: 20231 - DNA, 577 bp, Bovine  MMBT04488
gataaatgtcagggagacagtaacaccaggtgagagtgtggaaaggtggggttcrtgcaggtggcattcttggaggagttgtagccaagcttccctccagccagctgccttggagttcattcctcagaagatctccaagagaaaggtatcataatccttattttactgagaacgaatgaggtttccagaagttaaagaacttgctctgagttgcagagtttgtaaatagacagctgggatttgaacccgagtctgtagacttctctggcatggtgctggctttgctgtgaaacgagtggsttagattaaggctgctaaaaatctttcccctaaaatggtatacatataatgttgcaactgacacctctaagagcaactgacacctggtggcaactgacacctctaagagcaggtgctctggctattttctgtctacacaaggaataaaatacgaattatgacacaaaaactgggaaggccaggttgacttatttgctgcctgtccattgagtttcagagagagcatatcaggtttagcagctgcggcaggtcagcagtcaagataccaaatgcaaat

SEQ ID NO: 20232 - DNA, 600 bp, Bovine  MMBT08046
tcactggatatgcttccaaggtttactcacgcacaaagcacttaggactgagagagcatctgctgcatccgcttcttcagcatgttagcaggtgtaagtcttgaaggcaattcataactaatcagaaaatktatgaaaagcagagggtcaacaaagtcacacgttctctttggctcattcagctcaatagtaatattcaaacttccaagtagtatggcctcctagacgcttagccctacccctgcctgcatggaaaagggcttgttctccctcatcactcggtttcttgcctcctggatmtttgtcttgctctgaatcctgataattcaccaggctgttgtactgtggtagctcagatggtaaaaaaatctgcctgcaatgcaggagactctggtttggttcctgggtcaggaagatcccctggagaaaggcctgacaacccgctccagtattctggcctggagaatccccatagacagaggatcctggtgggctacagtctatgcggtttcaaagagtcagacatgactaagaacggcacacagcacagctgtactctgttgtgatcctttgactgctacacgtttgctttgtagcagt

SEQ ID NO: 20233 - DNA, 600 bp, Bovine  MMBT07728
taaaaatgttaaaaatatataatttacactctaatgtataatatgtagttccataaaatggctgcaacaaaaattaaatcactcaagtgctacactgcttagacacccttccacaaaatcgtaaatattcaaagcttccagctttgcctgttgatggataaacatcgccacggtttggttctttcatctgaaaaayggggatacctcaccactgccccagagggtcacagtgaggccgtggtgagttaattccgagcaggcctggcactgtgccagtgcagaatgagccttacaataaaygtggggtgcgttagccttcagagggttgctattctggaagaggagagagaggactgacagttttatagcatgcgatgtgatgagggctctggcagctgtgggcacaggtcttgtggaggacagagaagaagcaggatgaccacccagaggacccctcccactgcctctcaggctaaatgaagttgcctaccaatccctgccctgcgaccggcgccagcgtgctgctccccacagcacagacgccgttcctctctgcctctggtctctaccatcagcacatatgcttaagaattctctgcg

SEQ ID NO: 20234 - DNA, 601 bp, Bovine  MMBT06647
  misc_feature (1)..(1): n is any nucleotide
nacacttaaaatgattgtagaaacaggtattaagtcatggtctgatttataaactaacaaaagccacattagccacagatgctttttcccttcaataatttaaatatatgggaaaataattatttttcaaagggttaatttctattaattatactcttttttttaccactaactttgcatactgatttctcagttttatttttaagtcttttgagtttagctttttctattagatcttcttcaaatcaacctgtgattgttattaacatgtttacattttaaaggtgatccaagtggggtyggtaaatacatattccttaatatgcatgtcaagtcatcaaacctctatgttttcaaaagtgtttgtactgtgtatgataatttgaaactaggcagggtttaatgctgacattgttgtattcatgaaatcctatattgaccaggatggccactgagatgaagacatgacattcaagctgataattatctttattaatattagaaacttcattttggcttatattttactttttgttttttagttatttacagaggaaaggctttatgtgtattaatataaacagaattttactaatgtact

SEQ ID NO: 20235 - DNA, 600 bp, Bovine  MMBT12322
gtcttgtaaggatcctgacaataaaatgattcatattcttgtagcattattgttttccttgaggtaaaaataaagggaataggttctgctttttattttttaattcattgttattattacttttttggcagagacatttatttycttctctacaaatatctctcttcctttctctccttcctccagtgagggcatctagacgaagtatagtcattttatgctctggcagtcctttctatatactctatgctggcattttagcttccttttataagtaatcatttatatgcsttcctcttytccttaaaactttctctgccttatttatcattgtattctcatacatggatggttaggaaaactagtactcaataaatgcttagtaaatgaggaatttaggtgctgaagaagactcttgagacacgcctgggcaacttgctcaaggaaatcaaatcaatcaatcytaaaggaaatcaaccctgaatattcattggaaagactgatgctgaagctgaagctccaatacttgctcacctaatgcgaagagatgactcattggaaaagtccctgatgctgagaaaagaagtccctgatgctttt

SEQ ID NO: 20236 - DNA, 600 bp, Bovine  MMBT02962
attgacctgtaagttactggcagaaaaatcaataaattccaaatgaaaaaaaataatgcaataaccacactcagctttgacctaaaaacatgtataacaatcaatatgataaagactctgtaaatgtgattttaaaaaagaaaatgtagtgcattcatgtgaaaaagtcattttgccagctaaacattctctgctaatactgaacattcatttcgcttaggttttaaatattcctatgtcctgaaaatgcatacattatattctcagtgttcaaaataataatgtgctagaatgaaagcmcatctctgcaggtgattattatacatacattatctatcctgtgtgtttgtaggaaaaatatatttttcagcattagatgttataaaataacatgaatttagtagactgtttctagaaaactggaaaaaatatattgcattattaaatagtacctttaattaatgtaggcatgctataatcttgtgttctgaactatgactagcagaactataacgagcagaagacctactcacaaacttgcttgctaagttgttgaagtcatgtctgattctttgagacgctatggcctgtatcccacca

SEQ ID NO: 20237 - DNA, 566 bp, Bovine  MMBT17301
cagcagggcaaatgcccaaatctcattgtcacaccgtttacgggatttttgccttctgtgggcctcagtggattacaggagttttttgaatggtatttatatttcctctagccaaagacacattaactgtagtatttctttggcagattactactaaagaaagaaatgttgcttgctccacggaaataaattgataggttcaggaactgtcactttgcttatataagtgaatgcctcaaaagataaatgtttcaagcctgagcaaatggttttaaatacagaaaaaatatcctgaatccrtatacttaaacattacaagacataattggtaagtttgaatctttttaacatctggtaagtgctttcccattcattcaatcagttagtcagcacagccaatatgccagccactgtactgagtcctgctgactgaaagtttaaaaagatctcatttctgtcttctgggggctcacagtccacggggaaagacagacatgtcaataaatacaatacaattaacaagcgctattattagctatccctacacaaggctacagaaagaagca

SEQ ID NO: 20238 - DNA, 563 bp, Bovine  MMBT18863
  misc_feature (1)..(2): n is any nucleotide
nnatgaattcagtgacagtaataaactggtttcagagggacgttgaagctaagctcaagtataaaccacagtggtacacagcagtaatattacatgtttcttgaaacacacctgaaaaggcaggaccctgctttacaaaatcatytgccaaagtatgttcttcaaaacactagttctacaggtgttawaagctcttcttccttgatccctacagaaaagggttctatggccaagtaaatktgagaaatgaaataaaattaaatagcgttattcactgcaggatttttcagagtccttaatakacgtgttaggaacctccaagtcttgtttagggtttgatatgaaatatttcctgatctcacttcactatggaacccttctttagtgaatcaattctggggattagtgttcagtggaacacatcttgggaaagggtgtccaaacatgcatttttgtgttagacataattagtgatgatatttaaggttaagaaatgacaaacacagcaagaatatattttagaaatggcaatattcattaagtaatattaatattttaaaaaa

SEQ ID NO: 20239 - DNA, 587 bp, Bovine  MMBT07173
gaaaagtacaggraagagtgaaatcatgtgattcttcaccattcctctagactctggagtagacgctaccttgtgccccgtttagagctaagggccctccccggttagaatgtccaaggcaagacctttggagctgcgcctctatgagggtctcttgtcccagtccatgggcctaggacgcttctccccacctcccattttcaaagccgcccggtaggcgcccggtgtacgcggtgcaccgggagtctgcscctgtcacgccggctcggtccctgccacgtggctctcaattcggccctmtgtccagtcctgtcctcaggtttcgtcgatacttagttcgtaaggacagtcgaggtatctatgaattttcgcctgtatgctccgctcacatggcggacacgaaccgatccactgcgcctggataggcagccgcgtggcgagcgtggtaggcgcctccactgcccgctccgagctgcccaccaggattgtagcagggccccagagctccgaactggccgggcgatgtgcgcccatagaagtccaccgcagtctcgacgccgccgctgctgccacccgcggggggcgaa

SEQ ID NO: 20240 - DNA, 598 bp, Bovine  MMBT03906
  misc_feature (1)..(142): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaggttgtttaagtaataataaaaatttttcttaatattattcaattggctgattgacttaataataaggaatttattttaaacatcgtgctaaatgctgtgtatttaaagaccagtaaaaaaataaaaactggtttcaaggagtttgctatattrtttgttgtaaagtctttttcatatttagaatgattctgttaggatggatttccagatgtaaaaaatataagtatgaatacagtaaagtctcttgatttcttaaaaggatataccagttcacaattctttaaaaatatatgaaatttattttttcccatcattcaatccagatccttatatttaagaagtcaattaacatttagtgaacatttaatctatgctacatgtcaggtcctgcacaatgaaataagaatatagaaattaagaaataactgccttgcctaatcgagtggggaga

SEQ ID NO: 20241 - DNA, 600 bp, Bovine  MMBT08110
ccttcccccagctaccccatgttctagccatgtggagcttcccactgttcttagttgtttcacagctctgtaccttcacagttatttcctctataaaagggattcctttgcttgataaacccaacacatttttcaagactcaactatgaagacctccaccttctgcagaattcatcatttactcccttctctggattcctagccctagaccgtattatgatgatctgttaacatatctgcctccttttggagcctttgagttcaaaaaggacagggactgtcctttattcattttcctawgaatgaatgaatgagtgaatatccaagtctgccaaattcagagagaaggtctcagtaaagcataacatctaaaactatcagtttttaaaagtctgccttttaaaaatttataatggcttttctttttgccttatcttctttgagaatgagggacctttgtggaaaaggatatggaagtgaaggccttatgttacacacacacagttttgagaagaccagctcccccctacctctcatgtgtacatttttaatttttcgttcttcatcattcaactccttcagggcacagtaagtaggatt

SEQ ID NO: 20242 - DNA, 600 bp, Bovine  MMBT10105
aacacaatatctatcaatcatatgccaaaagtactttataaggagactaaagaaaagagactagtttctgaattacttagtccttgtcactctgtacctgacactattgtcatttcccccacattgtataatttgtgtatatagaagttactttgtcctcagatgttagaagacgatagaccacaaagaataaatgcttcccacgcaacttgttaggaatttgagcaaaagaacagaagagattgctctctttctcattcctacgggattacttggaagttgtttcactctgtctttgtmaagttgctcaatcttaccttaaaacttagatgcttgctctaagagtgaacatttgacaaagactagctaccagactgttagggctttcccagtggctcagcagaatctgcctgcaacgcaggagacacaggagaggcggctgccatccttgggttgggagatcctctggaagagtaaatggtgactcactccagtattcttgcctgaaaaattccacacacagaggagcctggagagttacggttcatggggtcacaaagagtcagacatgactgtgcaccacactgccaggcttctgtc

SEQ ID NO: 20243 - DNA, 600 bp, Bovine  MMBT22554
ggttggggaactaagatccctcgtgccataaggtgtggccaaaaaaaagaaaatctgaacaaagcagagattgcatttttagcagttagatatacattaactatccccattaaatatgtcatttctttcattgtgaacractgcattattaccagatgaaaggggccacctcctgttttcttaaatcagcctgtaggttgcgactaaggggtcagttagttggttcgggatacctgagcctcacctctgctcccgtcctcggcaggttcacctctgtctagtcagcctgtcttaatcgcygtgcagcgaccactgccaccgacgatcaagcctgtcacctacactgtcgccgcccctgtgacgacctcgacttcccagcagcccgtggtgcagacggttcacgtcgtccaccagatcccagcggtgtccgtcaccagcgtggctggactggccccagcaaacacatacaccgtcgcagggcaggctgtggtcactcaggcagctgtgctggcccccccgaaggcggagccacaagagaatggagaccacagagaagtaaaaggtgagcagcagcagcagtcactttgggcagtttttcaa

SEQ ID NO: 20244 - DNA, 601 bp, Bovine  MMBT01244
  misc_feature (1)..(1): n is any nucleotide
ncttgtgtaaaaagaaaaatgatgtctgttgmgaattggtgggtggggggggtgttcaatgtggtatgttgttatttagatgatctttaaaatcctttttgctcattacactataaaaaccgagaaagcagcccttgaaaagggaaaaacaacctgtatcctggccaaatcctccctttcaaagtagcttggcttgatttttttttctcttgatctccaaataaatttccattttttaagcaaaaaaaaattctacaatgctgaattttgtacatctgggaaagaaaaggttatggatatwaagtccctcccrctcccaaataacacatttcttttattttgatatgaaaatgctgaaatgaatgtggtgacttgtcacaggctatccatggggtttgggggagttgcagaacttccttgaattttcttattgtctttcatgattcctaagagcttgaaatcagttagagaggaattcctgagacagagacaacaagtggtgacagttttagcagagatctccttcatggtggatgaatgttggcatggttctgtgtcctggcagattcttcttgaggatgggctagtttgtaatatattt

SEQ ID NO: 20245 - DNA, 430 bp, Bovine  MMBT03021
tggtcctggagcccaggggcctgtgaggtgggcagctctctgggcccttagaacttctgcctgagccccatgggaacccttccggtactcgtatctaaggagaaaacccaggaatttctcatctgtgaggaagaccaagaggcaaaactgttgggttgggctcaggctggttcatgatcttcagtagaactggggaaggaagttaacccccccaggtctgttgtcaggaatcccttccgaaaatctacttgtacactcactgcagtttagacttcctgtgctttgtgcaacagagggtcracggtggagtggagtcaggccagcgactcttctccagctttttcccctgggctttgctggctaccgaagtctgtgtacataaaggagacgctgctacacaagcaccaaagacctgttaagcgcgtgcagt

SEQ ID NO: 20246 - DNA, 569 bp, Bovine  MMBT18676
tgacatgctgatatatgttttattcaagtctttgaattcaactatttcctgaatttttatactctgtttggcagggacaatcatcatcttaactttgtaaaataatgctcaaaagaaaaacttcaaaacctagttacatttgtctttgtagtttgtctacactgttcygtggtcattctrtgcaaggagataaactcagtttataagaattcataagaaagaagggaactgagccatttaatcttcttatattcttgataattgcaaactatgacagttctttacactctgtgcagctcrtactttcacagggcttggcttagacatccttgagtatttcagtaaaaatgaatgtacactgtcatgagtgcctgttttgtgacaaaaattgtactttcatgttgcttttcagtgcatattacatatcatccatatttaggttatcagatggttattttagcataatacatacttgtaatattcatatatccattttttttcatattttgtacctatattgcattcagagcccaatattttaatagcaaaagctaaaaagactttccatt

SEQ ID NO: 20247 - DNA, 600 bp, Bovine  MMBT16697
gaagtcttctcctttccttctcctactcttagcctattggcctcttagttgttcctttcaccttgttggaaattctgtgaggttagactatctatattttttcctaccttgttcctgttacagagcacttaattattatttagaagataaagtaatgcacaagagtttcttcctgaatagttttgatggtttcctgttttccacttgggaatacctctcagagagaaactatttctttaagaaggtaaaatgctgtaaatttttttctatcaatgttttgagcttttgaaaattactacyggagtgtgtatttttatctttctcacacctctgttagtatttcagactacacaattgtatgatcactatctttcaaattgtctttcttgtgaaaaataagtgactgtttgacttttatgtgcactgacagggacctcacattgttattttattatgcatagctcatagtgctgtagatgtaattaattggcaaggtctgtatgtgtggtttctaattttgctaatataatgctgttgggccaaagggaggtatagaaaacattcaaaattacttgccatttctattaattaataattggt

SEQ ID NO: 20248 - DNA, 598 bp, Bovine  MMBT04274
  misc_feature (1)..(21): n is any nucleotide
nnnnnnnnnnnnnnnnnnnnntctttggttccgggctctatgctttccctgaaacagttgacagttttgcttttggtattaaataacataggattagtctgcctaagggaccatctgttgttccatgcctgccatgacaattctgggtcctttagaattgcagcttgtggtttcttattaaggggagcagaagagcattctctatcaagagtctaagcctcagaaatgttgtccattctgaatgaatcaacatataactatgacatgtgtcaagtaagacaggatgtttttctttcattwtatgtaaataaacttgaggttttaacagatgggaatgtaagtttgtttgtttgttgttctttcattaggctgtgctttataatgtggatatattattaaatgcttcaaggcagtttctcagttttgttttataagttactgctgatatttctgataaagctacaagtaaaaatgaagtcctacttgttatatgctaactagtttcaagcaaatcagcaatacttatatccttttaaagctataaaagaaaaaggctgtcttcaacttcaaaaatcctttaacagagttttwaaaagct

SEQ ID NO: 20249 - DNA, 600 bp, Bovine  MMBT02442
atagtggtttaaaggagtacaatttgagttagctaatgatctgacattatagaaggggaaagaacctgtgagactaaattccaattagtaaacaatgtagtaccacagcatttttgttcctgaaagtactttactaatattagtgtgctgattatatttcaaagcctttctaaaaataatgtacttgacctgctagtatttgatagaaagtattaacagttaagatccttagacatttttgcatgtaagttttcactgaatttaaaggccaattgaataaatgtaggttgatgaaaggtwattctatgaaatttgtgtagcagctaatcttaaatatttcagaagcattatattatgaaaaccctgttttgtatagatgaggcaatcttcataaatttccatcatcaagattgcatttcatgtgctatttttccgtagctctaggaagatagcaagtaaaagatacgcactagcctagaaacatagaagagatcttaatttactacctgaaatgagccaccttaggggaccacccttccacactgatagttaatacatagtactttagttttaaagtataataaagctaccttctacctt

SEQ ID NO: 20250 - DNA, 600 bp, Bovine  MMBT02610
cacattcattctcaactttctaattctgatggctgtggatgctggtgccaacagctgagggaagggctgctttgaaggcagagggcaagtttagttttggacaagctgagtttgaggcacccctatgatatctagagcttcctggcaggcagttggatatttgggtctaactcttgtggaagaggtctgggctgcaactgctgattgggtaattgcaacgtgaggttggaggtgatctcctaaaagtagaatgagaagaactgtgggtttggagtcttgcatataaggtggagactcacrattagtggcacttaaggatgccacccaaggaggcagaggccttatttactgagatgtgagaactggaagagtatactcttccgcaaaccaagagaatgttgagattccagaaggtgggggtcatctgaattgtcaaatgtaacagagagacccagaaagagaatgcctgcagaatgcctactaagatttgggagaatgaaactcaggggttatcttacccaagcaggatgaggaagggtgtgtgttggggagaagaggggaagctggaatgcccagtgaggagaaatgaggaagtggaga

SEQ ID NO: 20251 - DNA, 600 bp, Bovine  MMBT11980
tcaaggcagggcgagcagtcctgatgggtccgctggaacggccctgaggggaggccccagggctggcatgtaaacagcccactgccacagtccaagtgcttggggcctacagctccatcctgcgaccctcccaccctcgctgcttttctgacatccttcctacccagaagaataaaggagaaaataaaagcctccgctggtccaccgtcaaggtgacgtttgctgcaaacttcctgtcttttcttgtggttgagattctgccctggctggtgagtgtcgaagtcaagacaggaacatagrctcagattttaaggcaactttgggtgaagagggaatttgaaaccatctgcctcatagtctccaggtcttctttccccatttagaagaaaaccccgggtggcttgagccgttcgggcgacagactcatgactcagttcctggtccctgacagtggccgtcacgttgctctggtcamtgtggcttttgaagagagagaaaaaaacaaaacaactttctaaaagctgttccgtcacaagtgtccgggagggttgacggttgagccattgttgtttagctcaggaagagggtggcagctgttat

SEQ ID NO: 20252 - DNA, 600 bp, Bovine  MMBT10710
attcgtaaaaatttcatggggatgttgataacggaaggaggttatgcacatatggaggcaggggttatacagaaaatccctgatcatccacttaattttactgtgaacctaaaactgttctaaaaagtaaactgtgttaaaaactagcataaattcttagccatagtgatatatatggcctcataattttcatatcatttagggataaacattataattttttatctttagaacagttaattactgaaaagtttatgagtgtgagtgtgtgtgtatgtgtaatttgttttcctttgggcmcatcaaaatgaaattaccatctgtgtttgagactgatttaaatattttcttgactgaaggccagagcattagcaggaagaatccttgaagtgccttctaaccttgcattttcttccttttctagccatattggcaaagcatcaccttgtctgtacacaatgacagtgaatattggtatcacttatcatcgattagtacactgttccttgagatcttggtatcaattacattttactgatagtattagaaaaccaaggatgaaagaaagtcattcagatgtctagacagtgagttacagag

SEQ ID NO: 20253 - DNA, 600 bp, Bovine  MMBT19654
actgtctccttcttatagctcatattgcccattagttggggggaaattgtcttaaaatagtttcagaagaatgttttaaaaagaggaactcctttgcagataaccataatgttttacttaaagatgcaaaagaaaaaaaaaaaaacagaactgtgatttggtgatactcatcactttttacatatgtgtttattataagtagttgtgtcatgtagaactctgctgttggggagtcaagacataatgttcttctctctgttcattatttgagcagaggaaggaaactttttctagacatgrattattaaagacaggatctaaagaacacagtactatatgtttgaaagctgttggcttaacataacgatcatcatcccacttcatagtccctggatttggtgctttaatatttagtttagtctaayactataaaaggcatgacaaatacactatgttctaggtttctttctttctatttaaaaaatatgtttaagtattgcagtctacatgacaagagatgatccagactattttaatgagttatgcatgcatgtgtgctaagttgcttcagtcatgtcagactctttgtaacccatggac

SEQ ID NO: 20254 - DNA, 600 bp, Bovine  MMBT08165
gcagcccctccctctccccggtccccaacccctgcctttcctacacagtctcacttgtgttttgtgttaattgcacttaatatgcaagtttcatgataacttcaggaaataagctcaattaaatgtagatatattcagcttactgttgcattttacaaatataatttttccattgatgtttaattgccttaaaattctttcaaggttaaaagggaactatctcttgaacattagttattaaattatgtaatgccaattaacttgctgaattgatttgagctttatgacactttttattgmttgtttgaaagcaagcttctaattatcaaaggattggatattttcaactcaaaagtcctctgagactaacagaaagctggcctgtcattttgaaggtcttggttccttatgaccagtgacctgaaccccagtgtgggctcaaccaaaggaagcattttcctgggtggagggttccgggaagccttgaatctgcagctggttttccacggtgttacccagctgctctccagatcaacagcggcacccagaagtagccatgtgatcttcataggcaaagagctgctatttcctccatttgtc

SEQ ID NO: 20255 - DNA, 600 bp, Bovine  MMBT15534
agctggattaacagctctttttatggtaaaccacttcggccctaagagaagaaaaggagtaacagagctccaactctgcactcccccagcctctacacctgcaccagcagtaaaggacccctttgctctgcagcttcttcccacacctctactctgcatcttcttatactacaacttgcttggaaacatcaagactaatctcattatgatctctaaccctcctttgtatcattcactgcaagaattccagaattctggagccatcctaaatcctccactcacatccccatatggctaagkacatcccctttcatgaactaccccctttcctactaatccctcaattcctgaaatcttttcaccatatcctctggaacttatcaacaaaatctcctatattttgacctcttgtctgaatgatcccttcacctttttgctcaagaggaaatctaatagctgaggccactgctctctctacagtctgatctgtggctgttttctctcccacacccctgacactatgtacctggacggggagggrgrgggggtagtggggaggagtagraggaggtactcaccgtgtacyttgtttctgtttcc

SEQ ID NO: 20256 - DNA, 598 bp, Bovine  MMBT11177
  misc_feature (1)..(94): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcctatttgaagctaatcttctacacgagcaatgtcttcttcttccctaaaatgttttaaaatactttgaaatattttcttgatattccgtttttaatattttactttgaattacttcaaacaaatggccagcacccatgtgcttaccacccagctttaacaagtatgaatttttgacatctttgcatcatattttatgttccsttcataaataggtctgtgaacaaaaactccagctggcaatacaactgctttctctaagataagcatattaggagctagttataattctacatctttatttaggtttttaagtatcagatggatacttaactagttattacagaactatcctcattacaacattttgaataactgtaaacatcaagacaaagattttttcttcatttattgtacccttcctatctcagacgaccagctgaacttctgaaatraatgtcctagacaacagaatcataggcagtttcttttacctcccggc

SEQ ID NO: 20257 - DNA, 598 bp, Bovine  MMBT04791
  misc_feature (1)..(6): n is any nucleotide
nnnnnnactacaatgttcagaaaagggctgcacaggggcatcttaaacaatgtaatttaaatattcaaactgtgaaacacttttcctttatctttgtcagtgcctcctacaagatggagagcaaagtagaacacaaactgctttttattttcatattcttttttgttatgattataggatattgaacatggttccctgtgctctgcattttggaatgaggggagaaggcctgagagggaggaaaaatgaataataatttcaaaacgtcaacatttctataatttttgctggggaaggtamaatgaaggctcagcttcaatcatttttttttttttctaaccaattccctaaaaagtgttggactgcacatgatctcttaaaaagtacttttgttctacaactgaagtgctgctgctgctgctgctgctgctgctgctgctaagtcgcttcagtcgtgtccgactctgtgcgaccccatagacggcagcccaccaggctccccatccctgggattctccaggcaagaacgctagtagaattaatttctgaaatggacatacttatattcacatttccttgaatgtttccgttataagag

SEQ ID NO: 20258 - DNA, 600 bp, Bovine  MMBT01961
tcccagacccactccagttcctgtttgttatttctattatgttttcctagacttaactcaacataaaatttttttttttgttgtctttgacatttagtttgtctcactatatgagaatgtacactctttgacgactggaaccgcatctgtcttcaattcactgtgttctccctagtacttgtaaaagagtcctgaccattatagaagctctttattttttttaatgaatgagttaccaaagcattcattctctagaaaaaggaatattaggctatattcactttgaaaatggtttaattrttatattgaataagtagttattaaaatgtttcatttccttttttctattacctaagtagggtttcatatcaattcatctctgaaaaccatcatattaaaagggaaacctagaaaatattggggatgttatatctgtttctttaattatctatcatcagtcatctctctccctaacttacctatctatacacatatgcagacacatagcctactaaggagctgtttcaccaaaataggaaaaatcttggtcagtggacattaacataacttgagatgcttaaatggagattcaaagcttcc

SEQ ID NO: 20259 - DNA, 600 bp, Bovine  MMBT10971
cataagctctgacggtgagctccagatttgtcactccctaatctggccatggctatagctagctgtcatcaagctctggggagcaatgctgtaaatcattttcccctttgtgcaaggagaaaaaatagaaaattacattcttctcagcacttttgaatgtgctggtgcctctgtcaatagctccttcttgcgagcagaaaagcagcatgatccccaggaagaatgtgttcttatgggcatcagcccagtcatccacacacagagggagagcactgttcactcatcagagtgctttgcccygtcagstcatggtgtgtacctcttaacagcaacctggggtacaggtcagatccccccttttgcatattggcgacctagacttaggaaggttgaaaattcactcaagctatcaggaggcagagctgcacctcaaatctgagctgaagttcagagttctgtactcttggccctgagtgtgattcaggactggggaactgcctaccgaagtgaggataaaatctgcctaagtaataaaatagcaaaataataatagtgacagttgtaaaatgctgctgctgctggtggtggtgatggtgctga

SEQ ID NO: 20260 - DNA, 600 bp, Bovine  MMBT01595
aagttaaatctttccccttaagcacrgggtttacaaaagtgagccgactatggctcctgctcatgaggagcctggaaagggarggagccacacagacaggaagagctggcatggggctgcttcacccctgccccctttctcctgggaccctcacttggaggaattcagagaaatgcccyatcctgcacgctggcagggagcttcctctagctcctgtcctggcagggctatcatggctgccacatgctgccagcctgcagcagccccgcacacacggcctctgtgcaccatggatggggyttccgcgcaaatgaaagtgagcgccagccgggcaggtcccagtcctgcagcatctcagcagggagagggcacttgggatcactgacacattttctcacccatgtgcttgctgatttctctgcatttacagtttcggcagtgcacaaagaaaccaagcagttcttcactttatataataccctggatgacaaaaaaggtttatttggaaaaagaggtaagagcctttatagaaagaagataacatagatgagtgtgtgtcacgtgcccagtgctgggtacaaggtcagaaagtgcatgatt

SEQ ID NO: 20261 - DNA, 600 bp, Bovine  MMBT02427
taaatctatccctcatacatatactataaaagaaaaaaaaggggaagggagaaccagagaagagattaaagatgaaaagaaaataatccttgaaaagatggaaattattatccagcctggaattaaattctcagcaagatttccacactttgttgaagggtaggactggtgtctcactttttatgaaactgaactttggaagacacgatcattaatgtacgaagagaaattactgtagtattctgaagtaaatttgagaataacttgaaaaataggttagcttttgaaaaataaggatamacataacattgatctcctatttttcctggtacaatgcatctgaaaaacagccaaataaatggaaattgctgtacacagacagaagaatgatagatgaaaagtaaatagaaaatataacgaaaagaaaaaagtacatataaagggcagaaaataataaaagtcatgaaattagaaaatatatatagtatcaggtaactttttaagtaataagtagtatatttatagtaccttgtcaaaaaagctacaacttggtacaaagtctctcacaacacagaataaaatgtgcttgatgtttgttct

SEQ ID NO: 20262 - DNA, 600 bp, Bovine  MMBT18240
tcccctctggtccggtggttaagactctgccctccagttcatggggcatgagggtccagatttgatcccttgtccgggaactaagataccacatgcagccaaaataaataaataaatagtggaggctggtcaacagccatttgagctgagtgatgtgaaaaagagctagagcttgaagaggctgagctggcagaggaattgttgggagctggattcaggaaagcttcacaagcttccgggagcttggagttagtagattggacaggaggagaccccagaggcctctgagagcagaagaargtcgtgtgagatttattgtacaatttgtgattaattggtggtgaggtgcagaggagaggaagcaggagttacagctttgtcctggtgcgtggtgagaacaccaattcaggggagcaccagggcaggcagggtgcagacaagtgaaggactcatcagctatttagacatcaaagtctggggagacatcaaagagcccaccttccagagacaacaaactggaatcaggagtgttgatgctggtgctgacagggccaccgagtcagggtctggggggactgggactggggctggagctcgggg

SEQ ID NO: 20263 - DNA, 600 bp, Bovine  MMBT06679
atatacatgtatagttcattaatatatggatatctgacaaagcaccatgtgatatattgatgcatctaactttacatttaccaaatgtctgctagcccactgtttccaatatttaccttctggaaacttgcaggttgtaaagtgaataaaaattagttgtatattggtgctcatcagacattaatggaaaaggaaatggcagcacactccagtattcttacctggaaaatcacacagacagaggagctgggtgggccacagtccatggggttgcaaagagcctgatgctggtgagcgtcygaggacagcrcatgtaagtgtattgttgattcctttgctgtacagcggaaactaacataacgttgtaaagcaactactctaataaaaatttaaaaayaaagactgtagttttatatgaagagttacttctcaatctgttacagtagctgggtctcagtttccacatcttctcccatgttagagcttttgaaaagctgaggcaccacatgtaagaagatctaaatgaatggtctcacaggggtktacatggggctgttgtctttagatcacaacttccacaaatgatttttaaatatttaa

SEQ ID NO: 20264 - DNA, 600 bp, Bovine  MMBT02927
agccagggcattgcttatttctaaaagctctctaagcaattttaatatgcagccagagttgagaacctctggtttaaagcactgctaaacaatatctggggttttcttagtgaaacaggaatgctgttaacttaaagaatgccatttacacaattaaatataaatcaagccaaagaaataatgatggtttttaagttcttctagatgagactgaagtttaccacgacaaaactgcacactcataatgagataaagaacaaagttgagaatgcactctcaacaactgctcctgagaaataygcctcatatctatcttagcagccttatatacaggcctgcygttatgtttcattttctatgctctttcatgaggtaccccagcacctgtttaaatatgtctgaagtagctgttaaaaagaaaaacctaagtaaacggcagatgttcacataatttattcatccctgaaagtctggctataagagaagaaatgcatgcagatgaatactcagaggtgacagagaagacaaagctggtgccaatccttttayagaatgacacccaccaaaacctctcacagagacttgaattacgccaggaga

SEQ ID NO: 20265 - DNA, 598 bp, Bovine  MMBT04255
  misc_feature (1)..(48): n is any nucleotide
nnnnnnnnnnnnnnnnnnnnnnnnnnnnnnnnnnnnnnnnnnnnnnnnttgtatcattactatttgaagtggcagcagtgacctgatctgagcacagggccttcttcccaacctttgatgtgctgtcggaagataagttaaatcccaggcttttggcatcaggttttaatttgatattgtggaaatgaattgtgtactcagtattaggacagatagtgactgcctattacctatctagtgaagtcattggaggcactgctcaggtggaacaatcaggaaaaaattagaatttgtcagctkcaktatgtgtctggtaatttgcctcattcataataagtgtttagaacatttctgattagctgtcaggaatttattrcttctgacaatagactgttgccacgtgkactctgggagagcactggttaacagcatatgggaactgtttctcctgctgcttgaagaaatatttagcagtccttcagttttagaaactatgagaaaacaaagtgctgagatcaaaacaaagaggatatgagcttcttacaatacagaattcataaacgtcttccactctgtgtctgacaatgatatataygtg

SEQ ID NO: 20266 - DNA, 600 bp, Bovine  MMBT05110
aaaaatgtgcacaggtatattctgcaaaaattaattttaactgtattgtgattatagtcaaaaagccagttgtgatttataatttaagaaaataaacaagagtttaaacaaaaaaagaacaacccttgctatatcagatacaacatatactctgaaggcacattaattaaagcagagtggggaatgggtcaaaaatatatgcataaactgtggatgagaacagttcagttagtaggtgcagaaaatatacagggacttaaaatatgatagaaaaatactgaacttcgactatagagggayagattatttgaggctcttgtggggaaatcaaccatttggggaaaagttaaagtctcacttcccaagtacacaaaattagttagggataattaaagtcattgtgaaataggaaatcataacaacaaaaagaaactataggtgaatatatatgtgacttggttgggaaatagctttttaagcataaaaatggagtgaattgcagagagatagactaacagatttgtccacataaaatttaaagactacatttcatatcccaaagtggatggtaaaggttttccacaaccaccatttcctaat

SEQ ID NO: 20267 - DNA, 598 bp, Bovine  MMBT20439
  misc_feature (1)..(76): n is any nucleotide
nnnnnnnnnnnnnnnnnnnnnnnnnnnnnnnnnnnnnnnnnnnnnnnnnnnnnnnnnnnnnnnnnnnnnnnnnnnnttcttccctcccttccttccttctcttttcttactgccttttcttacttgtcttttctctccccttctctcgtccacgccctgtctgcctccctctcttgtgtttgtgcagagcactcttttatctcctttatatttgacttgtggatgaattaaaattgtaccatttgctttgtggtttgattgttttttttgtttggccttctgaggccctgcaaggaatcrattgtgctgtgttgggcagagatcaaaaagctaaaagaagccagggctcaacccccagggtacaggtaaagccagrgtggtggggtcaggtacctgtrtgctccagcccttcgccccagtgcctgacccgagggcggctttccagtggggacccagacagcccttccactgccacaaagaaaagccaatgcaccctcccagccaccatccacgaaaccagggctctggggggctggagaggggtcccagctgcctgagcagtgactgcggctttatttgctctctttcctcatttgca

SEQ ID NO: 20268 - DNA, 600 bp, Bovine  MMBT12971
tggtttgagccttgggatttttccagcttatatggctttttgagcggcagggttaaaggtggggactggctctgataatattcctcccaggaaagtagctttaagaaaccctactgcagaggaaaaattagctagatatcccacaatggaaaagagctcttgtaattttaccttttcgaggggctagagaggtagtatcgcctaggggaggtgcacagggcaccstgctgttggtcattgggcaggtcacttaccctctcgatgcatctacaaacaggtagggtaatggtaatagtgccyccctcaaagaactgttgagggtcagagaagttaatatatacagagcatttagaattgtgcctgccatctgttaaagttagctattatttcttttagctctgtgtttttgcaatgtgttgattttctgagaaagtgtaggggacatacaggaagagtggtcagaagatagttcaagcgaggatggtcacttccttctttcccctcctcacactccccaccctcctaccccacagaccctggagctgttttgtgaggcagtaacgtcatatttgaatgyatgaccttgaaaacttctgatta

SEQ ID NO: 20269 - DNA, 600 bp, Bovine  MMBT02473
cgctgctaaggactattttatgtgctttcattgaattttttttctacagactgatgaggttgagattcatatttgtcttctccaagatatcttggacatctgaattagggactgttcctgggaaatctgccaagctgtctccctcttctttcctaacttggtttaaagcatctgctcattttcccccaacatcatagctccattctactctccacatcccactggactgtaaactcatggctgagaacattcctgtctgtcacctacctgctgacctgagtgctctgctcatgctcaaarggatttgcggcagcctatgtcttacwcatatttataaattccatggaacttaaatgtgcaacttttttcatagaagatgcctaatagatttatacttgaataatggatgaattccagtgttttaagtgttacattcaactatttctgtagttcccaggaatagtcagagtcaaacagtcaaacaggaaaaatttttagtctatcaacatttctgaggataggtttcataaatctctatttttttttttaaagaacctatcccactgtcaatcagtcatgyccaactctctgygaccccat

SEQ ID NO: 20270 - DNA, 600 bp, Bovine  MMBT11190
tccctatacatttgtctcactttgtgactggaggcattttttcagaagtctccctctcactgtatcatactcttttataagtaattaaaattattaagaaaagcaaaatttatgtccacaataggcatttgctgtgatggatgaacagaatggctggtcagaagacaggaagagctcttggtggagactcaattaactaccatattgtttgactcagaaaagaaygagagtccaaaggttttgcgtataacatattaacacataagagcatatttcaaatttaataacaacttgttttayctatacagtcaatagagccaaaaaaacttacttctaaaatctaaagtaggtattagctagctcagccgtttgaatgtgtctacttgtttgcccaggacaaagcctggcacatgaccaacrcacaataaatattcgttgaataaactcccttcttacagtcctgccagctttctcatttaggtgtcactgggcaaaataattaggaaggaggagaagcagcaagggaaaaacaagcttaataattttacctgacaaagcaytatgaacagagcatgcatttgctctgtagagaatattaaa

SEQ ID NO: 20271 - DNA, 600 bp, Bovine  MMBT11414
ttcattcgcttcagtcctgtccgactctttgctgctctatggactgtagccctccaggcttctctgtccatgggattgcctaggcaaaaatactggagtgggttgccattcccttttctaggagattttcctgactcaggggttgaatccgtgtctcctgcattgcaggtggattctttacctctgagccactggagaagcctggcatttgcctgtagtattttataaatgaatcttgtttctaacataatttattttttccatatcagtgtttaggtaaaagaagtactttccttttarcaatatacagaaactaacttcctacagattggccaaaatctttkaagtgtacaatccttagaggtaatataatcctctcattttgcaggtgggaggacagttagacccagcaaagtcaagtgagttagttgcccaagactgataagagactctgccaaagatgatgcttttgtctggtttttgatttgtttcccaatcttatgcctattcatatgtataaacatattcatatatattatattacttgtctgaaagggattttgcatctgcaaattttggtatccgtgggggtcctggaac

SEQ ID NO: 20272 - DNA, 600 bp, Bovine  MMBT06243
ccagaaaagtctgggtggattctgtaataatgaggattattattaatgcccctttgaagtggaaataagtgaggaaccctcctatggtgtgaaagttgttttgacaccctgaggaataaagacccctcaggagactctacaaaattaaaccccagcttctagagtctctcacagaggggtgagacaaaagtgctctcaatctagttcgaagccaagaagcagaaactaggagatctccctcttaggggttggctgcagagtccccaaggcttctgtcctctccaagcttgctgctgctckgtagctttttgtctatttggtaaagacgtgttatgcatcttaacaaacttgttcaacccttagccctcgtgatagggggaatctagtcgtgctagaaagccaaaggacatggagttcaggcctgcttcctgtcccgcttatcacctcttgggtaggaaaggcatgagcgataccatctgagtgtgctctttttgaaataaaaacttgactgtttttccattatttatgttagtttgacatgaatgagttccaatctcacgcatgatgctggggaccattcagccggtgctcctgtctgag

SEQ ID NO: 20273 - DNA, 600 bp, Bovine  MMBT04533
gagcgcgggctgcggcccccaaatgacattctgctgcctgcaactctgtaatcgcttttggaggggatattatgttaatatctcacacaagagcctccgatcaggcagaacgtcagggcggccaggcccaggccatatggtgcatccgaggtcctcctttgtaatcctgggtaattgaaatcctcttcctcattcggacgtggaaagccttcctcggtgggtagcagagggcccttgggtaatttactcaccgctcctcaggggaacatcattggggggatgatggcagggtggctgggrattcacgccagaggactttaccctttttgagaacaaaaatcccttgtacctacttaagaggaaaactggcaacagtaatagacccaccaattaccgagctcctgtgatgctccaggcactgagataattacatctgctgcctatgacaaactgccagacatgcattacgcccatttcaaagatgagaaaactgaggctcagagcaagcagcttgcccaaggtcagcagcttggagtagaggcaccaggactttccccaggtctggctggctagggctgcagtccgactgggagctggaag

SEQ ID NO: 20274 - DNA, 600 bp, Bovine  MMBT11410
aagagtttggtctctagaaaccaatcacagaaccattccttagaactgactcactggaagctatttctctgagactaccatttgaacaattgagttcaagaacatacagtcataactgtagtgacgacattaggaagtggaaatgaaggagctgaacgcgacatttagcctcctctctacggcaactcctctgaaaacatagaaagctagataaggaaattggtagcatcactagcagaaaacttcacatcccgtgagcttgtttgccaatggaataaggcaaaagtcaagaaaatggcytccacttcacttctgcctcccgaatctcatgcaaggaatcttgcaaggaatctcatttctaggaaactaccataggaaaagaaattttyagcattccaaaccctacaatagagaaaaacatactagaagcatgatcaaatagaaattgaattagccagtccaccatgcccaccacacagaagggaagactgagtttaccacattgaaagatctctatggaattagcaggtgagccatatctccagcccagtgcctggcgcaacatcctgcacctattagatgctcatcaaaaatttagta

SEQ ID NO: 20275 - DNA, 600 bp, Bovine  MMBT08628
gaaaagtgaaagtgaagttgttcagtcgtgtccgactcttcatgaccctatggacttcagtctaccaggctcctccgtccatgggattttccaggcaagagtactggagtgggctgccattgccttctcctaatgtttttatatacctgtttaattaatgaagaaccctatctctctatttggatcacatttttaactaaagaaagatgcttttaatcaacagttgtcaataacagatgtgttgacaactggagacatcttgtccatatagctgctcattcagccaacattttacaacayttggagtttcagagagttcttagacttcttcaaacccatccatatactcatagttaagaattcctgctctagtaaaagtatgatgatttaaggaatattgcaactacttgagggaaaagaattcatgtatgttggagctgggagataatcataaatctgaaaactgtcccttcaaagggaaggttgttttgcttcatttttaaagggaagaagataatggattttgttgttgtttatttttacaatggtttacatattctgatttctaactctagtagttttttttttttttttcaagga

SEQ ID NO: 20276 - DNA, 600 bp, Bovine  MMBT00669
aggcaaactcaaaccccagggatacaaacccttgttcatatgttaacttctcctcgagcaagtgaggcctgagggcagggctggctgtgtgttttctstatccccatggcctgggacttcgagtcaagtaataggcccctaggaaatatgtgctggatgaagaagaaaccaattacctgtctaaatatgtatttagcttccataagcatattcttttatatatttctgtatgtgcatatgtatctatccttccataaaaacttggctgagaattttttcttttctcttccagcatctaaygaccagcacatagcagatactcagtagctataggttgaatggctacctggcatgtaaaaaatasattgaaaagatgaattaacaaaacatccatggtcatgtgccaccatagatgcatttttgtggcatttacagtagtctgaggttgaatgtgggatactccacaaatgaacacttaagaggccagatactttgccacttttgaacattacactcaatgccttgggggcccaggtccagggaggcctgatgaatctttttgaatctgcactggcaagatggagaatgttatggttcagt

SEQ ID NO: 20277 - DNA, 600 bp, Bovine  MMBT01076
cgaaaggctccaaacaacctcaggtatcccagctctcrtctgctcacctgccgcaggaagctgtctttatcacattcgctctttgcctgctgctgaaatccaggccgttttcccctgttgggatctcgggaaagctggtcgccatacactatcggcgtcccttcaccagcgttcagtccgcgagtcccgccttctcacctcacctcctggctctccccgagcaccaggggtggtgttgggctgcccaccacactgtggggcgtgggggctgcagggacctgctttgcagcggaggatacraggccgggccctgtgttggcctgaacatgtagagaggctgtgggcaggtacgacctccatagtcacacatggctgggaaagtgtgcgttagcgaggaggatgggcgagctggtgggtcccagtgttcatagaacatttccagctgcaacttgatgcttctctctgctccctgaaaaccaccgagtcctcctytcctgcccctcattttgatggtctgtaattctctggatgaggaaccgtgtcttgtcttgtttagcattgggtccccggcacatggcaggcacagaatgcaagcctgat

SEQ ID NO: 20278 - DNA, 600 bp, Bovine  MMBT01083
aagtgctgaaatgtagaaggagggaatatttatgttttattgggattttgctgtaaacctaatttttctatttctgaatgagagaaaattcatgcaaacccctaagaaagaatttgccttttttttttaatgtccacttaaaaacactccacttgccttattttgaaagtataagctgttgagagtaagagctaactttatacattctttgttattctctcaattttatgctgatttaataaaatttaattttcaacgagacaggggaaagagcaagtacgtgtgaaggtgtctcgtacyttacctgttgatcttttgtgtttgcctgtccaaggatttatttacatcttttagaagtgttggtatatatgatacattttagcttataaaaagaatgtgattataaacaaatgcccatgttgctttttaattgagctttaaactttcataatccaatcactattttccttctctactattcagctcttactacacacatgagaacaccacagcacttaagtttcatgattcactgtaactggtgatgctgcagaagtaagacctctggtaatttacaaaaggtatatggttcagtaaaat

SEQ ID NO: 20279 - DNA, 600 bp, Bovine  MMBT13086
tactatatctaatataaatcacaaataaatatttcatgttatttaatggtgtcttgaaatctgcatgaggcatgcagaaaagtttttgaaatggagagaagtcagaattaacagaagaaagaccaaatccactgttttgtatgcggcccacaatgattattaatgaacacatgcactgggacatagataattaaaggagactcagaaaatacaacctagaatattatcaaatgcaaatcctttcattctcagattcttttttttttttttttgagcaagttttgacacaaattataactmaatcttattacaaggcactcaacattaaatcatacaatttttaaactcagaagaaccttaaaaggttaatttaaaaatggaagaactgaagttaagtgatgtaaagtgacctatttatggtcacacaaccagttaatagcagacatagatttactgacctgttaggcctatgccctttataccacattatgctgctacactgttagtaatgtcattatttttgtcattaatgtcatatttagcaataattaccacattttataaagaatttggggagtttgcctcttgccttcctgaccc

SEQ ID NO: 20280 - DNA, 600 bp, Bovine  MMBT08928
tcttttcccaattttgaaccagtctgttttyccatgtccaattctaactgttgctgcttgatatgtactaaatcaaagtaatttcagatcaaatttgccaatagatacctcaaaaataagtacttaagacactcttatgttaaataagagaaaataagtattcatggcttaagtgattttcttgacaatcacttatgtacaagcatttcatggtttgtatcagagaaaacatactcagagccagtactatacctgactataataagtgaacctaagagttcagccagcctcaactacagyagtttcattcagcaggatcaaaaaagccatttgccagcatgatgaaaccttttctgtgaccatagtctgcaaggctcagaattayccagcaattcaatcttcattacctctctgtctttaaagtagaaacccacttggctcatattttaacagtacatccctataataggatggctatgctgagatcctgggtagtaaaaaagtatgccaaggtgatttggatccattttgatactttctgaacctgaactccatagctgcaaggtcaattttccttaccactgaatagtttgtacctag

SEQ ID NO: 20281 - DNA, 600 bp, Bovine  MMBT11959
aaacagtacaatctaggagctcagttaagttctctgcagttcagttccaaatctttgtcaagaaactatagagttttttaaactggaatagcttactctttctaccagacacatagagttgataattaaagggtttaaactccattaatctttattagggaatgttcataacatggcacaaaggaaattcttgacttcattatgctcaacttgtacttttgtgcctgtgacaggtaacaccccttaccacgttcatattccaaaattatacttcctttggttagctggcaagtgaacatytgggaactctcacatgaagttgctgcctgcctgtcaaccattctgtctgcggagttaagaaatatttttctacacgtcaatagtaatgattcagttatttgaagattatcatttcctattccgggcttccaagatagcactagtggtaaagaatctgcctgccaatgcgggagacacaagagacgcatgttcgagccctgggttgggaagatcccctgaagtaggaaatggcatcccactccagtattcttgcctggaaaatatccgtgggcagagaagcctggcgggctacacagccca

SEQ ID NO: 20282 - DNA, 600 bp, Bovine  MMBT20470
attctaaatgctatctgcattgcttatatatatatgtatgtatgttgctgttcagttgctaagttgtgtctgactctttgtgatgctgtggacagtagcacgccaggcttctctgcggttcaccatctcccagagtttgctcaaatgcatgtccrttgagtcggggatgttatccaactgtctcagcctttgctgtactccttcttctttttttgtggctcatatattgggaggcacgattattgtcttccagcaagaaaatggaagcaatttgcttcagtttcatccttcaaacgtttrttgggtgattactayatgctattctctgtactgggcactaagcgttcaaaaatgaaagattttgctttcttctctggaaaactcaatatcctgctaaaatctaggagtgcccacagtggcttattttcctttctggagagttctgtgtctaatgtttctcatcttatttagtcactacttttccccctatcacttttcatcacatcatgaatgaacaaaaattaatcttctcctattatagcttcaccttaattctgattattcctcttaagtaaaagttatttatcttcaagccttacg

SEQ ID NO: 20283 - DNA, 600 bp, Bovine  MMBT20469
tgcattgcttatatatatatgtatgtatgttgctgttcagttgctaagttgtgtctgactctttgtgatgctgtggacagtagcacgccaggcttctctgcggttcaccatctcccagagtttgctcaaatgcatgtccrttgagtcggggatgttatccaactgtctcagcctttgctgtactccttcttctttttttgtggctcatatattgggaggcacgattattgtcttccagcaagaaaatggaagcaatttgcttcagtttcatccttcaaacgtttrttgggtgattactayatgctattctctgtactgggcactaagcgttcaaaaatgaaagattttgctttcttctctggaaaactcaatatcctgctaaaatctaggagtgcccacagtggcttattttcctttctggagagttctgtgtctaatgtttctcatcttatttagtcactacttttccccctatcacttttcatcacatcatgaatgaacaaaaattaatcttctcctattatagcttcaccttaattctgattattcctcttaagtaaaagttatttatcttcaagccttacgattgctttcaaaaaa

SEQ ID NO: 20284 - DNA, 600 bp, Bovine  MMBT16461
catgttaatatagctgctgcctcctggcagtaaggatgaagttgtctttgcttgcacaagctggcatttggcatgggcatacaacttcttgatatttcagtcaccaaaccacttaaagaccatttgaggagagaataagtgtcctggttgttgtctgaacgccttttgtgatacctcctggtaagatcaagaacacgtcagcatcaaattttacagaatgagtgtcaatatcttggaagaagatcttggagacagcaaagaaactctcttaaaatacgttagcatcatcacatctctcawtggtacagggaactatctgcctggaaaacctcagacatcgacaactctgagcgtcaagaagtgattcaagagattcaggctggaagatgttttagaaatagtttaatttatttaacttgtagtttccttttttatgcaatcagaaaatgctacatgagaaatacaaagcctttaagactctttaaacaagataaaaaaggacaattttaaatgactggaaagtgatatatttaacagtttttcttagcatgacacaaaatggtggtcccccttagatttgagctgtcctggaatgatgaa

SEQ ID NO: 20285 - DNA, 600 bp, Bovine  MMBT03193
aatttccatgagtgcttaatacagtctgatatattatgtgttcccagtaaatatatttttttaaaaataacaaatgaactttaacaagaagcaaacacaccaattaaattaagactagatgttaattaggagggtaatggaattacctagaacatgtgtgcaatactgaataatttaagacttataaagttattttacatatgattttctagtttaaaatattattatatttggtgaatttccttaaagtatgctaaagccaatagaattaaatataatagattttgctataaaagtggyctgttctgtttagtgaagtgcaatttctctgacttaaaatgatggctgatggcctctgtgtacaaattcaatatttaatctaattgtataaatagaagcataccattaattcatccatgtgggatttaaattagttactctgaaatttatcccacatacatactcactttttaaactgtcactgtgaaaataaaaactaaaaaaaaaaaaaaaaaattggaagatagtagtttcaaccactatgatcttcttcaaaaactgtacatgttctttttcttttgtttcaactcataacattta

SEQ ID NO: 20286 - DNA, 598 bp, Bovine  MMBT04937
  misc_feature (1)..(32): n is any nucleotide
nnnnnnnnnnnnnnnnnnnnnnnnnnnnnnnnttctatctataaatgtaaagataagattgcttcttggcaactaactacagggcttagaggaaaggactaatgagttgacatttgtatagacatttgaaaacatcaaacaagcatttctttgtgctgttagtagaattcagtgttattactgagctcatgtaagaacagttattaaatgaatgagaaatgaactagtggtatagagatgtataaattgttaaaataaagatgactgattaaaaaccaaaaggcagaagagatcataagkatttatataaagtcatttttgtaatattaccacatttgaattaagcacatgtaatgagttcataaaagacaggaaaaaaaatcagtgagacaaacatggaaggatgaaaactcatgcacctgttctctttcaaaaacctcacacgcataaagaaaaggataaaagatcgtataattccacacgaacaaatataacagtatgagctgactggcaaaatttgagaagctggaaagcacatctacaagtgatagctgattaagcaaactgaagaaagctgaaacttaggtgcgtagaggct

SEQ ID NO: 20287 - DNA, 600 bp, Bovine  MMBT17894
atggggtcgcaaagagtcagacaccatttgagcgactgaactgaactgaactaaagtcaccttcagcatcggtccttmcaatgaatattcagggttgatttcctttaagattgactggtttgataataaataattatcattgttaggatgtacttccacgtggaggcctgaaaagctcctccttcttccagaccttgtttaagtgtcatctgctctgtgaagcctgcttagacctccccggggcagaattaacatgccttcattagttccactgccgtattttatatgtccttttatctrtcctttggtacactgaacttcaatcatgcccagttatctgaatcaaacgtatggtttcaaggcctgatataatccagaaaaagaatagtcactgtgggagaaattcttgcttttttaaagaagagattgttaacccacgtgagtctgtaactaggaaagttgaactgaacgggtggaggaatacttttggggtagagtacttcctgggctgggcctgccctattccagatttgtcaacatccttccttccaactccttccagctgctaactagactgcccagagaaaaatgcaccatacc

SEQ ID NO: 20288 - DNA, 600 bp, Bovine  MMBT18475
gggacagctatgggcctaagttaacaaagttagtaaccggtactttttaactttgaccagagttgtgtgtacgttcattaaaattctagttaaaaccacacagtaggagtttcctacaataacttgaaaatgattggaaactgtgtttgaaagaaaggtcaccatcagatcagaggattactgtagagaatgtggcagcacagtccccccgcccacagtagctcacagtggagtgaaggcccagaaatgagacaggttaatgggacccacgggtgaaccagaaacgaagccaagagtgcrtgagaatttagggcacctctgatcactgggagctggtggttcttctgtgagtgctgggggcccctggccagacccccatgcacagagtgggcacccggagggctgtcggtgggctctggccctgtcgctgacctgcctctccctccctcagagcttcttgcgcgtctgcggtgaaggccccagcacaggtcatcgtgctccgggccctcgccttcctggcctgtgccttcctgctgaccacagcgctttacggcaccagcaacccctttgccccgggagccccgctgcccccgaccctgc

SEQ ID NO: 20289 - DNA, 600 bp, Bovine  MMBT22967
ccgggcccttttcttcagaatagataatccccatgtgctatcagggggtctgagatcctcagagactgacttgctgctctgctaactttatttcttttcctagagggagaaagaaatggtcttacccgccgtccaccagcacaatcctgactgtgacatttgggtccatgagtatttcaccccgtcctggttctgtctaccgaacaatcagccagccctgacggtcgtccggccgggggacacggcccgggataccctggagctgatctgcaaggtatgaggccacttggggttgtttgygttggaggactcyacggacactcagatgcgggtggcagaggaggaktcttgaaagaacacctttatttcataacagagcagtgttggatcctcttgtgatataygcataatggatggatgtgatttcttccacactaggaggagagggawtctcttagtagcttcttgcaacatgtgttcttgatagatttgtgcaaagcctmttatgtgctcattgcacaagttgtaragaatttaggtaaagaacaaagccgaaaattaaggcacccttgctcacaaaattcagaagtcacctcggtg

SEQ ID NO: 20290 - DNA, 600 bp, Bovine  MMBT01601
tttttaccatcactcataaacgaagaagttaaaattaaaacaataatgtggtcattaaaaacctatcatattggaaaagaagaaaaaaacgtctgataatatccacgttgttcagggcatttgattgtgggcatcctgacctctgctggtaggatgtttgttgatattttcctggatggcgcaaagcactatgtattaaaaccttaaaatgaacatggatttagtgtttatgtttcaaagtttatcctaaggagacagtttgataagtttgcaaggaattatggcactaggaaatttgcygaagccctactggcragagcaagacactgaagagctgacatgatcatcagtagaaagatcggttagcacatgatggkatatctaccagtaagatataaagacggatatctatatttataaacatatgataatatgctaaatgaaagtctagaagataaaacaataygaacaatatgatagaattcacttaaacacatacagttggccctttgtgtccataggtccagcattttcagactcaaccaacccccaggtggraaaaaatatgagaaagttccaaaaagcaaaacttgaatttgc

SEQ ID NO: 20291 - DNA, 602 bp, Bovine  MMBT13976
  misc_feature (1)..(2): n is any nucleotide
nnctgatgctgggaagagaagggagcgacagaggatgagatggttggatggcatcaccgactcaatggacrtgagtttaagcaaactccaggagacagtggaggacaggatagctggcatctgtagtccatggagtcgaaaagagttggatgcaatttagagactgaacaacaatagcttctactagtttcttgcaaaaaagtaagttggggggaagaaaaaaaacttttgagagcaactcacaatatctgaaaatgacttaaaaaaaaaattatttgacggtgctgggtcttagttgcagygtgtgggatctagtttcctgaccagggattgaacctgggccctttgctttggcagcacagggtcttagccacaggatcaccagggaagtccctgaaaatgtcttaattttaccttcacagtaggtttagtttggcaggtacagaagtctaagttaaaagccattttattaacacctcaggrtttggaagcctcratcctgtcctccrgcttctgatcygccactgagatctggtgtcatgctgatgcctggtccttacrtgcactctgtttcttttgtcgttgttcagtcgctcagtcat

SEQ ID NO: 20292 - DNA, 600 bp, Bovine  MMBT16300
aatatctacctctatagtgagggtgtcctgcagactgcttcagaaccgtatcaggtggattatttccaagataaaaccagccacttgactaatcactgcattcaaaaggagtactcagagaactatgggaagtatgaagaaggggaacgcaatgttctttgaggaattcaatcagtacctaacaagtgctttgaacatcaccctggaaagtagtatcttactacaaatcaaaggtatcatagagttacccagtcctttctctttctgttaaatgtgtcttgatggagctttgggagtttrtgcctttcaaggaattgttccatttcagttgtcgagtttaaggacaaaaattatttgttatatccctgtattatccttttaatatctatataatctgtaatgatgaaactttttaaaatccttatgcttaatccttctgttaccttatattggtaatttatatcttctctctttcacttgggcagattggttagaggcttatcagttttattaatctcttctaaaggtcagcttttggctttatagattttctctgtcattattgttttcaatttcttcatgttctttattatttttatt

SEQ ID NO: 20293 - DNA, 600 bp, Bovine  MMBT07592
aagctgcgatggctggtgagaaggagatgcaactgcagatttagcgagaacaccctcccctcccccaatgactggagaactgctgccagctccctgggcagagccctaaatgctccaagcccagaggatggtgtccccttctaagtacccttccctcatcttctccaaccataagtgaggcaggtggaggcccctgagatctcccttttatctcagagccagcaaggtcaggacaaggcaggcaggcagagcatggtcaaatcccaggtccgcctctacttacctgagtgcccctgtgtyagctactccacctctctgagcggcagccccatgcctgcagggtgttaagatgccggcagcacaatcgatgctgtgccctgggccccctcaaatcccattgggaattctgagcgcgctggctctccatgcgcatccattgccaatgcagacactgaccaactgtcggaactctccttggcactcatggaaatgtgcaccctcacgaaggactggggatgcccagctgccccgttccactatggggactgtttggagtgtaagctcaactgtttccaggttccttctgcaggaccagcccac

SEQ ID NO: 20294 - DNA, 602 bp, Bovine  MMBT01483
  misc_feature (1)..(2): n is any nucleotide
nnattctgaaaatatatcatttatgacatataatatattaagaattccctcaacttataaatactagtgatttgtgatcctgttggacttcatttattttrcaaatgtttagctattcctttccatgattcagatgtgacttcaaactstgcttgaagggaagaaaatgcatagctgcagtgttttattgcagtaacaaagccattcaacagagtgattgcctttctgtattacttattattatatactactatatatacatatatatatatgaattttctgctattgaataagaaaacatmtytcttttgttgtgtgttcccacatatcatgtatcctgataataataaatctgtttctctcaatattcttctgtgaattgatttagttttatgtagcaggacatttaaacagcctttttaattcagatagcatgtatcattaaaattgtaattgaaataacaagtccgtgagaccccttaagatttcaacaccatgtttacagggtacagagctatcaaattaagactgaaaatttttctttttccttggggatgctgtttgcaaatgtaaattttcatgtcagtatttaaacatattgg

SEQ ID NO: 20295 - DNA, 600 bp, Bovine  MMBT06524
tttctaatggttcactaaattagatctgaaatatctgggattgctttcttcagtttcttagtaaagagatacataaaatcttggttattgaagaacttttgatacttactcctggtcatttctactgaaatgatctgagttgtttatcaataaaaatgaatgtagtggtaactgttcaagttggaatatattgaaatgtcttcactttctcagttacctgcctagaaagtaaagattaaattgaagtgaaatgaacaaarcttcaaagagagcagagtcagtccacagataggaaggttrwataggaacagcaaagtattatataggaacaggttagtatttcaaataacacagaaatttataaagtagaatacatatacccctataatcttctcctccagaaataaagcactatcaatttgctatatatcctttaagatatttagcatgtgcagtgtgtcagcagtaaagaatctrcctgcaatgtaggagacctgggtttgatccctgggtggggaaaaattccctggagaagggagtggcaacccgctccagtattcttgcctgaagaatcccatggacagaggagccaggtggcct

SEQ ID NO: 20296 - DNA, 600 bp, Bovine  MMBT15952
ctaaacatcaattgaataatttttcattaaatgatatgaaagaatacatcagttttaggtttcatcatagcccctcagatctattttcctaattaccctgttgatgttagttttaaaatgtgcctgtactggcaaagtgttactgtttctgtaaaatgggtcaaggaatattatcttgtttttgtcacttcaatttatagcactaatttttgtttggacttgtattcattcaaaaatttttctctgtgagaaaagactagttagcctgctgctactactcagttcagttcagttcagtcrctcagtcgtgtctgactctttgtgaccccatggactgcagctgaagactagttagcctgctgctactactcagttcagttcagttcagtcgctcagtcgtgtctgactctttgtgaccccatggactgcagcacatcaggcctccctatccatcaccaactcccagagtttactcagactcatgccctttgagtcggtgataccatccaaccatctcatcctttgtcatccccttctcctcctaccgtcaatctttcccaacatcagggttttttcagttctttgcatcaggtggccaaa

SEQ ID NO: 20297 - DNA, 600 bp, Bovine  MMBT05310
agctaaaaggagaaacatggaaaggctgactcttgcttgtggcgggatagccctaaattctcttaatgacctaaatcctgattgtttgggacatgcaggacttgtctatgaatatacattgggagaagagaagttcacctttattgagagatgtaacaatcctcgctctgtcacattattgatcaaaggaccaaatgagcacacgtttactcaaatcgaagatgtcataagagatggcttgagggctgtttaaaatgctactgatgatggctgttagtcccaggtgctggcgcagtggamgtgcaatggcagaagccctggttaaatacatgcccagtgtaaagggcagggcccagcttggagttcaagcatttgctgatgcattgctcattattcccaaggttctcgctcagaactctggttttgaccttcaggaaacactagttaaaattcaagcagaacattcagaatccagtcagcttgtgggtgtggacttgaacactgatgaaccaatggtagcagcagaagcaggcatatgggataagtactgtgtaaagaaacagcttcttcactcctgcactgtgattgccaccaacattc

SEQ ID NO: 20298 - DNA, 600 bp, Bovine  MMBT10386
aatgttgcctaaaacttattttttgcaagggaaagacaaccactgaccatgtgtggaagatccaaccactgcctcttcttccttggccactggaaaaagctgccatcatgtatcttatgcayaagacaaaagaaactgctaccaaaaaacaaaactgctaccttactctggtccctccaatcaagaaaaaggagggttttagccagttgcgaataaccacaaaagtataatgaaaaaaagaaagggggacttccttggtgggccagtggttatgactgtgtcttcccatgcaggggatgyaggttcgatccctagtcagggaactaagatccacgggaaacatgccttgccttatcttccttgataagataaccccaagatttgtaagcaaatctttgtgaccaaatgcttggtcccaggagataaaggctggtggtccaagccagtcccagaattctgatccctttctgccagtgactgaactagcagtaagtctaagacctagtacacagaccagtgaaatctgagaggaattctttagaagggtccctgggaaagaccttcttccctgataaaaaaaaagaagcaaacaaggtggcc

SEQ ID NO: 20299 - DNA, 579 bp, Bovine  MMBT01516
gttctcacacatacgcacgcacacacacacagacacgtgtgtgtgttttaatctcataggtggggtaaaagaacagagaaagattctacttattgtgataaagtctagacctgttcttctttttttttttaacaaatgagaaactgagttagagtttaaataacttacttaaagtcacacagccagaaagtggaagagccaaaaattgaaccaaggcagaggatccagagcctgctcacttaactactccaatattggtaccaaccttctaggtcctatgaggactagaagagtgatgtstgcagagacactggtcagtgcccatcagctattaatattctcattaggaagctggaatgatggctagcagcatttaatgtgttacctgcgtagtctattctgagaactttgtctcttttttatgttagtgttttgtttttctagttaattaaaataaacacctatttgtgctgaaagttaaaaaaaaaaaaaagtcacagcagcaatattcactgtaaaatcaaatagtggattttgggcttcctaggtgggttcagtggtaaagaatcgatccctggt

SEQ ID NO: 20300 - DNA, 598 bp, Bovine  MMBT12375
  misc_feature (1)..(107): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggagaagagaaaggctacccactccaatattctggagacccagtttgtagtactttgttacaatggtcccgacaaactaaaatggtgcatttgtctaaaacaaaggctttattaatcatttcttaattccctggtctatttctaacctaaaatgtggtgggaagacacactttattttgatgagaacatrttctgatggtaagtaaattgtttttaaatataagttaatgsaatttgtcaaaactaaaattgaaatgccttctaattaccaaataattccctgaagaagaaacttcaaagtaggggagaataagcaaatatttattaatgggtcttgtgtttcctctcggaaggtttgtctgcctgtagatgaactggatgcttgttagagtggaccagatacagaaagtggaaatgaacacaccrgggaggtggaggcagctccaacacctcccaatccattcagctgacctatcctaaaacacaaa

SEQ ID NO: 20301 - DNA, 600 bp, Bovine  MMBT08793
tgcttcttgtttgtcatattcactagttcgttgtacttttcagattccacatgtaagtgacatcatacagatttcgtctttgacttatttcacttactctaatgacctccaagtccyttcaggttactgcaaacggcaacattttgttcatttcattggttgagtcgtgtcccattgtaaacatacaccacgtcttctttgcccattcatctgttgatggacactcaggttgccttcatttcttggctcttgtgaatagcgctgccatgaacatagggtactttcctctaacctttaaaygttctatgcaggtcatacatagacttctgacaaacttgggcatggttttatggcattgcctcacaactgtgtttcatagagaggtaagcttttaactgtactcacttcaccgaagacaaaattgagagccagaaaatataagtggctggtctcaaaaggcaaatccatttatggtaggcagagtgatgctcaggcctaggtcttcatactgtcaattcagtgctccttctactggtctacgcaggctccgtgccttactctaaaatctgtcttcctataagactgcaggcatttatttct

SEQ ID NO: 20302 - DNA, 600 bp, Bovine  MMBT07361
agttcgatgagcgacagcatcaacagtaaagctcaccatctatgcagagacgaacccactaccggccaattatgagcgagtatcgctgaatgcctgatacgtatgcgccatacatgataagaagctggttcagtaaccagcatttctatagcaacgcacaccgctctgcaggctgygttctgggaaggcagttaaaactggattctgcaatgtagcttcacttggaatctgctttgatttttgtcacctcattagaatgaaagtattcaaaccaagtaacccaagttattatgaaacagmagcaacttatcatagagaggatcttaaatcatgatttctcggccacgcaaggtcagtcggtcactttcaattcaaaccactgacctggtttgcttattcataagtgaccgttccccagggcatcgaatcagattgcagtctgaccacctgggacatggggcagccatctgctgtcccagttacgagctaaagagaggaaatgctataaaaacaagccagcacaccatcttttactgtcccgaaagtcttggctaagatgcattcaccatgaccgacaaaactgcatttgtcctactgggg

SEQ ID NO: 20303 - DNA, 600 bp, Bovine  MMBT14265
ggtgttcctctaaagcctgtctactcagagtgtggccagccaaccagcagcaacatcagaaatgcaggggctcggggggccccccaatcccacacacactgaacccgaaaatacagcccagtaaaagcttcaggtgagtcgtgtgcccacagcgtctaggaaacatcagccctgtgggaaaacgcatcccccgggaggaatgacggtatgtaaagtaacttcttagtaaaagaatttgtttaaccaagtctctcttccctgaggacagatgtagggagtggggcgaaaaggggttcagamgaggtcttaggaagccaggacattttcccagtcatgacaagccatcagttacagaaaaaacaaaaacaaggaagtctcaatgtgcaaactaaccagcccacccaacacaaagaaactcaaggtcagagaggcagggccaggcaaatctggcctcaccacagcctcccctttgtaatgtgcttgattgcattttattttctgtgttttcactgaaatggcagttcgcggagaaaccctcgcatttggctgcgaacaggctctgagcagcaagagcgcttctgcagaattggcaggagggaa

SEQ ID NO: 20304 - DNA, 600 bp, Bovine  MMBT18506
agtgaggcagagggcagcatgggaccaaaagacatcagtcagcaggtggacaggaagttgatgatgcgggaagcacaagaaagctttaaaagtagctgaacaataccagagaaagagcaaatagtctgtatgtaagcagcgttcagagaacagaagacaattcatgaamataaaaatgggtgcgccaaggcccgggtacagttaagtgcaaatctagagattaagatcctaaacacacctagaggtctggaagggaaaaccagtcttaytcctgagatgaagagtcaaggacaaaccarygggctagtacccacaagagaatgaggaagtgtgagcttcaggctagagttcttgactagacyattctgttacacgcgtttggtgactctgtgaatataaggcctcagaaaatttctttctcacctaccgtttactctgggagggtgtactctgttaaacaagagtaagaagaaagatgtcaacagtggaacctgaaaacagggatccaacgcaggagtagatgccctagaagacagttcgggggcagttccgagcttccagcacgaggcactgcagcaggtgttgagcacgcccgctcca

SEQ ID NO: 20305 - DNA, 600 bp, Bovine  MMBT05290
aaaacactgtgcaatttaagtgtacatgaatattggccaacattccactattaaagaaacattattgtgaatgaaagttattgctttaaggaatgtggccatgagagctgcaatgatcagagcatggggaggtgggaaaataattgaaaggacctagcaaaccatggctgcataatacaagcaagtgccagtggtgggaaataagagctccaagccctgctcttgtcacctgaaaagccctgtgagctgcagccctggcctggcaggaagtagaaaactgacactaaggtggatgtcagrgtaatagggaaagatggcctcatcagaggtcatgatgtttctatttcaaacacagcagaggtgctctctgtatagctggtacagaggataatggaaactagaaatacttaagagcattgccttgtcttgctttcctctcttttattgtgtgggccaggggcacttgctgctgctaagtcgcttcagtcatgtccgactctgcgcgaccccatagacggcagcccaccgggctcccccgtccctgggattctccaggcaagaacactagagtggggttgccatttccttctccaatgcatg

SEQ ID NO: 20306 - DNA, 600 bp, Bovine  MMBT03454
ttgtataaacaaaccgggatgccttctttgagccatgagcaaatccacagctccctgttttctgaagagaagaagaattaaagatgggactgtttaagttggaaaggtctggggcttgaccttgctactttaaatttccttcatcactaggaaattgctttgaattcgtctgcttggagaactctaatttrgtttgttcttggtttgaaccacaccatgaaagagatgctgtccatttgtattatagcaaaacttggaagccgcctcagtgacactgttctccagttktcctctctgctrttttcatctttaaacctgagcttgttctcagtaattcagaatgagacccctgacatcttactgcctgagtgagygtcccagctagtctctgcttcacagtttgcctttggacaaaattttacacctttctctgcctctcttttcctygtgtgaacaatggggttattaataatgcctacctcatacaagcattgtgattattaaattaaatgaaattctragaaaattagcgaacccagcccacaaaacgtgcttaggaagtgttatgtattaaattgcttattgttgttattaattatt

SEQ ID NO: 20307 - DNA, 600 bp, Bovine  MMBT14824
aaatagaaaaaaatagaatagaaaaatggaagaaaatattggattttcttctcctacaacctgtggatttttattatttcatgctttcttatttatgtatcaaattaaatcattgacaccatctaagtgaaaggtgtctttcaaagggataaagtrttcttcattataagccgagcaatatgctctaaggttgtactgacatttgaatgctaatttctaaaacaaargaagaaatggttcccccaagacactcacagagcaataagaagattagagggagatttgaaggatgagactcakatgctacttcagcattccagaaaaagcatccatcacttagctgacasagtcagggtcctcacttgtcacttacctgctgtatgatcttaaatatgtcactgaacttccccacagaggctttatctgggaaatgggagaaataatacttgcttcatatacggactattttttttgttgtttcatcgctaagtcgtgtccgaccctttgtgaccccatggactgcagcatgccagacttccctatccttcattgtctcctggagtttgctcaggaggtttagcataatctagtatataatct

SEQ ID NO: 20308 - DNA, 600 bp, Bovine  MMBT03135
atcttgaggacttcaagaccgcatacgcactgtttacaccattctgatcaaagtcaatcatgacttaagaacaaactgtagccttctattcagtatttctttaaataatctttctgcttctctttgaggaaagaaaaaacttacaacctggagactagtattaaccataatgataatgttycacgtttacatgctcaragagctttagcatcattagacagttaatgcatatgacactkcattgcatgaggtaggtcagtactgttcttccctcttagcgacagggatccaggtgctgcragtttcagttctcactggtacacttgtcatccatcagtcatagggycagggctgggaaccaggtcgacagaatctctgatctctccaacgtatgtagaactgtgagcagccaacacttcccaaaaaaagactgttgacaaaaaaaaagtttatcaatgaataacaggattcaaatagagtgtttccattctttaggagagataagattgtgaataattaacagcacagaagacaatgtaaaaacgaagggctgttgtgctgtgtggcatagacagtatgagctccagggattcagataaa

SEQ ID NO: 20309 - DNA, 600 bp, Bovine  MMBT09227
ttccctttcttggagaaaagtttattgcccataactatatactgtttaacatgctgacatttatagtgaagaaataatttttaaagctgtcttttcttagtgccacagttggttgaaaaagagaacaattcatttaattaggagaatatattggtcatacacagtggaacaaattaacctatttttgacttwtttttttcactggtgagttgacagagctttggacaaaactggctgtcttctttgacacaattcactcacagccataggatagcctttccaacataaagtgaattatartaaattcttgtcttatttggaacwgttggtgaatggtctgttctggtgaactaaggattatcattgagatcatatgcaaataagcttatagaagaaacatcttatgttgaaagtaatatgacttttataggtttaactgctgactcactccatcaaggttcttagaagcatgyaccagaagctgactgtggctgactaagygaaatgatactttgttcaaaggatactgggaagctcatagtatcattgacctgactggagaacaggcctgaggttaagttcccaggaaccatgtccaga

SEQ ID NO: 20310 - DNA, 600 bp, Bovine  MMBT21733
gcacagtgctctgcagatacgctcagggaagcagtaatttgtatcatccagtaattgaagttgcgcatgttctcagctgagatcacagcaagcaacgctctgccttcaactcataccatgaacaagtgtgatttttgccactatactgccgtgcagtactcattgccacttytgtgtgtgtgtgtgcatttttgtgcctttttttttttttttcagttggtgatttcactgttaaaatggcccccagcggtggtgcggaagtgctatccagttttcagaatgtaggaaggctatgatggkcctttagggagaaaactcatattagatgagcttcatttagtgtaaatgatagtgttggagaatcaacagcatatatttaatgtctttaaatagaacacacataaaacaagattatatattgatcagatgatgaaagtgttgtaatcagagactcaagaagccctcaccctaatggccctgcagagcggtggttcagtattcactgattcagcattcatggtgactttatagaatagaacttccgtgaataatagaaatagactttgattttatgcctcgttgagaaatagctggtaaagt

SEQ ID NO: 20311 - DNA, 600 bp, Bovine  MMBT12954
ctaaggtacaccaaagcccaccccactaataataataaaatgagatggaaaaaaattttctaatatagcaatatgctgaaaactaataaagagggtatatattataggaattgttaataatggcaagatttaagtcttcagtggaatccttgaagagttgatttttctagaagtttgtaaagtcgagtcttcacaacagacacatatcaaagacttgagctcagactatcaaccttacacattcactaagcaaggttctgcttcctgagatgagactctatggactcacacaagtacaargatggctcacttctcaaggttaaaggcattctagcctcaagctcagcagctgacaactgcattgaacgtgaatcatattttattttgtctttttagaggaattctgccaagatgaactataaaaataaacacaaataggatttatgagagtttgtaggatatgccttaggccaactttcaggatcaatgaatttgtttctgactttaatgtttagaatgactcatttatatgtcttggagtaaatagtttgtctaatgttatccttttagaacatataataaggtggaattttcttcatc

SEQ ID NO: 20312 - DNA, 600 bp, Bovine  MMBT10598
ttttgttgtgcctagagcatgtaagacgttagtctcccgaccgggatcaaacccgtgtcgcctgcattggaagcacagaggcttaacagttggagcaccagggaatgccctcattcacacgttatgaatgagaaacgtgaggtgagagattagggtacatgtctgctggctcctaaggctgtgctctttcttctctgtcctagcgaaatatgcaagtcagttcaggataattgctaactagcttagggcccccgaaccttcctgggttgctgtccttcagccaagaaattgatgggaacwattctcacataccctcaaaattcaagcccattgctctttggtcaaagagcaaagactctaataaacctggctgacctwacaccaagcaattgtgctttctggcaattgcagacgtggaaacaatctcagttaataaacttacaaggagctgtcctcttctttcctttccgttctccctctctttctctctctccctccctgtttctctctkgtgatgccatatttttctaacctttcccaccatcaccttttcctacaacgtgttctactttttttttttttaatgtggatcatttgcta

SEQ ID NO: 20313 - DNA, 600 bp, Bovine  MMBT12655
cgcccctcatcccatccacctaggtggtcacagagcaccacgctgagctccttgtgctatacagcagcctcccactaaccatctatttttttttaggtctctgatgttttaaatatagataaaatactagagtctatatggtcaatattttgtttctcatgtcttagtgtgattaaaagactaggaaattttaggttagcctttcagttctgcattttaaaataaatctgcattgggaagaggaagaaaaaagaagtgaaaaacaagcaaaaaaagggattgtatctttaacacttggayatcaacgtgaatggtctctgaactggcagatggaacttgatcaatgtagacatgaaataagaataaagcttacagttgggctcttggaaaatgtagaaggtagaatacaaaaaagtgccattcacttgttcactgtacaaagatcacccctggtaatacttttagcctttttttttgcagggtttagattatttacatggcagcgaccatgtagcatatgcagaattatgtatgttgtcatttttagagacagtttctggttataaaaataatacagaattatctaaaactggaagatac

SEQ ID NO: 20314 - DNA, 600 bp, Bovine  MMBT14154
tccctggagagaaatggtatcgcacttgaaatggagtctctccactggcagtcgagcctgaatatttgggaagagctgtgcttctgagctcaggacaggcctgcggtgaacagagaggcagcaaggggcagagcaggtgctgcaaacattttccagaaacccataggccaagatccctaatcagcgaccacgtccgtctggttctggctcagaaccgggtccacactgaagggcgctggggtgccccttacctctctcactccccacctccactctctactacacatcagaccccagacrccctttctcgacggggttttcctccgttcagccaggtgctgtaagctgcccagaacaggtgaagggccacgtgggcactggtggcagacaatccaaagccaggccagcggctgccaggctrtcgggggctgcgtccaggtgatggacaccctggtccaggaaaagttacacaggcctgggaaagaaaacagcgggacctgcgtgtcctgcccacgcaattcgaaacaaaatgcaatcgccctaaagtacgcgttcccaactcaaccgtctaaatgagcttctgtcacattacgtgataaa

SEQ ID NO: 20315 - DNA, 600 bp, Bovine  MMBT14388
ttcccctcccacacttacattctcctattcctgctactctgtcactaccatcaccaccaaatagttgtgtgaaatagagaaggaactcaggtaagatagccagccaagctcttcagttctagtagcaagcaaaatgtacataccccatccaccaaagagccaacaaggaaaataatttatcataatccctaggacatatacaccaccaaaatagcacagaatcaagctctgcccaacactgaatacaaattagctggacttggctacatggtgctcttcccagaccttgtggttaaatcrtaatgagctttttaggaaaaacaaggggcctgtatgagaaatggattcctaggcagagccaataggagaaatgcttgatgaggtttggaatttaagaataagaagcaatgattagagaaacgcagatggggatgaaaatgattatatctgtactagactccaactctgcttatttacttcagagaagtgaaattaatctaagatatgctaccaagtggcaagtatttccatatactaagtgagtgagtattttatttaggggatgaaaggtgagtgtgaaggatagtttagccaaatgct

SEQ ID NO: 20316 - DNA, 600 bp, Bovine  MMBT09438
aaagataattctcaaccgaatccagatttacaagctctgaagagaggtcacatgtaatcttaccgttgcgaaaaactttattaaaatcaaatccttggcttgctagaaagtcaatgcttgagctctgaaacaagagtaaatagaacatgcatttcagtgatgttcatggcaggtgtgtgaacagaagcagagaaataactctggggagtaaatgaaggcaaccaggcaagggggcagcatgccacgggtcagaggacaaggggtttctactccacggctgctgaactgtccattcattcmcttcaactatctgggcttctctcctatagtttatgagagaaatatcctttgttacccaacatttaagaaaattttacttggtgaacttatattctcccaacaggaggaaactcctgaataaaaattaaatgtatttctattatctcaccccaggttcaagtttaagggaacaactgtgcaaattataaggtatcaatattcacttcaacttagattctagaagcccaaaatcttaattggatgttctttacattcaacataataatatagaaaaattcccagtaaagagacttattaaac

SEQ ID NO: 20317 - DNA, 482 bp, Bovine  MMBT20678
ctcagacactggaatcacctacctttggggtctaaggagttgatctgcaagctgaggggatggaagatctgggggtrggaagagaatctgctcaatggggccccctgaagtcactacacggcagcttttagatgtattggtggtacttcttctgccaaagagcaactttcccaaagccccactgacctctgctccaggaattaagttattaaactccattataaggcaacaggaaacaagagagccaggcaggctgcactctcatgagacaggggccccaggccaagttcagccaagaaytaactataagcaggtgactgacctctttttcatctgaaaagtaaggatatcacttgtttttaccatattccaaatgtgttctgcggctcaaagagcatagtaagctggcagggctttgcagcatttaaaccactccccagatgtaaatacagcggcatgtgttgtgcggctcctagagagca

SEQ ID NO: 20318 - DNA, 600 bp, Bovine  MMBT08626; identical to SEQ ID NO: 4815

SEQ ID NO: 20319 - DNA, 600 bp, Bovine  MMBT01625
ggccctctccatctccaggactctcagagagagtacagccatgccttccttcatcctgccagggtccacatcccaacccctttttgggtggggttttacctgcctgggccagcagtcacctggtattctgtagagccctggatcctctcctctcaaccctaaaatctcccaacatgaattctgggtgctgccagaatctttttttgtcccaggtaccaaaaagcataggtacctgggacttggagaggggattttgtattctcagtgtgttatttttagatcccttagttctgtcatcaytgtaaacttcagggagtatcttccctttagaaatcttcaagtgagaaatgagtcctggtttctacatccatgcatacatgtgtgcgtgcatgtatgctcagtaatgtctgactctgcgaccccatgggctgcagcctgccaggctcctctgtctgtggaattttccaagcaagaatattggagtggggtgccatttcctcctccaggggatatttcccaacccagggatcaaacccacttctcttgtgtctcttgcattggcaggcagattctttatcactggagccacctggaaagcct

SEQ ID NO: 20320 - DNA, 600 bp, Bovine  MMBT18871
tttttgccaagaagtcttgccatgtgacatttaaagtgaaagtcactcagttggatacaactctttgtgaccccatggactacacagtccatagaattttccaggccagaatactggagtaggtagatggtcccttccccaggggatcctcccaagccagggatagaatccaggtttcccacaatgcagacggattctttaccagctgagccaccagggaagccctgtgacatttaaagattatcataaagatatagtgggaggaggtagggaagggaagtggaggttgaataaaagasrtaaattctcaaccaccataagaggatgtcaaaagacaatatcttaaattgataaatcaagaaatagctgagtgagcaaattactaaagtacaaagagawaagtaatagataaaatagttagacattgaaagtggcagcctcttaagagcagtatggataagagatggagcagagatccatacrtaccaccaggtatgtcttaaaagaattcatttatttttagaaccatatgatcttccaatctttcttctttcagaccttgaccagttggccaaccctttgtcactgctcaggactcta

SEQ ID NO: 20321 - DNA, 600 bp, Bovine  MMBT22165
tgaagcaaccacatttcctccaaccttacctcttatcagtatatcctttccatatccacctgagttcttaaagcatagtaatattgtattactctattgctcggcaactccttcctgataaaatctgagagcatctcttgaaaataatgcaaaacacaggtccaaaataggatgctaaagtttctttgcaaatcagttgattcagaacttgggagtgcattttccttgtagaaatamtacatggtaggtttacaaaatagccaaaactttcaactaaagcatccataattgaagcctccyagtttagttaacagtgtttccacctggaatgtcaagatgcagtccaaatatgtgtagaaggtatggaggaggtcatttcccttcctatcctccrttggacatagagatttaataaaggaagagatttaataaataaaggaagaaagaactaatatttattaagtgcttattatttatcagtctctgttaggcactttacatattttatcttttttgagacacagttkacatttaacattgtgtaaatttaaggtatgcagtgtgttgatttgatacatttatatattacaatatgattac

SEQ ID NO: 20322 - DNA, 600 bp, Bovine  MMBT07879
ttttttgtctgtggtgtttatccctctggctatgaagctcacaaatggtaagtaaagccatgcttttcttagagataacattgatgctgtgatagaaaacaaagatttagagcactcacagcttgtaagactattatctggagttgtttataacttgtaagccctgttccagagccagtggagtcatagattttctctagcatcacttgctattcaaccatataattctacccactaatctgtaagcatttcccaatcaagcaaatcaaattcgaatgatatcccattaggaaaacctgygagttagatcaagtggtaataagatttacatagaagtttctgcaactagggatcatattttaacaacgtcagagtgtaataaatcttcatttcaaatcatactgacatttaaactagatgctgggtcattaaaaaaaaataaagcattataaatgcrtcayacattcataaaagtgatcttctgagaaataaacaggtgattcattttagatatgtcttttagaatttattttctgacattagtattgctataactatggtggagtagttgttaaatgtaattgttcacatatgctgact

SEQ ID NO: 20323 - DNA, 600 bp, Bovine  MMBT05863
gtgaaaccaaagatattccagatttcattagtgctgtcagatctatgattatagatcattctagtaatctcaatcctggtattagcctcagctaaataaattcttcttgaatgtgttattgtcagtcttaggagaagttacattagagttagtaattaaggtattagtccctgcttaaccaatttagggaaaaggaacttggctttctgagtattaagttgattgttcatagaatcttgactcaactgaaattttgacatgtaaatataagttgaaattttaactggagaattgaaataytcttttacactactatacaaattctccctctttattaaaaaatacagtgttatataactggctttattaacagacatagtagttatataaaaatttttatgagcaatatcatgtaatcaacggcagagacagtgaaacaaaagttcctataaggcatcatcaataaaataagcaaacaaaagaaccaaaagtgtttatcaatgtttcctggtgaaggacacaatgtaatacctgtaaacagagtcaggccttctaggttatttataaagcctgtttgggattgtgataaagatacttttc

SEQ ID NO: 20324 - DNA, 600 bp, Bovine  MMBT02524
agccatcctaaaattgaatcctacaagttactaacagacttaagcttacaaccatctctgaaaatagatcaaaaggcacaccctgctcaagatggctcaataatgyccttttctgggaaaaagtgagagcagttctcaaaagaacacttttttaattgaatgattgcacaacctaatagagggattgcccagatttggtatttggtgaggggagattcaaccttgctagattaccctcacttcctctggagctctgtccccaggaggatgttaaaatcaaacaaccaagaattatatcartacagtgcttaatgaagatgtcctrtagtggaatttaaacaaatgtgaatgtacttatttttcctatttgattaattgctatattcctcctaaagaaaacacttttcagatacattgaaagattagatcatggctaatctatacatagtatctgtacatacatcactaagaagagctcacaagccagatttcacactcacaaacacatattgtttttgtatttcattatttttttcaatccatacccaacaaaatgatccccatcaccaaccagcctggctgcctaaacaagatttgtaa

SEQ ID NO: 20325 - DNA, 600 bp, Bovine  MMBT07700
tagcacattggcttccctggtagctcagctggtaaagaatccgcctgtaaagcagaagaccctggttcaattcctgactcaggaagggataggctggagaaaggataggctacccactccagtattcttgcctggagaattcccatggacagaggagctttgtaaccccatggtcgcaaagagtcggacacgactgagcgactaagcaattaacacattgatgaagaaaaatgctgctttggtgcagaggtattgcatctatgaatttaaatctaaggtgaacttgaagacactttgagrttgcttcttaagtttgaggttgaggtcagttagctactcatttaactgggagtggaaagaaatcggaacttacaactctcagctgtttcccaaggtggccacctctgccacctcctcctccttcacttttggggggaatctgttttcttgtacctactcaatctaacctgcaggagaatgccaatactcttaggtgtcttggcctagatgtggctagatctcttctattcttggtttgcgtgaaggaatagttcaaagctaccctcacatactccatttcagaacatgtatcctgtattc

SEQ ID NO: 20326 - DNA, 600 bp, Bovine  MMBT08588
ggtagtacaatcttgaaatgtgggccaaggctcagaagacctcagttagaactgacacccggactagagtttcagcaagaagttccttctatttaatttgtcagaatttgagacacacctgttcatctttccagaaacgtctttgtcattcatgaagcactcgatgttcagtggtaggtctgtgctgttagagctcatcagctttttcaatttttcacactcctgatacagacgaaggagtgctcgaattttggattttgcatccaacttgtacttagttttaaattctgcacaaaaatrttccactaactttgcatcgaagttttttcctcctaagaaaggatcaaaagctgttcccagtacctaatttagttaaaacaacaaataatctggttattttcaatcatatttgtaaccaaaaatttaaatgttgctaactcaatcraagactaataggctcaaaatttctatttaaactacaacatgaaacccaagtcaattaggatgtatgtcattataaaatccaaatgaaatgctacatctctatgatatttttaattctaatgattacatagaagataatcttagaaagtttttctt

SEQ ID NO: 20327 - DNA, 600 bp, Bovine  MMBT03904
tctgactcctagggttttaccataacaaaatttctgtttctcctaggatcttgctctgaagagcacataagtctaaaaccttgcattgagtttcaagggctttaaataatagggttgtcttagcaaaagaggtgattttccttagggaagagtcttgtccaggagaggttggactcctgtgtctatccacttgtatcattttgtctgatttaagattttaacagttccctcaaagtgagattcatcatataaataagactttatttaccaatacatctgaagtgaccgagatgctaattkctattgaattatctaattaatttttattttaatgcaggctctgaaccaggttgtcctttgggacaagattgttctgagaggtgataatccgaagctgctgttaaaagatatgaaaacaaagtattttttctttgatgacggaaatggtctcaagtgagcaaccctttgtcattttttacatgcgatgctatgtgaaggggagagaaagacatgatgtgtttttaaagaaaaatgttacaggctaaaaagaaaagttgatagagaagaaaagtatttacttagctctgaactggaagattg

SEQ ID NO: 20328 - DNA, 600 bp, Bovine  MMBT12510
taagtgttggactgtgttatgagacacaagtgyctggtgtcccaacattaaaaggggttttctttccatttggaagtattatctccagtctataaaaagcaaaattttagttttttttaggagaagtataaatgacagaaacactttaaacctcattactcttactcatttaaacctcattactcattactcttgcagggtagagctgtttatctgatcttcygtaagggcctaggggtggttttcagtggctgaaaatttctgcaaatctagaaacaacctgggaataaaccctttggrtggaaactaaagcacagacagggagagcctgggctccaaactttttcccccctgtttcaagcttacctgttgctggaagtataagaagaaacattgaatctatctctataggtctctagttttttaagattttaccagttgtgtgtagttctcttttgatatagtataaccttttatcaggaaaaatacttagaggaaaaacctttaaatttaacataaaatctaattcttttgctcctattgaagcttggaagactggatctttattagagtgcatttctacaaagagataaacatttt

SEQ ID NO: 20329 - DNA, 600 bp, Bovine  MMBT14039
ctaaagtgtccttgttccaagagaggaggtggggatggatacacctaggaaaggaagcacgcaacaaaaggggtttgagtcaaatgttccctgggatcccaaagttttctaagggaacagtgcggttcaactgacccactgacaaggaaagaggtcaacgtgggcaacccagtaccccacttcctggaggctttcaaagaaactcagcatttcatgctgagtttcagaagagaaagggcagctcagaggcaggaaccaaggatgttgagggtagggaggraccaagaaacagacaaaggragaaacaaggtgggaagagggcagataagggctgaggttgagacccagagggagagyagaaagaggacaggattgccaaacacaggcagcaatcagggctctggcgtgcccaggtcagcgacttcttctcctttcagtccacaccctgagtggatgccttgatgccccgcccaggcccctctactggctgtaagtgttggttccagtgactccaacaatttgtggtggcctcttctctggagacctgagcaaccagcagcctattaactgactgatgggataggggaagggtaccaaaga

SEQ ID NO: 20330 - DNA, 598 bp, Bovine  MMBT10988
  misc_feature (1)..(31): n is any nucleotide
nnnnnnnnnnnnnnnnnnnnnnnnnnnnnnntttcagacagtacagagatgggcatctgctctgtgtttattttcatgtgtgtgttctcatgcgtatgtgtgtttgtgtgtgcttagcacatcagacccctgatttcacaaatattgcttaagagaaggcagtgagccagtttaaagaaaaatgttcagtaaatgagaagaaaacctggcatctgagtacgacaaagtcctaatggaagttgacaagtgcctgtggtcccaggccagagggtctctgaggcccttccctctccaagaagyggtgggttcagaccccccggccccctagaatgagaaacacacagaccaggccctggtttccaccttgtcctcatcagcaccaagatataccatcaccaggagcggcaggagaagttgctatgaagtaagtggggtggtccttcctggccacaggcccccatatgacctcagaggacacagacagtgtccacacacatgacccctggtgtgattcaggccagatgaggccagggcacaggactgacccagactgaaggcagatgtggccggagtcttaacagagatggctcaggctggg

SEQ ID NO: 20331 - DNA, 600 bp, Bovine  MMBT01547
acaaaacaaaaatcaaataaaatcgtccatacccagtgagtttctgttttaatgaagtagatcatatacaccattgtgaattacacaaattctggggtaagtgcatttaaaatttgcatttaactgcaattttgatatccatacgctaatggagaagaagaaaggatggcccggtacccatctgcaaaagggaacctggagataaaaagtcaaaaccaaaaaataatacaggatgtgttttctaggtgatttacaacattacacttggtccttccaactatctcaagtgttaggtattaygatgcacccccttttttcaggtttatagaaatggggtcaactggatggaccaggaactgaaatccaggtccattaagccggagtttatgcactgaatcttgattccacaaagaaagaaagatgttcctgggagcacttgtgctaacactttacatatcgtctctcatttaatctccacattaatctttctccacgtgggtggaagttaagtatatgttgaaagaataaatataggcatgaaaagtgactgccttcaatgctgggaggacagagggaaacagcaacaaaagcagaagccaa

SEQ ID NO: 20332 - DNA, 600 bp, Bovine  MMBT01213
cttgttgcttccaatttaatatctggctttgaaacattttacgcaactagtccattttctattttattgttcagagcttatcacattctcatcagtctaccaaaggcatttttagaaaaggaagttctaagtccaggaaaaaataagtatatatttttaaaactctgtacaataatttctaaaaaatatactctatgcattggaaataagcttaaaactaagtctactgacactaaatttagaaagaccattaccaataattaccagtgtacgtttgaggggatagaatagaggaaatastatacatgtcatttcagtaaactatgccatggcaactaacaaaactctcataatttcatttcakccttttaagattcatgtataagaaacatttcattcatcatagaaagcctgcttttatatttcctccatgaaatcccaagaactactctgaaatcatgacgttgtgatgaacgtaggacacagtaaatgatttttgaccatgaaagctacgggctgaaacgaagccagttaccaggggaaaggtactactctctgtttgcaaaattttcttctcaacaacagaggtaatgctgagtg

SEQ ID NO: 20333 - DNA, 600 bp, Bovine  MMBT11828
gtccactgtgagcagcgcgtgctggagtcagaccctgggatgctgacctcagcgctctgagcctcagtgttcttgtctgaaagcggcaacgatgatgcgtctccttggttgtcagactccagtgagacgatcctgtcgagggcctggcccaaggatgggcaggaagcatgccttcagctactgacttccttcctcccttttcctgtatgtggcctcttcttcctttccagccyctccctctctcctcttctctctacaccacagactgagtaccactccctgtgtctaagagaagggggygctttgtcacagcaccaggagagggggtctggggagcctgatggtgaagctgccctcccctaaygcactatcatgacctagaacagggctgcgcaccaaactcagggttctcacgtggtttstcacrktacagtggggaaaaagcttcatgagtgaccagtacattttagcagatgagactcaagaatgcacccaccattcagcagagggatggtagggaaaaagtgaaagtgttagtcgctcagtcacgtccagctctttatgatcccacggactgtagcccgccaggctcctctgtcc

SEQ ID NO: 20334 - DNA, 600 bp, Bovine  MMBT06755
cctaggcactggagaagcacttgccttgaacaagtcgactttgctgatgacgccgaagttgacgtcaacagtgagggcgagctgcatggtggtcggcagcgtctccagcagatcggactcatcttcatagagataaacacatcgacccacaaagaagagtcattaataaacaatacygaagctcattaaacattaaaacaataacagtaacaaaatgccaagtcctgttttgtaaatgaacagctgcaccactgtctatattttccttacttttattgaaccrgcataccccatcacaayggaaaagaaacatattttcactattgacgacaygacaattctgagtaattccagaactttgtgcttgctgaaactttagatataaaatttagagaggatggggccaaggctagtgagcaaactggggtgggaaaaggatctggttcccatcttctgattccacagccctaacatcctagggatggcaaagaaaaatgagtataatgagtaccaagtggcttacagagttctgtcatgatcttattggatgcttggggcaaccctaagtatgttcattcctgctttctggaaagaagaaag

SEQ ID NO: 20335 - DNA, 600 bp, Bovine  MMBT00895
agtcggcatttgaatttaggttcaacctaaatgctcttggggtctgccctggtggctcagaggttraagtgtctgcctgcaatgcgggaggcctgggttggatccctgggtgtggaagatcccctggagaaggaaatggcaacccacttcagtattcttgcctggagaatcccatggatggaggagcctggtgggctatagtccacggggtcgacctgcaaaaagtcggacacgactgagtgacttcacttcacttaaatgctcttagctgagcattaaatgaatgtggtcattgcctcyctttttatcttctcaaataatggctctggacccaaagctagtagccctttcttgagttcaagcaattcaagcagcgagaggggtgtcctggcaagtgaggacgttacttcagggcattaggttcttatgggtgtccctgatggcctctgttggtaggataggttctgcggrttgtgtttccagtcatggcagtggagttgtgctgatccgtccccagcagaagcccctttgtgatgtgggctggggtttgtaccatgcctggccaaattgggtggaatccttggttgtggaacagtaaca

SEQ ID NO: 20336 - DNA, 600 bp, Bovine  MMBT05452
gtgtcttctctctacagggggagaaagaatagaactcagcacgtcatctgtagcaagtgagtcacatgcatgctagtatacacaacaggcagagagcagagtgctgatcttgcagtgctggcccctggagcctctgttctgactacagtttgcttgacatcctgtcccgccaactagcagtgattaccttctgaatctctgtatcaaatggcacactgcactcgcgccagagttctcaccggaggcgtttaccaggcaatcctccaaaatcattgccacagacgggaacagagaggggaygccaggtgttacctgggcgcagtgagagaaccacacaaccacacatcctcagacagccactcagaggccacagggtccctgagggcagtgaggagggtacgacttttaagaaagccracagaaatttctcaaacctgaccccctagcgcatgttaagtcacttcagtcatgtccaactttttgcaaccccgtggactgtagcccgcctgactcccctgtccatgggattctccaggcaagaatactggagtgggctgccattcccttctccaggggatcttcccaacccagggatcgaac

SEQ ID NO: 20337 - DNA, 600 bp, Bovine  MMBT03045
aggaatgtgaatacacacagatatatttcaaaacctggaaaatttaacctaaagtacattttagctttggagtgccctcaagggtggaactgaattgctcaggagatgaataatgggattcattactatgaccagttgaaatctaacctaacccaaggtattcccatgctgttgagcagcttagaaactgtgacgaataatgcagtcctgcttcaattgattttttatcctaccactgtagccatcaacaaacaggtattttctttctaccaaaaaaaaaaaaaaagaggtgcatctgtrttcattgaaagaggaaaaagtaacaaaggccatcctcttgcatattcagatgatctttgttttagctcattttagttctatgacacaaaaaaagtgcttatttatcatgcactctgtaaagttagattggatcaatatcttatggatgtaaatatttacctatacaagttgctttcattattgtgtctaaaaagtcatatgactgatgttaaatcatcaattaagagacaattttttgtcctttactctgttacacatgcaaataaaaatatgttatataaaacataaattcaacactgg

SEQ ID NO: 20338 - DNA, 600 bp, Bovine  MMBT04939
taaatggaggctggggggactgataatgaaacacacagcctttggccattggtcagcatccgattagaatgagtcagcaggtcttagaaagtttgggagcgatagtggtatctcagcggttastgaaaggtgggtttgggtctgaattctgggccaggcagagagatacagggccacagtgccaatgacatccttctccaattctgtctyccctacaagtcttattacctgmaaacaactaatttgttaaggtgagaagctgtcttttttctaaaagaagyctgaaacacagcacacagkattatttgtgatcttacattgtccagacctctgaggtttaacaaagcgacaatggccttgcttatctttgctgctggtagacgacagggtaaatacgtgagtrtttgagcatctaccatctttacaaactgttctagaaaccatggagatagagaagaagcatgaaacagaagcaataaaagtatgttgcttcggctcaaggagtgtatcacctagtttgaaaagcacgtttttacctacactgaaagagtaactcataaatgtaaatgagtctttgaatatgtaagttcaacatgaagk

SEQ ID NO: 20339 - DNA, 600 bp, Bovine  MMBT02539
catttctcttacattggcaggcggagaattcccaccaagccaccagggaaggctgcactgtggattacctgtccattttcctcagaggtgtccttcaaggagcgtaagttttccattttaatgcagctgatcaattattctttttataatgcatgaatgtgttgcccagcacaaagctgacctactgtgtgtcatgtgtgttggttctcttatcctttacttcaccaacatcctctttcagggtcacaggaggccccttcagaggaggctagaatctgcttatattttcccacctaactkccattyctcactcctcctggacggagttggctgtcacttgytcagagtttcttttgaagggtgtccttgacytctccaaggaataatagacctccctccccatctttcccctcaccatacacagacctaatcagaagtagatccacagtggacattcagcctttttagcctcctgcatcttttctctgaaaagaaaagagtaggcaaaaaagaaagaggacagaggaatgtagcaggctggatgtcaaattagagcctatcatgaagagtggggagctggagtcaactgctatggaaagt

SEQ ID NO: 20340 - DNA, 600 bp, Bovine  MMBT16624
gggcttcgccttttgatatctttgagtttaactgaaaaacttatttaaatgtccattgtattagtcctataagaatttattggaatgaaaaagctttacagtgtttatagtattgtaaacatattttatattcagttgtgtcttcatattaactatatttcctctgtaaaataaattgtgaatgttgaatacttcctgctacaaagaaacrgatcaattaaacacatttccatctccctctctttctttccttctccagcagaattctgtgtattaagattctattaaaacaaaaacccrgaatcagtaggaaatgtgtatatgcatatagttttgtgtgtgtgtgagagagagagagagagagaagattaagkaggttcatacatccaaaatctacagggcaggccaatagactgaatagactgactatccaggcaaaagttcatgttgtaatctatagtccaaaaagtagtctggaggtagaattcctttttcttttaagtatttgtcttttctcttaaggcctgctgattgaatgaggtctatccatattatggaaggtaatctactttaaagtctactgattaaayacatctaaaa

SEQ ID NO: 20341 - DNA, 601 bp, Bovine  MMBT12403
  misc_feature (1)..(1): n is any nucleotide
ncaaaaacccrgaatcagtaggaaatgtgtatatgcatatagttttgtgtgtgtgtgagagagagagagagagagaagattaagkaggttcatacatccaaaatctacagggcaggccaatagactgaatagactgactatccaggcaaaagttcatgttgtaatctatagtccaaaaagtagtctggaggtagaattcctttttcttttaagtatttgtcttttctcttaaggcctgctgattgaatgaggtctatccatattatggaaggtaatctactttaaagtctactgattaaayacatctaaaaaatttttgtacagcaacatctagtctggtatttgatcaaaacgctaatgtactatgacctaagccaggtttcacatgaaatttaccatcttcctgagaaattttataataattytayataatttgactgctctaaataaactgaaacaaagcaaagcaatgaaaatatraacacaaacacacacacamaattatatgatgattggtgatgttttcagcttactagtagtataaattctatctagtcacaggaaactatttctcatatggaagtgagaaactcagtaaata

SEQ ID NO: 20342 - DNA, 600 bp, Bovine  MMBT06161
cacttagtcagagacactcttctttgagacctcttggatccatccccttctatgtacctcctttgccttcttagctgatgttaacatcacctctcacctggattgctataactgatctccaaaatagtctcttggccaccagcctttcccacctgcagtccattcccaacactgctctttgtaatctggctcttgcctacttctccagacttatctcctattacttcytctctagattctagatcttaaacactccagctgtgctgaatggcctgcattgctctgaatgggccatacttytgtgcttcctgttgtcctcttggtctggaacattccccttcaatgtcctttgccttgaaaatgctttttgttcttcttgactctgcccagtattgcctttctagtggatttccatagcatttccctgaccttcatatgggatccctactctctatgtatgcctttattattgcgcttttcattagtactgttctcagagctgtggctgttaccttacatggcaaaagagactttgcagatgtgattaaatcaagaatcttgagatggggaggttattctggattatctgggtgagtccta

SEQ ID NO: 20343 - DNA, 600 bp, Bovine  MMBT00862
aactaacccttggaacagtaaacacaacacacacacacacacacacacactcctatgcatacacatgtgatcacgggcaaggccactgtcaaatcctggacagctctgtttggttctcaaggctgccttttccacttagaaagctgggcagcagcttcatgggtattctttttgtctccctctcgggcacaggaatgtgagaggacaggagtcagaagtcacgtgtctgggcccttctcagccattcttcgtgtccacttattcctggaagtaattcatcctactctgtcccctgtctawtctctctctggagccttcccctgagctgcctccaaggtggcaggtgacaggctggyctggccgagaacaaagacagttatccttggctgccacctgtctccctctgyrtgcctgccctgtcttgtcatgctccctccacatgtctagyagacaccgcaaggcctctgggcaggggcttttttttattattttttcctttaaaaaattctctggtttcttctgtggttagatggcttatgtttgatgtttaactyctctacacccccatttttcttcattcttaaaaaatgccaacagaaa

SEQ ID NO: 20344 - DNA, 600 bp, Bovine  MMBT22894
caaatcccgccagctctaccttaaaatagatccagaatctgactattctcatcaccttcactgtttacagcctggtccaagtcaccagcatttctcacctgggttattgcaacagcctcctctctggtctccctgtttctgccagtaaccccctacagactgctctcggttttggtgttaaaacataaatcagatcataacactccttctctccaaattcctttctctgggtaaaatggttcataagacccaacaggatacagccgctggtttcttctgaacgcctcctcccatcaccgyccctcccctacattccagccacacagttctctgaatggaacgggcacattcccacctcagggcctttgcattagctggtcctcttgccggaacacctttgcccctattatctgcagtggttactctctcccttccttcagatgtctgtttaagtgtgagactttccctgacaacctgagagggaacagcccctccactctcaggagcccgaatcctctcgccccgtttgctccttgccccagcccccacagaactcagcactgtctgatacagcgctgatttatcatctgcctccttgcc

SEQ ID NO: 20345 - DNA, 600 bp, Bovine  MMBT22410
ctggagctggcatccatgagtctgaaccacagccccatcacctcaagagtcactaaacccaagcctcagtgtcctcatttacaaagtggagatgatgccaacatgtggcatggagagtgttgtgaaggtgataggagataatacacattcacgctgacaacagggcctggagcaggcagtggtgcccagaccatctgctgccgctgcctcgaggccagcaccatcctcagttgtgggaggtgcgcttcgaaggtaatccacamagactggtagagcagagaaaggcgcaaacaagtacayacatcgacacaggacagcagggagaggtatgggccgtgggcagctcgtcgaaggaggctggtattggtaccaacactaagtcactggaactgaacacaggtcatggaaacacccagtgtggtcccagaccctcttaagatgatgaattgggatgggtcctaccacagtactcagaaccgaccgaaaggctaactgaatgaaaggtttttagtgaccagcacctgggatggtaggaatgcttagagctggctgcctgcgcacatccacattggaaagacaactacaggagcacgaccttgt

SEQ ID NO: 20346 - DNA, 600 bp, Bovine  MMBT03303
taatccctaataaaaatgttaaaaagactcgactgacataactcaggctatgaaatcagagaactattgttggatattgacttttatcccagttctttcaaagtttgggtctttaatttgtattttccaagtctctaaagcattcctaacattgaagtttcatttccagaagataagtcaagaatcgtcatgactacttaactagctccactaccatcctatgttgacatcaattgctttggataatatatcagagtcctgtgtctggtcctcagacttgaagattcaggaacctagtaytgttttctctamaaaagcaayctgtctctcagggaaaagttataaattggaatttctaacttggaagttaaatcattatttttaatcaaacatttatagcatgcctactatgtgtcagagactattcaagcactttggaaataatagccactttttcctttataacaattcatttacagatgagaaatagcagacacaacaatgctatattactttcctatagacatacagcttatcagtagccatagtttagagttgaatccagccaatctggttctaaatctatgcctgcaaccatgc

SEQ ID NO: 20347 - DNA, 600 bp, Bovine  MMBT01893
ctactcgcctgtgaaaaatgaggaggatgttgccgagctgtccatttctccttcagacaacgcagtggtcttaacaagtaagcattcaagtgtatttgttcaataaatactaggctagcgcataaggaaaagaattttgtgttctcgggtaggagcaacagagattaagacagataaaacagaactacaaactagattycaaatctaatgcacagctctgtaattytgaaagatgttacatttgttgttattttaatatatctttgatatctacaactttttaaaaatcagtggagaaayaccaactgtgaagttcaaagacttcaaacaagttctgcttccaaataagcacattaaaaacaaatgtgtgccaagagacgttacatgactaaatctcagtgtttagtgagagaaaaaaatgaggattgaagctagtgtcatggcatctgttttattctcatttaagtgtcagcaggtaatctgtttggtatttgaaacttagaaacagtgactggtcactcagggtagatcaggattttattttgaagaaggagccagaagtttaatttgtacttcaaaaagaatctgttagcaggattt

SEQ ID NO: 20348 - DNA, 600 bp, Bovine  MMBT00653
aggtggtttagtaggttctggtttaaacttcagttccttctttctaagaaaattaggggaaactattaagcaaagtgaattcctcagaatcactttagactttcctttcggcactatccaaattttataaattctcttctgcctggagccctaaatctaaatctccataactgtattggctcaagtttcactttaagtacaatcttaatggatcatattcctgaggaagcttgcttcctccaataagcctgcaaaattctctcttattattcttgattgtcccctgaaatgttactcttygtgaattaatatggctctgcctagctctagataaaatcctaattttctgtcaygtgtcttgtctgtgttgcattttctgtgcacttttgtccacccctccagtgaaagggggtattttaaacatttttgtttccagagagagcaacttgctggttggaggatccaagtttaaaatggacccccagagaaacatgtatggcttgaggcatcctgtgtaattcaatgaatatccaccctacccctaacccatatttgctggctaaagcaaatgtgaaagtcagagaggggaaggagttatat

SEQ ID NO: 20349 - DNA, 600 bp, Bovine  MMBT14596
aatcagtcacacttttcttgttggaagcctcatatatatatttgtaccttgctaaacctggtctgaatgcaggagttaaaaattcctcagaaatccagatttaaacctgtaatgtcgtctgtaaatataaatgtcatggacccaagattgtgtaatgaatgatcctgccatgaaggaaattcagaagaataaaaagatacacatgcctagggcaagaagtcagcaaagagcccttaaccatgatgctgttactgagaataatgaaaacacattaaaaaaatactcatttgtaaatatgtrtatatatagtctagtaaaaacaggcaaacacatatctttctgataaagacatctttttattctacttacttggggcccaggtcagtatcaattggtcagcctgaaaatttcagtagtctctgtttgcatggcagaaattctgcacatgttttatctgattcctaagagtatctaaaaggatcttttatgttaaaagagaggtgaaccttcwttgacagactttgtctattccacttctaactgggcctctcttttctcaggatctatcctagccaaatatctcagttacatttaccatgc

SEQ ID NO: 20350 - DNA, 600 bp, Bovine  MMBT01909
gcattgaatatatcattttgtatcatttataatgatgttccccctgttttctgcttttgtgctaggttcacagccgtagcacagacagatttgaaggagccgctgaaagtccttggcatcactgatatgtttgatccatcaaaggcgaattttgcaaaaataacaagtatgttcaatttagaatttgctcttaaacttgaacagtgtgttataaaccaagtttctgatttgttcaggaagaaaaggtcagcattagggatgtgttgctgtgaaactcttcagggtttcattggatgcctyactgaatgacgctgccgagcctccatcacttatatcagcatgagtcatgcatcccttacatttcccatgtacatttcatgggaaacctacgtgactgcatgcatttaaagaaacatttcatgtattgtttccattacctaaaaatttggctcttaattagatattagtctcttctttttccaaatgcacaatttccccctgtattttccaattttcaagatcaagaatgtttgagctctcaaatggcttaacttccaccaaacaactgcaggtgccagtatgtgcaaataggattttggc

SEQ ID NO: 20351 - DNA, 600 bp, Bovine  MMBT05716
acccttcaaccacagagcccctccctgagggggcaaggggtggcatctgttaatatcttaggaaacaggggttctgaggaagccgagagggaggggctcgggaagacggggttggaagcctcaggagtaaggggaccctgcgctctacttacctgttcgcgggtctgtagggtgagtagggagcagtggtacatgcaagggtcctgtggctcatcccttctctccttccctagtgaccaccctcccttggtgggtgcctgggaaaagggatcttggtctaccagtatgccagtcccaagygggcactcgccatcctgctgctggagaataaactttgaaggggtatttcaggagaactcagggtagcagtctcaggccagaaatttgctctccttaaataggtcagaaacaccaaaggcaagaatcagacagtggggtccctgagcagagccactcactcagctagctcagaggctgacaacaaacagacaagaaaggcccatcaatgctgcaaaccccaaacctttccgtcattttgataaggctcgggcttttgactctgtggcagagtttaccgactccagttaattccagcttcaa

SEQ ID NO: 20352 - DNA, 600 bp, Bovine  MMBT01470
ccaacgtcactgtggtttcctgggtcacaatccctttrcactcgcagaaaacccaagtgcactgttctggccctttcagcacatactacatctgggcttcattgaggatttcacagagttagaagcacaaatccccgctcctccccaaaaagtggccaaaacccaaagacataatgagtgcaaaggatttgctcacccacacatacccctggccacccccaagcaaatccgagaacagggtgagcgctccccaccctcactctgaagatttggtttcagagttctctcccgccctctttycttttctctcctcccttcaggtgccccttcccrtggctcagttccacggctccctctctggccttcagtttcctcaactgtaaaatggaaatggtgacatctatctcccgggataatggatcaaatgaaataatggaaatgaagtgctttataaagtgcaaatcagggtcagtaaactcctgaccctgtagtctacaaactacaacacctgtttttgtgacacccttgaattaagaatggttttgatattttttaatggttgcaaaaaagtcaaagaataagattctaatacccaagaaa

SEQ ID NO: 20353 - DNA, 598 bp, Bovine  MMBT13918
  misc_feature (1)..(32): n is any nucleotide
nnnnnnnnnnnnnnnnnnnnnnnnnnnnnnnnccccagccagacactcagactgacttgtaccccgagaggaaaccagctcaggtgacctgtgtttctcagttactagtgactaactgtgaggtggagccactcacagccactgtgtattgaacagtttcacacgtaaacacgttattttggtttcacttcatagcctttttgaggggagtgttttcccctttcttcagatgaaaataaaaacatcagagtaacgaggcttctttctaacctcagtgccaccgtacctctcccacccccytaccccctctcagtggataaaagggtgttctgctttgctttggattcctttttccccagggccaagtgtgggaaagtgctgctgtcttctgctgtcctctttacctcccttatctctcctggccttggattcactctttttttgatgtttaatatttaaatattgtgcactgggctctgctgtgctgagcgctttccatctgctattttaattaccgacccctcctgaccatgttatgaagcagttggtattccacccaagatgccatgagaaaacggagactcggagcttcccagag

SEQ ID NO: 20354 - DNA, 600 bp, Bovine  MMBT01604
ttgtgttactaggaaaggtgggatggttctccacacatagctacacggcctcacggcctcatctcgtgtgagcctcaagaggcatggtatattggctccgtggctcagaggagacagcgaaagcccagagagcttccatatgtgtgtgtgaagacttaatcggtgaacgactgagcatccatccctatctcaggtttgcccctgcccctgttccgtgcctctgtgagggtctcagagaagtccagacacccgagagtcacccctcaccttctaggtttcctgctactggaatggaccagrcagttttccctcttcttcagaggtgggagcagggcatgatttggcccctgtgatggtggctgaggacacctaggggacacagagtttggtagaaccccaggccggtgggggtagcatcctgggagagaggagaaggtggggtaagggagaggaacacccaggggtggaagaactgctccctgaggcagagaaacccccacaaaaccaaacagatttcacccagcgacaggttacttattagcttcaatgtagacagcatcttcaatgtagacagcatcacccttggcctgaacgcggaag

SEQ ID NO: 20355 - DNA, 600 bp, Bovine  MMBT06072
taatcatttatgaacaagtgcacaccacattttcattttgtactgggcccagtggatgatgtatgcggtcttgcaataacatgaagaagttattaattctaagaattgttgaagttcacattatcaatagggtaaaataagtttggataaattcatgaattaatgtagaattcttaatgaggtctgtttttaagaagctgaagactatcttttgggttttctcaaacctttgaggatgatgtaataagggcagctaccaacagagggcctaacagaaaatgaaatttcctttctcattaygatctatctgaaactcagagacatgcatgcaactgctataaatctgagtaaacaatgaattacaatagaaatgttgatcaactacttttcaaaggaagaaaaacttgaaataatgattaaaaaccaaacagaattatgaatgaaatgtgacacttccctctctctcagcatttaaaaaagtaagtttctttgatggctctctatgacccttattctcactccagtttccccggcagcttccttgtcctaatcacttaaacaatcttacatcttccccaattagacagaaaccagaattta

SEQ ID NO: 20356 - DNA, 600 bp, Bovine  MMBT10877
gtctgtttctgttttgtatatagattcatttgtattatttttatattatatgctgcatataagtgatatcttttgatatttgtctttctctgacttccttcactttgtatgataatctctgggtccatacagcttgctgcaaatggcactatttcattattttttatggctgagtagtattccactatatatgaacactgcatttattaagcctcttgtctgttgataggcacttgggttgtttccatgtattactactttggctgttgtaagtagtgctgctgtgaacattggggcacrtgtatctttctgaattagtgtttttgttcttcccaggtatatacccaggagtgtaattgccggatcacatggtagctctatttttatgtttttaaggaatctccatattgttttccctagtgactgtaaccaatctayrtccacaccaacagtataggaggccttgccttctctctgcaccctctccagcatttattatttgtagactttttgatgatggctattctgacagaagtgaggtgataactcattgtggttttgatttgcatttctctaatgattagtgatgttgaacacctt

SEQ ID NO: 20357 - DNA, 600 bp, Bovine  MMBT05532
caaacaggccagcacctccagccacaacccatatctgcagagcctgctggcctgcaaagcttcagctggttggtctcccagcagggcccagggaccctcactgtctgtgagctgcaagctggtggacctgccctacaccctggggcagtgaactgtcctcctagagagtctcatgatccagttttcacagggtctcttcatcttagtcttaacatccatcccatcagtcacaccaagtacattaccttctaagcctggagaagcccctccacccccatggagaaacagcactcaacccgygcttgtgtccagctcccatgcaccactcccatctaacctcactccaatcacaaatctggggctcttcttctgggcttcctttattacaagattttcctcctgattcttggctggacatgttctcagcaactctcttccatccagcgaggggaggacagaccacaacagccagcacaaccttcctcccaccccaggggttcatgtcacaccaaacaccccacaaggaggtaggtgggctctgcagatccccaattcacaatccctgaaccagtgcccacagacctttgagaccctcccatt

SEQ ID NO: 20358 - DNA, 600 bp, Bovine  MMBT02245
tttctaaatttaggaaacaaattctgkttttttttttccccttttcttgcttttttcatttattgtaaaatcaagaaagtgaaatattctaagtatatgcttacaatgattttaccattaggaaaaatgctagtgatattgtcagtgagtcatttccttctttgtttatattcctacctagattttaaaccacaggccatctcacctctcagctctctctcagtgccttttcctttatccctagagaattaatctcatgtaagtcttcaactttgtggctgtgacctcggaaatttcttyggyactccacattgtgataattctttgtctgaaagaacaagagcatgagttaaccctaaaagaggagctggactgcagaaaggaagcaactccaagctactgaccaaggcaagcctctatcatacctctatttcacctttcccgaagtttcatgtatgttgtcaatattgtatatctgcacatacacacagagattgctagattgtggtacctaacaataagaatttcaacataggactttgtttctagtattatctaaactcaatacctggacgtaccctggagattcaactgatgttt

SEQ ID NO: 20359 - DNA, 600 bp, Bovine  MMBT07120
ctgggatgatacaccattgatcattgtaagaaatacttccagaaactgtttttaatctttccgccaragcattagcaattattctttagcccatggtgagtaatgacttgagtttcccagcttctcaatcgataaaacatttaccctaccgctacaaatgtgctcttcgcttagacaagcagaatttttcttccaattactctttttttagtgtgacctcataaaatattttaaaacatatttcaaggctttttttttttaaaggagaggaacaatgctcttccatgtgcttatattttyctctttcttttaagaaataagtcatgacaatttcatagttatttgaatagctaggactgctttttttttttatcattttgtgcaaacttaagacatgatttgagtccagccaactgctacattttggggttagccaataacaaaacaaccccctttccattttgcctgaacaaagatttgaattcctttgaaaatcaacaacaaaataactcccaaggaggctgagcaactcctccactttctctgcatggttcataaacctatagcactggctaatggagagcagccataaaacacact

SEQ ID NO: 20360 - DNA, 600 bp, Bovine  MMBT05366
cgtttagagttacacctgtccttaatgtttcataatacttaggaaaaaatgactgttttcttattttccttttgaagccagtcttaaaggtggacccttttcccagttttattgagatataattgacatacatcactgtataaatttaaggtgcacaacataatggcttgacttatctttatatattgtgaaatgataattgcagtaattttaagtatccgtcatatcatatagatacagtaaaaagaaagaaaaaatacatttttccttctgatgagaactcttaggatttactctctkaacaactttcatatgtatcatacagcagtataactatagtgcatcccctaactgctcacgtgtaccttatatcccaagtacttatgtgtcttataactggaagttttcacttcatttaattcttcctctccccacctctggtaatgaatgtggtttttcattttgtttttgcttttttgttccatatataagtgagagcttagcataatgccctcaacttccatccatgttgtcacaaacagcaagatttaattctttttatggcagaataatattctgttgtgttttaaaccacactta

SEQ ID NO: 20361 - DNA, 600 bp, Bovine  MMBT22905
gctccagagagtgtggaggctctggggtcagaaagaagtcagagtaatggacagtgacagtaacacccaccaagtgtggaatgcctacggtatgccagatgctgtgttaagcacagttcttacagaaactccacgtgatggaaactatgatcccatttaaggatggggagactgaggtttggggagggacatccatgtgctcaaggccatagggctgggaagtagcacagtcaggacatcaatctgtctgtgtgcagcaatgatggtaataatagcacataattatataccattcactakattctaaggcactgtcctaagaatcccactaaatacacaaccctatgatgtcactgctatcatcactaccattttacaggtgagaaagttgaggttgagaggcttaaactaatttgaaagaaattactcagctgctagaattwaaaaaaataataataatctggacttactcttcaccatgttatgcagtggattacgccttctatgcatttaacttgggaagatctagccatacacgatgggccaaacactttttaaaaatcattttttcattttttctgttttatgtatctaaaaata

SEQ ID NO: 20362 - DNA, 598 bp, Bovine  MMBT13051
  misc_feature (1)..(67): n is any nucleotide
nnnnnnnnnnnnnnnnnnnnnnnnnnnnnnnnnnnnnnnnnnnnnnnnnnnnnnnnnnnnnnnnnnnataaaaggaaggacaaagaccacgtttgaaatacccagaggccaattatcttcacagcatctaggtgacactatatgggttaggttatggatcaagttattttctagttgctctgcttgctttttatctaacaactgcccacatacctaatgcaatgagtgtctttaccaacaaggaacacaattagccatctcttctctctgcttcccttctactctcttccttcctgtaamcttccagagtgattactactatgtattttggaaaggctctgtgctctgcactgtggaagggcctgagataaagcatagttggtttttgctctcaaatagcctagaatttgtcagagttctaagtgtgtagagattgttctataaatgttggttaccagaacttgcaaattactggggaattaatgcatgggaggagtgtttatcgagaccctgaaaaaaagtgaaagttgctcagttgtgtccgactctttgcaaccccatggactgtagcacactaggctctactgtccatggaatt

SEQ ID NO: 20363 - DNA, 600 bp, Bovine  MMBT12003
catctactacatgcctgccaaagtgctgcccatcaggcacacagtgggaaacatgaatgcaagagctctgcccacaaccccctcactgtctgctctgcatcatccagcttgttccaacagaccaaattctctaaggcaggtccacgacttgcggtccatggcattgattaacctgaaaataaagagagatctttggttatctgtgtatttacttttctaaggaaagggctcatagcttttattcatttccctgattcttcactttaaaagttaacaaccaatagtaaaagaaccatgatkgaaatcaaggaatgaacaagcagttaatataagtggaggaccacttctgctcctctccctgtctcttcatcccatcgcaatctctggtcacatcttattgagaaatctcaagagccactagagtgtaactgtatgatacttgccttgaaatcgctaaagtactacacataaatactagttaatgctacggtcattattgctaaacttgtaggtttcttcttccaacattttccaaaaaagtcaaatatttcatgaccacctactatctttcaaagacattaccttgcaacgctggtcatt

SEQ ID NO: 20364 - DNA, 600 bp, Bovine  MMBT05486
aacagagaatatgatcatagtggcaggcactttgtctgtaggatttcacgtagccctccccgcttcccagggaggttagtctggccgtctccacctccaagggtaggcagggcccagagaggtcatgttgacagaacagcttgacatgaagtggtggtggccacaggatgcctgtggctgagcgcctggagacagctgggccccagcctggatgccggctttgtctcttcctggtggggggtcttgggacaatactctgagcccaaggacatggaggtgggtgcgtccatccctcaggcrgagactgaacggcattgtgcacacgacagcaaccggagcagaatgcgggctcagggaggggtagccgctgtggcattactgttggggttcagtcgctgactcgtgtccaactctttgagaccccacggactgcagcaccccaggcctccctgtccttcaccacctcccagagtttactcaaactcgtgtccatcacgtcagtgatgccatccagccatctcatcctctgtcacccccttctcctcctgccctcagtctttcccagcatcagggtcttttccaacgagttggctctttgca

SEQ ID NO: 20365 - DNA, 600 bp, Bovine  MMBT10920
gccaaagaggctgaggtccagaaagacctggaaaatcctgctgagcctgaagcccaggagacttctgaaagtgaggaagaaagtgcagtggtggaggaagaaactctcttgaaagaatttgaggaaaggcgatcacttagacagaagtctgagctcaaccacatggcggagccagtgcacagacatgtaacaaaggatcctagcagccaggaggttctgtccgaattgagggcactgtctcagaaactcatcacrgagaaccatcagtcagggaagcaagaactgagttcagcgaggacwgctcagagagaggaacctgccagggaggaagaggagcccatgttgctgcagaggccaaagagagctcggactctggaygagctggaggagctgggcagagaagggtgtgttgaaaacaaggagcttcccagaactgcagtggaagggctgcagttggagaagaatctaagtaatcatattggcgcccccaaggagaagaaaaggaaggagcaaatgattgatctccagaacctcctaaccacaaaatcgccttctgtgaagtccttggtagttcccatgactgtacaggcgttggaagat

SEQ ID NO: 20366 - DNA, 600 bp, Bovine  MMBT17731
gaatgccatctagtcttttctttgggcattaatttcaactttgtcctggaaaattatgataacatttgattctcagtttattagaccaaattaaaataagtaagaaacaaaactggtttttcctttgaccactttgagtgctccatgcaacctgtaaatctgaaaaactggcataagtattctgctgaggcttgctctgccttgatctgcctagctctgcccttgatatgagaaaaaatatggaagatgccctgtgtcaagttacaaaaattgacatgagaaaggagaggaaattagatstatgttagctatgaagactgaggaaagcaaagtgtgaaattggaaaaggcaaattttctacagcccatctctcttgccaagtcatctgtctgagtgaaagaagacctttaagtgaactcttcgaaggcctacgggcatatttcttagtctgttcctragaactgctcatctccaaagaaagccaagtgcatgctcagtcgcttcagtcrtgtccaactctttgtgaccctatggaccatagcctgccaggctcctctgtccatgggattttccaggcaagaatactggagtggttgtcat

SEQ ID NO: 20367 - DNA, 600 bp, Bovine  MMBT13438
aaatatgcaaattttcagagtctcagctgtcgatggaaatacaaataatagaagtgttgayaacagttgcttgtaacacatgggctttctcttgggtgtgttgttagcagctgtccccaggtctgggggttcctgattagggcaacagytctgaaaactgaattctactctaagctgaagtattggaaagtaaattacacacatcataacaaggagccacaaacgggagaccttgtgaccctgccaatcactgagtttggagagagaaagtaatttactaaatcgtatctcatgtagagkcctgatcccttgctagagattcagtccctgactgagttcacaatcccagatacggaccccaacccccatcacttgctgaccactgaccctggcacagatggagccaccatgctctgcagagcctggacccccggcaagtctaacgccagccctggaggcgagctggcatggagtttagaacagcgtgtgattgtaactattcaggccacaggataagccttcaagcctgaaagtccctagtaaatttagcttggtttgaatattctgtcagttgctttcctgggagagatgtggattttc

SEQ ID NO: 20368 - DNA, 600 bp, Bovine  MMBT02150
aatcatatgagttaatcagtatcactaacactttaaagtatcattaacacattaaagtatcactaacgctttctggtgtttgatctggcctacctttccacaaatgtgggtctctgcagattgttgtccctaacttactgcggtgaggccagcctgtcttctcagagggatgaacttgacagcccttaaaatgagccataagttaaccagggcctggagctcatatccaggtcaagcaatgcttgagctggggtgtagagcttgaaaatccagtcctgactgttctagatcattttcatygtatgtgtgtgtgtttgtgagagagagaaggacactaaccaattctcaatcagaagcatcattcccktactttttaattaaatgtttgtttttatcacagcagtatgtatatataattttaaaagccaaagcatcttataaagtgtgtaatataaaactggttccttggctcaacctgaccacgtctacccactactcccgcaaagcagccactttgaactcttcttttgttcttcaagtagcttctactgccatttaaatttttaaaatttttagttattgtttattttcttcttccca

SEQ ID NO: 20369 - DNA, 600 bp, Bovine  MMBT01948
atgttaatgactcctgaatttacatctctagtccattcctttcctctgagtttcaagatcatatatacccacttgaatactggctattaccttttggatagttccatttctgtttcgtttcagaggcacctcaggctttgttcttgtggcagatcccatctcttctcttgtcctgtgtcccacctgctccttctcaagtcatcctggccacagcaagtcacaccaccacccacaagttcactccagctgtcacttctatatctcaacaagcgccccacacccaccgaaccgctcagtgcrgtgtccctgcagagtctactacctccagttcattactgtgggaggcaggttccactccacagcagatgtggaatctcttctgttcttcccattcctgctgacacccacctagttcaaggaccaccgtggacctgaatcacagcaacgacctcctgaacacctcctgtmtctcctctccagtcctctccatacaaacatccaaagagagagtttgcacacctagcttggatcacatcactgccgtctaaaatctgtctgtactctcaggggcatmcttgccctcacccagcactttgtgct

SEQ ID NO: 20370 - DNA, 600 bp, Bovine  MMBT03791
accaggctcctctgtccatgggattttcccagcaagaatacaatattacctgtaataagtcaaattacacacaggaacttcctccatagccccaaatatgtaaatcagagacagaagtaaaaacaaaaatcattaaatcttttaagaatctaatcacttaagagagaatattatcaccccaaatattcagtggaaatcatccaattgaaagacagaatgtgtatatgtgtgagtgagtgtgggtggtggcggggggagatggaggaagagaattcggagacagcatcagcaaaaagaaayagaagtggttttcatgaataaaactctgaaaacacttcactccacttgtgcaagaattatggagagcagcattattttgctgacccagcaagatacttgcttagcaaatctcttgactacctaagaacactctgtcaaattatttaacttgttaataacttctaaaaacagaaaattcttggcagcctcttcgctaagaggcatcgctctcatttcagagccctcttcgctgctctcgctgcagttactactcaccctcatgctcttcagtcttcctcttgccaccgtgggctccaaatc

SEQ ID NO: 20371 - DNA, 600 bp, Bovine  MMBT08943
ttgaaactaagcttagttcagcaaaacatatttaagagggttgaaatctggtgctaaagagacttggcatatattccagaggacttttgaattctttcagaacaaggataatatttattgcttagataaaatatagttgtgaataataaatcaagtgtaaaactgttgttcttgcttatactatatattctaatatcttttggttattttctatcaaattcataaaaatgtttgttgagtacctactgtgtaagcttctgttacaagtttttacgaaacgtaagacaatctctgctgtcyagataatttcaatctgttttcaattttgacctctttttttctttcacagaaacctaagtttttctaaatagtttttaaaatatttccagacataattcatatgccataaaattcacttgtttaaagatgtgtaattcagtggttttttagtgtattcagagctgtgccttcattaccacaattttagaacatttcattagcccccaaaagaaaatttgtacctcttagacatgaccccctaatctgcttccaaaccactttctgcctctatagacttgcctcttctggacagttcatata

SEQ ID NO: 20372 - DNA, 600 bp, Bovine  MMBT09830
tcgcgcatacacaaaaagaactcacttgacaaacatgcagggggcagctctgtgacatgaaagggtctttgaatgcaccagggccttcactcaagttttcttaatgactaatattctytttgtgtcaagaagattcataaatgttcaaaaatgcaaagggatgtcagtatgggtagaatgattcaaatcacacacacacacacacacacaaatagaatccagaagtcactacttaaaatatgcaaagcttctttccaaagtaattagattatagacttcgacctagcaaacagacataartaycttaaactggacaaacgcaaaccttaaaatcattacaagagaaaataaagtgtgatttaggaaccttaagagattaaatacctaatcatttaggcaccaattctcaggtgacaaaataattctgacttactttctaaatttgttcgacacttgtgagtgaamagggaagggaaaatctcaatacaattcaggagagaaatgggataattactccacgtaatcaaacctcccagagactgcaggctactcactttagcagcactaatgactgtggcggtgtaagactgaatgttgtct

SEQ ID NO: 20373 - DNA, 502 bp, Bovine  MMBT21741
ttctcttttatgtcgggaaatacacgtcaaaagtcatttaagaaacttctgaggaagtctgctcttgtgttcagtgccaccacttcaacgtaacctgcttactgtgaagaaggatagggttaaacagcaggaaaggtaataaatagtcttgtaacccttatctgtggggtcacgtcccatgtttttctgagatcttcataaatgccagagcagcttgttgtaagagctctttgggaagccagggggccagtgctgcctaccttctcgtgtggtgaggacatggctctcatgatgtatctragggccgacttttgacactccgtttactccagaagcacaccatgtagcaggatggtgaacgtaaagtaaaaatagttaacaacatataaaaaattagattttctcatcccataggccatcccgccccccttttagggagggcttctcattggagaggtggtgtgaaagaaatactgtttgttttatttctttaaaattcgga

SEQ ID NO: 20374 - DNA, 604 bp, Bovine  MMBT01323
  misc_feature (1)..(4): n is any nucleotide
nnnnatgtttgcttggaaaaaccaggcaagcaaaaattaagcacaaatctttcataaatccctaagtcttagagaatcactgtttagtgttcctagttttgtgtatgcatgcacacacacacacacacacacacacgtgcatgcacacacacagacatatttagaaaaatggggtcatcctgtacttagtgatttgtgacctgctttgttcacagaacaatgcctcgctgccttaaatggtcatcttgaattattattaatccccacccccaaggacccacttctgtggtcatcaattgcttayagttatttacaaaatgagcaacataagtccaaacaacccaaatcagtcagcaacggggagagcatttctcactaactgatgcagtggtaatctgtgctttgagcagtggtgtctgctcagaaacaagccctacatcccatgaaatgtttgtttcatcaagggctccagggctcaggctgtaaaagaaacaaagagtttactgagcagccataaccttaaaattgctacagtttctatgaaactggaaaattccatcgctacagccaatgtcaacagcccaggcaagaaaggaatgtagga

SEQ ID NO: 20375 - DNA, 600 bp, Bovine  MMBT01540
atttccctggtggtctggtagttaggacttagtactttcattgccagagccccaattcaatccctgattggggaactaagctcccaaggggtggctacaaaaatgtcttcagtcacactagccccatttcaagtgctcagaggccatgtggctcgtggcttccctagcagccagcgcaggttacagaccacttccatcatcacagaccactctggtggacagcactgggtccaggctctattggatttgtgtccacgggtgcccaggtcttcagaagaaaaggtacaattccttagattmgctgcctttgagaaggcagctgtttgctggcctgaaggtcagaggaggagccctgcactcttcaaagtgyttcacgggagtggctggcctcatgctggggctccgcgtcagccacatggccccagctagagctcgggagtctcggcacacgaggctcctcttcatgtttgtctggccgaagtctgaattctctctcgggcccatgggcaatcgcgcgtttgcatttcagcgagtaaacccttctggatgacaattcatgaccacagagtctccacagagaatcagatctggagcttctca

SEQ ID NO: 20376 - DNA, 600 bp, Bovine  MMBT18385
aggtgtgaacattcactaactgtaggaatcccagcatgtcgggggcacaggtaggatacatatccattaataaagatagacccacttctgccggttcactaggggaagacctgtgatggaagacaaaaggtttgtttacatttttatgtgccatcattactgaagatgtattgccactaatttattgactatttgttctttctttgtaaattaggtatcttttgggatttgcttattttttcccaccaaagtacgtgtgttctcctgtttgatttgtgtgacttcttcggtgctgttcaygagcctttctgcctccggtgcctcctgcacatctggctccttctttctctggtctttgggctttagtcacgttttctgacttagagttgcacttattttgttgtcccatctctccccacgtcttttcccaggtgcctttttctcatttgcccttcatcattcagtgtctttaatggtccccgtttcattctccgatctgttgcgtcgcttcttcttttacttttcatcactgtttttttccctgatgttccacttccctcctttttctacttcccttgttttgtcgtcaccaggcagtaa

SEQ ID NO: 20377 - DNA, 600 bp, Bovine  MMBT09943
gaagcttaaagaggcagaagtgtttttgttccagtcaaacttgattgagtcttaaatcatcataatgagattttcagcggtaacagcatgttctctgcttctatttcccttgtttctgaggcttccatgcaagtctggttctggttgtggggagaatgaggccgtgttattttctccgggagagacaaggagatgccctggggtctggggcttgttgaatgtgtcctttgttaatcagcactgagtgtccacgggacatcagcaaagccccgtgggaagccagcagcggtgcgtggaccsgtctgtcatgccaggccagcgtggcagcgccatcaagacagctgttcctgttgggcttctcacttcaaagactcccgccttcctgaacatgcatcccgagttttattttccagggctgcaaaccaccccgtycctaagggcacaaaaggtcaagctttcatcccaggccgagaggaatatgcacttggatcctttccttttttgttttccttcagggaagtcataaaacctgctttgataattagtaaacagccagcatgttcccaacactcataaaacataaaggcgacatgaaaaccc

SEQ ID NO: 20378 - DNA, 600 bp, Bovine  MMBT05727
aaaaagacaaattgggagattgaaattgacacaaacatactactatataagaaaacagataactactaaggacttaactacattgcacagggaaattttactcagtactctgtaatgagttatatgggaaaaaaattttaaaaagagtagataaatgtatatrtatcactgattcactttgctgtatacctgaaactaacataacattgtgaatcaactatattccaataaaaatttaaaacaacaaccactcttgttaaatgaaatctctctagtccaaggaatcgaaaactacaggamgggccaaagtttcatcaaacagacaggggcaccagcagagccagagtccactctgtgagacttcacctgcctagcacatgtcctgccaggccactgtgcagaagyggcccagccctcccactatcccagggcccctcattgggggaaatgcctgcttcctcctcccgggatagagcctggcagaggaaggtgaggtgagcaggaagcagaagtgagcagtacagacaaaaggacttcgatgagggttgttaaaagaaaaaaaaaaaaaaaccagaatcctttgaaatgacaggctgagac

SEQ ID NO: 20379 - DNA, 600 bp, Bovine  MMBT01517
ggatgctgtggtatgtgcgccgcagctccgcgcaccgccgcctcatccgcctcaaggacacgtacgccggcgcgcgctggctccgyggtgagtccccgacgcagcaaaccagcgggcgggcggccgagcgcacagcgaaaccagcctgctckcccgctagctgcagccscgcggtatctgcgccctcgctcccttccacctctctcctgtagtcttctctgcctccgtcttcctgtccatcttttctgtgcccccctccccacaccttcacttctcttctctctccctccgctttcaggytcttgccttatattccgacgttggagctacggttacagaaacctattcacatctttctttccttatttaaagccctgccatggttccactgaccccgtgacagaggccacactccctatcctggcgttcaaggctctctctgatcgggtcccaggtgactcttcagttttatcttctttgtcctcattctgtgctccaggctcaaaggctttaagttcccgtcacagtgtctcattcctccaaagatctggccccaacgccaccttctccacacacttggcaggaattactcctcactcc

SEQ ID NO: 20380 - DNA, 600 bp, Bovine  MMBT06116
aaggagacgaactcaggcataaagcctgaggtttaggactcagaacccaagagtcttaaactatttagaactttagaactctgcctgtctggagtgtggttcacttagagagcaagtcaaaaaacacagccaggaagtacaagatgataaaactatcacaaaggttttgggtaaacataagrgaaaaacaaatygttgactagtcaataaaagggagaaggcaatggcaacccactccagtactcttgcctggaaaatcccatggatggaggagcctggtaggctacagtccatggggtygcacmgagtcggacaygactgaagcgacttagcagcagcagcagcagtcagtaaaatatgggaatcatttacaaaaggagattgtgtagtaactcccttaatagagggtttaccctgatgaagcaggttcctagttattccctgaagcattcccaagtgtgttttcagaagatgttttggcaatatgtatcaaaaacagtaaagacgtgactaacagcagtttctctcaggcaaattgctcattatcttctaaattgtttcttcatctggtaataacagggtttgggggaggattaaata

SEQ ID NO: 20381 - DNA, 600 bp, Bovine  MMBT04275
acatatgtgtatgtatatatacacatgaaaagatattcataatgtactgctaagtaataaaagcatattgcaaaataaataattgtaatgtgaccacatacttggtatacatgaacagatcacagaattaatgttaatgtatacacatgtacacacaaccaatagcattagtagcttatattgccattctctaaatttttctataagtgtatattttgctgataaaaaaaacatcaaaaaagctgtatagatgtttttggaagatctgtattgacaagaaaatgtttatgatataatgcrtaaaaaagaatacaaagttatacacacacaatgatagcaagttgatagaaaaaaatattttgacatagagaaaggctgttaggaaatatactaaaatattcacaatggcgatctctaggtaattttttccttaagatttataagaatcctatgtcaagcatatattatctttagcatacaaaagctattttaaggctttttatctgtattgttctacctatccccctagctgaattggttcataaactcaaagctggtaagacaattgattttttgttttttgtttcccctttccmcatc

SEQ ID NO: 20382 - DNA, 600 bp, Bovine  MMBT22106
attaccacagaaaaaaactggactatccttgagtacaatcctgccaatgacctgagaagacgagcctgggggagagcgggtagggaggtgccaggggacctagtgaatgaccccatttcagaagcaaacgcggggatgtattcaatamattcyagtagcaccaagtcacatgaatctggatgcacaaattaaccccaggctggttttaaatcatctctaagagactgttacacatttcagggagatctgagaatgttgtgcacatgatcctcgctktgtgcaagaagatgcctgcctcaytgaaggacaggtggctgcctttagcaactttgtaagtagattaaacacaccaaagaagcagtgcagagttctggataccaggatgagacctgcagcyagatggaacagcacaggagctgcgtaaccttaaccaagtgctgcacattccctaagcctcagattccttacatggaagactggaacagcagcagcatcctcataaagatgtcacaacatgaattaacacacagacaccatgctggtaaccatggcaacacgacaacattattcttgtcctatctagctaactttacggcttga

SEQ ID NO: 20383 - DNA, 601 bp, Bovine  MMBT19758
  misc_feature (1)..(1): n is any nucleotide
ngtaaatatcaaccactcactacgtactgagtaactataatattcatggcacagtttcacattctttttagtgtggtgctagcatcatttctactcttggtggtctttagttatgtatgttattatagcttagctggtaactgtttttaattctcaatcccatatgtttttttgcatgcaaaatagtatcaacaacattatgtcagacccaaagatacagaaggtgatgaaaactgagctggtggatcctcattcatctaataagctggaaaggctttacagaaagaggaaccctaattgyacatacaacaccctcagtctcacatgtcttcaaaatgacctttaaaagaatgctttaaatgtcatagcttttttagaaaacattgagccaaacatggaaattgcatgagaagaatttctgaatctccaattaaaggcacaaagagccacattttcaatttcctcttctttttttctttctctaacttgtcaatgcaattatttaataaaaaccaacatcacattaaaataattaggcataagcagttgaatgttgatggatataatacaagcagtttcttagacagaggttaagtttttg

SEQ ID NO: 20384 - DNA, 600 bp, Bovine  MMBT07783
tcgaccgctggttttatttagaaatgtgttatttagtgttaaggtattaatgattattgttggtcacaggacttaactgtctgattcaagttatttcagatttattgagacttgttatatggcccagaatttgatrtattttttaaagtactgcactttctttttcattcttatccagagaaagcaattgagctgcgattggcaaaaattgatcatactgcggttcatccccatttacttgacatgaagattggacaagggaagtatgaaccaggcttcttccctaagctacagtctgaygtgctttccactgggccagccagcaacaagtgagtcaaccccagagattccctggtgcagctcccaggtcacagtgataatatagtatctggacctagactgtcatttccagaagaccttgacttttataaagcaaatgtggagaagatacaaactgtccaggttgttcacttgtttaaacaaggaaacaggtgacagagcatcatcagctcccgtctccactgtgcaaattgggatagctccatgtatcaggacctgtaaaaggccagactgcagatgggttgaaatcatctgcaaatc

SEQ ID NO: 20385 - DNA, 600 bp, Bovine  MMBT16882
gctggcctccaggtgctcaatgactacttggcggacaagagttacatggaggggtgtgtgccatcacaagcagatgtggcagtatttgaagccatctctggcccaccacctgccgacttatgtcatgccctgcattggtataatcacatcaaatcttatgagaaggaaaaggccagcctgccaggagtgaagaaagctttgggcaagtatggccctgccaatgtggaagacaccacagaaagaggagctacagatagtaaagatgatggtggcattgatctctttggatctgaggaggargaggaaagtgaagaagccaagagctaagagaagaacgccttgcccagtatgagtcaaagaaagccaaaaaatcagcacttgtctccaagtcttccaccttattagacatgaaaccttgggatgatgagactgatatggcaaaactagaggaatgcgtcagaagcattcaagcagacggcttggtctggggctcttctaaactagttccggttgggtatggcattaaaaaacttcaaatacaatgtgtagttgaagatgacaaacttggaacagacatgctggaggagcagatcactgctt

SEQ ID NO: 20386 - DNA, 600 bp, Bovine  MMBT08041
agtgaactccgggagttggagatggacaataggcctggcactctgggattcatggggtcacaaagagtcggacacgactgagcaactgaactgaactcaactgaaacagctattcacattaaaaactcaaaaatgatttattttcatttgatgaataccacgacttagaacttgaaattactagcttaaattagctacaaagttaagctgaattaactaaatatagtaacttcatgccaaacatcatatttgataatttaaagatccttttattgccttagtttcatttatggatcctgrgttttacttgagctgtcagaacttggaactcattttgttttcaatatattaccctctamtaatgtttgattttttattttctgaatgttacagtggatcttgttttatttttctatgatatgaaatgatagcccaggttaaaatcaaacaggacacataatactaaaaattaaattggtctttgtctattaaggaaaactcaagtacaggtatgaaaaaatatgccagtacccacgccaggattcttagcctttactatactctataatacctgacagcagcttctaggagagactggat

SEQ ID NO: 20387 - DNA, 600 bp, Bovine  MMBT03268
tgaaatactgaattcactactgggcttatcgtgggcatcttttaaatattagaaaaatgacaatcattttttctgactgttctgtttgagaagactctaagggctctctctgtataaaaatataacacccctctgaagttatttgccttatccttgtactccctgagatccccagctctccccagtagctccactaatcatgaactctcccatgagagaagccctctaaaaatgctgtctttgtttactgggtgattttgaagcctagtctcttctgggaataaaaacccaaactgaaayggttggagtctgcccactgggaatttaaaccacttgactctaaggctatgatgacaggaacacagggaaaaatagatgagattctgagttgcaagaattccccaggactcactggaaagctacctaaggacagagggggaaaaaaagcccaaccataataattttctccaaagggccatactggggacagtgtcctgctcagttctttggttatagtttttccacctctagcagttgcccctgaatctggtgaagaattgtggcaccatcagtccccaagtcagtttgtgggggggttgt

SEQ ID NO: 20388 - DNA, 602 bp, Bovine  MMBT04435
  misc_feature (1)..(2): n is any nucleotide
nnatggaagcaggacccaggtgcttcctttctgaaggaaactcccaacacacactgagatccactattaacaatgaacacatatcgacagaaaagcccagagattctcaaatcaaattctttaaggcttataatactgtagattcagctttaagggggagaaattaaaaagcaatcattttaattattatgtttatgtcaagttaagctaactgctacagtaatatcacttggcttagtctactgtaattaattcagtgaatgtacaaagaaaacaaattagaactatttatagcactgaarctgagtggaaatgagatattgcccaagtgctattacaataaatataggttgttgacactccttcaaactatgctttaggactttcagccatttatgttattcttcaatggtaaaaacctccatgaaataaagaaaattccaatagtggatctcatcaatcttattttcagatgtgcatgtcacgttgagtaaccaggcacttgttttatttgagccaaattaaataaatctcattaaggaaatgttactagtatgcaaacactgaatgcattaaaaaaaaaaaaaagctgtctctgcaat

SEQ ID NO: 20389 - DNA, 600 bp, Bovine  MMBT16936
actacttgctgtgttagtctaaaatgttttaatgaccacatctctactgacagcaggtacactgtggtgggcatggcctttgatatttctaagcattactgattcaaatgtgatctgctgagttcacagaaaagcagagaaagctgtttttctgggatctttatcattttatacttaaaattatatattatttatagttccgttcatcccagataaatgtgtgtatcttatcatatatgcctgagcctagaaaataactcacaaaaataatcctcaaatagagttgttgacagataaatkatggaaatagtgagcaatggacattttggaacatgtttagtatgacagttaacaaccatacatgttatttatcttgcttttcagtgtcagatggaaaatatttcattccgagtaatggtactcatgacaagaagcaaggtttgaaaaaaaaatagtggcccttttcctgctgagtcctaaaagttggaaatcataatggaaatattaaaaatggaaaaagakaaagagaaagaggaaaactggactactgcaactcagcgttttgtcatagattcatgacaaggagatgcacaaagaaca

SEQ ID NO: 20390 - DNA, 600 bp, Bovine  MMBT01210
tgatgcagagatgggcaggaacacagactccttctcacccaccaccaccccaaagagtgtgtctccataaagatgagaaatacctaacaagacctgagtgtgtataaattctcccaaagtaagatgggctctttgtaggatgcaaattttgaatagtcaccgtcaacctaacagatatatttcaaatgtaaataaaagtcatcaagcagtaacagttcatctcctgacttcattttttgttgtcacagaggtgttctgtttagagagaaaataagctgttataatattccaactgaaatwtcaagaacatgatttagtaggtgagttatttagggctacttagtaaatagaatttctggactgtggtaaatgtgttactctccttcacatgttcaatgaaacagccttttcttcttctcaccaaggtagttatcctgtcctcagcccagagactcaatttctaacggctgttggatttattccagggcagccaagcacaggttctgaaccattttctttttcaattcctgtggcctcagaatgctcagaaatgttgacttttgcaaagaggccaaggaggtctgcacgtgtgccaaggct

SEQ ID NO: 20391 - DNA, 600 bp, Bovine  MMBT00815
ttgcaggcagattcttaaccattgaaccttttatgttttgatgatacgctagttaaatgaccagaaaatacatttaaggaatggacactaaactgaaagggatgaaatacaagaacttctaaacaatgtttaaccatatttcatgattatatatatgtaactacttgcacttcttgggggatttctattcaaattggacctctgaaaacactacatcttattattctaaagttacaaatgcatttcagtttctttagaatgtgttaggcttttgctgactaagcagcattacctcttagwagaggtccaaagctataatttgacccctctggcaaattaaatacaattatgcaaattaccaggatttgggcataatctaattagtacgatacatatgcaccagataataatttccctggctgaaagctagattgtcttatttcatgtttgaaatatgttttagaaaaacattctactatgtaagtaagatttcattatcttatatatactatttgctcagctccacaatggacatgtttagaaaaataaagccaaaattggaatcttcaagtgatgatgtattttgtcagaaattcatag

SEQ ID NO: 20392 - DNA, 600 bp, Bovine  MMBT21822
tttttcactcatttaaggccaaaaaaagtgctttaaaccctataatttggtcaccaattagtctttgatttactctgatgtacttagaggttttttagtattaaaaaagscttgcagctgaaaatttacatttaaaaagtaattaatgccaattcaatgaagaaatcctcagtttcctgtagaatcacattgaacttcaagcccttttaaaggatggaaagaattgatcatcagctaagaggtgcttccttggttctctgttggacaaaattctttgtccaggtaaatggacatcagacmccttcccacttctctttagctttgtccccatcactcttcatacctacrtgtgttgttactcagaagacagcatttgacgaacggttactgtcaagttccattcctccctgttccagccgagcgcttcccagacacagacggtcaccaggacagtgactcaagcagagccgcttgcgtctgatgtcagctgaagtcctcccgcccatccctttactgctttcttggtttctgagccgtcatacacagagttatctcccccgtgtgaactcaccgtctcattctccatctccctctgtcacc

SEQ ID NO: 20393 - DNA, 600 bp, Bovine  MMBT08604
gttggtaatacaagagtgatctttgtgtcctggttctagaagtattttttttgtctagactaaatgtttttgttcccaacttgctatagcggtgcagcagtaattgaactattttcgtggttctacaaacagcctagagcactgaagttttaatgttatcattgactagatcacaccaaaaatttagtaataaccttttgacatttcagctaaaatcaattcttgactgtctcagtcttcacattgacaaaacatgggaaaaacacggttttcagtctaccaaaacatccagtaacagcrcctaataatttgtacagtcaatcatatctgtcccccactaycctaacagtgaaagtcaagatgccttttacgttaggacctcagggcttaggaggcttgccggaaacatttgcctccttagtttgtctgcgtgtgtccctttgtaaatcatgaaacagaggagccagaagaggcactgctttggctcatttaggataatcagtcattttagagtagataaaactggctctcagaggcattaagagcccactgagaacgatttacagacaagattaaaagaatcttcagtactatttacaa

SEQ ID NO: 20394 - DNA, 600 bp, Bovine  MMBT13950
cccgaaccggccctcacctcccgtgcaggcctgacaggtaagaatcagctggacctctgagagttaccggaaacagaactaaaggttctggggaaggagttgcctcagacaacgagatccacccacagaactgcctgcagggactggcaagttgtgtttgtacaaaacaggacagggtgtcctgggaggtgggtgcaagggagggtgggcgaggggaacagcaggagaatccatgtcaaatctcagcagcttgttacatggcaggaaaacaggcccagtgcagcctgatctgaattgccrgcagaacctggagatcttgattttagcatacatattgtgatttctgaaacactggtgaaaattttaaaagtacagccggccaaagaaagacatctttgagtaggatacagcctcaggtcaccacctggggacactcagcccatgtcagctctgcccttggcatactcaagggactgatgacccagagggagggaggtccccggggtgcctctcaccctaactctaacaccagcttcttcccctccagaggatgagatgtcccccaccaaatgcccagcagctggcggggcctccagcaaa

SEQ ID NO: 20395 - DNA, 600 bp, Bovine  MMBT13908
aacctgttccagctccacccaagcycctggtcatgctctcaccccctgccttcccacacatgcctggagcattcctgtctagcttggtcagctctcctctcccacaatctagtttaaatgttagctcttctccaacttcccttgactctttccagcagtgtccactcactctgcagtgtggctctatacataccctctgttggcacttcttacatgttcctggcaccatccctttggaggtctggttccctctggaggtcatttttatgtcatgctctccctttctcaccttcctcttaygttagatataaaacatgtagcatatattcgtaaatatctcttgactaaactttcttttaaccttgtaattctgaaaggaagtggaagttatgaatttcctccattctgactagtagcaagttcttagcattgtttctagaggaagtttagggaaactttccagaattcaccaagtgtgaagtagatgtgctgaatctgaagtaatcaaataggcctgatgttaccggatacatacctgaccatggagctcacaccctttctccatcctctttctagttatggagttcttatctggtgttt

SEQ ID NO: 20396 - DNA, 600 bp, Bovine  MMBT22166
ggggatgatgtatctgcaaacagggatatgggtgagtgtgatgagtgggataaccttctggaacaaggagccctctgggcagagcacttaggcaagtcctttcacctgctccaaagtattgtgaggatttaatgacataacccattcagagccctggaataggacccagcgccacgatcggccttcaagagagtgcaccgctgtgatcatgagtctagttggtgcggcaatgtctgctctgtgtgtgtatccagttttttgtgctatggtcttatcatcatcattattataacagtgctrtgttgcaaatctgtttgtgtcattgttgaacgtgatgtgtcatttcggtcacgtatgtcagggttaagtgacctgaacaggacttttctgcatctccccattttcaaagccccgtcagtccacagatggaaaacccaagtccccattcaggatttccagctgtgctggagaggagcaaactgtggtctacacctagatcatgtccaccctctcaatcccctctctgcccatgttgtcctagaagcccacctcccccaactggctgacaagagcctgaagggcagatgagtgaggggcgca

SEQ ID NO: 20397 - DNA, 600 bp, Bovine  MMBT18935; identical to SEQ ID NO: 4593

SEQ ID NO: 20398 - DNA, 573 bp, Bovine  MMBT04182
gatttattgtcaatgttgctaatacaagaatttttaatagagtagttacatagggaatagatgcaaaaaaatataactttatttatatggtttctttttttcaggtaacaaactgggtagacccatcatttgatggtttttcagagactacaagcatttctgctattactgccacatcattaagtgtgaataactcaagtcttagaagaaaaaaggtgccttccacattagaaagtagcagatttccrgctagcaaaggaggaaacctatcttcctctaaacagatctgtggtctagaamattcaaaagaatatctgtcagaaaatgaaccatgggtggataaatacaaaccagaaactcaggtaataattagcatacaaagaagtcttcataatttagtttcaggaaggagagggatgtgcatttttgttattattcataaaaacctttttgcctaaatgaattagaaaaaaataataacttctaagtttttttatatttccagtctcgaattttcccagcagttattctgaagatatatcattggttatttgtctttgatttaatttaacc

SEQ ID NO: 20399 - DNA, 598 bp, Bovine  MMBT19179
  misc_feature (1)..(41): n is any nucleotide
nnnnnnnnnnnnnnnnnnnnnnnnnnnnnnnnnnnnnnnnnaacataatcaagaaatagaacattttcccagcaacccccagaagtttccttrtgcccacttgcacatcctgcaagttttgagaactgatttcttttacttgaagtgctccrtttagagagagagagaaactctttggaaacaggccatctcattcccaaatgaaatatctccaggcagaaattaatttttgtaattgtctgtcttcttttctgctacaatccatgtcagaaagcatggacttgaagctgtcaatattgmaactgctttcactatgggagctgaaggccgcatccactgggctcttgacaccaagcctaaatttctcatgtttcatggccacgcccaccacaagccctgactttttgcatgtgtatatttgactttcattttgatatagaaacacttaagtagctataatgcctgtttccctgtggaagtgttgtatatctgtccaaaagatgggaaatttcagttgttgagtgatcaggaaatgtcacttttaatccaaatataaaaataaatcctatagacatgaccaactaaactagtgtgtaat

SEQ ID NO: 20400 - DNA, 600 bp, Bovine  MMBT12570
agtggcagggtaygtctccagaagggaggtcagggaatttggcttcagctctttcttttcttgctttgtggatagtwccttataacctggctggcatcaggactttgcagacgcaggaaggaagagatgtgttctttaatgatggaaaaatattagagcacaatgccctcaaaatagaacgtgtgcacctcgcctttattttggggacttttattgttgtaaccatctctcctgggaaatgctgtgggaggcttttcccctttggtgaagcagaataattgtgtaacctgaggtgtcccygagagagctgaagggatgatgtcaacacacaggttttagaaacatgactgcatattttttaatgtcaatcactgctcaagtaacatcccttgtctccaaagtccaatttctgtaaaatgaagataatcatatatgtggctgcccaccccaccaggctgctatgaggatctaatgatataatggataagattatgtctgcagactataaaatgcccccagtgtaaattgtcattttcatcagcaatcagaagacctgctacttttgggttggtgccattccacatttcatygtttatgaag

SEQ ID NO: 20401 - DNA, 600 bp, Bovine  MMBT06661
agaaaaaggagtgaaagcgcccccaactcacatctggcaagttcaggaagtatcaaaggaaaggactcaactctaggttagccacaattgaaaatcacaaatcgtctctaagcttcagtttttgttctctaaaatacaggggtgtgaccagatgactccttaggttttcctgttttgggactgcagttcagcaaatggatgttgtgtgagttacaaaacaataaatgaatagctttaggtcagaaaaatcgaacttaaaagtgatgcttaaaacagacagacctggctctccagttcttstagagtatttttttctttgtgtacttaacccaaaatatttgataaaacttccaagtatgcctcattttttgtcaggtgatactatycattcataaactaagtaaagagataaatatttttaaacataaacatttccacaaaataygtaagtgcctccaaataggagaaagagatggttggatggcatcaccaactcaatggatatgtgtttgagcaagctctgggagatggtgaaggacagggaagcctgatgtgctgcagtctatggggtcacaaagagtcagatatgactgagcgact

SEQ ID NO: 20402 - DNA, 600 bp, Bovine  MMBT19513
gtggtgaggaagcaatgaaaagtgcatgagtgagtgagtgagtgtgtatatgtttgcacatgtacaagacgtagagagatagatgcagaaaacataaatttcaaggatatttaatcttagattttagaaaaaygtttattatttgagcaggtaagaaaaygggtggagatctagagaaattctgaagcaggaaagagggaagtcactgaaacacaaacttgctgttttagctgttcaaagacaaaaacagcaaaaaagctttccmtctgagagaggctcaagagcacagatgtgagctgrtggtgcargaagagagcagaaggttctgaccacagcaatcgttagaggtactcaatgccactcactaccactaatttctgagttcagaactatctgcagtctctcggtctctgctgctcatgatagttcaaaagggaaaagaacaaggcaaattactacagacagttcccactctagagrttcttaatctgcaagttgccctttttagatctttttggctgtgttatgggctggygagatcactgtaaaattatcactcaaactcttcagttcctctcctcttgttttctctggaaaatg

SEQ ID NO: 20403 - DNA, 600 bp, Bovine  MMBT19514
gaagcaatgaaaagtgcatgagtgagtgagtgagtgtgtatatgtttgcacatgtacaagacgtagagagatagatgcagaaaacataaatttcaaggatatttaatcttagattttagaaaaaygtttattatttgagcaggtaagaaaaygggtggagatctagagaaattctgaagcaggaaagagggaagtcactgaaacacaaacttgctgttttagctgttcaaagacaaaaacagcaaaaaagctttccmtctgagagaggctcaagagcacagatgtgagctgrtggtgcargaagagagcagaaggttctgaccacagcaatcgttagaggtactcaatgccactcactaccactaatttctgagttcagaactatctgcagtctctcggtctctgctgctcatgatagttcaaaagggaaaagaacaaggcaaattactacagacagttcccactctagagrttcttaatctgcaagttgccctttttagatctttttggctgtgttatgggctggygagatcactgtaaaattatcactcaaactcttcagttcctctcctcttgttttctctggaaaatgctttgctc

SEQ ID NO: 20404 - DNA, 600 bp, Bovine  MMBT13465
tttttataagggaagtgagttcttcctcgggagcctccggatggtttrtacttatgtcctattagccagaactgagctggatggtgactaagattctgaatgggaattggatcaggcaactcatggtgtcggctgccaatacttactacaaattcatatagtgcggagagggcattattgggtcagccacaaggagctctggccagtcagctggtatcatggtagcctgtcagctggtatcatggtagcctgcagaaaggttgttctcctggtaacagttctcacgtaatggcatgggaytagaaattccaaaagacaaggacattgtttgygtgatctcacttagagcttcaggacctaatccaaggcctggtacttggtagctgcctgacaaacatttgtgaatgaatgaattgtccatcagtgaggatggatttcagtgggctggggcactcagggaatagggatcaggataattggattttctggcagcctgagggtgaagcagaaaagcttatgatttcaaattaattccagcaacactaagtgcattctacatccaaggctccaaggtwaaaaaaaaaaaaaaaaaaaaagaat

SEQ ID NO: 20405 - DNA, 598 bp, Bovine  MMBT19515
  misc_feature (1)..(39): n is any nucleotide
nnnnnnnnnnnnnnnnnnnnnnnnnnnnnnnnnnnnnnnaaattttatagaatatgcacttacccaagaccatcttgattttcattgagctcagaaagtctggaactggatttctgacgtttaggtttacccctttctccaatataaccagaagtattttcatataatttttccacttcacaagcattcaacatacattcatcaagattgctgaagccagaaggaatattttctttgttgagacgtccccttraattgaaaaaaaattagcttcattttactttaaaaggtaaaaaggaykttttaaagacactgcatcatgcagaaagaagagtgcttagaaattccatgtttcatcttttataaaaatctgagcagagtgctactcctgagaccacttggtgccaaatgtatcagattaaaagagaaattattcctaaaggcaaactggcgagggctgtgtttctaccaatgaaaagcttttgtatttgtaccgaaagtaatctgtattcaaaaccaggggaattgtgcaaacttgcaaagacatttttccattattcataggttttatatacatacatacatacacgtacatgga

SEQ ID NO: 20406 - DNA, 600 bp, Bovine  MMBT03867
ctacttcctcagtataaattagttttttaaaattagatttacatttccagaaatcttgagtgtttctagattctcyatttcttttttcacatcttttgtttcaatctgtaatttctctctccatattttttcatcccattacatcatctaaaaagaaggctttctctttcaaattcaggatgtgaggaaggtcttgaagagatgaatttgatgaatatctgttcattttatgttgctcaagagccactgaaatttttttcttttgtgttttggttcctgattaaacttccctaaaactcwagtaataacatgcccatttataatgtttactttaaagcatatttaaatattgcagtaacttgcattttatttagcacaatctacttttaaagttctaactgtaagaagctatatatgttcataattacagtttatttgaatgtgtagtattttgggaacagtgaagtaccatattttggggaggtggaatgaaaacaatttatgtatttttaaatgaactaaagtttttttaatgttcactgtctagagtaattttaaaattcattatttctattttatatcataatctgtgaattaaaa

SEQ ID NO: 20407 - DNA, 504 bp, Bovine  MMBT19463
ccaaatttaaacaaaaggagaataagataaatctttcaagtgataatcaaaacagtaggaaggaagtatatgggttgccttataaattgaagtctgtttttcaaaaactatgattttcagtaagattagtaagagtgtctgaaatatttatgttagtaaagccatggtgaatgaggctgacttgctggaagaaatcatgccaaaagttggcatgtcaggatgtggtattagtgtgtttacatgttaagccagttgagaagtttgtgataatgtgctaatttagaatgattgttgactackgaaatctttctatcaatcccgatactgatgctgtgggcctgggactgatggttcacaaaggaagaaaacattctcaaacgtggtgcttttgcagagctccagctagtcaggagattcttttttcatcctaggcaactgttactggtctatagcaccatgggagaatgcagtccttatttcggtgattgagttagatcacattat

SEQ ID NO: 20408 - DNA, 600 bp, Bovine  MMBT19278; identical to SEQ ID NO: 4868

SEQ ID NO: 20409 - DNA, 600 bp, Bovine  MMBT16580
ctatcaagcagctgaagtcctaatggcctcaaaaccagttcccagagagtacagtcccagagctggggccaccagagagcagcacagaaggtctttgagaaggtcaccacccatcccttatctggtgatgaggctacttggaagttcactgtgaaagaacaggcacagtcacactctcagccttcagttcatcctggctgaacactttctccctctctcttcagtttacaaaatccagcaggaatcacagaaatcaaactgaccgagagaaatcactaccgacagggagacaattttacraaataaggacacgtggctgtccagaagacgccctgactaggaaggggaacgtattagtcactcagttgtgtccaactctttgcaaccccatggactgtagcccgccaggctcctccatccgtggtattctccaggcaagaatagtggagtgggttgccatttccttctccaggggatcttcccaacccagggatcaaagccagtctcctacactgcaggtagattctttactgtctgagccaccaggtatggtgaaatctcgctattgaacaccaccactggcccttcctaggcgagggt

SEQ ID NO: 20410 - DNA, 600 bp, Bovine  MMBT06827
taggaagtgctagcttagccactaatcatggtgacgtggttcttacttgagtggatcrtgtgaagacatccctttctattagtttgaaagrttttrattacaggtaacacaaactaactggctagtgttaggaaaaagggagaaaaargtatataaatttgcaaggataccaaggatgtcacagaagcaacgtgaggatagggaaccaggcatagakactgggtatgaatgaaggcacttctgttcttttatgccaagagggaggaagccagggtcttttaaccaagcaggatggtctasagctgctgctgcatgtaggacatcactgatgctgctgttgctgctatgaatgaatcttaatggtcactttggttttgtgtccctcactacagagtcactgtcccgtgttggagcttctggttgattgagactgggacacttgcgcctgttctgtcagatgccactccaaagaaaaaagaaagatcatcagatggtactccaatgatctctggtttcttgctagaaaagggtgttgatggggaactgccctatatgataaaagtcctctacactcagaagacgagcacctgaactagaaga

SEQ ID NO: 20411 - DNA, 600 bp, Bovine  MMBT11930
caatgacagaaacaggattcaagcacaagggttttgttattaaaacccattttctttctgtaccaccattgtgtaaaccatttttcctttcttccttaatgagagttaacaatatccataaataatttttcaaaatagaaagtaaaaacaatgatgttgctataagaacatgtgtagctacagccggtaaaataacctttgttagaagttataacyacttccaagtaaagtgtatacatattttattagagtagctgaagaaatggtgatatgatttaagcagcattttcatttacttgyaaacatgagtgtgtgartactttyttgtgaccattttttaaaagttatagttttcctacaatttccaaaagtctagaaagtaagtttgattatcttaacacacacatatacacacacaatcacagtaattgtgtcttagtagtgattagttatttccaccacagaaacttggtatttgagggcttaartaattccttaaggtaagaattaagcaatcaaaattctggtactgtttattattagaattacctggagggctggtatttgttcttttttctatttttgactgggggcaggggc

SEQ ID NO: 20412 - DNA, 600 bp, Bovine  MMBT08462
gctgagaaaccagactccgctgacttcagctctggcagtagggaaggaaggagggtagacaggaaatgggggacagggggtggcatgctgaatttactcttgtccctttggaggggggttgctgccagccctgcgggtgcttcatctggctgtcaatctggacaaaggctccccaaaccttcctccataccccacccctgcctgccacccaaccaagtcttacctgatgcctaagcaygagatatgtcctccataaaccattttcagatacagaaaaatgactggaagtacaccaaatcrttaagagagattagccaccaagcgtgggattataagtgaattttatttggttcttttgactttcctgtgttttcctaatatttttcaatgggcagaacaaaatcataagtgtttaggaagtctgggggtcccaggtctccccagctagtgagtaaaaccatccactctttagctatgaatgcccacacaggaaggctctgagctggtggtcctgaccygggggcaactttgcccccccaggggacatctggcaatgtctggagataagctggttgtcatgacttgggrgagcattgctgg

SEQ ID NO: 20413 - DNA, 600 bp, Bovine  MMBT09708
cacaggtgtcacagctcacgcgctcgctccgacgcccggctgcgccgtgaccgcagccctaggccgctctcagagcagcctgtggttgtgtcgctgtctccaggagctgaacaaccgcctggctgcagaaatctcacggctacggacactgctgactggggacgccggtggcgaggccgctggttcgcccctcacacagggcaaggacgcctacgagttagaggtatggctcggagccaggcccttcaccagcttgcggcacacgagtckcacgtgggaccaggggtggccccagcttaygggaaaacccaagtcacgccaggacacagagaacagttagccagacagcatgggacctctcgaggccccagggacctttacatttaacccaccctcactcccttgcccctctccctggtttccaccacatcacaagtgctgacctccaaaacggaacactgagcagctgygtgacactgcagctccctcatttctctctctaggtcttgttaagggtcaaggaatcagaaattcagtacctgaaacaggagatcagctccctcaaggacgagttacagacagctttgcgggtaatgcacg

SEQ ID NO: 20414 - DNA, 600 bp, Bovine  MMBT14121
gacttgtgactctcacgctgagctgcagttcccagggggtggggtccagggtgctggggggaggctggttcccattgaagcgctccccagatgccaagttgcagccagctcagctaattggcaagagaaggagaagcaaaaatagtgaaaatctgtgaattaataaaacagccttgaagcaaccgccaaaatgtgtacaaatcatgaagtaattagaagtgtgaagaattctatcgggttgactgtttccaaatccagcatctgatcgctttaggaggccaagggctggcaggccagggragtaaaattctttccattgcattctcatctggccttcttggagcctgggtttcttgaaaccctttcrgggtccaggcagtggctctgggacctgcttgagtcaaatgtgcaccttgtgaaggccctttaggacatgcaagatcttgtcccaatagcatctcatattttagaataaaactttaaggtttcacaagcgttttttggattgatggtcgtatttaatctcactatcaccaaatatttttatgtcagtaaaatactaacaattactctaaaaaatttagagtaggaaatcaaagt

SEQ ID NO: 20415 - DNA, 598 bp, Bovine  MMBT11597
  misc_feature (1)..(34): n is any nucleotide
nnnnnnnnnnnnnnnnnnnnnnnnnnnnnnnnnnccgtttcaacctgcttgggttcctttggcttccaaaatatagtgatggcccagatgagagagaaactcgtgatgcagctaagtttcccttaaaattatgctatacagatagaattcttcagtaaaagaatgtgagttagtgattgtctccctcccaggggatcaacctggagagcaagcatgaaggaaaacagagccccaagcgtcctgcagaggcctgtggtcaccatacctggcgcgaatrcttgcctctgtctggacttgctyggtcacctttcacctttgtctggcaggctctgcrgagcccccaggtcactcttggctaatggtctgcttatcactcagttctttcctcgtgccagagtaatctracaaatctgatctratcttctttgttgcgcaccttcagaccttcacgggttcttccatatttctccaagacttgagtcccttttcctcctcctcctggtatgtgagaccttccgaatatctctccgacccttctcttcacatcccaccagcctagccgggtcagacracttrttcttgcttgatggccscagcc

SEQ ID NO: 20416 - DNA, 600 bp, Bovine  MMBT16759
taaacatgtcaagcatatcagtgctataacacagaagttcccgaaggacatctgaaaaaatctatgaaacatgcagacaacaggagttttaaaccatactctcaaaacacaaactaagtttgagtaatgctaacctaataaccagcttacaagaattttgtttgtttttaattagcctacgtctgcttcaacagatctaaccacactgtttgcttccaatgttaataacagagaaatacagtttaaagcaggggttggcgaacttctgcaaagagccagacagtaacttaggctttgtgygctatgctgtttttgtcccaactactcctctctgcccttataacacaaaaacagccagagacgattcgattcacacaggaacaagcgtgaccacgtcgtgaattatttaaccatttaaaaatggaagctccagtctcccattgtggtcctacaacaacaggcggcaggccccactgggctgagttacctgacttccccagagttcaagcccagagccccgggcaaaaggaaggagagcgcttgcccggaacttccgtcactcttgtcccaccccatctccacccccttctttaaaaaggc

SEQ ID NO: 20417 - DNA, 600 bp, Bovine  MMBT01108
aaaactcactggactggttcacagtggcatgcctgctcaggcttaccacagtctgcaccgctctctgttatatctccgtagagtccatttcactccacctccgtggccagtgtctgttttgatcgataaatktcgctcccataacagtgaaacatcattaatagcacctctacatgtaggtcacctgccaattccccacaggcctttgagactgccacctctcccaaacattagccatctctccatctcatccacaggtgctcatctgagcttctgtgccctatgtatcttcttcttcckctgccccatatatctcaaaatatttggcttgttgacacccttatgtcacctgtagaacatggcttttttaatagcctcattcccctggaaagccctaagtaatttgtccagccttgaagcttaatcacacctcctagtcatcttcattgttggttagtttccatgatgtcttcgcagaaaaccccgcttttgctcacttctctggggctccgtctacccctatggttgccgtttattactggatttgaattctaaatgtttgggtactatttgtttacctaaaattcaggcaaaataaaa

SEQ ID NO: 20418 - DNA, 600 bp, Bovine  MMBT04721
gggtagaaggggatgacagaggatgagatggttggatggcatcactgagtcgatggaaatgagtttgaccaagctctgggagttggtgatggacaggaaagcctggcatgctgcagttcatgggatctcagagttggacaggactgagcgactgaactgaactgagtgcatatgtgataagaagctctggaaaagtcttttaaaaatatcattttcctttttattagattttaaggtcactcaactgctgcataaaaaatagtctggaaaacacaatgtattttcttattacttcaattsactacacgtagatgggggtggtctctgtgatgccataagtgctgggttaaggttctacgaaaacacggaaatgtatttacttttttcttttcttgtaatttcaggacagggaagaaaagagtacaagaaaaccagaaacatcattgaaaattaattgtttcacaaactcaaatgaatatttaggttcttaaatgattattttaatagacaatgtccagaacttattttggacaatttctgctgtatttgttccttaataactatttacatctaggtagagcaaggggcctccagaattat

SEQ ID NO: 20419 - DNA, 545 bp, Bovine  MMBT09996
ttctctgaatagccttccctaagtctctctgccctctattccagggagcctacaagtcatccacaatatgctattgtccagaaaaaggcagctggacagaactcgaaggagatgtggcagaaccgctggcagggccagcctgtgcaacagttatcctgcccgcctgcgtaccttacaacaaataacaccaggaaaccccggaacgacacattctaggaagcagtgacaagtgacatccctattgtagccagaacaatgcattctaatggtacatctgccgaaacccactttagtgtctgrtgatttacaagaagctacaaaaggaaaagacctgttcttgaacggaaactctgtctgtaactcggatcacatcaaacttcctgtggtgacagactcttccattgcagactggttttaacttgtctcagctttacgaaatccctcacgtggatctcgactttcaacaggagaaagaaaatacagaggagtgccccccgagagacctgaggatcagtattgtgcattgtagtttacctgcatgtgat

SEQ ID NO: 20420 - DNA, 600 bp, Bovine  MMBT17244
caacacaaacatggatctagatggattatcataaagcaaacatctctggacccaccacaggagtcaataaatacaacacaggagacatcacagaagactgctgttagcctcccaatcccgaggcctcttctctcccagaaaaggcagtctctaacaaagttgtcttagtttctcttcccrtttctccaaagttttaaaatcttagcagacccttcacatttaaagttgtggacctctttctatgctaattaattcatcactccttttaatgactctattttaaaaagagaggtacctgcktacattttttaactgctcagattttaaatgtctacttgtcatattaacgtgaattgttttactgtgcagtatgcrgatgcttccaggtgccagtcatttggataagcattgccatttgcccccagttaaatggccttagacctctgaaatacttctaattcattcctttgtgccctttcattgtagaaatctgtcacctgatatttttgcaaacctacttctcacttcaagcacctctctctacatcaacaaattccttttagggctgattttccctagttaacatcctggacaaaagag

SEQ ID NO: 20421 - DNA, 600 bp, Bovine  MMBT09386
gtgagggaactgaaaaggtgagaactcaggccatgaaaaatttagaatataggatgacagtatgccacaatttgaagaaaagcatcaataacttagtgagagatggtggtgaatttgtaaaaagcaataaatagaagaaaaatgccttgattccttttttttgtgacaaagaaaagacatcctgaaaataagtaagaaaactcttttatttcatttatattcaataattgtttcctaacagaatatgaggacctatgccaataggaaaaccgtgtagatatatctctttattcttctggygctggtgttgacataggagaggaacttccgtcttcattattcctctaacctccattttactgtactctatattattttatcaaataatatcaaaacatttaaactkaaatagactgccaactctctaaacaggatctcgatctaagatgtagcagaagtaaaaggattatgtttgcacatgagaaatgaaagtaagaactgtgaagaaactctggagagtccacaagtctttgagcctaatgtctggaagaaatggcagctggaggcggatgacctctcatcacctttactgtttctcac

SEQ ID NO: 20422 - DNA, 600 bp, Bovine  MMBT13653
gctggaacacggtgctgacagtcagcacatctccaggggctgcccaggaatgaattctccactggcgggaaagcccgcggtgtagccatcacatgaacatcaccagaaagcgtgcgtgtttaattagtcatcacttgaaataaacaccaggaacatcagtagcttaaaaggagctcaacaccccatgcaaccacttcaagaaagtgctaagaattaatgcaagtcattacaaggcaaaagcaaagaatgccaaccactcagacagagagaaacggtctgtctaaactgtggactccaaayataaacagaagggcccttgacgagtcagttatgtacttgcccaaagcagagacaagagtgggtacgaattaagagagcgaatttcttttgcactcaatrgatgataagagcaagatgccacaatgaggacaaagatgtggagagacagttctgtcactctgcccaaagccccaaccatagccaagtttcaaggcagccaccctgaaccgggaggtgactgcctttcctcgggcaaggcagcaagctgggcaacccccgcacactcacaggtcacccacttgctcatcccatggagcactg

SEQ ID NO: 20423 - DNA, 600 bp, Bovine  MMBT04595
ccatcctcggaaatgagagacgtgtgaggtagaactgaggtcttctcaggttcttttcatctctggggttttaccttaacttctctcaagttcatacattcatcccaagaatagaactttctcttcattctgaaattaaaaaagaaaagtttagtgcctggggacggagggtgtgaagacacaaattacactgctggctttccactctattattagtttgcttcaggcaagctgtgtatctgtcttcmctcctccttaaaagcagatcatctccattctgtgcatctcaaggccacttcstgcacgctcatgactatgtcacttcttggacaaattacctaatgaccctccrtgccgcaaattccttagctatagcgtagaaaccgctgcataagagaagyttattgtaaaaggcttaggtaaggacttagtaaatattagatgttcctatttttaccagtatctgtgaaagtgaaagtgaagcygctgagtcgtgtccgactcattgcgaccccatgaactgtagcctaccaggctcccctgtccatggggttttccaggcaagggtattggagtgggttgccattcccttctccaggg

SEQ ID NO: 20424 - DNA, 600 bp, Bovine  MMBT01584
atttatttctctaataaggaagcatgccttgaaattgctttctctcgtttttccctatcagaagtccaaatatgttgctctttaacaaacatggtaataaaagcaaagccccaaggctccacttactattatgcaaagactggttatagaatgcaattcttgaagaacatttgcttgcctagaatctattcagggctcaggtaagagtgtcaatttcatcacacttgtctcttgatcattataaagtatgaacttcttgaagagagaaattctatttaatcatccttggaactctcattyctggcacagaatatgacccacagtgggtgtgtttaatgaataaatataaatacttgatactttttagtcactgagttactgatgttcaattttcatttgacttttttttttttttttggtgcactggcagatgactatttaaagaacaagcaataaaaaatggggattgtatctgtatgaatcactctatgagttatttgtatatggatttcagtacatcttatagctaggctttgtagtgattttcaagggaccttggtaagttcaaattcctaaaatcagatcacaagtctatattgc

SEQ ID NO: 20425 - DNA, 493 bp, Bovine  MMBT17284
ttgtcaacaagattgtgaccttccagggagaagacagaagcctcaggactctgtaccctggcacctggctcaccactatttagtcatatggctgcatatttaaagttttgggtaaattaattttcaactaaatatagagttcctatatattctctacgcaacttctactaatgcaaaaacgtcttacatacctgtagactttatcaaaaccaaaaataaaaaaaaattacatacccagagaacttatcaaaactaaaaaattaacattgtacattactattaatctaacacagaattcaytctgatttctctagctttccattaatgtcatttttctgttccagaacgccacactgccctgaggttttaatttttcacttgtttttataacaaaattataaagtcttttcaaagattttatgaatgacaacatccagattataatcgtaatgttgaatatattatgccttgaatttaggagagaaaaaaatga

SEQ ID NO: 20426 - DNA, 598 bp, Bovine  MMBT02435
  misc_feature (1)..(1): n is any nucleotide
ncaagaacactggagtgggttgccatttccttctccaatgcatgaaagtgaaaagtgaaagggaagtcgctcagtcgggtcgactcttagcgacccccatggactgcagccttccaggctcctccatccatgggattttccaagcaagagtactggagtggggtgccattgccttctcctgaaacactgtaaatcaactatacttcaattttaaaaaagaaagatacaacactgtaaattaactatacaccaataaaaaattaattaagaaagagttttagggatttccctggtggtgcwgtggttaagaatccaacttgcagtgaaggggatgcaggttcaatccctgatcagggagctacaatcccacatggcagaccctgaaaatactgagcctgtgctccacaacttgagagwctatgtgttgcaatgaaagagctcacatgatgcagtagagatcctatgtcctccaactaagatctagtgcagcaaaataaaatttttaaagacaaaatttttgatttttaaattatttttaaaaattagaaaaatttctttaaaaaattagaaaaaagaaactgtgaggctacacttatat

SEQ ID NO: 20427 - DNA, 598 bp, Bovine  MMBT19805
  misc_feature (1)..(83): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnctaaaaagttatgctgtactaaaaataggagatatttaaaaatctccagtagtagctagcattcaaaatgttacattaatttgaaattaatttcagtcacataaaaaactaaagaactgttgcacagctaggttgtattatttccatcagactatattcaaggtgtaggaaagcaaacacatggctccatgcagttatttctctaaaatacctttcrcttgaaattattagcrtatatggccaattctaatagctgcttagagaactcaaaatgtcatgacatccctcttgttgtagcatatattttgtttttgtttcacagaatacaattattaaaaatakaaatattcagagctaacatcctccatgagagatggccattacatatttgtttttaatagtcatagaattttagatttgcaaagaatttccaattttacttgtagttattcctctgcttttaaataagacaacattttgatcatttggaagaacttaatcttttcttaaaattc

SEQ ID NO: 20428 - DNA, 598 bp, Bovine  MMBT19806
  misc_feature (1)..(67): n is any nucleotide
nnnnnnnnnnnnnnnnnnnnnnnnnnnnnnnnnnnnnnnnnnnnnnnnnnnnnnnnnnnnnnnnnnnctaaaaagttatgctgtactaaaaataggagatatttaaaaatctccagtagtagctagcattcaaaatgttacattaatttgaaattaatttcagtcacataaaaaactaaagaactgttgcacagctaggttgtattatttccatcagactatattcaaggtgtaggaaagcaaacacatggctccatgcagttatttctctaaaatacctttcrcttgaaattattagcrtatatggccaattctaatagctgcttagagaactcaaaatgtcatgacatccctcttgttgtagcatatattttgtttttgtttcacagaatacaattattaaaaatakaaatattcagagctaacatcctccatgagagatggccattacatatttgtttttaatagtcatagaattttagatttgcaaagaatttccaattttacttgtagttattcctctgcttttaaataagacaacattttgatcatttggaagaacttaatcttttcttaaaattctcctgagatccatact

SEQ ID NO: 20429 - DNA, 600 bp, Bovine  MMBT12729
gtttctattttatctagcaagacagcctccacttgagaaaatatgatgcccagataagaagtatttcttctttccctttattgttctgataaatactccagaagagtatctcaaaaatcagtggcagctgcctgtcaagaagacattytgtcaaattagacaatttaatgattttgcagtgtgacttgaaattcctatttttaatagaattgtcacaaaggttcatcaccaactacagacaggtacgtgatttagctgtgagtcaccaaagttagcaccagctagagaatttatctgagktaccagacttagtaagaagagagagacacttgtggttttgatagaatgcccatgtgggttctgtttatacagaactagagtgactttgttgaaactctgttgtttctattggtgttttacatatatcttagctttgctagaatctcttaaggctatcaattcatgttmttttgccaagaatcaatatcaagcaatgttttgtagttctcaggagatttgataacctataaaagcctttctatgaagaagtgtccttagaataacaagcttgtttaaatctttggcagtaattttccatca

SEQ ID NO: 20430 - DNA, 600 bp, Bovine  MMBT07007
gacatctttgattgtcatgactctttagagaaagaaaggaagagcaagagctgagatgtattctcaggctctagtgggtagaaaccaaggatcccatttgacagtccatgatggacagcgcaaccctcacaacaaaatggtccagcccaaatgtcaacagtgtcaaggttagaaatcctgaccaaatgctagctcaaaacattatttttaggattatgatgacaatattatcactttaaaaggctaggtccgataatatcagaattggcagagtttagagaaaaaagtgataattctccyttgtttgataaartaaaggttttggtcctttgggctcatcttcattccagaacatgataaactattttaaaatcgagtcttctcagaatagttctgaaaactagggacactggctatggatctaggcttcctggattgaattccagctcagccatactagcgttgaagcctggacaagttacttaacctcygagcttcaatttcttcatcttttaaatggagatcatgagaagaccaccttcaggaggttgtgggagatgaacaagctgaacgatgtaacatacttggccccaaacctag

SEQ ID NO: 20431 - DNA, 600 bp, Bovine  MMBT20723
gtcatgactctttagagaaagaaaggaagagcaagagctgagatgtattctcaggctctagtgggtagaaaccaaggatcccatttgacagtccatgatggacagcgcaaccctcacaacaaaatggtccagcccaaatgtcaacagtgtcaaggttagaaatcctgaccaaatgctagctcaaaacattatttttaggattatgatgacaatattatcactttaaaaggctaggtccgataatatcagaattggcagagtttagagaaaaaagtgataattctccyttgtttgataaartaaaggttttggtcctttgggctcatcttcattccagaacatgataaactattttaaaatcgagtcttctcagaatagttctgaaaactagggacactggctatggatctaggcttcctggattgaattccagctcagccatactagcgttgaagcctggacaagttacttaacctcygagcttcaatttcttcatcttttaaatggagatcatgagaagaccaccttcaggaggttgtgggagatgaacaagctgaacgatgtaacatacttggccccaaacctagcagcggaagtgct

SEQ ID NO: 20432 - DNA, 600 bp, Bovine  MMBT07933
ggctcaggtcgatccagggcctctgcttctcgaaggcgtgttggatggtgatgcccacgtccatgtcgtagggcgtccaggagccgtggtcgttctcccactcccacaccacgccctttccgggcgccgaggcggggtcgtagtagttgcgccggacgggccggagggtccctgccggagagggacggaggaggcggtcagcggcacccagggctggaacccacgggtgctaccttaagaggctcgcggtaagcgagtctacgtggccggcccttggctgccttggctttgaaggaggckccttcctgccgttttaaggtctgccgtgaacggggagggttcaggggtgcaggctggggtggaaggcagggtgggaagctgatgagctgcaagggaaggatgygggtgacgctgcagggtaccccaaagagcactgcctggtttggagttcggagactctactttagtttgcagccacatttgtttgcttaatataacagcccacaacctccttttctcccccaggagaaataagataatagctcctttgcraagtttttgccataattaaatgttgctctctcactcaacatgtatgta

SEQ ID NO: 20433 - DNA, 600 bp, Bovine  MMBT13489
gcgagtctacgtggccggcccttggctgccttggctttgaaggaggckccttcctgccgttttaaggtctgccgtgaacggggagggttcaggggtgcaggctggggtggaaggcagggtgggaagctgatgagctgcaagggaaggatgygggtgacgctgcagggtaccccaaagagcactgcctggtttggagttcggagactctactttagtttgcagccacatttgtttgcttaatataacagcccacaacctccttttctcccccaggagaaataagataatagctcctttgcraagtttttgccataattaaatgttgctctctcactcaacatgtatgtatttgtgccaagtccgggatttctcaagcgccctgtcctttgcactaaggcatatcacctttgacacatagtaggtgctcttaaataatctctcttcttccgtgactctctgaaggcctaagcccccgagggctaagaggaaaagaacacaggtcagggaaccctagagaacgtaggaagactctgtccccacccaggatgcccgcccaggtggtgatggagctggctgtctggacttttatgggtgtggtaa

SEQ ID NO: 20434 - DNA, 600 bp, Bovine  MMBT06698
cagcacacaggatcttcattgccacataccaccttccctctagtagcagtacacaggcwtagttgctccttggcatgtgggatcttagatccacgcccaggcatcaaacccacatcccctgcattggaaggagaattcttaaccactgacccaccagggaagtcccttattctcattttacagatgagaaaagctgaccaatttagcttcaagtcaactatagaaaaacaaacaaaacaaaagccatgactctaacatgtttcttgcacctactgactttcattggttcatttaatgctygttccaatttttttttttycccctctctgtagcgtcttctcagcatgctttagaaagtggagactggagaaatcttcattcttttctgatgcaaagattaattccagtgacacatataatccactgtgtcctaccattttccataatgggatgacaatttttaacttttgtgagacaagttatgcaaataagcacagccaaagagaatgcacaaaataggatgtgagagcaaaggagaatggaacagtgatggtccttccttttctcttacagcagcaatctgctgaaaagaggcctctt

SEQ ID NO: 20435 - DNA, 600 bp, Bovine  MMBT03223
cccctcggaagcccaagaagtgagctgctcggggccagcgcccttccctcccggctccccaacgcatcctttctgtaggagcctccaggcccaggtcaccttagtcagtcccatgtggccttgttgggggaacagagcaccccacgaagagggctgtggggcctgccctgggggaggtccccttgctgaggcaaggggtcgcacccccactgtgtggccagcaagggccatgagttcacactgacaccctccccgaagcctctgtcctcacagacccactcctccacgggcacgcactckcaggcagcatcctccctgggttcccccacacacatccacaagacgcagaaccgctgagagctgctctgcccccctgataaaagtggttcccactcgaggctgtcattcagctctgccaagttttatttaaaactgatgagatgtgcaggggtgagtgcccagaatgggcgggagggtgggagagtaagcagaacgctggatcatgagccaagccatctgtctctgttagttgacactggccaggtcactttttcctccatggtcctcagttttcccatctgtaaagtggctggaccaagc

SEQ ID NO: 20436 - DNA, 600 bp, Bovine  MMBT07740
agtgtgatgaggcagctccagcgtgcccagccatacccacacgatggaggtgaagtcacgactcagaaagctatgtccaagagaggcggggatcacagatgcaaacactggtgtgtctcgtttgcgaggcgaccgtcccctaaacatatcagatgcactcccctattcccaggcagactgataaagtagtttgatacaaatcagttgtagattagattctgcaaagcacgttttcctaggaaatccaattgcacctgctttggtttctggggcggcatccgttatccggtgatggtacargaattgcgctgcagctctttgagtgggaagggcgagatccttcatccgacsggggtgggatgagactgctcgagggggttccgcagggaaggggctccagtgggcacccttgggtcccaggctggctgggcaaccttgccaggcccctcggctggtgcctcccccaccaagacccacccaaggggcccagcctgcaggccatacatccgaaggcaggcgttcggtggagctccccgcaatttattttaattacgtgtgtcataaaaagaccacctacagatgagacaatgctgccgtaag

SEQ ID NO: 20437 - DNA, 600 bp, Bovine  MMBT00829
acctttctatgaacaaaggtcatttttattttaaatatttcagagctttatagaggcatatttgggacacattaaacagaacacatctraagtgcatactttggtacacagggaaaagctgatttcctttcctgtcactctaaattagtttgtaattcctagaattttagataaatggcatcataaattaggcacttttttgttcttatttcagtcagcataattatattaaagtctatatattgcatacatcaataattcatttctattactgctggatagtattccctgagtgaacaytgcagaaaccaactatctattcatttgttgatcgatatttgagtttgtttccagttttgactattgaaaataaacctgttagggatatttgtgtatatgtcatttatggatgtatatcttcatttctcttgtggaaatctctaggtgtagaaaaacttgcataatgtagtatgtaaatgattcagtgttaagaatgtgccatcctgttttccattggagttgtactattttgtcctctcttcagcaatgaagcagagctgctcatccttagcaacacttaggttcatttaggttagctgt

SEQ ID NO: 20438 - DNA, 600 bp, Bovine  MMBT00589
aggggagctggtttcctgagaaggtgcccaggacgggggcctcagccgtggccccatccttgatgaccaggaagtcaaactgaggctccacgtcgatgtcattgaaggccaagtggatgcggctctcgggccgggcgaggatgagccagacacagtggaggtggttgccgtagtcctctgggtagttgggcgacaggacgatcccagaagggctggtgaagttgaagaagcaggaaactgcaagagaagagccatggaggtcagtgagcgtccctggcgctgtgcccaggccactgaggrcaggcaggggggcatgtccttagtctaaaagcaatagagagaaaaggtgactggggtttggctggactggctgggctctgagctctaggcagcagacgtgctgggttyatgctgcgtgyggtgctgggaagggtccctctggcacactgcgggcaaggcggagctgctctcctggccttcctgcccttgcggtgagccgatcccaggagtgtctgctgctctcaggccctcctgttggggaaaaaccrccatttaagctgaagtggagtcccagtgcctggttcctcttagctggtggtg

SEQ ID NO: 20439 - DNA, 526 bp, Bovine  MMBT11240
cagcgctcttgaagatggagaggcagccgagacccaccttccctgattgtctgatcaagatcccacttgagtggagataccagcttactagttattgtgtctaatgagtaaattgttgagcctctagctttaaatgagttgtatgcagttattctctaccaatgaagggatggggtaaaagattttccaatttaacctcatgttttacacatttttagataaagcagtgaaaaacaacgtttaaaatctgattaatgagttctattttttttttttttctgttcttggcagggaggttastaaaatagtgcaccggggttctttgtgtggtttctttgccctttaacagttatttaacaaaaatactccaatctgcatttgatatctttatgctattgacattcaaactcctaggagctgtctagcccactgagactggcttttatcttttcctggtatttggagactaaaatggacaatgacagcagccccagccttactgaagctcatcaaactgtctcattca

SEQ ID NO: 20440 - DNA, 600 bp, Bovine  MMBT14215
ttgaaatgctccctctttaacttaatagtggttaaaattactattactttgtcttttagggggtatggtaagttaacaactgtctttaawacttagtgatgttatcaagagctgttatgtaatcttttgttgttcctgattgttctctgtaatggcatacatttaagttgtacttttgcaaaatcaccataaaacttctttactgcttttattacatttctgtgtaattttagagtaccaatacagtgagcatcaaatatatttttatatatacctaattgatacagctggaacactgakcattcagttgcataatttgggaaaaagcacataaaaattgagcctaacccatgtttctgcctcctcctcgaggccttttttcactgctccagtctgtcctgattttccacactgagaaatgctctagcatgtagtttgagtactgaattatttcacatttgattgtttacagtgttctcttcttgccaattttcactttatcttttctccatcagttcagtctctgaaattgtgtactttccatgacagagtatcaagactaagcacagagaagtcatgttgcacagaccccaagatcct

SEQ ID NO: 20441 - DNA, 598 bp, Bovine  MMBT10650
  misc_feature (1)..(18): n is any nucleotide
nnnnnnnnnnnnnnnnnnctctgtttaatcatgatcgcataagattggtatagtttcacagggtatgcaaaacagacatgccttaaatggttaaaattttgcttgtttgggctatttttaaaataattgaatgtgttaaatttgaatttggtgtctgtggacttctgagctagtgagtctaagcctgctgtaaagacataaacgactgggaaccaataggcagaggccgtctttggctcatttatatagcagcactgctttcatgttagctccttcctatgtctccgtccagcttatagmatggctatcctttgatctggtaccccagtcctgctccagtcagctgggatcaaagtaggagggtcaatctcctggatgcagtatctaggctcaagctgccactcagagggcagttacaagcttgaaagaccccagatagactttccctcaaaacctttgcctatcccatttatccatgaacaaagtcaaatgccatcccttacaggtaggcttctcccataacacctgcccatccattgcccccaccctcacgtctccactgtatcctatgcaggtcactgtcagatgtcttaccttg

SEQ ID NO: 20442 - DNA, 591 bp, Bovine  MMBT06617
gaagggctgggttaggggtaagttttaaagatgaccatgtggaatgcacagggcttccctggtggctcacacagtcaagaatccacctccagtgcaggaagcccaagttcgatccctaggtcaggaagatcccctgaagtaggaaatggctcctactccagtattcttgcctagagaattccatggacagaagagcctggtgggtttcagtccatggggctgcaaagagtcagacagaactgagtgactaacacacacacacgtggggtgcagcctgcaggggactactaagtctgaaaytgtgaaggcctgagattttactctccttcccaattagtaagttagtctactgcagaaatagactgtatatatccatgtatacatacagaatactggatcttaagaatccatttattacttatagcagtaacagtaaccagagtagaatggtatctctgctcccccattcccaaattcctctgagatctccatgatttctttatcttcccatgtagccatacttgacattacagaaaaaaataccttcagttttcttttattttttttatttttaattaattaatttatttt

SEQ ID NO: 20443 - DNA, 600 bp, Bovine  MMBT04819
ggtgtggctttccatacacatccacaaagccggtgcagccagaaggagtagacatgggcttttgttgtatttaagccaatggttttttctcctctgaaaagcaaaaggagaaattctctgagtccttagactgaaggaagacagaaatcataatcattctttgagatctcctgaatagagaacctaaaggtctaaaatagtttatggtgggggaaaaaaaacatatttagctccactgttgacctagtattgaaacattgttcatctactctttatgtcaggctagaattaaaagacagmatctgcagacaacatccaagaacatcctaggttccccccgcaccccaccctggcaccattgtgctctctatgtcgttaaaaattttctcattgcataaaaagatctaagatcctccagaggatatgttttgctttttttttctcttttatttccctacctttaaagggagaaattcttaaccaatgttgacagttgaggctccttggaaatcttttgggttcatcctcttctgaaatgattagaagatctagattctcaagttccataaaactcagggtgtcctatatgctttgtttcct

SEQ ID NO: 20444 - DNA, 598 bp, Bovine  MMBT13700
  misc_feature (1)..(155): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaagatcccacccttgccatcctgtatccggctgatctccagcacagacgttttatttcctcacttataaaatcaggatgtgagtccttattttctgggtcactgtgaagagcaaatagagatgatgtaaagcctcttcctcytccttgtaacacaaggacactgggttcctgtacccaagtcaaaattaagaatcacggtggctcagatggtaaagatggagaagggaatggcaacccactccagtatccttgcctggagaagtccatggacagaggagcctggcgggccccaatccatggggtcacaaagagtcggacagactgacaccatgtctggtgagcccagagggagcgagtggggcagggagagagcaccaaacgaagggctgggaggggggcctaagcctcatcccttttggtggcaggctctcggcccctc

SEQ ID NO: 20445 - DNA, 598 bp, Bovine  MMBT05844
  misc_feature (1)..(96): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtaatgggaagccccattgggttgtctctaagggtaactatgactggaaaagtgtctgcctttgtttaccttggaattcccaagtggcaataaaacagtgcactttgttcctcaggaggacccaattgttgggatgtcgtccaaatgcttccctcctggtggcgcctgtagcccgtcatgacaggacaggaatattgatcraggataacctaatgaaatattaacgccartggatgtgttggggaaagagcagatctggtcttgcgagagttacattgggtaagaattagccccattagatggctcgttgagtattcaggggagacaattcttgctttataatatatgcttgggtttgccttatggaaaatttattgttcattcatttgatgcactcctttaagaggtcaactttgactttcagtgctctcagaatttattctttactccattgttccttgaaaactatctttcattggatttctttgtgcattgagtt

SEQ ID NO: 20446 - DNA, 598 bp, Bovine  MMBT04159
  misc_feature (1)..(28): n is any nucleotide
nnnnnnnnnnnnnnnnnnnnnnnnnnnntatagcacttttttttttaaggaaacagagttttagcatgtaatattttcttctcatttacactgacatgattaaaaaataaattatctgttagtgtacagattacaaataaacacccttctaggctgttagtaggcaagcagctcagtggtctctaagacgatttctcaaagttctgacaatcctgtcaccttctccccaaactaagcatggttttcatcatgacacatctctatgcagatagacaccttgattgactttgcttttcctaytgggggcaatttggaacaattaacaacatttttattcattacccatgaatttcattgtgctaggtgttgaggtcatatggatgaataaatagataagtctctgcccttgtatatcaggtgtgaggggtatggacaggcacgaagcctgcaggggaaagtcttctgtatctataaaactgagccaacctggaggtggaagggattgtcatactatgcttaacatgttctagaacatgacgtgtgtgtgtgtgtgtagtgcacactcagtcactcagaaatgtctctttgcgaccccatg

SEQ ID NO: 20447 - DNA, 600 bp, Bovine  MMBT01102
aaagcaaaaattaaatgtaacatagctatacaatgctagtaaatgctaatcctgattgacaaacctagcatgcaacaatcaggaatgtgtgacagtttatattctgcaaagacaccgtgtacactgaaaaagtattgagaacaggaggaaatagcaagagattctgaaattataagcagtctttgatttagacatgattacttaaaaaaatacatacacacacacgtatgtatctatagatacataaacacagtaccatatatatgtataaacactcatacacaacacacatactccttygatcttcctctccccatcaataaagaggatactcttactgtcatgaaagtcataaagacaaatgtggaactttttagagaatctataagcttaaaagaagggaaaacaagaaataggatgaacttgggaaacaaaaagatttgaagatggactttcaagcacaattagatgatatgagaaaatctcagccctagaatatctcccttttcctgtaaggctttcatttcactgattcagaatccctaaacttctccaattaaaaattaaataaaaaataaattgaggaagagtattctaaac

SEQ ID NO: 20448 - DNA, 600 bp, Bovine  MMBT02298
tgaactgaacctggggacaatccccgaatggccttatgagggagatggaagtttgactycaagatggyttcttctcactgatacacttggaaaacagagayggtgcccctgatagaaacaggcagtctcgcaggggagcctgctccaggcagggaaagaatagatgctcggtttatacacggacttgtgggatgtgtctgtgctccaaacatatatttgctgagaagataaagggtggagccatgagcctggagagagacctggtggcctagggtaataaaagggagagaaaagactcayttaaaatcagtggcaccatttgcagacaaaaatgattaaactgctttaaaatctcccttactcrttgcaggaatgtatttgacaaatcctttcatcatatatacagcaaagggaaatgtcatcccaacccayatggaattacaatgaattccaaatacatayggccaccaaagagtgcaaatcaatcatgttttactatatttcagaaaagtttttctttttaatggtccttgtgactctaaaagtaaatatcatgctcattccatattaygaaaaagaaaaatatctatggaataccct

SEQ ID NO: 20449 - DNA, 600 bp, Bovine  MMBT19049
cagtatatgtcaaaagaaataacagtgaattcttcctttaccctaaagataaaccactgtgagtactgccaaaaactaaagacaaagaagatttaagtgaacctratcttggataaatactaggtttcatatattgtcatgcaagcaagcaygtgtcaaaaggcagccagcactgtcttttaaagatggataaaaactsaacatacttatcacaagttcccagtgcaaaaggaatatcatctttaaccagaatgttaggggttttaattaaagtagattttgttttaagagatggaaagrtgygtgcatattatagaaccatagatgaatatatgtatatagcattgtacagtgggtttacatggttctgaaggttcagcctttcaaggtagaataatttggtgaagaccactatttccctcacttaaatctttgttaaagcaacartggactcccactattctttttcagcataatgagatcaagataacaacagtgacatagaggtgtccatggctctgtttcaagtagtttgtccatctatcagatattaggagatatagaagtattatatgaaccttatagcaaaaggatgcttaa

SEQ ID NO: 20450 - DNA, 600 bp, Bovine  MMBT19054
tatatgtcaaaagaaataacagtgaattcttcctttaccctaaagataaaccactgtgagtactgccaaaaactaaagacaaagaagatttaagtgaacctratcttggataaatactaggtttcatatattgtcatgcaagcaagcaygtgtcaaaaggcagccagcactgtcttttaaagatggataaaaactsaacatacttatcacaagttcccagtgcaaaaggaatatcatctttaaccagaatgttaggggttttaattaaagtagattttgttttaagagatggaaagrtgygtgcatattatagaaccatagatgaatatatgtatatagcattgtacagtgggtttacatggttctgaaggttcagcctttcaaggtagaataatttggtgaagaccactatttccctcacttaaatctttgttaaagcaacartggactcccactattctttttcagcataatgagatcaagataacaacagtgacatagaggtgtccatggctctgtttcaagtagtttgtccatctatcagatattaggagatatagaagtattatatgaaccttatagcaaaaggatgcttaactt

SEQ ID NO: 20451 - DNA, 600 bp, Bovine  MMBT17342
acatgggaaacacttgtctgtcctgatatatgacactgtcataatatggtaatgccatctgccccatactctttccctgaaattttatgttttatttagttcctgtacctgaatgcttaacaagtactctcctctagctgtatttagagattacagatagacatgcaatccacaccaggattccattgcaatctgcactgtctcgtgccctccacatgcagctgccggagagaagagctgcccgtgcttagatttatgctccctcctctgcaagagactacatgggcaccgctgcacccrccttagactaactgtacaattagcactgtgatagaaagtccctgagtgaacacacgctccctcgtgacatgattaactccagggactctagacaacaggagccagtcacaaagtgcaaactaattaactttggaggacaggaatgaggacaagggaggtcaagcagttggcatgctggccacagagcccagagcagcagaaatgaaagttcagctgaagcagtaggaatagaaactgcttcaaatttaattttgtgatttttctctctggttcttttgtcattttttctggactttatat

SEQ ID NO: 20452 - DNA, 516 bp, Bovine  MMBT13544
gtaataccaatctytagtaaccatcttgaagagggagattggcgtcatcttgggttaggtggggtaagacaagacaacttaggatacgttttcgggaggagggagatttatagaaggatttctggctctcactgctgtggaatctaaatggattagtcatgttacgatcttgaatgtggaactacactcaagagtcttcagggacccagggtgacaagacaactcgatttcagtgaaaaagcagcatgttctttgaccctgagtacaccgatgttgaactacaatccctgaacacaggtyaagaaagatgtgaaagaaaaggaaaatgaaggcatgaggaaagaggagagaaagggaggaaacaagaggaaggttatggagagaaaagaaagaaaaaagtggggcagatctaggacggacacgaggtctgctcacagcggtcaagcctagcactgcccaaggcgcctgagctgacagagcagagacacgaggctgaaagactatagtcagtttcat

SEQ ID NO: 20453 - DNA, 598 bp, Bovine  MMBT20073
  misc_feature (1)..(149): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggaattccatgggtttgtttccatctgattagaaagcaaatcacccccacaatcattagcacagaaaactgaataaattcaaattgtctttaatgtcaaatggaattcagtcataaatctctcagttcccctcattcccatcagtactkctctcttccaaggccatcattacatttaaaatgtctctgaatctcttctgctcctgctaacagacacacaagtagacacatattatatggcaaacaaggctggagccagaatttgatccacatccatctggcccaaacatcaatcataccattataccatactgtgacatttcagcatagccaaataaaaaaggcaaaattactgtagcccttaaaaataatccttgatgaagaaaaaatatttggaaatcattggtctatactagtgagctagtcattcaatatttcttagtaaatc

SEQ ID NO: 20454 - DNA, 600 bp, Bovine  MMBT20760
acccttcctccgtctttagcaccacaaagaaagctggtcaagtctttctcaagttgcacctctctgaccttctctcctgcctccccccttctactcttaaggatacttttgactacactggacccacccagaatccaggatactttcctccccctttttgggtcacctgattatcarcctaaattccatctgcaatgtaaatttccctttatcatggaacctaacatacacycttcagagattagggcgtagacatcttcgggggcattattctgcctatcacagggcaaagagaagatycctgcccacagaatccagcagtggtttacttggcagagtaggtgactcgggcttggaccagacatgccagagcttcagtgacctgtcctgggagtrcagttctgcaggaccttggagagttcatggatgagtgctatgctactgacartctagtcctttaaaacctggagcaaaccccctagtgccaagtggctcagggaaacagaggctaccctcataggcatttagcaagtttcccacgtcttattaatctctcatccatgacttagcctaatatcaggacaaggcagcatctccaat

SEQ ID NO: 20455 - DNA, 600 bp, Bovine  MMBT02818
atggctccatatattatgaatattagctgtaggttcttaaaatgtacattgcttttggaaatttaactgtaggaaagttagtgttctttgaacttatggtaaaaatattcacaaagtttttgatgtaaagtttcatacaggatgagataaagtttgtttcattaaaaaaaatgatttcaatattgctttctgtttaattaaattgcatttatagcacaatattccaaagaaagtagatctgatgatcagaaatcaagaatatttgtattcaacaaattaacacttcactatttagttcaygaatattcaataaaagattaatttattttaaaatgtctctattcctttactcactcatgtgaaaatacattgaatcatacgtctaagttcttgacaacaataaactagatttttatatggtactttccagaaacaaacacaaataaaactaaaactatttgaaaacaatagatactctagagaattaaaataatttatartatttaagcaaaataacaatatcagttgtgaaaagtaaatgactacttccagaatataaattttctttttaaaaatgtttgttcagaaaaacagttgaca

SEQ ID NO: 20456 - DNA, 600 bp, Bovine  MMBT16195
cagaactcattcgtgtgtagaggacttcctgtattacatatggggcacttaccttaggctgaaccctgtgatcaaggtcttatattacctacttcagttcttacagcaagcttgtgagaaaggtgctgttttttccctatggatgaaaaagcagaggcttggggaaactggttaacttgctctacatcacatggttagcaaaggcagcaccagaagtcagagcccgtgttcttcaccacttgatcgtctgtgttttcatctatgtttccatcaagggaatttctggtcttagtttctttyctcaagtaggtatcatctagaatgctagagtttatattatcagctggtaatttggcttatggaaagggcactggattaggagtcaggagacctaaattctgatctaactctgccactgactacagcagctgagacaaagtgttttcttctgctgggctaccaagtgggaactgataatgcctgctctgcctatctcagggactatggggagggtcactttcaaatttatccaataatgagggctcactggaggctcaagctcatgtgagctgcatttgcatgtatttttcattattgtta

SEQ ID NO: 20457 - DNA, 600 bp, Bovine  MMBT03212
aggwgaaggggatgacagaggatgaaatggttggatggcatcaccgactcgatggacatgtgtttgagtaaactcygggagttggtgatggacagggaagcctggcgagctccagtccatggggttgcaaagagttggacacgactgagcgactgaactgaactgaactgtattctctgaatttttaactattttaaaatcttcatctttgtcttcccttcaagcccatgtgttcagggaccarctttgcagcactgagtgaagtcacctatagtccccaagaaaacctggtaaatcctwatgttcagagatgaaagaagaaaatgagccctgaattcctttgtcattaaaatttcttccttgtcgactgagtttctgtggatttgaatgaattatctaagaatcagtgttagcgtttaattggaagacagaggaaaccacaaagagtctgacaagaaagggcagacaaaataagaatgtctctaggcattgaaaagtttgacaggcgagaagagtttgtgatttgcaaagcagctggagaacatgagtcagcaggagataactaaaaaaagttaaataattaagcttacataatagcta

SEQ ID NO: 20458 - DNA, 600 bp, Bovine  MMBT06062
ttccctctatcacagtgctgacacacagygttctttcaaatcctcaactagcaggacctcggcagatggagcctcctaccacaattcccatctgttgattttttgctccatggcccagctcctgaattttgctgacatgttttaatctttaaaatatatgtgactgacattctactcattaacattgtatgaacacagaaacaatatgtttttcttagccaaatctttgaataatattgaagtttgatgggaaatgggccatggccttgggtgagcagaacacattgataaagtcaatcyatttgcttgtgtgtttccaattagtcaaccacagcttgcctcttggcaaatatgggtaacagatgaaaaggtactttctgggtcagcattaatgcatcactgaaagcaagtyagtgacaatttgtaagatgaagcataaatctaagagaaagccaccagtatcatcaggctgaaatctttggtgcatgcatgctcagtygctcagtcatgtctaactctttrcgaccccatggactgtagcctgccagyctcctctgtccatgggattctccaggcaagaacactggaayggttgccatg

SEQ ID NO: 20459 - DNA, 600 bp, Bovine  MMBT18706
gctctcatcaaaggaactggtatcttgttgataagatttgcctctgcccagtttcccaaggattctccttttgctgaaaaccccttctagttgccatcagcccatttatcatcctcaccttttggagactactgacaataccagtaggacttctctctcaggatttcttcaacagaatgagctgtaggtctaggaaggatttcagaagatcaagttcagtctgtttttaaaactgtaggtgggacaactatggccaaataggctatgaagaaacattcagaatctttttctgtttaaagraacatggcggggaggggggtgcattcttaaaagataatacatttatttattcacacttggattgcatttgtgataaaataaatgtctaaaatctttaaaatgaaacacagtaagtacttagaagatgaagggctacacagcaaacagtcttgaagcatgactttcctcggggacttctctgcctggttttgttttcttagtcaaacaacaaaaaacgcctggagactgctctttctttaaaaaaataaataaataaagcaaggagttgctggagaaagttccagctgtggtaaggcctgc

SEQ ID NO: 20460 - DNA, 598 bp, Bovine  MMBT16382
  misc_feature (1)..(209): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaccccggggggtaccttagacgctcttggtgggggagataaggcacgataccaggaaggaggcgatagtcctgtgaaagacctacaraatgctaagaaaggtacccgggaaagaccgggaccgattgatcacacccttccgcctagtagaaatttggaagacttcctgggcgaggcggtacacagccgatcttgaaggcttgtggggatttgggagagaggagggtttgcagaagagaacagtgtgtggaggggcagcaaagctagaggaggacaaaggtaaaaaggtacagtctaggaatagtagataatgcagttggttgcgtaaggccacggtgaggagtggtgtgggggcggggggcggtcgccacagtcgtttggggtcc

SEQ ID NO: 20461 - DNA, 600 bp, Bovine  MMBT02863
ggcatctgagtgcatgggrcaaacgtagcatcaagtcaagcttctcaagtcaagcttttagatacctatgcctttgttgatgaaaaattttatttgtgtaaatgtctttttgaagaaatgcattgcagatttccttatatgaaaccttcctccatttataatttattatgaaagtaacaacacactcacttcaaggtaaacaaagctaaaagcctagatattcttctatagttttctccaggttcatacaaaggagaactgtcatttgaaggaaaagtattgcctcattcagttcccatmgaacagagagagatgaattgctgtttgcatacctgttattcacatgtaggtcactgcccctcaagcgctgcatagactttgatctcttctgaagttaaagcatttccctgcagttttgtttatcctcagcctagtctggggtacctcaaatttgaacgaagtcactcatgaatgactgaggttttgatgttgacaattctctctactgcaactcaggcgtatgtaactccactaatctgaacatttttgccatcaaaatggctaaggatctaagtatcagagtccctgaggaagaagctc

SEQ ID NO: 20462 - DNA, 600 bp, Bovine  MMBT05238
ttgtgtgctactggacatgtaattaacctggtttgcacatgtatagagtgttgctagtattaataacagctatctcacaagcttgtcatgaggattgaacaaaataccctctaggaaaacattctacccagaatagatgcctgataaatgttcattcctcacatccttgctctctttttccctcccccacttctttctttctcctctcccttcccttttcaccatcccctcccctttcctcccttctttctgtggtagagctgatatttacaggaaaggaccatggagatctagacagaraggagattgactctgggcactatgagggaaggagagaaaagtcagagaacaggcaaagcgcaggtagcaagtgagagggatgggcytggacagctgataagagaaaaggttttgcagttaggaagtgcattggcactgacagtatctgaggcttgaagaggtcaaagaggtatagatcacatgcctcctatagtcagcccctatggctgaactctggagaaggaaatggcaacccagtccagtgttcttgcctggagaatccccatggacaaaggagcttggtgggctagagtcaacagg

SEQ ID NO: 20463 - DNA, 600 bp, Bovine  MMBT09589
gtcacttatttgtaaatgcttttttaagaaacagaaacaagaacccaacaaataaataaccaaatttggatgatttgaatatgtttggaatgttgagaatctatttacattttaataaggtatttctttggtgcaggtattagataaatctccatagagatgaggctaggacacagaattaagaagaaagaagcacccttgacaatttggagaaaaggaaagataagcagagtagtgtttaatagaaacagatgtggatgtaatccctttaggaagaaaaaaaaagccgtacaaatacarcataagagatgggaaaatggctttaaacacaaagaatgaaaaaacctgggagagttttgagaaacccaagctcagaatggcttcatgactcagactgtcttccatttcacatcccaacatggtgtgttatgtggataacttaaagaaagacacagtgttacgcacaytatattatttataagaaagattaacacgggtttctgaaagtggcaacagagggttgaaaagagggtttgtcagcctaaaatgaacacatcattatatatatakagagagagagtcacagacacatattctggt

SEQ ID NO: 20464 - DNA, 600 bp, Bovine  MMBT06575
caaagtgaaacagtactaaatatgggagagggtgtttgcttaaagaaactatttgctaaggcaacccattagaactgaaagttttcattatgagacatgcattagggacttctttttttctaaaaacattacgtagcttaaaatatgctctcaaaaaaaatatctaacagtcagaagggacattctgtaaacacaaatttattttgtttttattctgaaaataatatatgtattatgtctaccttttcattggcaacatctgtcagctccacaatactcttcaagttgatatcaaagtcmcgtagaagtttccactgatcttgttcaattcccacacctgcctttttaattgcttcattttcaagcaacatttttagtccctgagggaaacctataattttttatattaatgtttatataatatttatataatatataatatttatttccataggttctatcaaacatgacagatttattatgttctacttcatacacattttatgtttaaatttgtgtttaaattcagaaaccaacrcttaccttgaatgtttttgagagctttttttttcacctaaagcaaaaagtcctgactgataa

SEQ ID NO: 20465 - DNA, 600 bp, Bovine  MMBT10461
tgcatacccatgttcattgcaacataattcttaatagccaagacataaaaccaatgtaaggatcaatatgtgaatggagaaagaaatgtggtatagatacacaagggaaagcttttcagccataaaaaggaaggaaattctgccatctgtttcagcatgcatagactgtgaataaaatgcaagtaaaataagttagagagagaaagacaaatgctgtatgatttcacctatacatggaatgtaaaaaaactgagctcatataaatagtgtataatggcaggggctgggggctagctattsagttatgcaacatgattaaattctacaaacatattgtatgagtttatgcctataattaacaatactgaaattgtgcacttaaataactmttgaagtagatcttaagtgttcatatatatacaataggtagggtctgagatatgcatatgccttctcattttgtcttacctgtagaaatgaaaaacaaatgtttattttaaaataatgcattaaaacattatcgttaaataatataatacagtttggataaaatttaagactattcttattcaacatgttctaaacatacacacaatacaa

SEQ ID NO: 20466 - DNA, 598 bp, Bovine  MMBT06241
  misc_feature (1)..(93): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattatcacattactactgggaatctatgattcatctttatttttttatgtgtcattatatttatcaagtgttaaaataattcttgctggaggtatatcatcactattcctgcatttaaaaagccaaaatgatttggacaaataaaatacaaaaagaaacctactttttgagatactactactgttctgaaactattgctaaggagmatttaaacatgggtgtctttttatgctccaataatcatgagtatttcataatggcttttaaataatctcatcaaaacatgaaatagcattatgaaaacaagtcatctttcatatcctccagatgtaagtactttctgctcatacactgtgattcctggaatttgttatttagaaagattggtagattgcagctgtcaaaaaaacatcagatattatttgaacttgtacatcatcatggactgtatcagagattataagaaatgagtaatgatgataactgtaaagtgatgggcttgtc

SEQ ID NO: 20467 - DNA, 600 bp, Bovine  MMBT04542
ttaccacccggtaaagaacccaggactcactaaatgttgcactgaatattctcataactaagttcaagttgccttgaaatcaggctggtgtcttttttgctttgactttcattcctcccaatctcctacctcctcctcaccaataaaaggggtgagtttaagtcattttggtacaagaacttttctgaattttgatttgatacataagaaagtgacaaatttgtcatacccttaagtgcaataagggtactctttcaagttagatgctgggttcacaccctgggtgggttaataagatamaatttaatgtgataataagataatactaatcatttactaggattatattaataagataatagattggcatcatttaaatagtaagtctaaatggcagagagtaactactaacatctggtccagaaaaagtggtttctgtctagtttaaaaccttaaagggtaaaacataactttatcaaaaagaactaagtttaccaggcacttctggttgtctcgaagccattgaaagactgggatccaggcgcttttcctacacagactttgagctgagttccccgccacctagtaaaaataacaaag

SEQ ID NO: 20468 - DNA, 499 bp, Bovine  MMBT19472
ccatggttagcaaaaggagagayagcagcagaatggcttttgttgactatgaaatctcacatctctcctgtaaaagtcccctttttttggagaatcctttttaactggctgcccctgccgccaggattgctgcctgaatcctgggcctcactgttgccaggaaactttctactccctaaaaggtttggtgtgtagtctgtcataagaatgggccttaaagactgtcatgataaacaatttagctacacgtgtctctaaaggtgtggatttttgtccatcttaggaagtctctgctagagkacttcttagctctgtttcttccctggtaggttcagagtccagtgtagaaagaagttcatctgcatcctcatgcaaataacacgtggctgcaaaattggtttaaagtctccttggctacagttaaaaagaaaaaaagaaaaactggataactgcattgcaaaagaatcaaatggacttgtttctcacactatatacagag

SEQ ID NO: 20469 - DNA, 600 bp, Bovine  MMBT08864
aatttattttaattggaggataataacttcacaatattgtggtggttttgtcatacatcaacatgaattttaagagaaaaactaaaatgtacttttctagtgatgcagaaacttttcagaattaaaaaaaatcaaaacatgttaattataagttcccagcacatcaatgtttctgcagataatgattataaacttaagacaagattaaaaccaaactaccttaagtctctggagagtaaacagtggcaggcagactctggagaggcactggtactggaaagaggagattttcacagattrcatttgcaaagaatttatatggaaataaacaaagtaataaagagtgaaaggatgcctctttttagatagtgtggtcaggaaagaccattctgaggattcatattggagctaagaaggaatatataagacagccaactaataaaatttctggcaagaaatactggagtcaaaagaaagaatgattgctgaggtactggggcaatgcttggcatgttccagaagcaaaatggagacccacggagctgaatgctagagattaagcggcaaactggtgagaaatgaagttggagaggaagacag

SEQ ID NO: 20470 - DNA, 598 bp, Bovine  MMBT13205
  misc_feature (1)..(31): n is any nucleotide
nnnnnnnnnnnnnnnnnnnnnnnnnnnnnnngacagaaggaagctaggaggtggggctttgtcatccctctgtgggagctttctcagagatgcaggcctggctgcccaggagccccaggaatagtcctgcagcccccaaggagagattcacaggagcgagttgtggggtctacagagctgcaccccctgaactcggggcacccagcgtttcaccctcattttggatcttaacatcaactctggatcaataaggaaaagcctattcactgttctgttacctatgtcaaaagatatgtcccytatgaaataaartcataggaatagagagacagacattctttaaaaaccgcagaatgagaatttttttwaaaaaaattaaatgaaaaaggaattaatgagaaaaggaaactctgtgatagaaactaaaaatgtaatcacagaattaaaactcactattaatcccttggtgagattaaagaacagagctggtgccgtgaaatattaaatcagtgctgtagaggtcaaggttgaaaactctcatcaaaaattcagaggtaaagataaagaaattaaaatgactagaggaaagtttataggt

SEQ ID NO: 20471 - DNA, 600 bp, Bovine  MMBT08256
aagaatcagtgacaagggaatatgtgaagcccagagttgtcctcatccaggatcatgatgttgtttgtgccttttaamtagataaaatcaaatacgccacagctggtgaggtggagcatctcttagattggaggggtccactgttgaggggttttgaatggaaactaaaaacaaactggtagctaatggcacttgtaagraaayaagtgcacggtacaaagcaattccctggctagaaatctagccttgatacgcacaaggcatcattgctattttggaggccactggtaggtagaactstgctttacatctcattgttcaagatcaacttttaactaaaccttgccacttaaaacagtatcaaagtttcagtacaccaactgagaaaacagaagcacgtcacttgtttatccttgtgtttcatagcagaagcaccaaagcaaaaaaggaaatgtgcttgcttttgacaattgaatttttctcatgttcatctgctaacactttcttacattgtaagtttgcatttattttgcaaggactatattgatcctacacacagagatgacaccactcccctccaggctggcctgtcaatcagca

SEQ ID NO: 20472 - DNA, 600 bp, Bovine  MMBT13674
gagcacactatttgagaatcaggccatctgcgtacgatcaaggatgttcccattcacataccagattgctatttgcacagggtgtatccatcatgtctcaaggatgaggaaaaaaataagacgcgaagcataaagacaaagcactaggagagtacaaaatcagattacagtcttgcttccaccagggagtagctcaatcttctttattctgaaattagcctgtgcgtcctgaagagggcgcacgcacattccccgggagtgctgcctcttcacacracagctgttaccaagttgtctaargtctgggataagttcttccatcagggcttctcctccctctgtgagggggtacaactttctctttctctgcctccttatactttcgtgtccttggttaatcgctctgactccccgtttggagacctgatccaagtgttctcacctcaccagctcagtatttctcatcaattaactacctagccctttcccataggaatacactgttaaaaaaaaaaaaaaaaaaaaaaaatatatatatatatatatatatatatatatatatatatatatttatttatttatttgtggcggctcagcaag

SEQ ID NO: 20473 - DNA, 600 bp, Bovine  MMBT08074
aggaataactgaaaaagaaagtcttcactggtaatataaagtctaatgatattataagcagtaatcttaagcatcaaacgtgtaaaaaaaaatgaggcataattactgacatttcaacaatcttctaatagatatttagcaagttactgatttcaaatatgaatttaggccaaataaacaatgaatgttagtagctggaaactaatcatctatgacatatttgctgattttgtttttaaggatatgtttagaatcttacagctgtatgccactgataattgttccaaataagcccaccaktcctaaaaactcctttctgctcagcttcttcacgatgtattcttcacacacattagaaacagcatagagggaagctccaagaaggaccaagatgtcaccaatcagtacattattacctatagagagataagccataaaaagggatacattgtcactagggaaaactctccagcttgcttccagaagtttatctggctcataatcatctaaataagattttacagaagaagaaaccctgatttttaaaagtttaaagactcttactcttctcattttctggcacaattmtgctttcatttt

SEQ ID NO: 20474 - DNA, 600 bp, Bovine  MMBT14593
ctctaaattgtcgctggtaccagattttagtgaattttcgggtggtgtggtgctgtagtttgtgggggactgttgttttaatcgggagtgattgccgagtatgtgcttggccagttgtgtttcgtgacaagaaatttaggcttttgaaaaaagttcgtggaaagggaaaatataggttcatgaaatgggacagcattaagaacagactgacgtttgcaaaatagttgtcttaagcaaaagttgggacacaaggattgttggtccaagagggaataaaagtggagagtgtttaaaactttratagtgctcgttttatatctggttactataataaattggcctacattttgtatgtttgctttttcattcctgttttggcgctgattcatttttattttgttgtataaaattgtcagtcttgatagatggaaaatagaagaaaagtgatttgatttctcagatttgacaaagtgatggttttctggattcacttttgaagtttaggttgttactctgtcacaaagttaagttgttactttgtcacaaagttttgtttgtcacaaagttaagttgttactttgttacaaagttaactcaaat

SEQ ID NO: 20475 - DNA, 598 bp, Bovine  MMBT18319
  misc_feature (1)..(22): n is any nucleotide
nnnnnnnnnnnnnnnnnnnnnntagaagctcccacaactttgctccaaatgccccccttccatggagacctgcctgctcacatgttcctgaagccctcagagctgtgtcttcatacttggtcctgagtggggatcatgggaagtagttctggggactgactcatgacatatccctggaatgtgagaaataagtcagatcaacacaggtcaggttatctctcacctgtaaccctggacttggctcacactaatgttctctgcagagaagttattctgtcttctgttcatyggactcctcaycctttgagtataaatgatgccctatcttggttttaagaaaaattattctccttccttattgtctcaatagcctatttttcaaacccaaagagtagtgttccctcctctctctgtgatggaaagagtagtctttctatcattttgcatycttcccaaccctgttgctcatgataaatacactatttccagaagcctggagtcatccttgatttctctttcttttatatcacatattcagttctgtctttaaagtgattatgtccagtagcgtgatggtaaatctttaacaactgactgt

SEQ ID NO: 20476 - DNA, 600 bp, Bovine  MMBT09809
caatactttctatgtcagtcttaagggaaatcaatcctgaatactcattggaaagactgatgctgaagctgaagttccagtattttggtcatctgatgcgaacagccaactcattggaaaagtctctgatgctggaaagattgagggcagaaggagaagagggcatcagaggatgagatggctggatggcaatgccgaggcaatggacacaaacttggtgagggacagggaggcctggcatgctgcagcccatggggtcgcaaagagtcagacatgactgggtgactgaacaaccacaaygacaacattatactgaaaggcagcagagtgagttagcctttgtttagaacacaggacacaatggagatgtgagccattactcgtcactgtaattcaagaatatggattgatggtcaagcaagagagagagggtcctatatagtcagaatcagagactgagatagacccagcaagagactagaaaagacccagacaagggtgagaagtgagacagatgtactttaacagaagtcttcccatgacccacgaacatcaaagggaaaaagctgacacaggtgaaagttgttgagggactgctac

SEQ ID NO: 20477 - DNA, 598 bp, Bovine  MMBT14128
  misc_feature (1)..(150): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcctgaaaagagtttgcctgcaatgttttgcagattgggcaatctcttttttttttttaaattattcttaaattattttatcagcttataaagtaatcttcagggatttctcttagtagagatttttaagtgtcctttgcatgtaagyatatgcagaaaatatttatttattatttttaaaattaatttttactggagtatagttgctttagagtgttgtgttagtttctactgtacagcaaagtgaatcaactattaagtgtccttttttcryaattttatttacttgcctattgactgtggtgggtcttcatcactatgcgggctttttctccagttgcagygagtgrggcttctctctagctgcagtgtgtgggcttctcagtgtgytggcttctctcgttgcagagcaccggctccaggcgcttgggctttgggagttgcag

SEQ ID NO: 20478 - DNA, 600 bp, Bovine  MMBT01784
aaaaaaccttgtatgccaagttatattcacttggaaatttcttagcaagtaatatagttttctgaaaaggttgtgggtgggaaggcttacctctttcctaatttaatgactaccaagtgtacatgatcctatgatagagaaaggaacatccattgaccaccattacaaccaagatttaaatataaggacacattaatttttttaatgcagtacctattttctccttcatcgggctattttggctgaaataatttgacagcaaagcaacctttggtcttgtttgagaggttttgctgcttytctccacgcacctgtgtctgtctgtgcaataaacctgactgtaggactctcatcacaaatgaactgtcagatcattactacagttgatgcaatataatctgtcttgaaattagaatcagtctggccaagctaggcgttcacttgccatagaggctaattcacttcttgaatatgcattcatggagatatgcctcgatttggaatccagagggagtacacgttaagagcagattttctgaattagcatggcaagagggaagggtccttcatttagacggctgcagatgccgctccctcttg

SEQ ID NO: 20479 - DNA, 600 bp, Bovine  MMBT09442
gaaaagttcccactggattaggcaacaggggagtgaccagtgtccatgaggaaggctttatcagtggagaaatgggmatagaatccggactcaaggggagggagaggcagatgcaggaagcttggctggaaaggggagaggccaggcaggtggaggctgggggcatgttgtcttgagagcaagtgcttcaggtcggaggtggccatggaggayaggcactgtgagccatagctcgctctgktgagcaggcgtgtcccccatcacactggcattgtagatgtagacccaggttcctgtccrtcccttgtcaccacagggcatgaatctctctgggggccagaagcagcggctgagcctggccagggccgtctacaggaaggctgctgtgtacctgctggatgaccccttggcagctctggatgcccaagttggccagcatgttttcaaccgggtcattgggcctgatgggctgctccaggggacggtaagtttggaaaaatgtctcagaggccatagtgcaaaggtagagaaagttctatcctacatctgctcaccaccaccctcctggaattcagttttcctctttgtaatggtcagcct

SEQ ID NO: 20480 - DNA, 598 bp, Bovine  MMBT08238
  misc_feature (1)..(42): n is any nucleotide
nnnnnnnnnnnnnnnnnnnnnnnnnnnnnnnnnnnnnnnnnntgagtcaccaataaactgagacttttcctcctcccccgtactttgttcccacagtggtcacagctgcctacaggttcctagagactggagttaccgaagagtgaccgaggcagtgacctctgaggtctcattgcttatcctcccccattatcccagaaatgaacaagctggcatccacaggaattagcaggatcataccgggacaaatagagatgtcaaactgattctgtctctggttctccccctcaaatctctttmccatcagtttcaatctcattcttggtttttctctgtccctttctattctcctttgatcagtgcttcctccctcgagctgttattttcctcctctttgttctcctgtgtgacatctaccatcgtcatcctatccccattctcctcctcatctcctcctccttcctgactccattcaaaaataatgataatgataaagataacaacaacagtaataaacagttgtctgctgactgtactgcaggaacacaaagtactttccgttagtgatcactggtggctcctcaagtcccgccagcct

SEQ ID NO: 20481 - DNA, 602 bp, Bovine  MMBT13198
  misc_feature (1)..(2): n is any nucleotide
nntactcaagatattttttgaactcctctttggtatctaacttcagagctcatggcacattatttaaataacttcctaattctgtgttgagcatcagtgagattagagggtttgtgtgtgtgtgtgcaccattttttttttaatccytcagatgacttttctgaccaatgcagatataaatattgaccaatgccttcaatctttactctagctatcccacagtctgcctgtattcatggcagcrtggataaaattagaggactgagaagactaagatggactaagakcttggaactaagctyttcataacacttgtagaaatcattcttgtgtacacacacacaatacttagtgtagatttctgatcatgaaacttcaagataaagacacttgtattgcatgagataaaatgaaagtgtgggaagcaatactgcaaaaggaatgaattcaaagcagtgaattatcatggctaattcctttaaataggtttatacacttgacagaaatcatagaaaatggattttttcccccataataaaggatcaaaaacatttctgaaactactcttttccctttgggacaattttaatacagatgaagga

SEQ ID NO: 20482 - DNA, 600 bp, Bovine  MMBT10013
cccccggttctcccctcaggcaagaaagaccaccttgggacgggtcacctgtgagaggcccggggaggaaggacccaggcctgggcactgcgactattttttgctgctcccttattaccttcttttttttttttttctggttgtcaaatgatccttttttttttttttcctttgcagttcttaactagcggggcactccactgcgccactgttgatatcatctatgatgtcatgagggtggcggccatcaacattgcagcccacagactgggcggtccccaggatctctttaatggttcyagaaagttctctagctagagaccgatkccgcatctgccaggcaatgttgacaatctcatcaaaagtaatgtttccactgtgcttaatgtttttctgcttctttctgtcccttggtggttccttgagggctttgatgatcagggcagaagcagaaggtaccacctcaatctgggcttgtctgttctggtcagtttcattgtaatcctcagacccttccaatcaccagttgccttggcgatatcatcaccaaccttttttgtagacagacccagagggccaatcttgggggccagggcagat

SEQ ID NO: 20483 - DNA, 600 bp, Bovine  MMBT04733
gtgcccaaaggcaagcctttccggtcaggtcacatcagagmcacctgaaaggagaaagtgggtcacaaacaagatcagaaggttcctgagagcaatacctaagaacccaggagactggaagaatccaagattccctccaggaagccccacggggaggaggggagggccctttggctgactaaaattctaattttagataacaaaattggaaaaatattttagatagacaagaggaccccaggtgaccgaggttgtctttgctgactttttctatcttccttgcagaccacaagcatcacrgtggagagaatggcacctttgtgatctctgattccccttrtaactgacatagcacatgtgcgtgtaccaagtcccttcagtcgtgtccaactctttgcgaccccatggatgataggccgccaggctcctctgtccatggtgattctccaggcaagaatactggagtaggttgccatgctctcctccagggaggtgacasagtagtagygcttaaaaggaagattttcagaggatgactagaaaattgaatctaccttaccagctcaatatgtcaacctcctagaggtgtgtatttttaat

SEQ ID NO: 20484 - DNA, 600 bp, Bovine  MMBT04646
aggccttaatcttcatgactgaagccatttttgctgtgtggactagtcactcatcagctacacagtgataacaggtctgagtttctctagtaatgggaacagatatgttacaatctatactttccatttagttccccttatgatcaatgcctgaatttcaatcctaagagtatattactatttgattctgaagcacatgccaaaagaatccagcaggactgcagacatatcgtccaagtgcactgccacttccagtgactttatggacaacatctgtgtgttatttgaaaattaatcctyttccatctgtgtaccctatgttttggattccctttccttcacaaatatcctgaattcaaggtatctaaagtcctggagcagttgtccggaggaagagaagcaacagccccgcccccaacccttgggagcagaaaggaagagaattatcctaaggaattatttaaaaatccagacgcggcagacacaaataaaaccatggctgcataggttgatgtcccaggggtccaaaatttaacgtcacttgtgcaataatttgtttagcattaaactaaaccagtttgatgaactcaaatgccctcg

SEQ ID NO: 20485 - DNA, 600 bp, Bovine  MMBT18747
ttccactctctctgcttgtcccaacttggtggctccaaaagctacctgtcacaaacagattttaagttgatttttcttctatctctgcttccatcagattaaaatatggcaccttcactgccaacgttctagcttcttttgggaccaaatcacgtrttgtcatcagggtctcagttgagagcaaagagcaggaacttcttgtaaagcgtgatgtggatcaagggtaaggttatttagcactagaaatctttttgtaatccaatcattccagttactggaagggtggaagaaaatgtgacygtgaagtgggtcacttcttaatatccargcattaaaatgccagcttgaaaaattagtataaaaacttgttatatagtttaatttcctgcttgtaatggcgtgaaaaataaatcagtgagtggtcggtgatgcaactgcaggcrgggtgcccggatgtagacacrgcataaggtgctgtgytctttcccctccgtctctcaaatgtcccttcatattttgtttatggaattaaaagtgttagtctgcactagcgtctcctagtcttgcaaatgcaattaccaaggcaattagtgaaatttt

SEQ ID NO: 20486 - DNA, 600 bp, Bovine  MMBT06165
attaggaccatatggaaaaaattcaaagtcccttcctggaggctatattcatatgtctgttccttactatttccctgaaattaccctatttcaagcctttatcatccctatctgacgcttcccaaacttcccatgtctccagccccctgtgctttaattagcttactttgttgtgacccactgcctgcagaatctactagagacccctgagcacagcctccgtggaagccccaggctgcaccagcctttcctcatatctatttattttccatagattctcctcccacaatctgtgcttcrgtcacactgggccatttgcagctccttatacctgctctgcatttctcaacctctgtacattattcctgytctcatttctggaargccttccctatgcttgatttccatcaacatccttcactgagcatctcaaaggattcacaaccttgaaatcccttgattcctcatagacgggtgctcttaaatattgttccctctgccgcctctgayaagctcatgtcttgtccccagagtaggaagaatcctgatgatctgggactcagtattgccatgatcccactcaaccacacctacatctta

SEQ ID NO: 20487 - DNA, 600 bp, Bovine  MMBT12785
gaataagtacatgtgagttatatttctaactttacatcaaagatgctgactgttcaactagtagcttttctagctaccatgggcatgcaagagaaaatctgagaagtcgatgaggagttttgttaatttagcttctaaatggacatgcatttatagaggatttaatctaaaaatcttctgtctaagctgcttctctagaatctggcttttcaaggcagttaacctgacacagtgaaacagcagtatacatgtatttgcatttttaactcccctaagcatactctgatattatagtcaaayggcagaagaaaggaatcatcagtcagcctttagcacgctgaatccaaatcacaacagagatttactgcttatgttttattcttcccaaggagacattaaaagaaaagactgcttaagaacaacggtggcatatgcatatacagaaacctgggtgtgtattcatatagtgggtggaaaatcaggcactcaaaaaatttctgctcaacaaaagacaaaagagccataaggtattgttttttttttattctaatagtataatgatctttaatacattatagagacaagcataggagatggttt

SEQ ID NO: 20488 - DNA, 600 bp, Bovine  MMBT13607
acacgactgagcaactgaactgaactgaatacactgtaaatacaggaaaaaaattgtgtccaggagaatccttttgctacaagtaacagaaatccagactccagctgtttttgtttttgtttaataagatgggtttcaaggctgggggattcagagatttcgtggcgtcaagggggccccacattattgccacttccctggactgctactcacaggaygggcttcatcttgcaactctggccaggagctagggcttcaggtgccctgtctcttgctaagtgggagtgaggaacaatgggyatccatcctggaatcaggtccttcccctccatcttattggcccaacttgggccccatgcccaccctgggacttcttaataacaccatcagaggactggcctgtgctgcttggtctgaacgtcagcatccgctgctggagcagtggctgtgttcagcttcccattcccatgaatcacagcagctgagtaagcacccgaacaaaactggattctaggaaggaagagaaaagcgaaatagatgttgggagaggtgtagccgctcctacaggaggcttccctacttcacagtgtggcctcgggc

SEQ ID NO: 20489 - DNA, 600 bp, Bovine  MMBT11378
ataactgttattccctgaggtttacaaacattaacrttcagttttatactctaatagcartaacatagaaataaatgagctttaataaggaacataagtcttactgcaataagttgaacttctatggaaaagactaaaataagcaacaatcaataatcaatagagactataaattaatttcataagctctgcagattttctctttgggtttctcattttgttcttgagctcataaattccttggttagtccatatctgagtctccatcagttttaaacactgcagatattcttccctctstcatctgcttaactttgccttggctactcaatattgaactgaaatatttagtttttgatatattcaagctcataccattttttttttttttttcctttggttctwtaaagtttttattaagaaatctttctgcacttttttaggttgcagtggtgttcccagtattttcttctactaactttgaagtttcagcattttatgtctttaattcacctggattccatcactgaatgtagtattttgtctgcccattttcctagtgtgtgctactaaaattttcctttatccattgatttgtga

SEQ ID NO: 20490 - DNA, 598 bp, Bovine  MMBT12100
  misc_feature (1)..(36): n is any nucleotide
nnnnnnnnnnnnnnnnnnnnnnnnnnnnnnnnnnnntttgtgtatttctttaattggaataaattgtatcataatgtgcacaggcacaaacttctgtaaatgtccaatgtccagtgtctttcctagaccctggaagtccatttctaaattcctggtttggaggaaatttgttcgtgaacccaggaagcaggtttgagaagttatgggtagggtgcagccggcacgtggacttaatggataagcaggaagggagggtctcccaaggttgtcaccctgcctggggtgggggtaccgtccccwgatggttgagaagctcatttgcagccatcactctttgcagtgtctttcattttgcatttatcgcgtgcttcctctgagctagttattgtttctgatgcatacgtcctgctgcttcacctgaactgtaaacgtcttcaaatcttactcttaagtcttcatctctttgcctctcctcttgctgccttacctaagaaatgcttggtgggttcttgttgtccccccaccttttttttttttttttaagtgctgtgcggtagaaacgtttattatggtgttaagtctttaaataattctcagc

SEQ ID NO: 20491 - DNA, 598 bp, Bovine  MMBT11225
  misc_feature (1)..(70): n is any nucleotide
nnnnnnnnnnnnnnnnnnnnnnnnnnnnnnnnnnnnnnnnnnnnnnnnnnnnnnnnnnnnnnnnnnnnnntcagtatcaaaataggcctcatgttaggtaagaatcgttctctcaaagtatggagataaatataattttaaacaataagatattactactttctacttttaaaaaatcaaaagtattaattttgcttgaatataaaataagaaaaaggctattatgaaacttaagaaattgctgaatagcagaacaatgtttcttttccacatgagactttaattcataaaagaaccccytttgtttagggaggtgggaaaaaaggagttgctaaatgttatgatatgagaatcactatctgttaaaactcttatttattttagactctgtcttttcaggctagagcttgtattttacatgtgttttaagctatgttctttaaaagtaaaatcaggactcaccaagtgtttgaactattattcacatttctgctttgaaacttttgcattgtgcttgctgtctaagtagcactaaaactcccctggcacagctacacagtaagagaaaagggtaagaaagagactaaaaggatcagat

SEQ ID NO: 20492 - DNA, 600 bp, Bovine  MMBT18820
gaaaagatacatgtagagtgatggtcggccaaggttaccagattctttgttgaaagtcatggatcctgtgcattccatctgatgtaatgagaaaattattttattaaataatgtaagaacgcctatatagtcttaggggagagccagagaatcagatttgcaggtgttgaagctcagagaagaccttgagttgtgtcaaactattctagtgagcccctgccactgccatgactgggcttaagaacttccatgcgccactccgttatgcacgcttagttgctcggttgtttctgactcttrggaccttttgaactgtggccctccagactcctctgtccatgggatttttcaggyaagaatactggactgggtcacaatggcctcctccrggggctcttcccgacccaggggtcaaacccatgtygtctggatctcctgcactgcaggcagattctttacctgctgagccatcggggaagcccaggaacttaggtaccttgtactcatttcctcttgccgctataataattaccacgcatttatagtctaagacaacacacatttattctcttatagttctgaaagtcagaagtccaaaat

SEQ ID NO: 20493 - DNA, 600 bp, Bovine  MMBT12377
tacacagtgtcacttctgccaygtcttttgtccacagtaggtcacagggccagttcaggctcaggggaaggaaaataaattctagattccacttcttgttggaggagtggcagggtcacattgcaaaagaacatgtgggtyggaagagattgttgtgaccgcctctggawcacactctgccacaatcaggcatatggctgtgtgtgcactttgaaatagggtggtcagggaaggccttatgagacagcgaagtgacatctgagcaaagacctgaaggagaagggagcaagccttgtagayatctgagataaaagcattccaaactaaaataagtaaatacaaagaccctgacgtgggaacaagcctgacaggttcaaggaatagtcgggaagccactatcaccaaactaagagtgaggatgagggaaagaatggtagagatgaggtcaaagaagtcccaggggccagaccatgtagggctttgagggacctggaagcggaaatggacaaaaggataaatgattgagattcctacttacattcataggttaggcctatgaattagattgggcttatgaattcataggttaggcccctccta

SEQ ID NO: 20494 - DNA, 600 bp, Bovine  MMBT19546
cttttaaaagcagagtatatcctgggcagtctaataagcaacaatggagcaacgggtaaggtgctgtcatatcgtcaccataaccgtcacgcactgtccctaccagaattccagttcagaaacaactcaatgacctcgtagttactgtgcactgaatattcccgaaatccctggaactggctctgccccagtgaaagaagtggctttggttgagcagtttacttctctgtgtttccattttctcttattaaaaaggaaaacaaaacaaccaagtcttctaatatygccctgctctattgyggagggtgttacctaatcagcgttagttgtggaagtasgtaactccctgggcttcagaaaaggctcagctgaagctttgtaaagaattgtgaatggaaattgagcctgtaagttcaggagaatacacttacagctttatgtatttcagtgatctgaaaaataaactgtatttggctatagagaaaatgtaataaaaacttattttgaaatggatttcttagaatattttaacatacatgaaaggaaggaagtcctaatagttgagtaacaagtaatttaagcctcagatatcttgtctga

SEQ ID NO: 20495 - DNA, 600 bp, Bovine  MMBT11600
accttggcttatatgtagtggtgtcactttcactggtgtcatatgctatagttacttagaatactgcagacaactcttccactggctcatggagtcctaggttttaaattacatactaaccaaactagtaataaccaatcaacttgtctagagagtttactatgagatgtctcaatccaggagtccctgattaatccttcaaatctactacttcccagtgtattttcttctgtttcctcccattctccttctaatcctggtgcagacatgctggctccctgcttctcacttgcttctccwtccccttttcccctcctcctctttcctcactcattttcttccttttcttctctctccttccatctttggtccttgaggaagtcaaagtccttctgtcttattctccagggcacttggtttatcttgacattcaaactgaaactgacctgtgcattgagttcccttatgaccttcctacttgtccagcttacagatgactcatagaatcagcttttaattcttattcatgaatgcatttgcattccattttgacatcccaatatttcctcccactcgtcacttgttatcattatcatccct

SEQ ID NO: 20496 - DNA, 600 bp, Bovine  MMBT10121
gtcaggagttttgaggaatcagaccgtcctgataatgacctgaactctgcagccagaatttgaagtatttaccccaagagaaataaaaatgatttccttccatgccaaatgcataatttgctgctcataaacttttttaaacaacatacactaactattgagtaacccaagtattctccatagtcatgtatagcataagtaagctttaatgaggaataaaaatgaaactgaaacctatgtggccaaaaaagaaaaacaaaccaagtaagtagaatagaaatgatttgaatctaaacagtmtataaatgaatgtgcctgagctactwagcattagaaatcgcaaaaaaaaaaaaaattatacaattaactgatgtcaatttgacattaaatgcagcagctttattttcagcattgtagaaacaaacatgcagtaagctcttgaaaagaatgaattgtcctttttatagttcagtctgggtattttaagttcccaaatagttctagatcattggacttttaaaattatatacttggagctttcactttatagcagaatgattattgtcatgaaagacatgtttgaaattgcaaaaaggtaga

SEQ ID NO: 20497 - DNA, 600 bp, Bovine  MMBT04854
ggaaaccccaaataataaagcctaattttgaattttaaaaaactatgtgaaactaagatgtgggcaataacagcatgcaagctattccagaggtggtgagcgctgctgagttcaagggttttttatgtctttggggaggagggcaggactttgactaatatttggtattattgagtcagaagcatgtgttaaaaataagagccactattaaggaaataaaaagacaatataagggttccaactaggaaggggctataaacaaaaccccatcatcctatagaaactaaagaaggaaataaragaaggataaaggaaaccatcaacagaacccaagcagacctaaaccaaacctgaatcttttggaagagctacctcccaaagcagattgcttctttcaaaatgcaaatagttctctgttcgcacacagcacaccctgttgttgtcattatgatcacaaccactttttatttcagagactgccagatttaagctgccagggtctaattaggaagccccctccatccacaactgcagttatgaggctcacccaccacaggtccttattatcccagttggtgctcagtttaagaaagcatcggt

SEQ ID NO: 20498 - DNA, 600 bp, Bovine  MMBT03674
gagttgcagttccggttgggaggggtggggcgcagcgttgtgtgatggagagggcgaggccccgcgtttgttgaagtggtctgcgtaggttctgtttcgtgtgtcgtggacgtcctctgcagtgtgtctccctttgccgaagctgatggctttcctcagctggagtcttgagaatagcgggggtagtggtgcccaagctgatggctttcctcagctggagtctttagaatagcgggggtagtggtaagtgggggcgcaaggtggtgtctgatgagacttgtagagattgttttggatcasttaggctcaggtgaaaactggagatcgaggtttggtcttatatatacaaaagtatgacagacgtggcagttattgatcccctgtcccggaggcaaactgcactcggaaagctggctaaattcagttcaagaggagtgttaaagggaatgtgggactgatagagcgataatggggaactgggagaggaaagctgttgttaggcagtcagctcaaacctttgttgctttgaccttcgggattgaaatacttatggtgtgagaacctcatttcttctaaaccaaggtgatgcttcctactctc

SEQ ID NO: 20499 - DNA, 505 bp, Bovine  MMBT18617
gggtgggagggccgggcctgcttttttcctgccttccaggaagataaggcagaaagcggggatgaaggatagaatgggtaatactctgaaaccacaagaaagggtcctggctttcgtctctgccctacagytcagacatgctcctggggcatctgggagcagggaatggccccacccccactactctggggtccctgctcagggaagctcagaaccctcagtgggctccccagacttccatctcccctccagtgtcagttcacccacaagctgtttcagctctctcactccccttcggasccctagttttcccttccaggtgagcccagcaaccctagagccaggcttttccccttgctttcctgtaccagctaaagccacagggaccctgggcaggtgacatgacatgcatgggccttgagggctggctgcaggttcatcttcccctaccctctaggatccctgcctggaccccaggcacagatcagccctagagcaaccaagg

SEQ ID NO: 20500 - DNA, 600 bp, Bovine  MMBT08356
ctcagtaaataattggcctgctaacagtgtagataatgtcctgtggtaaccagcctccaagatggccacagagagccccacctctcrgtatttacaaatgtgttcccacctcacattatacctggattgatctgagtgatcagtatggcagaaaattggtatgtcacttccaaggttaggtcataatatacaccaccttctgtcttggatgtacattctctctctcttatacctcactctgaagaaagccagctgtcctttcacaggatattcaggctgcctaaggtgaggtccacaagrcaaggacctaatgtctgtagccagtaggtaatcaggyagtaaagtctgccaacagcaatatgagtgagctgggaaagctgccttttggtcccagtggagcattcatatgactgccatcccatccagcagctgtatggcaagttcatacaagaacctgaactagaatcagttgagctaagcctctcccagattcctgactctgagaaactttctgagataagtgattctttatttaatctgataaattttgagaagattttttatgcaacattagataactaatacaatgtccctgatgac

SEQ ID NO: 20501 - DNA, 428 bp, Bovine  MMBT13052
ctcagtaaataattggcctgctaacagtgtagataatgtcctgtggtaaccagcctccaagatggccacagagagccccacctctcrgtatttacaaatgtgttcccacctcacattatacctggattgatctgagtgatcagtatggcagaaaattggtatgtcacttccaaggttaggtcataatatacaccaccttctgtcttggatgtacattctctctctcttatacctcactctgaagaaagccagctgtcctttcacaggatattcaggctgcctaaggtgaggtccacaagyatatttctccagcaayaatttcattttgtggtctgtatttttttcctatttctttttcaaaaatagaggagataattcttaaagacacattgatgaaaattattattgcaagtccaaatacacgggtt

SEQ ID NO: 20502 - DNA, 600 bp, Bovine  MMBT09017
ygccgctagcccacccctcttcctctcccattaccctggtatatttttttcacagtgcatacaaccctcagaaattatctttatgcatttgtttacctgtcttatgtttgcctttcctcttggaatttatgtgccacgagagcacagaccgtacctgtcttgggcactgcagcatccatggtctcagcacatagtaaatgcctggagcaatggaaggtgctcagacrtggaaacaaataagtggattcgcatgacttcygctggcacgcatgagttgatcttcttctctcctcctgactrtcctactgcctatttgactccatcaggttgtccctcctcaaatttatgttctaaataaaattttcttcttccccttatgctgcttgttcctcttggggttcactatcgtttaaacaaaaacctcagggtcatctttggctcttctctctcctcactcctatatacacttagtccccaagtcctgttgacttaaccttggcaatacctctggactccatcccctcatccattcgcctctcattcaggcaacagaagcactcacagggatgctggcaggagcttcctaattgacttcccaac

SEQ ID NO: 20503 - DNA, 600 bp, Bovine  MMBT19970
cttctggagtctggtaactgctcctatattttgcatctgttctcatctaactgaatatttaaaatctggttgtttttctttggccagactttcaattaggtttaatctctcctttgatgccaacttaaaaaatcttttactacccttacattaataaagtacattacttcaagcactataagatgtgggttgtgacaaacaagtatttattaaaaatttgtcttggtcttttaattaaaccccagagagctaacctgactaaacaggcagcaaaagaatctcttaatttctgggagtatmtgatgtttaaattaaatccacattttgtttttttgtttttcttataattcactgaagtaaatgcacttttttacaatccatgctggctaaaacacacccatctctacttctgtacccatccactcacagctggcctcatatacaaagattcctggtcagtccaaagtcaaaatgcaagaatgccactcctaagaaataaggtattaaaaagaaaatactcagaacatagaatgaacatatcctgatggggcttcagtcaagccaaaaccttgtgggatacaagcacccccatgtgcaccc

SEQ ID NO: 20504 - DNA, 584 bp, Bovine  MMBT04296
  misc_feature (1)..(1): n is any nucleotide
naaagcttttaaaataaatcagtcctgtttaaaccgcagctcagagagttgggacaactcattgtgagacttctctgtttttagctgtggagcaagctgttttgttttgactctctcataaacccaggtctaacacacatttacttggccattcttggaaaaagaaatcaaaagagccagtcctggagcrtctgagtactggtaagttcagagagctttcagsgtccaggggaggcaacagagaactcccatctgaatgactgcttcttaatggagggatgaaaggatatgayggacgcaraggccatgttggacaagcgtctcggtggggaaatctgccaaccggacaacgcctcgcccagggaataaggatgcagttagaaccaccttattttcaaatggccaccatgacaagagctgttaagtattaaacagatgtctgctatccgtgattgcatttggatctcacaacttagcggtgtcagtagaactaatgactgagacagataaagtggcttacttcctgcatggattaagaattcggtataaaagccaaaataaagtgctgcacacctgccacattt

SEQ ID NO: 20505 - DNA, 601 bp, Bovine  MMBT07275
  misc_feature (1)..(1): n is any nucleotide
nttgaaggtcacacctcacctgttccaacacctgctgcatcttctgctgccatatggcattctcctccttcagatttgtcgcatactgatctctctctgcctgcagctgcctcagcgaatccttcagctgcaaaaggagtgcagaagttagcaggggctgtcacaggggggcctcacctactcatggtcatctggggactcctgtacccctctgtgtgtaaagcctcacctgctccatgtgggtctccagctgtgccctctcctccagggcctgctgtaactgctggctgctatcaggggyaggttgactagaaaactggatggtgaaaaacaaagttagattggggggcccaggctgatccacacaacgcccacccccaaaaggtcagcatacaactcagggttatccttaatattgttagtaccatgtctactttattttcactaaaaaatagctttattttcactaaatactcaatgtaaacaattctgatagtaagtgttcaaagttctcccagcctccccaatccagtgtgtatccttcttgacccttttccacaggtatgcaaacatgcttcattgatgcacagtgccagggata

SEQ ID NO: 20506 - DNA, 598 bp, Bovine  MMBT07212
  misc_feature (1)..(44): n is any nucleotide
nnnnnnnnnnnnnnnnnnnnnnnnnnnnnnnnnnnnnnnnnnnnattgaaggtaggagaagagggtgacagaggatgagatggttggatggcatcatcaactcaatggacatgagtttgaacaaactcagggagatggtgaaggacagggaggcctggcgtgctgcagtccatggggtcgcaaagagtccgacacgactgagcaactgaacagcaagagtgatcttcacaggtttcccccggaargggcttgtcttgcatctgtgtacggtaagcatcttatcaatcccttcttgcctcygacaatcatgttgaaactgctttctagtctaggtggaaacaattaaaaaaagaaaacaggtatcagtttgaacagactaataaaatggtttgtccacatcaccttcaaagggttaggctatatcttgtcrggcatcttatgaataacctccagtattcaaaatccattttccaaaggcctgccccactttcctgcttccaccactgctggctgaagtcatctgacttccattttggaacttcccacaagaattcaagcttggtccaaaacctctccagcctccaaggaaaacagacca

SEQ ID NO: 20507 - DNA, 600 bp, Bovine  MMBT04895
gtcctttcagttttatttactttgattccctgtagatcatgtgtttatgccctgttgacaatgatatgttgttgcctaatattgtttccttcctatcktttttttttaaattaataagttagaagttttttcagagcaataaaaatgatttatttcttttatgtagaggtatagcatggatcctacatattgttatagtttacacaatatttgatgaacttattatcctaccagtaattggtgaatcatcaaagttaactttacatcccttggcatgccacttagtaaattagaaaaaakaaagttgtagagaaatgattctgtactgatgtgtgtatctcttccacaataggttatgatatttaaaagaaacagatgagcttagaaggttaagcttcttgagagctgacagctgccctgtcctattatagagagatttccttggcttgctagaataagccccgagagtcagtggactgacttgctcttgtcacacagcgattgaacaagctgagttagaagacatgtgtcaaattacaaggggattcacacagcgcccatgtgccaagttttccatcatagcatgacaaaaacaccatg

SEQ ID NO: 20508 - DNA, 600 bp, Bovine  MMBT05463
ttgtgcttttgcaccttcaaaatatatccagaatgcaactaattctcatcaccttcattgcttcactgctatcaccaccttcaagccaccgtctctctctcctggataattgcattacccctaataggtctccttacatttatgatgcccaccccatcactgtcattctccacacagcaagttgtatgaaccttttaaaatataagccagatcccattacccctctgctcaaaacccttccatggtggcccgtgtcagttgagtaaatgcaaaagtccatataattgcttacaatgctcytcatcatcttgcttctctttgacatcatttattatcccctctcatgttctctccattttagtcacactggtctatttatctcagccaagcacatcaagtgctgacctgcttcaaagtctttgcattgctgccccctctgcctacgtatctgtaggactcattcgatcacctctcttgggtatctatacaaatatcagtgaggtcttcccagacaactctaagtaaaaagtatagcacttactgcactgcctatgcccatccttgcttaatttcsccccccacaaatttatcaccaaatga

SEQ ID NO: 20509 - DNA, 600 bp, Bovine  MMBT06556
taattagtttaagaatttttcactctaataaactacatccttaggttaggagttctaaaacaacagaaatatatttggttattcatttttagaatatgtgtttcctcacatctatttctcactcagggtaacaatagatggcaatagttgtcaatagatggcaaactaaatatgccaaaaataacgtttcctaattgcttccacttcagaagacaattacaaggtggtttaaaaagaaaagtaactctaaaactgacccccaatcatcactaccttggtatctagattttaactattttyccttgttacccgaattaaaatttagtttcaatcagcaaaactaagtcaacaaaatgacatatggaggtatgaaaaaatgattggctggaaagcccattattttatatgaaatcatattcatttacatgactttggtctctctcttcgcagtttttggaaatgtaatgggataaacctatacagagagtggaacataattatcttcaaaccctttttctttgtgccttaatttagagcattgggatcatagagcagacaaaagtgagacttatcagatgagaattcattctacacaattca

SEQ ID NO: 20510 - DNA, 600 bp, Bovine  MMBT05491
gacaccaaatcgtgccctccaggcactggatttattgaaaaactacatacatattaaaacatctttatatacattttctctgttataagattacaaatatacaaatgcaaattccatcaaagtcagcatcttgtacattagaaacaactgcagaaaacctatatcctaattccatcagttaaattgggattcctcaaccagttaaaaaaaactggcacagctcacccagcttcccaagtgcagctcatgacagtgaaaccacagtgtttacatgggacgtttttccaaggaagcagtgaygtttggttccgagggrggaaaaatatgtttaaaattctgagagcctcatggtggttcggagaaaactgggactggtggcaatcctcttgacaacattttgatgaaactccttgatggtcttctctcaaaataagtaatgaagttattacttcattgtcctctgactggtcagggcaacgtactcaacccagctgaatgcaataaataatgattatatataattcttcggtcagaatgaaaaggaaggtccttgagcaacagtgtttcaaatcaaaaactgaagtcctagaagagaggtct

SEQ ID NO: 20511 - DNA, 600 bp, Bovine  MMBT05086
tgtcctgaagcttccagggtctgaggaaactgacgtggccgcaggatggagcagagccagaatgtgaagctcagtagacgatcacgacgttgagcaagaccaggccagaggagagtctgcaagtcacaccacagacgcatatgtgtgctttgtgcaatttgtggtctgcctctttgcttcattctttttttcgtaccttggcatggacccaccaaacatcaatagaggttacttcaggccttgtctgctgtgagctatcagtaactttggtttcttctttacaaactaaccttgttcatyctcaacttttttttttctttttggttgggarcatctgcagaaggtctctgcctggagatggtgtgctaacctatgtctagcagacaccagcaaggcacccaggtttgatcatggcaacaaggcaaggctttagggaggatcattgagagcaatgaggtaaaagaagctcctagcacaggtgactgctttgcacctcgcctgtaggatgtgatgttgtttgcggtgacttatttaacaagcggctagagaacggagatttgtgttttagctcatgaatggagggtgaaggcctggaatttt

SEQ ID NO: 20512 - DNA, 600 bp, Bovine  MMBT08770; identical to SEQ ID NO: 4568

SEQ ID NO: 20513 - DNA, 598 bp, Bovine  MMBT08391
  misc_feature (1)..(26): n is any nucleotide
nnnnnnnnnnnnnnnnnnnnnnnnnnactggagtggaatgccatttccttctccaggggatcttcccgatccagggatcaaaccccagtcttctgcattgtaggcagaccctttaccatctgagccaccagggaagcccttgggattgttttagcattatttacactaacgaatatattctgtaattaaaaattttaaggctctatagtgttagttacatattcatagtcaagatcattatcagctcttttttagaagggcataccattcctgaattctttattttgatgtatctcttayttagccgtatttcattatcaagtaggttctttaaagcaggcttcataagcgctatgtttcctcccatgttatgtgtttgaaaatgtagttatggtgcctttaacaataaattacaacttggctgaatattaacttcttgattcaatccccatttttatttcttgcctttgaactctgctgctgttattccaatgcctcttggcattgaaaattgctgtgaaaaatgctctggcctgaggccagcctgtcttgtagataatttgcttttctgcctgcaatctcatagtaatctttattt

SEQ ID NO: 20514 - DNA, 471 bp, Bovine  MMBT08113
gggagcaggcgaggtctttgttctgcttaatcaggtctctttgtccctgacttcaagcctaatccagaacagaccagcttagctggcccagacccagaataaggaagttcattattactgggtagaagggaacagttaccccattaaaggcagctcccaggcccctctgccccagccgccttcctcacgcagctgctgttttgactgcacggttcctgcacttgatattcaagttccatagtcatttcaggaagcaatctgtattaataaaatgcaaatgtatacatcgtggcatctcartgacaagacaatttcctctggcacttactttgtcctaacctttttgcaaggttgagaaggtactatctccaatattccttgttaatttttctaggcaatgccaattaatttgctgaatggattttaactttatggctttctttttactgtttggaagcaaacctctaatca

SEQ ID NO: 20515 - DNA, 600 bp, Bovine  MMBT10097
gggagcagcccactggcctggcagcctggggctcggttctctgttatggctgaagcagacatcacagctctctgtggtttctaagaactggtggaatttgcatgttgagaatcctcgttccttggcatgaagcagactcaaaagcatcgttgctcatcatttgtcatctgttggagaaagagcgtgtgatttgtttacttgtaatgaagcttgaccatacttctccaggggcctttgcaagaaggatgtgtcagcttacagacctgtccccatgaataaaaccacaggcaaatgctcccyccatcttcccttctcccctctcatttctgtgctttatgtccccactgccgggccctcttcaagggcttatctgtgggtgagttcagaaacttcagatgataaaggacacccagataattggccggttctccaaagtgtctgtcccctcagctgctgccagattccctcttaatgagtccgtgcagtgacggtggggtctgagctcctccagctccgtgggaaaatgagcttccctgcattgtaacagcttgtggctcggggggaaaatgacagccattgcacaagtttcctttgaatgta

SEQ ID NO: 20516 - DNA, 600 bp, Bovine  MMBT07489
aatggagaacagaagatcctggmaggatataatccatggggtagcaaagaatcagacacagcttagcgagagaacagcaactgcacttcagtcccttttgttgactataaatcttcagctgtctttggtgtaatcaaagttgaatttagttctatactgaatcttctytcctctacttcaatactttaactagaatctatcttgtttcttgtttagtgcaagatttttctattatactatcctttcaaactcctatacagtgattttccacaacaaccaacgtatgctcctcttcatagwtttgctctatcgttcttgctttgttgttgctctcaatttttctcaaacatgttcttaataacctgaatataaatctcttctaagtctattaaatagaatatcatcaatgtttcagctcataccacactctcccttcactcaaatagtctgtgtaccttgcattgttattctgcaaattggatcagcaaactttataattccattcacacattaaccaagcccactggagtacatttggcarcaaccttcagaatctccccaaagttgggaattcctgcaggttctactttgcactcttag

SEQ ID NO: 20517 - DNA, 600 bp, Bovine  MMBT21586
tctccatcttctccatagaattgagttcatagtcttcacacagtaactccttaactatttgttgagtgattcagtctaataggcagtagaagctttgacacacatatgtattgttttattggcttcyaaattgctaggtgtaactaaaaagtatcagaaagttccctcataaatatatactgtatttttccaaagccaggaataaaattaatattgaataattttatttatgtagaactcaggcagttttggtttgtttttttttttttttttcttagtaaatctctcccttagctctgyagagatagcctattggttttattgtgaactgtgttttctcttttcataggcttcctcatgtatccagaggatcttgtcaacattaacattagcaatatttcccacactgtatttttttaacttcctttattatacagaagcaggatccatgttttttactctttttgcctacttgatgtgtctttatggaaatcataaaacttcagccttgcttggattttgtggcttcatgtttcgtcaaacaaatatcatctgggctatcttctgtgcaggaaatgtcattgcacaaaagttaactga

SEQ ID NO: 20518 - DNA, 600 bp, Bovine  MMBT09676
gtaatgtgtcatcacagtgggcaggggtgacacgtgacctcagagtgcaggtggaatgtcagacgggggttcagagggggctgggattgggctgtgtctccatggggattcctctcgtttaaggagctaatataccatgcacttgaggggcatcaaaaaaatttcctgtggaatcacttctttctgacattccaaaaaaaagcagatatgaattccatctgctccaacactccccagttcacttagagctgcctagcatctctgcattcaccccaccctggtcccccagatctctagcaygtcacacttttcagaaggccttgggaaagtcagggagtgtctctgagcctcaacgtggagcaggaagtcctggaatttcctacgtcaggacagaactgttgaaagattcacacctgatgcgtgtaagagattttcctagtaactatccaaattggagatgttttactaacaagaatgataataataacgatactgttggctgctgctgctgctgttattagtttgaaacctagccaccaaacctgggcttcaagttctgggggccttggacaacagagcctaccctgacctacaggcctc

SEQ ID NO: 20519 - DNA, 600 bp, Bovine  MMBT04179
gtgaagatgttccttgagaccatgtcacactctgtttctcacccaactatcacctgctggttttaatctcatcgatgattcccgcctaaaacagttattactgcagtggttgccagttagtgatgtaaactcttatgtagacctcgaaatgacctcgagaaatgcactctattattaacattgtgagaataaacaaagtaaggggaattaatgaccatgaagagctagttgttatcatctaacttctgaatcctgactcaatatacaaaaaaatccctaaaatcaaacaacccaatctaytggaattagattaatccaccattgcaatgggctaacgctggaaatattcawattaagattaaaagttgtagaaggggtactaaagtctctttttrcatcttcaagaatatgactaygagaatttaaagatgtgtgtctattattctgtaccttaaaaaaaaagcacagtgtaattcagcataacactgttccaacaacttgtacttcatccgaaagaatttatttgctgaagttgttaaaaaaaaacaaaacttatcttcagaggtgttcagcagcagaaaggccygtcggtatcttctg

SEQ ID NO: 20520 - DNA, 600 bp, Bovine  MMBT19697
gggctggggaatgcagtctatccggctggccaagcttccctctgaaatgtgtgtgttctattgctaaggagctgaggatagatgtggcctggcctctgccccctcctcacagtgaatcgcctccttctggagcatacccttcttctgaaacgtgaggtctctcttcgcaacttcgastgtaaaaatatttcgacacagtatttctcagtgccaactggaaagaattaccgtaagcaatttttcataaaagatcactcctttgagaatatgttttcatattttgctttttttgacattttsggaagcaaaattacatgcaaacatttgttctgcaattgcaatgtgtgaagaagctgtgcctctgagtttcaaaatctagtttgcgccgaggcccacagaagagcgtgtcatctcggctcacgttccaaaccggggaacacttgctccgtgccaaaaactggaacaggtgatgctgctaaggaagagggtgtggtgatgaccaaattcccagggcctgcgtcttcgtgaaaggggtttcagatccccagccacagcctcagggttaccccacgtgggctgaacattaaatgacagctggaa

SEQ ID NO: 20521 - DNA, 575 bp, Bovine  MMBT17726
cagtgtgcatttgatatagtatcattcttgaagtgatcattttaaaatgaaaagtcaggkggaaaaaagttaatatgtattaattttttatttaaaaatatacagaaataagaaataaaaaattaacttgctttgtagagtagataaaatgctttatgtgaatgagctaaaagagaaggtcatataactattagtgtactagatatggccatttttcatttgttagacagaactgacaatactttataaaagctaataacactctaatgaaggaaacgtatagagtttaatgatgaagcrtgacctttttgagcttaatggatagagttgaaccttggcattaagctcaaaatcatttgaatgtgtaaaacatggtgttaatatctaattttgaatgaattttggacttcccacaaatcccttacaccactttctgagccatttcatcaacagcttgctagactgcatccagttcaccatctgggaagtgtcacttgctacaaaataaacctgctccctggatgacagcaggatacctaagcatctgctgtttcataagctgcacagaacaccca

SEQ ID NO: 20522 - DNA, 600 bp, Bovine  MMBT05719
acttaatcacatctctaggaagagtgtggtacagctaaatacagctaaatggcgactcatgcacaaacctcaaaaacagcaatgttgcttctgactgtaaacctcactcaaaacttttttcccaagtggtttcaatattcagttggaagagtgacagttgaacttaatggttttcttttctcacttttcttcagaaaccaatccatctcagtgctacagtgctttgagacctttttagacccatgacccttttggataaacttgaaaatctcatgacaccatccccactccacctctaaytcccatcttgagctagtacagggaacaaattctatttcctgcatatcctgtcagacaagaaaaaamattatggcctttawttttcaagttacatgaaaaaagatattttactttccatatataaatatattttttaaaaaattttcaaatcacataacatcctctcctaacaccccaccctgctactccatcaactaagkgcttccatatgttgataatgcatggcctattctatgcaatattgaagctcagtgtaagactctaaatgggtctaattatgaaaatagttagcatatttgt

SEQ ID NO: 20523 - DNA, 600 bp, Bovine  MMBT04950
tcatgtcagttgattgatgaacattttaagttatcaaaaggtacaaaatttggaagcagtgctatttttgtcttatgcttgtgtccctctaagcaaggtgattaatttcttttaacctcagtttccttgtctacaaaatagagacatatacagttgcattctagaactcaagagaatttttttcctattctttttcccatgccaaaactaaaaattttaattttcttattatgcaataaaactattctcactattgaaaaatcataaaattagacaaacaaaaaatagagccccattaaycctatctgcaaagagttggacacgacttagtgactgaataaccacattcctatccacccaaacacaattattcttaacatcttaactacctctcttctaaatggaattgattgcatttcttttgagaaatggcatctttccatatacactattttgtaatgttttaaattcatcctcagcaactaaatcaacattaaatacatcattcaacatcagaggtcagcaaacattttctgtagagtgtcaggtagcatttcaggcaggcacatatctcatgtcgtgatttttaaaaataatctt

SEQ ID NO: 20524 - DNA, 598 bp, Bovine  MMBT00980
  misc_feature (1)..(37): n is any nucleotide
nnnnnnnnnnnnnnnnnnnnnnnnnnnnnnnnnnnnnctaaccactcttgcttgtctgatgttgaaaaaccaccatgttgaaaaacatatcagtagctaaattatatccagcacatcaaaaaccaaagctgggccaaggcgaggctgtcaagtggagccatagggtctccctaggtcctgtctcccagagtcccagctgttttcccctttctgcttcccaggtctttctcctgttatgtctggagactgatctggcttgtctcatcatctcccagtgcactcccaccctttgaccctgcrttttggatcatgaactaaggtcaacatctttctggtactctagggcacacctgaatatcccatagtgttgaccttatttctgtgtaagcctgggcaaggcagcttctctttcttccagtgataacatactctgactctaattccaaccagctatcttacagcattggtcacaagggagaccaggagagtatgtttctgattctgcgtaaaaccatcctggctgctagaaaaacaaagcacaacacatgctgtatgaagaataagcccatcacatcacgctcctgtgtgagggcaggcc

SEQ ID NO: 20525 - DNA, 452 bp, Bovine  MMBT21815
tgactaataaaagtgaggaaaaataaaaaaatatatacctttcagtttatgtccaaatatttggaaattttgtagtctatagggtggtaaaccaactatgtgttacaggtgtttagacatctttgtatctggagtttartcatcaaggttaattggaatatttgttgaatttataatgtatgttgttgtttataagactctgagaactactatgggcttaaatggaatctgtttggctactaggcattattatgttttagtaatgttattaaagaaaaacaagagggaaagagtaactcrtgtatttttattgraattgttctaagctatttggcacatatgtcasagaattataaagaaggaaactaacatttctgatggagatatgaatcatatcacacaatatcttcacttcaaatacttataatcagaagaaaagtagaaggacatat

SEQ ID NO: 20526 - DNA, 600 bp, Bovine  MMBT09209
atgctgggagggattgggggcaggaggagaaggggacgacagaggatgagatggctggatggcatcactgacttgatggacgtgagtctgggtgaactccgggagttggtaatggacagggaggcctggcgtgctgcgattcatggggtcgcaaagagtcggacacgactgagcgactgaactgaactgaactaaactgatgatattaagagccctggcatattcatatgtcaaaaatttaaaagtaaaagcaattatttcagaactaattttaacttaaattacaacaaattttagacrggctacacataaagaaattgatgagtcagaaaaagagcttctgtattytttccaactctctcttctggggccattatctatatttattgctgtattactttaaacattcttttagttccacataatatttttgatatataatctcataaaacagaaattttaaatacctctatatccttctttgtttccatttcatctgaaagctggaaaaaatttaaaataaaatctttaaaattctaaatttaagaatttttagactttgtaactctactaagtatgtgtgtgtgtgtgtgtgtgtgt

SEQ ID NO: 20527 - DNA, 600 bp, Bovine  MMBT19978
acagggacagtgaacacagagattattgtatcttttctagagttgcctggtgatttgaatcctgtgcaatttagattatgagattttgcatactgtcacaggcattggtaaggaaaatatttttagagtgattccattataaagtgacatatttccagtttggagcccagctaagactaagaatgactaaccaaaaacacrgagaatattatcgatggattttgggtcttccaaggaaagcaattctcagtgttgtaacagrcagtcctaaaatccctgtcacaytgtacagttaaatcycatttttcaatcacatgaaatctactggaggagaaagagctttgttacatggtataatttgagaattcagacttctttcactttgtggggcagcatgttcagtaaacctgtatgcagatcaagaagcaacatttagaaccctgtatggaacaaatgattgattcaagatcaagaaaggagtacggcaggactgtctgctgtcaccctgtttaacctatacactgaccacatcatgagaaatgtccaactggatgagtcacaagctggaatcaagataggtcggagaaatatcaaccaccc

SEQ ID NO: 20528 - DNA, 598 bp, Bovine  MMBT06786
  misc_feature (1)..(62): n is any nucleotide
nnnnnnnnnnnnnnnnnnnnnnnnnnnnnnnnnnnnnnnnnnnnnnnnnnnnnnnnnnnnnnaaatggtagggaggctatgtagcatttgagaaacttgaggcattaagacttatcaactgaactttacagctggaaatatgatggtgtaggaaggttaagtggcttggtcattgtgccaaaggtaggaacatacattagggattattagtgatggctttgctatgaaattcatcaacaggcccccaagccaatattattcccttgttccaacacagaactcggagagaagggagaggcrgcaagaggaagatgattaagcagtaaaactctttctagaggaaagtgaaaatgtgtccaaagtatatagacaaggagcaatattagagtcagccagaagagacccaaggagctacaactgtttaaataaaattgccattttatattcacaatgggccagcttttatcccggtatagctcctcaggaattctctggaaaggttcctaactctagaattacttggtgtgagtgaattggggccctatgaaaatgatactcagtgatgattttatgcaactactttttaaccacctaacag

SEQ ID NO: 20529 - DNA, 600 bp, Bovine  MMBT06946
gggcaaagcagactctagtatttgcttatcagttactgggcttgtcatttctagcctctgagattcctttatttttctggcagcttaggtatacattattaatatgtcattaatattttatgccacatctttaggtgtgaggtctctaaaaatctagtatgccatatttttttgtaaagctctttgaattagttagctacttccgtgtaacaaattatcccaatacttagtatgttcaagcaataggttttatctcctaggttctgtgggtcaggaatccatacgcagtttctctttcaygaggctgcagtcacggtgttggcaggcatgtcaytcatttcaaggctcaatttggggaggatctgattctaagctcacttgtgtggccgttggcgagacttatacccttgctggctggtggttggagacattagttacttgttaagtggttctttccacaggaatacctacaacatagccacttgtttcttccagagtgagggctctgagagagggggagagaaagtaggaacacatggatgtcatggcctccttgtaactcaatctcagaagagacattccatgacctttgccatcttc

SEQ ID NO: 20530 - DNA, 600 bp, Bovine  MMBT07656; identical to SEQ ID NO: 4782

SEQ ID NO: 20531 - DNA, 600 bp, Bovine  MMBT15117
gggtgggagggaagtttcccaaagaaagggggtgtcaggccccaaacccaccggaactcaagtctcctggccagcctgccaaaagtgtgtgtgatcagtattctgagacctaggaccaggagtggagaaggggatcataggactgctgcaaggatggcactgatttccagctcaggaagatgtcagattctgtgcttcgggctcttaactgtgatgcttcctgtttggtatcaggtgcctcagtccggaaccctgaagctgtcccacctgcgggaaggagcatacacctttcagttgacygtgatggacaccgccgggcagaggagctccgacaacgtctcagtgaccgtgcttcccgtggccttctccacagtaggtgagaagaaagcccttccctcgcattcacagtggccaacagaggccaggctgtggatggaagggtggtgttaaactggcattttaggggcttccctggcatccagtggttgaggcttcgtcttccagggcagggattgcaggttccatccctggccagggagctatgatgcccacatgccttgagggcaaaacaccaaaacacagaacagaagcaagggcttc

SEQ ID NO: 20532 - DNA, 600 bp, Bovine  MMBT12353
tctactaagtaccagattatgtgccacgtactctgggtgactcagaattaaataagatgcacttaaaagtgggtaaggggggcaagacaggtccaggacaattcaatataatattgtctttgtactagagctatgaatggagcaaggacatctctcttcattaaagagagcttcagagagaagtggattttactaatggtaaaggaggtgaagttcactccaggaggaggcctgttgaccctggtacatcttrgaaggcttagcatgtaggcaggatatgaagaagatgagcctggaagrtaagatcagggcaggtgaccagaggccttacctgcttgttacagggtctagactcttctgtgagcaatggaggaagaacaatgctaattgaagagtgttaggtgcatggaaagaatgctaatggtgttgatttctgaagactttcagtcttccagagaagtgaatggcaagatttctactgagtctgagtttagcaatgtggttgtgacacktgggacagtaagtgttgaatagttgctgtaggcaaagagaaaggaagctaatcaataatgagcaagaacactggcaaactgtatccag

SEQ ID NO: 20533 - DNA, 580 bp, Bovine  MMBT05433
cctcaccggagatccaccctccctactcccgcggagagctccgcaggattaagtcttgtgaatcccgacccccaaccctcccccaggccccaggggcagatgagcccttggccaccgcccctccaatttcctgcagacccggcaaacaaaaggctcgggaagagaggcgaggctgaacagggcgcccttcctgcaggaacagctgatggagcaaaatgacccaggagggagagcaggggagggatgaaattccagggttccaggaggaccgcagcaggaggccagactcttggatctcgrggaaggagggagggagtcccggaaagtggatatrcaaggcccaggcaggacactgcagtttgctgggctctctcagatcccagcagccctggtgggggtgatgtcagccgtagggaatggagagggtggggggaacactggatttcaggtgagctctgaggcccctaggctggagtggtgggggcttgggagaggcctgaagccctgcgtcatctcctttggggcccagcctaccgccccctggcccgacctgctaccctcggtgagggccccaccctgg

SEQ ID NO: 20534 - DNA, 361 bp, Bovine  MMBT19298
cattcagaaagtaacaaagggaatgaggttcctctgggaagcaattttgcctagaagccccaaatttaaactgtgaccactgctctgagctaatctgagaggaaaatatggttttctgaacatctaaatttggagatttccgaataggtgactgatgagtgaagatggagatgggcaggaactagagagaacctgaggaccttgtactagcagcctgggcccagcacgcccacagctctcttcctgagggatactgctgacctgtgggcccttgtggaatttttgaggaggcgaagcaargtgacagatgtaacttctccctagcttggctctcgccctgggatacctgcaggtagagaat

SEQ ID NO: 20535 - DNA, 600 bp, Bovine  MMBT16263
gtgtrtttgtataatagttctaatagctaacatttgttgggcaatgtagcaagggctctgcttgagtaaaaacttactctttaaatcaaatggatgaagtagacgccartgttaaccttggcttttttaacaacgaaactgacacacattaggttgtgacttactaggtcacacagtcaataaatggtagcactgtctctgaggcacacatcattattatcctaatagtctctgtaagtgtctgggttccaaatgacttttacagcacagaacagtattcacaagtatcagattctcatmcatattacttttgttctttaaacatgaagatatattagtaaaataaatgtgagaatggaggaatttgaaagtcagcaagctccattcttccaaatcctaacattggagaatctgtacaaagaacactgcagttggaaatagtcttaactttgagtgtcccacttcaacccagtattaatttatatccaaactcagtttgtaagcaaggatttattttctagaaggtgaacagcacatgtacatggacctaataataaagcctgaaatctttcagtgatttcaaagacaccatgagatttc

SEQ ID NO: 20536 - DNA, 600 bp, Bovine  MMBT10281; identical to SEQ ID NO: 4726

SEQ ID NO: 20537 - DNA, 600 bp, Bovine  MMBT07679
ttaaaatcaaatctgcctgccgtacaagaacgccacagcaacctccctctctgatacatgcagcaaatcacattacgatcacttcagaaagggcctgccaggcttcccagaatgctgtacaaaatcttcctgtgttagacaaaaacatttcaattggaacaaatgcaggacctcaagatccaaatgagttcacatcacaaaaagcagccttcctcttattggaaacaagttacagattttcagctgtcccagtgtaaaatgcccagatccagccctttctcttctttcaagggcagcttyattcaggccaggttattgtatgttgtggatcatatttcttcccatgacaggcacataagatatgccctgtatttttagtgtattgacacatatatttctcaaaatgcccaataaaataaatattatcccaatgttacagaagaagaaactaaggctctgatactactctcctgcccctacaaactcccagaggtagtaagaggcggaaccaagtcttgaatgcaggctctgcaccctagaatcaatattcttggtttccctagtggctcagtcaagactctgcctgcaaagcaggagacc

SEQ ID NO: 20538 - DNA, 598 bp, Bovine  MMBT19544
  misc_feature (1)..(62): n is any nucleotide
nnnnnnnnnnnnnnnnnnnnnnnnnnnnnnnnnnnnnnnnnnnnnnnnnnnnnnnnnnnnnncgtcttgactgttgtttaaagagaacaagcaatccatcattgaaccagggagtcactttctcatagaaaagtaaaatcagcatgtgacactactcagccctagtgttttgcagattaaaatgatacatggcgactcacgtgttcctaggaagattaagtcagttatcttgttccgctgcccagacaaaagaattcccctcaagcagtgagtggaagctttacagaaacgaaaaagttsggctcaattgtacagtggtaaaacaaaatttagcaagaagatagaaacaagaatgttacttcacatgtaggcaacctccctgcaaaagatggtacaaagaagaatccatcctgaacaggggagctattaaatctttgtacaagcctctgctgtttgaggtgccaattttattaccagaaatagatacacaatttattgtctgactgccttagcaattgatttaaatacagagaaataaatgagcagccgctggccctggggcagttagcttcctaagagtaggttacaatcctgtagc

SEQ ID NO: 20539 - DNA, 600 bp, Bovine  MMBT08437; identical to SEQ ID NO: 4824

SEQ ID NO: 20540 - DNA, 600 bp, Bovine  MMBT00903
gcaagacgtgtcctaatcrggaggaagccctgggaccctgtggtgctttccaaacacacatccccaggcagtggggttccctagcctgcagggtccagaacgtggcacaggggatctgacgcccatccctaatgtagagcagggatgaagagatcatcatctgaaaactaccgaccacagtacaaaagcagcatggtccagcggctaagactccacgctcccagtacagtgggcccagggttctrtccctggtgagggaactggatcccatgtgccacaactaaaggatcctgcatgctrcaactaagacccagcacagtcaaatacatacaaaaatattttgaaaagaacaatacaaaacrgaatgaattaactgaaaaagtcatggacagtgcacatctgcactcacagggaaacagaatattctattaagttgaacatgtgctccccagtgactttgaagaagtgggagtttgtattcatggaaaggaggttggaactgagtgctgaggaagggaatttggtcactgactttaattatcctaaaagctttaagatgtctgaccagattatatttgtaagagacttaagaggagtcac

SEQ ID NO: 20541 - DNA, 598 bp, Bovine  MMBT02582
  misc_feature (1)..(89): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaaactgaagtgtggggcaagtaatattatggtaatattgtgtataggagagataataacaactgtgtatgcctgctactgctcatcagaaataattattacatgaacacagtccaccccagatggtgggaaatccagccactactactcctgatacagaccatagttgggagacaaatacatggcaatgcagggcgggcatggaaarcactggtataggacaggaattctcctgaacaactaatccaaaagtgaggtgccctgaaatggaaccagtcagccctcagggtggctaggtcaaccacaactttaaaaacccagtacatcagggaaatgtatagaaaacaggtgacccaatcccaatttcccatggacatccacttacctttgggatatctgaatggtaaacagatgggtcccacacaattaggattccttcattgtacaaactgtctttgaggaagcctgcttctgtggtgaccaactgcaggaagaaacagacaggc

SEQ ID NO: 20542 - DNA, 600 bp, Bovine  MMBT23240
aagaacatagtaattaattaaaaaagaaaatatgttgacaacaatttaaaaaaagatggaggaaggggctacaaactgagaaatgaagctctaggatgaaaacaaggaaatagattgtcccataaggcctccagaaggagccaggccctgctgacactttgattttggcccatgaagctggttttggatttctgactgtcataactgtmggaaaatattttttwwaaaaaaactagtttatggtaatttattaaagcagcataggaaattaatacaaagggaagagatgattacttgatsctttaatgtcacattgaaagcattttccaacacacctatttaggtgtcatctgactctttaggtctagagaagtataatttagcacaactaatgaggatttagtcattttacaattctgtaaaactgatgcaatgatattttctgtccacctaaagaagacatcacgattttggttcttattgccctcttgggcattaatcaactttgattctaacttagcaatgttattttagcaatcctttgtttttttaactgactgtatataaataccagttctcacatcctcttttgagttaact

SEQ ID NO: 20543 - DNA, 600 bp, Bovine  MMBT11779
ggactgttttccaaaaaaccttgcctggctctgaactgtctgtccyacaagcccacttccattcagttccaaacccttgaggcagcaaacccaagctcagttgactcctgacttgactttgtatatgttcttccagttatttgacttggacttccctctacaattgttagcttggtccacctgtgtgctctctgtgtcatctagagacttttgcctgactcaccccagtacctgcccccctacaagaagtcacagttccaccaccaccattgtgggactyctggagaggataagccagtyagggaaataattttayggagaggagctttttgattttctttaattcaccatgtaggtcaggagattatttctcagaaggaaatataaaataggggatgtaaacctggagtcttggtctagtcaagaaggaggtacaaacattttaaagagaaaaagtgatttaatctctctcctatcattccgccagatggaatgaagtcctctgggaatgtcgtgagggaaacatttatcaggaggatagtaaaggacttaggattattttgttatccaccttctgtaagcaagcacttctttttgctt

SEQ ID NO: 20544 - DNA, 600 bp, Bovine  MMBT18849
aaccttgcctggctctgaactgtctgtccyacaagcccacttccattcagttccaaacccttgaggcagcaaacccaagctcagttgactcctgacttgactttgtatatgttcttccagttatttgacttggacttccctctacaattgttagcttggtccacctgtgtgctctctgtgtcatctagagacttttgcctgactcaccccagtacctgcccccctacaagaagtcacagttccaccaccaccattgtgggactyctggagaggataagccagtyagggaaataattttayggagaggagctttttgattttctttaattcaccatgtaggtcaggagattatttctcagaaggaaatataaaataggggatgtaaacctggagtcttggtctagtcaagaaggaggtacaaacattttaaagagaaaaagtgatttaatctctctcctatcattccgccagatggaatgaagtcctctgggaatgtcgtgagggaaacatttatcaggaggatagtaaaggacttaggattattttgttatccaccttctgtaagcaagcacttctttttgcttttgtattttttttttt

SEQ ID NO: 20545 - DNA, 600 bp, Bovine  MMBT17665
aaagcagtgagtctcagaattaaggatttcatagatctagaatttctctctgagtggaccaactttgtgtcctatcaaaataacagaggcaaccattaattattaccagcgtcatttttgatttcttaaaagacattttgacatcagctcaagatcaagcatcagccttcaaactgtacatactttgaagttttttggggaaaacctgctactctgcccttatttccgtgtcattctgccacagacggtggagactgtcccctactcaaggataggggaccagagacagaacagtgatcrgctgttcctggtattcaatctcccctatcccgccacttgggaatgctggtgactggagaggtgtctatttcctataattactgagtcttaatgtaatcaccgaagcagagagccagctggaaaggatggagtctgacatcccgcaaagagagacagctaaataagtcatacggcttgcagacagcctggctgctggcttatgtaatcacctccgcttggctccctttccgttggtccgtttctccgtttggccttttcgtgcttttgctttctgaggctgagcctctacaataggcaggg

SEQ ID NO: 20546 - DNA, 598 bp, Bovine  MMBT05022
  misc_feature (1)..(50): n is any nucleotide
nnnnnnnnnnnnnnnnnnnnnnnnnnnnnnnnnnnnnnnnnnnnnnnnnntccccaccctcttatcttccttaactaagccaatgcactatttgagttcaatcttcaatcagaagaatatcgaaacacccaagaggtgctctctttgcttacacactgaacatgaacatgtattctgctactcccacacaaggggatatagagggactctgttacttaatctatgaaggcatcctgacataaatgtcctctcttttcagattcaaagtacaaatgaagatctactgaaaacttccagaayttagagatctatttctaatccgaggggaagatagaatctgctttggctcatcacatttttctatatcctttgagtgctaaccacaggaaatatttttaaactaacaagtcaagatgtaactctttctttcattccagaatctgactctcctctgaggcaacatgtgacactgactatgaaagaaataggaagcaaaaagaaaaaatgtgatttcagccacgaatagaagactgaaaaaactatccttaaattagtagagctttgtatatagatgttggttccctagggttaggctctt

SEQ ID NO: 20547 - DNA, 600 bp, Bovine  MMBT14238
catcttgcaatgcagaggacaccagtccgatccctggtcggggaagattccacatgcctcagggaaactaagcctgtacagcacaaccactgaagcccgtgggccctagaacccatgctccacagcaaggagaagtcactgcagtgagaagcccgcacaccgcaactagaaagtagccctcgctcactgcaaccagagaaagcccacacacagcaacaaagacccagtgcagctaaaaataaacactttaaaaaaagaaagaccagggagaggggactgttgctgtaattgaaagctgayctgagattttaaactcttctggcccaagtgagtttggtatattagctcaaatattggtcagatccccattcctgtctgttctttggaacttctgtaggctaaataaaccctctgaacatcctttccctcagagataacgtgggaatattagcccctgtctaccatgatggtttgaggagattaaattttataacgtagggctctcacttacgtcatagaggtgagcgccatctgaaattatgatattttgatattgctgatattctgtactccttatttcgccatcacccaaggagggat

SEQ ID NO: 20548 - DNA, 600 bp, Bovine  MMBT15045
ggggcgcgtgaccccgggcggaaaccgtattggatggggtgaagaagggggctggcattactcagcagaaaccttttgattggtcaagggatctaggttacgtcatgggggcgggacctactttaaagagccggcgaggttaaaaaggctgcatgtaatcatggatgaaataaaagtccgagaatttttgagaaaacaaaatagcaattttttaataaaatctttttactacaaaagcgtgatctggaaggcggggaggctgtacaggcgggagacagtccaggatcagggctgcatctytcacttcttcctcttcttgtctcccggggtccccttgttcttcttgccaagaatcttcagaaggctcttggacatgtagtagggccggtctgctgagccatcattccgctccaagtcttccactaaggcgcgacagagaccgtaagagcgaacctttgggaaccaaccccactacccgggaaaatgagggactaagagacagctgcctggtttccagactgcaccaccaccggctggtttggggcgcagtttttgtaacctatgtaatcgtgtcctcatctgcaaagtagggtgaacgat

SEQ ID NO: 20549 - DNA, 600 bp, Bovine  MMBT17465
cttcagcatccacttggagtaacttgggaccagaaaaggaatttactgtatgtggcagactcttacaatcacaaggtgagtcttgacagaattatataataccctgcttttcacttgtggtatttaaaatgctgaaagatctgtgagcctcctacaactgccactctaaactgtagggaggagtaacagtctttgacaactgtacataagcctctctattccttttttggtcctttctttgcagaaatgatgtgttagtactctgagctggggaaaggactaaacaaattcccaatgacratagccagaaattgggaattgcaagccactaaagctgttgagtaacatcttcagtaaataaggagaaggcaggtaacagggaaattaatatgtcagttaacaaatgaacatttttgagcctttgcatagttagcaaataattcgttttcatcaacatttctgttttctttgtctattttatttttactatgcatttttaaaataaaatcattggaacataaatattagtattttgtgatgagaagcttatgaatttaacgtaattgaaacacaggaatcacagcgtctaacataagtagc

SEQ ID NO: 20550 - DNA, 600 bp, Bovine  MMBT12226
acttcagagattctgtgtggacatcaacacgtgtcacttccagtaaactatctctgtaaaaaataaaacaccaatacttaataatgcttaaaaataaaaacagtggttttgtgagaaatcttaatctcccctcctcattcaagaagcccaccctacctgctttaacaaataggaggtccacttttgttttaatgctagttatcagaagctcactcttttgtgagtactatactccaaagacaagtagctctattattggtcggcttctggattatacttaactgaaatatcttacaatckctaatcgctaatctccccttccctagaagtctatcttcatcaaagagatggcccttcaaaaatttaataaggatctgtcacgtcctcttcttcagccttaacttccacagactaaccacccagattagcaatccaattcccaaaatcgactttaaaatataattcatattataaggtagacaccccaaaaacaaaggaatagacataaatatgcatttattttcacattactgttagataaatcataacacttaaataaatccactgagcagctatttactacaagactcaaaaacacaa

SEQ ID NO: 20551 - DNA, 600 bp, Bovine  MMBT14135
cttcttttttaaaaaatgcatttgtttttaactgaaggatagttgctctacagtattgtgttggtttctgccatacatcaacgtgaatcagccataggcttacatatgtcccctccctctttcctgaggatactctagttattatctcaagatgtgcgcgatcctgcttaaccactcttcctttacatatacaggaattagtcactatgacttagagcagggatttcaaccctctttagcctctagccagmgatatacggtgcaagactgtgtaagacaartattcctgctcctcttcckttgcactgtcaaacccagtgcaagcctgaactgrctctcacctgttgcctttctgcagcctaaaatttcattcaatttgaaggattcctctggctttattcttttcacttctttctactgtctttaatgctcatctctgtcttttctcttgtaaaattgtgttaacaagtcagcaggggtaagcttgctttagggaacttaaaaaggctctcccttctgccctccgctacattgcccccgtccatcactttgcattccgggcgcggcctcctccacagcctgagctcttcgtgtcgggcg

SEQ ID NO: 20552 - DNA, 600 bp, Bovine  MMBT05106
cttcctccctttgtgctaacaggttttgcacataagctcttaccaaaaaataaaattctctttgaatgataaattagcaggcacattcctattcacacgtggtggaaattctatcctagcaacagtcaccaaattaattgtcatccacaaggattgggtctgttttcttctagaaggagatttaaaaccattagccagacttttccagattcttttatgttaaggagttcattaggagataaaagcagggaaacaaatcccactgaaatgatctgtttgaacttctgactttttcmaagmgtattttgataacattctgtatgaaaaacatttgaagtgtggagcatgtggtctcttcaggtagctgtggtctcggcgttcagacacaacagcctgtatccgtcagcgcagctgtactttgaacaacctcatccggaagggagaacaaaatgtgaagggataagaaaagagagctgggtgagataatgtagctctacttaaaaactaatttaggcagataaatctcagcccaaataacctgatctttaacaaaagggggagggaaggaggaagcttcaamgttgataaggaaaagaggtg

SEQ ID NO: 20553 - DNA, 598 bp, Bovine  MMBT17026
tctttctatacaagtattgatctttggcagggttgagattgctctttacattaagaatgaacttgttcaccaaaatataattagcacaagaagacggaatattattaggggcctcattaatttcaccaagtttatttaaattgcagcaggatgtcaaatcaataatgatggctaattaagaaaaacccatctgatttccttaaagtacatggagggggtgccacaaaggctgcagtggggaggaaggtgagaagtttctgataaacagagatggtacctcctctcttaaatggaggggayygaaggtgagctaggtaggtgtccttgctgaattagggaaagggttgcctgcagtaggtgtgaaatttgaagtgattaactccagaggcactagaggcytgagaccccatgtcatcatgagacgtccctcttcccctctcagatttcattagaagactgtgaattagggtgaaaaataaggaatcagaaccagctggttttgaatcctggtccttccacttatccctkgggcaggaagatcccctggagtaggaaatggcaacccactccagtatccttgcctggaaaatcccatggt

SEQ ID NO: 20554 - DNA, 600 bp, Bovine  MMBT10583
ctcatagacacaggtccaaactgacatttatcattttttcttacttctaatcattctcaattttctcttgtggtggaaggctcaccatctgtccagtcttacaagctagaagcatgaggctcatcttagattccttcctctcttacctcccacctccaatcaggctccaagctgtgttgatatgactgggaaatagcccccagagctttccatttccagaatttccatcttgctgcagccgtcagtgtttatcaccactggtttgcccacagctctttcaccagcttccttctctccttmctccggtttatcattaatgctgctgccaaagttttccaccaaaagattatgaatctgatggtgctagagatccataatcctttatctaaaacttggagtgttgcaaaagttcagaatctttcrgatgaaagaaaatcaagatkcaggacactgtgtaggccttgtagtgtactctgagccatcactctatcctgaaatgcaaaagagcacttacatgaagagggacaaataaagattacaaatagcgttcatgtaagtttagtgttcactgacaaatgagtttgtgccaaactcatgaaa

SEQ ID NO: 20555 - DNA, 600 bp, Bovine  MMBT17377
ctgctctctggcaggtggattcagagctaagctccaagtctccagctctaattggagaaatctctgataaattcccacagcattccatttggatacgtattgtgttctgttatggatgttctctgccctgctcccacccataacaagtctgctggtataagcctgtcctacaaactgctgtggtggacagtatatctttgtattgatttgatggagctgggtttttctttcctagtctcagtggagatatctgtcagttcagtatcctattttgtaggaataatggacaaggcaaagtgrtgataaattctgatggtaagccaagctgtattttcttgctacatgagaagaaaacactcatcctaaaggcagtttgttctccattttaaattactcaaagaaagcatttttacccagatgctaccccctgggtctcctttgtcacctcaagcagcctaactcatccttcccccccgcgccccctgacacacacaaacccttcgttaattttttatgacttgtgaaagatctccactaacgtgaaactgtcctacagacactgtgttggccaaaaagtttgtcggtttttccataagatgt

SEQ ID NO: 20556 - DNA, 600 bp, Bovine  MMBT10322
ctcccagagttcactcagactcatgtgcatcgagtcagtgatgccatccagccatctcatcctctgtcgtccccttctcctcctgcccccaacccctcccagcatcagtcttttccaatgagtcaactctttgcatgaggtggccaaagtactggagtttcagctttagcatcattccttaaccaacatttattgccaacttcctacatgccagatcttattcaaagtgcttgtcacataataactaatttacttacaaaattcttatgatgctgaatagagctcctgtgagggtccccratttacagaygaggaackcaacctatggagccaaatggtggcactggaactcaagcctgtgtctccagagtcatcctkcttccactctgcaaagccrcctctcataggatgaaagcttctaagtctcttagcatcctggaaggcacttggtaaatcctccaaagacgagacatattattatcattattggatcccctcacagcttcttgaagaatgctttgtgcaaggtagtttaataaatttatgttgatttgatttagaaagaactctgttgtatcctcttgagcttctaagggatat

SEQ ID NO: 20557 - DNA, 600 bp, Bovine  MMBT13153
gattaggtctcttgtttggttgtgctgcaagcattatccaccctgaggggaaccaggctaaatacaaatcttcagattgatttaaccacaaatgtgtatttataaattgcaactgacttttctaattaattttgcatcgtgctaatggtttttctttgtaaccactgattatatcaggagggatccaagcyrgatctggagccatttgcagtcactgttagtgtagagagaaatgagaggaagcaataaagaaagcagcttcyagggacctaactcctggaaggtagttactgatttcamcaaatgtctagagaagcaatgcaatccasagcatcagttaggaagatccaccctattacccrttttacagctgggtttccttgcaactgaatttttttttttttttgctgaagaaaatgtttaaatgattattgcaaagtctgtgtcaaggttagacatcaaagaatatgaaatggcttccaattatgggaaggaaaagtcatgaggacagattttcaagaaatataaggtgtcaaagacagggctaaggaggaggagacctggatattcagggtacttttgcttcttaataagattcat

SEQ ID NO: 20558 - DNA, 598 bp, Bovine  MMBT07940
  misc_feature (1)..(69): n is any nucleotide
nnnnnnnnnnnnnnnnnnnnnnnnnnnnnnnnnnnnnnnnnnnnnnnnnnnnnnnnnnnnnnnnnnnnncgacgggggctgacgaaggacagcggctcagatcctgaccacctgggcggcagcacacggactctgccgcccctcaccgcctgtggtctgcctcctgaggtagagtcggccgaaggtgccccccacctggcctttggtgaggcgccccgggttcacacagacgcagccgaggatgtcctggaggggaggaaagagtgactgtgggtctggaaaggctgaaaccatgggcayggatgtgaagaagctggactcatctaggggttcagccccagaggatgttatagaaactggaaacaaaggcagacgaaaaccatctttgggccaatgtgttaatttattacagaaaactctgagtccctcttgtgtctccaaaacaaaataaagaaggtgactcagccaattcccaaacgtggagacaaacttgctctattggtttcacagcgtgaaaggtttacctcctgaggttggactggctctgctttggcaagaggaggttgatggggtacattcccccacgagagccygaacc

SEQ ID NO: 20559 - DNA, 601 bp, Bovine  MMBT09366
  misc_feature (1)..(1): n is any nucleotide
ntcccctctttcttgttctgggtggtgagttatacttagaaaaatggaggggatgttctggctcattctttttatgcttcatctctacacaaacttttcttttttggccacttgttatttttataatttttaaaaatgtaaaaaaggatagatgccacagatgctgcatattataaagggagytggacatggtgggaatgggttagtttgaagacaaactggcctagatctgaatacctcttcagccacgtgctaatctgagtttttagttaacatatttaatctccctgggcctccctckcctcttcttgaaaacagattcaagacttagatggcaaggtgagtaatatagtgtctcygagtatctcttgatttggaagaagcacatgcattgttcagcttgccctgaacacaggtctagatgacgatgtttaccatattgaagaaccttctagcaaatgcctrgggcccactggaatgatcaaattcactaaaatgtatgtttgacatgacagtgtggaaagtatttgtttcaataataggaaactaaaataaaacagaaatggatgaaaagctgtttgtaacggatagaaccttccgt

SEQ ID NO: 20560 - DNA, 600 bp, Bovine  MMBT08211
ctagtattaactagtatactattcgtgtgactagtataactattctctacacttatgtgtgttcaatgttttccataataaaagttacagtagaaaaaaatcatcagtcattcttattataaaaaagrttaagatattaagagatttagtatttaggaaggtgagaaggaatagtattctctgggaagagtgtgggacagggtgatgaatagattacagaattgtagggttcttttgttaagatttgtaagcgaagaagcatgtttttcaaacatttgccttgtcaaggaagtcagtttytcttgctcccytttcaggtatggtctcatgaagtcctgctggcrttggagtgaggacagccgcccctcacttagaaagctacastcrtgtctcgaaactgctgctcaaagtgcaaatgacaaggctgtgttgcaagtaccggagttggtggtacctgaactgtacgcagctgtggcaggtgtcagcgtggagagtgtctcctactgctacagcatcttctgaaggtcctgggacaacacccactttggggagatcgtatactcttgaaagcagtttctccaagaacaaagacttttctag

SEQ ID NO: 20561 - DNA, 600 bp, Bovine  MMBT18802
cggggcatacactgaggcaagagcagcagctggtgggygaagggaaggggagtggggaggacgctgtcctgccagggcacagcccagtctcaccccacagtgggtctggcagccaatcagggttctgctgtacatggctcgggttaggacatcccagaggctgtcaggggcttctgacagcttgatggtcattgtcacccctccagtgaagtccacaagggcttcagacacctgtccacgctgcaagtcttcataggagccagagagcctgcccaggaaaggaacagatgtgagagaagraagagtgtttctactgtacacaggacagtccaaacaagtctaaagaaccccctgcttggttattcccagggcatgtgtctgctatcccttcctcccatcccaggggcaaaaaagaaatatatactcagtttctattcctactgcacaagtccatccatcagggaaaggtaagactccagaaaggttgttccagtggggtgacccttacataagagaccctggatgtgtcacttctgtatttgctgagctaggcctcagtatctcacttgataaacttcccctgcctcctcttgccctccc

SEQ ID NO: 20562 - DNA, 600 bp, Bovine  MMBT19238
tgtgatgatgatgaggatgataatgatagaatgagttgataatgggcaggaaaaaaatgttgtggaacacagaatatcattacctaatgttgtttctggagccttggttgtatgagtgacaggttcaaygayggtaggaagaactagccaaaaacaataaaataaaccaaagagatttttaaaatgtatttgaagactaatttcagaagctaatttttaagcttcargacagagagaaaagagacacatacttgttctttgcagatctgaccaaattatggccaatatccattaacctcrtaagacaggttatgcactttgttcaatatcactgtggtcaacaagaagctctagatgtttggttatctgacccttgctagcatggaagactttgctagatgagctttctacacgtttatgaatataaacatgttagacttttctaactactggaaaaagcatttatcagtctatttgcacttctatacaagttgacatataaatgtctactaatttgttcactctttcaataatcgtgggtataataatgaattcacacattcaaaaggataaggatcaatgtaaaaaatgggacatgct

SEQ ID NO: 20563 - DNA, 600 bp, Bovine  MMBT20970
tgactacagttcatggggtcacaaagaggtggacatgactgagcgactaagcacagcacagcacacagcacacatgtattcttttaacagctgttaagttacagtataacacatagatagtaaaactaaacaagaaagcacacagccagaatcgcttcctatcattttttatattcccaaggagtagcctccaattatttttttaatataaaaaatattcttttaatttaagtttaattccatatagtcctatagaacaatattcctatgaaagtatataaacactaatttgcattcagygtaatattttgtttatgcacaaaagtcaactaatcctttcagtgagatgttttggtactatgagagtcttcattgaaacaaacttttaggagaagaattcatattaggaatcagaatcttctgataccatgacaactttgtgttgtaacagtgaataatttaaacccatgtaataaatgaacacacacaaataatacacatccattaactgatggatggcgcagaaaatagcaatgtttttgaaaccttgaaagaattttcaaattaaattttcaaatcaaattttcaaagcttttctca

SEQ ID NO: 20564 - DNA, 600 bp, Bovine  MMBT03813
gttaacacagtggctcttcaggatggagcatctttgtctctggcctcagtggggtagccaaagtacttagcaggcactcagtgcaacttcgttgaatgaatgtcgattccagtagttaaagcaaaggtctgaaattgtggtcctcaacccccacctccaccgccacacacacaccttctaggataaatccatcagttctagagtttaaaatagccccaagtgattttgatagaaactcaccccctcaatttgaaaactattgactgaaatataaaaacgcagcttttggagttgaagaaraggacatacagggtaaggagaaatgtattctgttgataaattgttactagaggacaaggaaaaaaagttgtctttctcgttcttttgcacaattaacctttagtaaaagtaaataattatttcaggaggtacactstgaccaagtgtgactcttgatgatagcatastgktttgttttctcttttattgttagacaaaaataatgccactttcaaagaactgataaatctgagtaaaactctttacagaagggaacaactgagtccctgtagcctattaagtaaagctccacccttggcc

SEQ ID NO: 20565 - DNA, 600 bp, Bovine  MMBT05003
caaacagttagttaaacctatctcctgctatgcagatctaatccagtggattgctcctgaatgtgtaactgtgtttaatgctaactttgggaagattctaggagaatatggccactcatatccctctgatcaaagtatttcttttgaagtctttttagagtggtaatatatttcatgttagaactgttaaggatgagggacccaatggcacctttgtctggaaagaaagaggatacctaataattaagtgaaatggcaattatacctaccatctcacactaatattctacagccttctgmaagtcataaatcaactaagaaattactccgtgtcctgtgatgtcttcattttgaatatgattagaaagtattaaaaatatgtgtgtttattttcttggagtattgggtaatctacattataatatataaaataattttcaataaagctggtcacaatattccttacctcttctgataagtagaattttacatcatagtggtttgaattttgttttgttttttcttgttgtcttttttattctttacggtatgacaagcttgtttttcaacttagaaaaaatagttggacagttatagatt

SEQ ID NO: 20566 - DNA, 598 bp, Bovine  MMBT01756
  misc_feature (1)..(224): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctagtattcatggtgataaaaactactctctgaatgtagagagatgtgaaatttgtataattctagacatgtttrtcttaactgcagaagtcccagaagaatagattttctcacgtctccatggggtgtttcttaaatctattactttatgaaattaaatattggcatatgaaaacctcagcagctcacttattacctaaattaaaatgtgttataatttgaattttgttcattttaaattgagtgaagattaacagcataaaggaggtttggtaatggaaggtaagaatgtaaaaagataaggaattggcaggatatgcgattttgtaaatggttcagtgatttactctttttgtcccttttgtataacagt

SEQ ID NO: 20567 - DNA, 600 bp, Bovine  MMBT11296
caggggggtagggaatgtgttgacattttggccctccccattttgcaaaatgtgcagagttccacatggaactcgccatgtcggtgtagctgcatgtcaaccttggtgcttttctgcagagcatgtctaatttttgcatggctgtggacagtaatcagtaatgaagtcattaaatgcaagaggggtggagagagaactgtctgccaaccttctccattaaattcaggtactttggcacatctctaattaagatcaggaggcttgagttccaattgacaaagcactccatccccatgatamgcagtcaagagtgctcgagggcagagytaatacagtgagcsgggtaatggcttggataattccaataaagatttccagttatacgagattctagaggttaccggagctctccagagaaggcgctcactctaggtgtgtggctagggtctcctagaactacagagacatgatagtcacgagggcacagctgagtgattcacctggagtccaagggtgccaccttagatccctgggactcagcacccctcttatgaaaggggtggcatctccctcggagctctgagatcttcagcattaagt

SEQ ID NO: 20568 - DNA, 598 bp, Bovine  MMBT18117
  misc_feature (1)..(81): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnctgctaaaaaggttaacatctccgagtcgccggttaagttcgcgctgcagcctgatgatatacttaacagcagcaaagcgcccagcaaatttcctgcaacattagctgcatttaaaagtataatcttatgcagctttttcttgctcaacaacgtttcagaataatgggggaacgcrtctatttacaagggagaaaataacacacagtatttaacactcygtgcgatgcttacaattcctttaggtgcaaacccgtaaaaacagacaaggggcttgaaatactctccacaagcagaaaagcgytggaacctgggggaccataaccaagtcgcaggttatcaaaggctgaggyttgtctaataagtgggtgcagggcgcacgcgtgkttttagacgtaattactatatgcagaagggaaaggcttagcccttctaactagcacgtaatgagcccctcatcaatagggtcctttataaggcttctctctgtgcagcagggcagaactgactgctgggctg

SEQ ID NO: 20569 - DNA, 600 bp, Bovine  MMBT03946
aaactgctgagaatgtggcacccttgtaaagaatgagcattcaaagcattcaaaatttaattccagatatacaagcaataattctcaaactgtccaggttctgctaatacagaatgacacatttgagaagaaaacattcatttccttcctggtgcatttccaagctgtctgagaagctgaaattttctattacataaaaaaaggccacaaatattcttcagtgattgtccttgatacacagtccctcaggctcaaaaagaaaacagctctcattatgctgtcactacaaagtgcacataytgtgtgtataaagagcaaaagcaaataaataaataaagtccacaacagaaacatgagcgaaaattgctgcaacaacttcattactagggattttaagatgctaaagaggtaacgagtaggaaggtacaaggagaaaaaatggatgttaagatctgcacaactagtgtggattttcccaagggcaaacttcacttttattaaccatctaaggcagaaataaatataacgtatggtggtatctgcagactgctatgacatctttactgtttctggtaaaataatttagcaactgcacccaaa

SEQ ID NO: 20570 - DNA, 600 bp, Bovine  MMBT08599
ctgcgaccccagggctatacagtccttggaattctccaggccagaatactggagtgggtagtccttcccttttccaggggatcttcctaacccagggatcaaacccaggtctcccacattgcaggctggattctttaccagctgagccacaagggaagccttagaaatcatttaggaacccaagaacattgggtttccttgccttcatcttcccacattggtctttttctaaagaaaagaaaaaatatatagctgcagttgtacaagtgaacacttccactggaaagaatacaatgatayagcccattgaggggaagcatcagaaattctaaggacttcacatgctaaacacaattattcattccttgtatggttccctcccaactattttcttcctattcacatmgtcactcattatttttaatatttattttatttatttatttggctgccctgggtcttagctgcagcatttgggatctaattccccaaccaaggactgaacccgygccctctgcattgggagcatggagtcttggccactggaccaccagggaagtcccaccaatcattactgacgatgcaaactttgtaaccata

SEQ ID NO: 20571 - DNA, 600 bp, Bovine  MMBT00998
taagagtgcccactgtggatgctatacagttattcaagtataaaaattcatttacgatataaaaactcattttgcagaatttctttatggaacaagatacaaactacatcataaaaacatcaattttattaattttctttgtacttgttcactattactaatcaaaaactatcatatytgtcttgattgttctcatccagtagagttggttttattgttatttctcttgagtctttccagacctcagattcggtctctgatgatgaaaatgtgttgtgtccctaaatactgggaaaaaakcgacaatgttttgagagtcatcccagaaggcctcctacatgtcacgttctgaactaaaacatctgcagacgaaggcgcctaaggagatcacttttgaaagagcattgcttagcttgatgtgcaattataggagatcatttkcccgcatatataaaggaaaataagttctaataytgagtgagattagacagaacttctagaattatttttgctactcaacgtagcttataccatatcccttaaggggtttgtctcttaacagtatggagagttrgatcccaatcacatggtagtatttca

SEQ ID NO: 20572 - DNA, 602 bp, Bovine  MMBT04736
  misc_feature (1)..(2): n is any nucleotide
nngtaagtcctttctctcccttttctgtataataaaactttgctcattgttcaaacctcaatactgcttttgctctgaagggttgtcagatctctcccccctcccaagaattggctgctctctctactgtgggctcatagtgtttcctgcaacttccatgtatgtgacagctgtgagtcatttaaaggaaggacctttcccttatccataatgtaccccagaagccttgcatagtgcttggcatctcgatatgaatacaattagacactgtcaacctgacttcagtgcccgaagagactagkccgatccattttacaacagtatgtgattactcgaaataaaattaaaaagcatctgctatggtgtgttgagggtcaaatcttgccagagtaattgagttttgttctatgataaygtgactgatggtagcaaggaggaatcatagggtgactgtatactgaatgaatgacccactctatcatgattttgataaagctcttaattttttccagagagctttctcaatggtaatctaggaagacattttcccaattatacaattttagtagatgaggaagtaactatcaaagaaaggcttctat

SEQ ID NO: 20573 - DNA, 600 bp, Bovine  MMBT07206
taaggggattttaagtctactgtcttaatagtcctttgtagttctttggcacctggcttttcttgaagctcaaagtattttgcaaacattagctcattaataccgccagcagccttgtgaagtgggtagtgtgaatgtcttatccccacttgggattcttgaatttgaggggaaaaggggttctggctggtgactagtgcctggttgaagagaggccccaggggttggaccaaatttaatactcatgtttgtttctcatcccaccagaagaacrgtggatggtgagagaagcgcaagccmaatctggataccagttgaaactaggcttctccagctgtgtgaatttggaccagtccctcaacttttgtgaaactgagttttcccttgggaaaggggggctgatgataagaattataaatgtaacgttgttgtactgagttgtgtcttacccttttgtgaatctatggactttagcccaccagactcctctgtccatgagatttcccaggcaagaatacatggagtgggttgccatttccttatccaggggatcttcctgacccagggatcaaacccatatctcctgtggctcctaccttg

SEQ ID NO: 20574 - DNA, 600 bp, Bovine  MMBT07966
gaagtccaaaggtagtcttgatttgtagcatttgctgatctttgaggtgctcaagccataatcaagctagcaatgtgacgtcactgaagtctagagaaagggaaaagatgcccagcagcacaccattacatagtacttctaccatacagatgcgtgagatataaataacctcaagagcatagataatagcaaagttgtagtaaaataattaagaagtgaaacattgtgaggattttaaacctgtattttaaagtaattcatttaaatgtaagtttgtgtgatttaacttttagcaatgaytgtttaacatccagttytcaaaattcctgaaattttaagagtcggctctttgggctgatgtgagctgactctagaaccttcgttgcatccccctccttacatctaacttattttgctggattgaattattttcttcttactgaagtatatccacttgtattctttcagcaaagtttgtgtaaggtaaactcatcatcttcgcttgtctgcaaatggctgaaaatttggtgtcacttatgaatttaacttgtgcagaattgtagtttgaggtttattctctttccacattttgaagatatt

SEQ ID NO: 20575 - DNA, 598 bp, Bovine  MMBT02806
  misc_feature (1)..(3): n is any nucleotide
nnncccctggtacttaggatcagagaagcccttagttaactactaatatattacacaatatcatagaaagtagaagcttcagaaatgaaaaatgttctggtctgtttattttaagatatagctaaaagcttgattttatgttatgtcagtttctatagttaaaagctgcattaatgtggctgaaatactttgaagtatgcagagataaaacaaatcagcaggtatttaaactgagggctatgaggtggaaaaatcatcactttcccttcaggtagaggcctgaagatatatctttgttartgaggtttcctgctgtcctgctggatcttcaatcatttaaaatgcaaatcccaaagaatgaagtaagagctatcctatataaaagaaggtggctgatttttttttttttttaataaatgatcatgccatctgcttacctcatcattctactgactatgaaattcacttatgcaattatatgaacttgtaaactataaacaacataccttagaagtccgcaaatggaattattacttttcctgaatgcccaatctcctcccatagtttagagtttattcatatggtcaggaaaacagga

SEQ ID NO: 20576 - DNA, 600 bp, Bovine  MMBT02456
ctgaatcctttctcctttggcaaattctgatctttccaaaaagaacccctcccccctccagattcatattcaaatgctcctatgttcaatgatccttataatgcagtttgatgttttagtatctcaaatgttgattgagttcaagtttaaataatactgtcaaagttgccatagatattttgaaaaggatacccaaacaatgtacttcacaaagaaagatgaataaaatgatgcatgattggatacatttcacattgataatcaacttgctaattttagccaatatcaaatgttaagcayacaattttctgtctgctgaggttgtacatagacctgtgattatttctggccactgatgtgtgagtggacgaaatgggtttcacttttggactgctaagctgctgctaagtcacttcagttgtgtccgactctgtgccacccaatagatggcagcccaccaggctctgccgtccccgggattctccaggcaagaacactggaatgggttgccatttccttctccaatgtatgaaagtgaaaagtgaaagtggggtcgctaagaagtcggacacgactgagcgtgtccgaatcttagcaacc

SEQ ID NO: 20577 - DNA, 600 bp, Bovine  MMBT07655
ggcagacatggtgctgtcaccttgcgcttcacatgctgccttttggtgttgatactgacttcttcatcaacttcttgtgaaagggagaacccgctgtcacaagcagtctccaaaggacctggtctggaggaagctgcatgagcacaagaaaaagcagccacagaagatccgagtcgggtcaactcattgctctaaatggggtgtgagtgaagtagtttggtccaaagataaaactcatgggtctgctgttccctccggctcaattatcttccaacttcatccaggcttttctcagctgtyacctcccaagagacaccctctgaattaaatcctccaacattctgcatccattatcctgctttgcttttcttcatagaattttacatgacagttgctcattaatttctcgtctgcctcctccccaagggaaaggcagggatactcacctgttttgttctctgctgagcctagaacagtgcctgacacatacacaggaggtgctmaagaaatatttgctcagtgaatgaaagaaggagaggtcctctcctggcagrcataaccaccagyattccaggcaggactgcagagttgacacccttc

SEQ ID NO: 20578 - DNA, 600 bp, Bovine  MMBT09850
ttgcttcagtcatttccagctctttgcgaccccatggactgtaccccaccaggcttctctgtgcatgggattctccaggcaggaatactggagtgggttggcatgccttcctccaggggatcttagattcctttactaaataaaatagacagattatttggatttttgcttaattgcatttgtaagtggccaaagtattaagccatacataggcaggaacaccaaggccttttctaagtctagtctacaaaaatgaggctgtaaactcctagagaatgggcagttatcttttggattatytgttttaaggttatcccttactgagtttttgccttgtcaaagaaatttgctttatttataaactttctttcttgctgagaaattgcaactccaaaattttaagaacaaaaccaaagtagtaatactcaataatgggtgaaaaaatgtttaaaatatcctactttctgtctaatattgaatagtcattggaatttgtgacgtctactggagacastgtrtaacagctttaaaatatttccttaggtaaaagtgatacaaataatcctggacctgaaattaataagattcgaacaccagaga

SEQ ID NO: 20579 - DNA, 600 bp, Bovine  MMBT11077; identical to SEQ ID NO: 4530

SEQ ID NO: 20580 - DNA, 600 bp, Bovine  MMBT01372
ccctgcacttcagattcctcacctcaaagatgattccttgtactcttctcaggactgttttaaacataagcattaatatctgaggatagctggagaaaatgaaaatgttattctaatgttaaattaatttgcattccaaagtggaggrattctgctcgagccagccctcccttccttttccttctatccatttagcaagtgctgagtgccaaatgcccttgttgggcctgggctacgctgggcttacccgcacttcacagacaatctccgtacctggtttgactccaccacctttcctgyctagtggctcacgtcgtctcacctcttgtaaccacctgctgttcacagccttggggcaaacagtagtctacccatttcatcttcatcatccctgcgtgaaaccctgaggaagaaatcagctcgcacactgcgtttcaggcccactgttacccccatatgatgaaatgtacacagagaccctcaaaattggtgttaaaagcacataaacctcttggattgttgagattctagcccaagcagggtgtgtgtgtaatatcactaaaagcaggtatgatggataaaaatgaatgatggcccctt

SEQ ID NO: 20581 - DNA, 598 bp, Bovine  MMBT05874
  misc_feature (1)..(184): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagcagaagaatgagagtgtggtgtctaaattaacagcaagttgatattcagggctgtgcttctgttaaagaaccagggttgtctcttttgaaagcctgagcccaggctgcctyctccatgcccctgaacaggagcaactcttttcccatgcagccccagccccaggcctccttcaccccaagaagtaaatgcagggagatgtcctggccagtcccaggccacctggtggttacaattctgtgttatttactccaagatcacatgaaacacacacctgtggtgggaaatatttaatgcagatgttgggaagcagctttgccaaaattgtcagaaaagcgcatgtgaggaaattacctcctggtccctcggtggggattacgtcttttatagtctccgtattttgaagtattt

SEQ ID NO: 20582 - DNA, 600 bp, Bovine  MMBT00831
ttgtcatatatacactgaattttatggctaaatttgaattatctattatccattctattatcaagtaaaatacccaataaattacaaaatattaaacatcgataacactaaaaagaagtaaaatatctttcagagctagtttaaaataaaagctaacaatatttcttttaggttaatcaaggcatcaaatctctgtatattgttctttattcataatcctctctagagtacaaccatgtgatttttgcacttactgttttactgtagattgtcacattttaaaaagaatcaaagttacayagctactaggtaagccaaattattggtattaaatgaactgtgattattaaatgaacacaccacagtacttgagcttaattttcacattttcagaggaataattttctgcatattttagatatgatgtcaaatcttagaagtatgtgctctgtgaaccatttttgataagcacagcactgtgtcagttctgtatcttgcattgttttgctacaacatgaatatcatatgtcctaagatgcttggtctagtaacactgttattttgttatgcattagtaaatatagtttcatagcctgtttt

SEQ ID NO: 20583 - DNA, 600 bp, Bovine  MMBT11775
aaatatacatacatattcatgattccaagtgtatgacatctggaaaagataaaatcatggaaacagtaaaaagtcgtggagacagtaaaaagataagtggtttccaagagttcagggagacggaggaatggatatgtggagtatgggagatatttagggcagtgacactattctgtaggatactctaatggcagattcatgtcattgtacatttttcaaaacacatagaatcaataatacaaagaacaaaccctaatgtaaacatgtcaagtgtggatttttgttaataatggctttaaycaatattattcatcaatgtatggcaagtgtaccacattaatgcaaaatgctaataataggggaatctgrgtgggtaaggtaggtttgaagaggtatatgagaactctatgtacattycactmcatttttatgtaaacctcaaccagcccattctgaaggagatcagccctgggatttcyttggaaggaatgatgctgaagctgaaactccagtactttggccacctcatrcraagagttgactcattggaaaagactctgatgttgggagggattgggggcaggaggagaaggggatggc

SEQ ID NO: 20584 - DNA, 600 bp, Bovine  MMBT10179
atgaaggatctgataccactttcaaaaaaatcttgtttcacagaggaacaggctgagtctcctagagtcaagttttagggtgctccgtctttggcctctcctctaaaaatgaacacctgtccttgactcctttctcccccacacccaattcctcaataattctgtccaatccctcccaagtctgtggagaatccatacgtcccagtccttgtcatcactctcctaggcagttaccatcacccagttctcctggcttcaccctctacagagagcagaggcagttgtaaatgcctgagcctrattaagtccttcctctgcctagaaccttccaggagtactacttcactcagagcaaaagaagtttctcccctgggtccataaggctttgccccacctgccccattattttcctttgtttcttctctgcctctccatccttgctccaatagcactaagatctttgcttttgggagaacacacaggcatattctagccttaggacctttgcacctgctgttccccaattctgaaatgctcttccttcagaagttcccaggacaaggaattccctagcagtccataattaggactccctgcttc

SEQ ID NO: 20585 - DNA, 600 bp, Bovine  MMBT10485
aactgtatcatacactcatgtttaaattagggataattttggccacaagtaacagaaaatctaacagcagattaaacaacatggtaatttgttttttgcccaaagtcaattcaaaacagagacaagtgtcagaaattttcagagggagtgctctcagaaacatcaccttaggggatttgaagcaagcaggactctgggtagagggagagttggcctgaagttaatttataataagacctgaactgaacttgtggggagctccaaagatggatggctcttcagagatggttttcccatgtyraagagagacacccaggtatttatactcccacatcaaccagacgttgaagaggggcttctccagggaggaggcaaacatatcctcagtagggaggtgttcttcagctgataaaattctggaagatggcttgacagctgagggatgttagctcataatcttagcagttggaagaataaatccttcggtcttgaagggggaatctaggagcccataacctcacaataagactagctatttgtagttgctatggttttagttcacccactcagagatgtcagaccttctgcatatttgtttgt

SEQ ID NO: 20586 - DNA, 600 bp, Bovine  MMBT16526
aacccccattatccccagcccctcagcccctggcaaccacccttccactttccgtctcggtcaatctgactgatcttggtatctgatgcttctcagcaacccaatggtccataaaccagcagtgagagagccctgtaagttaatgcagggaaaaggcaccataaggcccaggccctttgttctgggcctaagtcaggttcacaggtgaatgaatttgtctcctgtaaaaatactgagtcaggtaagttgtcctgtaagtttgttaaagacattttatcaaataaactagccaatgtatcrtaacatatagacctaactgtcctggaaagacagaagaaacaggcaaagcccaagcaggggaccattttgcacatgggcagaatgctgcctcagggagtcaatccactagaatacgacttgcagcacatatgacagctgagacttaatttgatgattcaggattatcaaggaaagagtaaatactgttccatgtatcatttactagagtagtaaaacagtatatatttaagggggaaaagttctgaaaaagtgcttgtgtgtgtgtgtgttagtcgctcagtcgtgtccgactcttgcaac

SEQ ID NO: 20587 - DNA, 598 bp, Bovine  MMBT16766
  misc_feature (1)..(174): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgtatgtgaagccaccatatataagtacttactgtatacaagaccctgtgttaagtacttcgtgtacattatcgagcctcagtacatggcactagaactatcttacagataagataaagcttrcaggtgatgaacttgtctaagatcatacagttattaaatgacaaatctcagatgtaagtccaagccaaaaattcacaataaccactgctactgtgtccatgtgatccacagaattctctgtgagactgagccaaatcagcaggcagtgaacactgtgaaaattcctgcagtcaaaaacacatcaagtatctaatttaaatttatggagtaacagccaaacttacttgctcatggagtcctcccctttcctccatacctttaaactgctcttagacatattaccctttagacaccatga

SEQ ID NO: 20588 - DNA, 600 bp, Bovine  MMBT04462
gttaatttcttcttccctgccattcacaggtggacagggtcctgaacaaaggcactttagtttaacagtaggcagaggggcagggttttctgagcaagccatcctgtatgattataataacaaaagcgatgaaaaacaarctgaagaaacagttccagtatggagccacaactggctcctccctgcgacagaactaggtcyaaggccattgtgtggggcacgttgaagagacctcagaaatacgcagatttgactcccagtcctgctaccaaagttagctgggtgaccttgggctagatrcatcatacctctgactgtcggagagagagaaaaataactaataatacttcctatgaaaggctgttgtgatgattaagaaatatctataacaaagaccaagcacagcacccaacacttagcaggtgctaaaggaagagtagctctgaggagagaagagctttcaaagaacgtgcagtaaagwagagaaaaatgaaaggacaggagaaagcagtaaagcaccaaatgcagccttrattttaacctcccttttcctcacttgctctcctgcaatggccaagtaasatcacagccggttaagta

SEQ ID NO: 20589 - DNA, 600 bp, Bovine  MMBT15013
accataggatcttaatatgcaagagctttttgctcacatgctcatgaggatgatctacatggtttaagcaaagagctttggtttgactttttcctcctattataatccatcctacccaagaattcaaatatgcaaacaattattgtgtacctactaagggcaaatgacagtgttggatatacacaaaaagaccccaggcaccttaaagtaataaaactgtcctccactccttatgttaactgaagacatattatcagcagaaaaagcagcacagttatcaaatccaccctgtgtaaatayagtsaggaaaaacatctttttcttttttccatcatgcctaatcatctttaacactactgtttaagggtttgctcctattcgtggagacttacagactgagagagatacaaagcatagtcccagactttgaggactgtctaataccccaactctgaacctcttcaaatatctagccaagggcaatgcaaatgatgtaatgctgaataataaaaatggaaggagcaatggaataatwaaaaagggaaaaatgtagagaagactagcaacattcaccaagagataaagaacactttctagaaa

SEQ ID NO: 20590 - DNA, 601 bp, Bovine  MMBT19034
  misc_feature (1)..(1): n is any nucleotide
ntctgkggcgtggttaacatttcattactaaattggactttgaaygcatactacattttccctcacctcacagatgtctcttkaggctcctcatgagttatacatctgtggcctgctggcactgccccatgatgtgctgtgaaagaaattgccaygatgttaatttgctttcatctcagaagtgagatctcatccctcttttctgtgtgtatgtatctctaagttaaaatgatcattgcacgttaaaacattttggagagattgctttarttttatgagtatccaaagcgagtggtacagycccttataggctctctagacagttatttgggtttggattatagaatcagtgcctagttaatgttaatgacctttatctttaggtcattttgctaatatattattgtaaaggaaatactgtcaacgtgaataccatgcgtttcttatatgattaaagtaatgcactaaggaaatgattcagataatccacatgattcttggccatgtttcaaggaaagaatgagaagaacttcctgaactaatttacatttaactgattgtaaattgtactaagattctcttgtcaaaaattctacttggt

SEQ ID NO: 20591 - DNA, 600 bp, Bovine  MMBT03978
cagagtctggggaagaaagccaccaggcctagtttaatttcagttcggcttgggagtcctcctataacaccgggctggtcccacagcctgcgtatgaaggtggggttgcaaacacggctgttatatttgaacctccgtaaagctgcaagcccttatccacagcatttgactccgcctttggtccatcccaggggcctagcaccagggcctgcacaaggctgttgccagaaaaactatttcataagcgttccgtggcccctctcagccccccagcacccaccgtcatgcgattcctccagwaacggtaaactgttatctggccctaatgacttctccaaatggggcctgaagggaaggtcccagtcagggcaaaacgggaaggaggcagccgcgagcacccctgcgcacagcctggaccaggagggacaggcccccgagcaagagaaggggccaggcagaggctcgcggccggacccggcttcccaccccggcccaggcagacaccgccccatgtgccactcacagcttctggttgagcccggcctggctgctgggctggaagtcgctgacgataatgccgagctgccggatgttctccac

SEQ ID NO: 20592 - DNA, 598 bp, Bovine  MMBT05829
  misc_feature (1)..(225): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagtacatattggaatcatgtctctaaagcctaatttcaccatgaagccagagttattagaagcatatctttcytgcaaggaaaatttaaaatttataaacatactggataatggtcttggtggctcagcagcaacaaatacataatttagtatttgggcttattctgattgccctacacacatcaattatcttcactcccagactgtatattaggttgacaggcagtattcaaatttaggtctgtagtcaccgttccactttctcatcacaaggattattacagatatgtcaagtatattgggaaaattagaaacgtatctaagaatattcataattaaatgtttaaaaatttactgaagatgatataatt

SEQ ID NO: 20593 - DNA, 598 bp, Bovine  MMBT05435
  misc_feature (1)..(74): n is any nucleotide
nnnnnnnnnnnnnnnnnnnnnnnnnnnnnnnnnnnnnnnnnnnnnnnnnnnnnnnnnnnnnnnnnnnnnnnnnnttgtaacagacggggtttccgagtatgaatgcttgaaatgggactgggtgggctcatgaggaaggtcaaagctcgacgactcctgcactggatccagaggcaccatcccccttgcgagcatctcaggcccatgaacttgacctgggacctgaggacaaacaggttgggcttgtgggtaaattactttttaaacaggaatttagacaaacaaaaagacagtaagtaygccaggggctgggcgagggccagggccagaatacttttttaacagccaagcggagcaggatctaagtaccacaaagactataaatccaagctttaaatcagtaactctctctctgctccagtctcaaagtccacgtgctgctcacacatcacatgcgtcacctcgcctcacctgctgycctgacaaatccagctccagatcctccagcaaggtcacggcctcctccccgctgtcaggacggtactcctgcagccaggcctggagctcccggggcagaatggagaggaactgctcgagc

SEQ ID NO: 20594 - DNA, 512 bp, Bovine  MMBT22319
ggccaaagccacatacttaataagcagcagatccaggagttgcctgtttctgacaatgctggtacgaggctggggctaccttcaccaaccccctatctccgccggctgttgcttttcagtggaggatctcacgaccacatccaagggtatttggatatagaggacttccgacgagccacggcagcctcttcagtgatggtggcccgggcggccatgtggaacccgtccatcttcctcaaggagggtccacggcccttggaagaggtcatgcagaagtacatcagatatgtacgtctacayactttttcacaacaaacttttctgtctgtctgcccgctttctgcagaaagtgctttgggtgagcctccggtccccggaagcccatgtggttcctctctttttctttgttgtgttgcgaggcattgggttttcctggctgcagtgtgaagagtgggctgctggtggggagggggtcatggccctaccgtcaccctcttctaaagcctccaagg

SEQ ID NO: 20595 - DNA, 600 bp, Bovine  MMBT09613
tcttcagaatggtttgattttcattaagactcgtagctggtctgcagccagtgtgtggatgggcatcctgtgtatgaagagtcctgaggcattttgaacaccccatcctgcattccctgtgcacatctagagtgtttccatgcagagatgtccttgtgctacctgcagagcagtgtttggaggctcaagtgtttgttgcctgaggcaagaatgagtgcccttcccaaaaggtacgcctgagatattgagaggttggtgacttaataaccagaagggataccaatcaaactgtaacacagygccaaacactgacttgtccccttcccaattttctcctgacctaggctttggtaacctaacctgggagcttcgtaagaagctccatctctctggctatgctctgcactaaccctggtaaaagttggcagtcagaaatattagtggactctctgtggttgtaaccaattaattcactcacctcctccctaattgcagtgggtgagatgctcaccagctgtgattacaaattggttctgtctagttgacaagaccttatcaggaaattaaaataaagtgatctggcttacaatacatgaagca

SEQ ID NO: 20596 - DNA, 600 bp, Bovine  MMBT12877
catttatcctggaggcactaaagaccaattgggtcactgagctgtttctaaatgtagaagatagttcccaaatcaattatcaggagatgctgtgtgaaaatattggagattattgattgactgaactatatacatttcttccatgaatagaacacagaagtagcctttatgtaatggagtatacctaactagtaaacaaaaaagtatatagacatgtgttagagtaaatttttaaaaaattggaacctcaatccccagtagagaagttctttgtgtggcttctttgcagtcttccatttytggtgcttgcataaacttgaatctatccacttgagagtcaatgccagtcaaccagaaggtcatgatgcatcttaaatyctgttatgatgtcaaagttatgggctctggcttcacattcaactgagggaaagagctgtataatatgataaaagatacacactgttagtgcctatagcaaggacattgtgctaatactacaagagaatcacatgagggatttgtgaactctgctgtggagactttcagtgaggagcagatatttgaggaggaccttgcaggataagcttgtctggctacagt

SEQ ID NO: 20597 - DNA, 600 bp, Bovine  MMBT20214
atcaggagatgctgtgtgaaaatattggagattattgattgactgaactatatacatttcttccatgaatagaacacagaagtagcctttatgtaatggagtatacctaactagtaaacaaaaaagtatatagacatgtgttagagtaaatttttaaaaaattggaacctcaatccccagtagagaagttctttgtgtggcttctttgcagtcttccatttytggtgcttgcataaacttgaatctatccacttgagagtcaatgccagtcaaccagaaggtcatgatgcatcttaaatyctgttatgatgtcaaagttatgggctctggcttcacattcaactgagggaaagagctgtataatatgataaaagatacacactgttagtgcctatagcaaggacattgtgctaatactacaagagaatcacatgagggatttgtgaactctgctgtggagactttcagtgaggagcagatatttgaggaggaccttgcaggataagcttgtctggctacagtccacagggttgcaaagagttggacaygactgagcaactaactcttcttcttctttgcaggataaggggcttccctggt

SEQ ID NO: 20598 - DNA, 564 bp, Bovine  MMBT00774
  misc_feature (1)..(15): n is any nucleotide
nnnnnnnnnnnnnnncctgaattttatctttttcaggaatgggatatggagacagaacaagcacattttgtggcactcctgagtttcttgccccagaagttttaacagaaacatcctatacaagggctgtagattggtggggccttggtgtccttatatatgaaatgctcgttggtgaggtaagtagtataagatagataaaagggaaagatgattgagagaacaaagcatggcatttataaaaccacttaatatgtttcctgcataaatagaacttaagctttataaatacttacatgyattagtaatgctcatgatcctatgtcaccttcactgtcttttttaggttgttatgtttgtggaatgtataccagtggtttgaaaatagtttatctgagtgttgctatgggcttcccaggcagcgctagtggtaaagaacctgcctgcttgtgcaggtagacataagaaatcaggtgcaatccctggatcaggaagatcccctggaggagggcaaggtaacccactccagtattcttgcctggggaatcccatggacgaaggagc

SEQ ID NO: 20599 - DNA, 600 bp, Bovine  MMBT00061
gtggtcaacttcgtgctgccgcctgtgttcaagctcattgcacccctggagggctacaccaggagtcgccagatcgtttttatcctactcaggttctggactcttggcgtgggctgggtctggccgagggacattggttctaccaaataagagactgacatcgtcaagatatgggatccggtgggatctggattcagatcccgactcctcctgtcactgagccccagttttcttcatctgtgaagcggggagaactgtgagcacgctccacacaggagaatccggggcacgtggtgggcrctccatcagtgttgatgccctttttctcttttccacttgccaggacagtgtctctccgcctggtctccctgctagtcctgctcttctctctctggaatgagatcacttgcgggggtgatgcggcaggatgagaggtgcaaaacctgtggctataattacaaagaacttccggggaggatgcggggactcctgggtccttgaaggaaaggaacaacccggtgggtcccagattcttggtttgggaggaaagaggagcttgtggtgctagaataccttccccatgaggacaggggtatggat

SEQ ID NO: 20600 - DNA, 600 bp, Bovine  MMBT11137
tctaagtactatgtatccatctcattaaagctgcttgcagttcagaaacaactaacaaaaaatagaaattaaggtaataaggttttgacccataaaaagatgaatgaaaattatgcattaatgtgcatctgataataattagcaacattcttttataaaatagatgtctatctgctctctacaatgttgtatctgtcttttgccatctcccagaaataaatctttgatttattattgccccgggctaactgaagaaaatgttaagtctcagctttgtgattcatgcatattgactatgcrgtcagtgaagaagaaggaaactagagattttgtgaaacaagggccayctgtgttttattttggarctgattaaacgtggtgcaayctatggcaaaattacaacagttatggacttcagtatgcaaggattaaaaaataatcatatttaagagtttataattgtctaataattattttccaagtgtcattatrccttaatttccacacacatcttttggtcatagccacagtactagtgagggcaacatttaaaggaaaagacactattatttctactatggaaaaccttatacaaatgct

SEQ ID NO: 20601 - DNA, 600 bp, Bovine  MMBT16978
gccaccagggagatgagttaagggacgtataaaggacaaagaagaaagactggtagaaatacagaaagacaacattttggggaaggtttctacatgagggattttctgtgaagtctacatattctataaaactgagaaaaactcagattaaagtcaatcgaactcaaagaagaattattcacagtataagaattaggactgaaaatccttgaaggtgggtgttgaaggtgtttcctcttmagatgtccagtggtaccctgggatgaaaagacttgtcaagaccgaaatgacagcagagaragtctatgtccaatcacttcttccttcattatgccagcacttkacaaagatttcctctcacagaaactagatctaaattctgttctgccctggtgtttaaattcttccccctgaaagtgatactgttataagcagtagattcaatcaaactaacatcgtatttgtctctacgcaagacgtgagttttgcattctggagttgatcaaatttaattatttacttactctcttacatcaaattcacctgctgaaacattttcctaaacaaatacctatttctctatgtagtacactggaataa

SEQ ID NO: 20602 - DNA, 600 bp, Bovine  MMBT05312
ttacacttagtacagctttttatttgatcaggtcggaaatacttaccactcagaagaacatggctatgcataattatacctgaccatgggaaaaataagtacctcaaatgcatgtatttgcactggtgattccaactgcacaaacctttgtgccatctgtgtgtatatgtatttttcacatgaattgacatgcacaccattttcattcagtatgaaccttgaggctgctgccattttcccatttaaccaaaccgatacctgtgtaaatagcctaaaggtgatccttgaaaacttgtttcrtatatatttcagaagttattttgcataaatattaaaattccaaaaagctgcagggtaacttaatgtataaaatattacaagtatggattgcagacttcatacaatagatgatagtgtataaattctattgaatgcatgctttctgttttaagcatgagactgtacacgtttactgtaagtccttgcatctgtggtgctaggtgagtgtgagaaggtgtcaaggactgaaaaaatattttgttgcctaacaaaaaaaaaaaaaggaaaaaaaagttgtctgtaggcatgttaaatatgctt

SEQ ID NO: 20603 - DNA, 600 bp, Bovine  MMBT04345
tgattatttaatagaattatttcttagaattcaaaacaaagtacttaggctatgattagctgtataaatccaataatatgcacaacaggatgtatttcttgctatattttttcccatttacattccmatgcttatggcaatctttctgaattcycctgtctttgcaaatttccaactcctagtcctttgtcatcataatttaatggatttctgagtttcctatttttctgaggtgcaattagagaccatccagaggttcctactactttccctccccaccttcctgcctatgcagccacwcattcygtgttctctcctgttactttcaatcagttgtccatgctgacatctgaggccaatcctgagacttatgcccctgaatttcattccctttcacctactcaaggatatctcttcaacagccctaccccttcctctcagcgtgcattttccatctctgctgtatcatgtctattagcatactaacatgctctaatttctcccatctgaggacaccctatcttagaccttctattacccttcagcagccccacttttaagatcctcattatagcaaaattgcataaagaacattttttt

SEQ ID NO: 20604 - DNA, 600 bp, Bovine  MMBT05405
agttgagcaatgtaccgccaggctacatctatcctccttggtccttttgtcgaacagaaggaacacagggaggaaaatgagtgaaaatcaacattctcaactattcagtgtagatcattgcttagtgcttatcttctagatttgggcaaaggagccaagaaatgtttcaaaaagaaaattaaaataatcgctacatgtgatatacatttatacctgtgactattgatctgtctatttcttctttcacttatccattcgtttctaaatttgagaacacaggactagagtggttaaaaggcrtatctctacataaccagcatggatgcttcctacactactatgcttgattctgtatcagtcttctgttaagataatgagctgtgtgatctctgaacacagggaacacggacagcaatacttggtttccctcccttttttccatctggctaacacaaagttttcagatgggagtttgcatgggatgcctgggccaaagaaaggctttgcatctaattcagaatcttttcacgctgtaagaaaacagtgactagggcctgtgccgaaaactggtcttctaaggacaactgctgttacctggca

SEQ ID NO: 20605 - DNA, 600 bp, Bovine  MMBT05998
cagaatttgtaatgttaggcacagcagctgaacatactacagaggagtagaaaaggagaaaaaaatgatgccattaaccatgcaaatgtgtgccacatctgtactaaattgccatttgcatgaatacagctaaggcaagcaggattactgtcattagagcaatgctgtttgcactgctatattgcatttaaggttgtgtgggtgtttccatttatactgccccccttctttttaggggtttataatttggttgtaataatctgctttgggatgaaacattactacaagttcacagagggrgagcaatttttaattataaaattggattcaaattggttcagccatattgtagctagagaaaagcatttaagcacactaaccaaaaaaatatgttttcttttaaaatacaagtcttttgacttgaacttttttttcactttaaggcagaaaactatttttaccgtagcattttatgtttgttgatttttgtgtagtgtcccaccagaagattgatattatatacacaaattgtccactttaattctcaaacttccaaaagaggttatttcaagtacatgctttattaattatttaaaatat

SEQ ID NO: 20606 - DNA, 600 bp, Bovine  MMBT02858
taatctaattctgcatttggtctgaggccaacgcattgagggcattcaataaataatggtgctcggtgtgcatttcctagatcctggctatgtaggtctgagayggcactgggatcccaggtggccagcttgagagaggtggtggatgaagggtggtaggagtctggaggccacgaaggcaaatgtgttcggattgtctgacacagagattatacacctgtrgggcttgccgaagtgaaacctacacatgcaaatattattctactgagtcggttagggtgtgaccttcttcctgacatsattttcccagattcaatctgggtaaaagtacatcaaggccttactccctatgagcacacagaccagtgtttacttgtcttcattaagggaattctctttcctgtgagtgggtggttctgggaggggcaaggcaggattatctgggcagtcccaaaggaggaagagcatgaagaagacagaaaatcctcagaatagaatttccttgacaatgtaggtccacctaatccattcattcttcttatctatctaccaagagattggtggtgaagctataaagatgaatgacataagtcctcctgg

SEQ ID NO: 20607 - DNA, 601 bp, Bovine  MMBT03406
  misc_feature (1)..(1): n is any nucleotide
nctattatatgaagtagatattagatcttttattctgccagtgccattttaatcacagcagttctttattctaaatagtttaaccttggamgacctttccccagggcttcttatttatttagatattgttatgcaacacacacacactagcatcagtgaaggcaggrcgatcccttcttaactttcacaggagggattgtacaatacataaaggagctggttaaagaagtggttttctaaattcctgggtaaagaggggcagaggtgagagttgaagacctagagcagagatccctccaakttgcagtttaagtgatggagaaatggatttggagattttgttctttctctctcttctctttctttctctacttaactcaatctcaggacacacttttagtcttttcacttaaagcaaaaggctcatgtttgmtgggtataacttgcaaatgactttgaaaacttttgaatcaaatgaaaaaaatcaggaatttcatgtaaaaatcatgattttcaacttctgatgaaatattagagaatctggctacccttggtccagagtccatcaagacaactactgccaagttttaggcaataacca

SEQ ID NO: 20608 - DNA, 600 bp, Bovine  MMBT09753
gctgggcctgaaagtgggtatcaggtgtctacaggtgcagaggaaggaaaggacaaccccarggtggggagcagtatggacaagggcatggagtgtaaagggaagacacaggacgtgtgtgtatgtgagtrttattgctggaggtagccagagatgaggctgccaagaacggggctagagcaaaacatttccagctgtgaactcaggttgttttttataaaacactgcaaaaatggtcatgcactaggaagtgtggcaatgtcaartcatgataaagttttctcaaagatgagtcttcayttctgtactcatcttgtggacaacactttgagaagccctgccctaggggtcctaggatgggctgcagaggtcagggaggcccacagatttcttgcagctggtcatgtatattcatttgtttagggaagggggcaaagcttttgtcaggacctcaaaaggttcaagatctccaaaggacacaaccctctgctctagggaatggtcactgaaggtctttgagcagaacgatctagtgaggctttagagctgaggggagcagaaaatgtgcctgattcagcctgagaccccttccttccctgc

SEQ ID NO: 20609 - DNA, 600 bp, Bovine  MMBT08093
aatctgccttttaatacaagtttgggccccaaatcaagtgtgtgagactgagatgctttaaatttctgaggcgactcctaagtcatcttactgtgtatgctgtgagcgggagagtccagcctttggaaccaggtacgactgcttgcagatccttctgggctcctccaagggcaagctactcagctgttagcctcagttttctcaactagaataacagggcggagaagattaaataagtgtatatataaagtgggtgcttaatagatgtgatcttttcatgggtggctcaaccgtcttccwtgacaaccaatttaattgtctctccttttacctatttctgtacctaaactgcctcttcatacattatcttgtttcctctgcatccatatggcttactgctatctgacctgatctctttcatctatttgccttactgtctgctgtccgtattggctcgtgaggtctgggagagaagggatttcttctgttttctctatctttgcctctcctgtatttaaaaaaagcctgatgtgtaatatgggattcccaggaggctcagtggcaaagaatctgtctgcaaatgcaggagatgcaggagac

SEQ ID NO: 20610 - DNA, 600 bp, Bovine  MMBT11514
catttaatgtcttataataaaccataatggaaaaaaaccaattcattccatggctcctggcaaggtcctcatgggaactgctgttactgtgcatttaccctgtgccctgcatgttctgagctctatgcattagttcactttacctgcaccaccaccctatgaagcaggcactgttaggatccccactttatagaggagaaaacaagacagagatgtgtacaggagacgcaaatgcagggcacctggaactggccatggcatccagagccgctcaaagtatgaatccttcctctttgaacrgatgggggcagggcttggggtccctgagaccaacaggacagcccttgtcccaaggagtccacacaccaaactggtctccacacagccctcaacacaaacctcctgatcccaggcatccagaaccaggagtgctgtggattccgcctgcccaggggaaggctccccagttccccatcgggggtgctagatgctccaatcactgtctcaggccctgtgcagcctctgattccaagaccatggccagggagacccagggcagggaaggcactccggatccctccaaaccacacacgtttaaag

SEQ ID NO: 20611 - DNA, 600 bp, Bovine  MMBT01785
cccgtgagcactgctgtctacaccacataacaccacatagatcaagagtggggagaggccgaagtcatgaacaccatagctttccataaaagttaattaatgacagaagcatattgctgggaatggcaacacggctgttatttatggctcaggaaaccccaactgtagggatttgccttttcctttctcccagtcccagctctacccacgagtttactcaccccattacagtaacttcgtgactcatttgccaagttaacaagactatagcatggaatctataaaaattaatacaacagytggacatccaacacgcatcccaggagaaacagaccaccctatggatgccgccctgttcttctctatccccacacctcaacacttcttcacacttcacatttctactgttggcaacagttcccacctgtcacccccaagaaaaggatttccccgaggaatccttggtgctgaaaggcttctagacacctcctttccccacttcccagccataccgccccacacaggcatgggccaacccgttaggtgttaggaaaacggctcaccactgacagaccattaccgctttgagaggctgtgtag

SEQ ID NO: 20612 - DNA, 600 bp, Bovine  MMBT07689
caaagcactttcagttctcagaatcgaaatagcccaaatggaccccttcacaagttaaaatccttttaaagcatctgaaactgttgccaattagatttgatgcttaatattgctgtgtacaaactgtctcagtggagggcattccccaaaaggaaacaagaatgttatttcaccaaataatgtacttatcacataaacaatgatataaaatctrtgggggcttaattaagaactgccagaagcactcctatcaagtcaaaataaattaacaaagatgaatttcttagatgaagaccgagrtgcacatttaaatcaatgcaaagcttttgaatcattaacaatatttacgggttttagtgtttaaatatttaataatttgtagtacaaaacagtaactcttaaataaaccttcaatagcagctgttattgttaagtacctatttcatattagactctatcttgacacttcataagtttgctcctcaatacaaaccattctatcttacatgtggagaaacagatgctgagagaggcaaagtcaactgaggtcattcagcaagtggctttattaggatttgaatccaggtctaactattccta

SEQ ID NO: 20613 - DNA, 600 bp, Bovine  MMBT20855
tctgtggtctactcatcccttccctggtggctcagatgataaagaatctgcctggaatgcaagacacccaggttcaatccctgggttgggaagatcgcctggagaagggaatggctrcccatgccagtattcttgcctggagaattccacggacagaggagcctagcaggctacagtccatggggattgcaaagagtcaaacaygactgagtgactaacattttcactttctgtggtcgattaggtgagggaggctgtgctagaattgtgcataatgtttttgaatcatggtagcagggmatattttagatatctggaaagaagtgatcgacagccagacagctataagtaaatgttgtagacacttttagagacatcawcgcagctcacaacagcatgtccttctctgagaaccaccccagagagcaatctaccctccagtaaacctgctccaaggtgcagctgctgaaagcatgaatggatgctacaccatttggcttttcttttccaggaatttagagttctgaaggaagaaaccttgagtctggagatagttggagcttggtcatatatgcagacctttaggggaagttcacagtt

SEQ ID NO: 20614 - DNA, 600 bp, Bovine  MMBT07944
gtcttttccagtgagttggctctggaactcactggaattaaccatcaggtggccaaagctgagcttcagcttcagcatccatccttccaatgcatatccaggtttgatttcctttaggattgactggttggatctcctcgcaatycaaaggattctcaagagtcttctccagcaccacaatgttagaagccaagttgtagkctgaagtttgttcagcagcatgtgctctcaactagggagatggtggagtgacttggaagcggatcccgttgtcctgagcacacccacccaccttcctcrggcagttgctcagtgtttcagcccaaacgcagagctgagtgcctgctctgggccccaagggcagcagcctcagttcatggtccagtgggtcctctggacagatggccacattyggcctgggctctgtgcattcctttgttctggctttagactgacagcccacgtgtatggacctgttttctctctaaataagtaaataccatcaggctggatcttccacccaggagacattcagtctttttgagagatctctgcagtatctaatttcactggccatgggttaattcttttagcctaatt

SEQ ID NO: 20615 - DNA, 600 bp, Bovine  MMBT07059; identical to SEQ ID NO: 4697

SEQ ID NO: 20616 - DNA, 600 bp, Bovine  MMBT07371
ggtgggctgccgtctatggggtcgcacagagtcggacacgactgaagcgacttagcagcagtagaccaactagatgcccaataaagtagagagaagctgtcttcttgggattctattatatcgtatacattatctgattaaggagacagccaaagaaataaaccggaccatatggatttaattaatgaaataattagatcattaattcggctcaagtttttaacagacagaatttctgctttcagaaacctgaaattgtatattactatttggggtggaagcattaacaagtacaaaaartacttcagggataaacacatatcatgacagtgaactacctaggtatactacttgataagaagagtcattaaaatcaattgctgtagtctaaaaattaattagtcagttgatataaattgtgtgacaggtttgaggggttgctattgttactattagaaccgcacacaatattctaacaattggacacccataaaaatagggagaaatcatctcatttctgttattggatctgaggtggtggagggactatattataatatgatttgttattttattgggggaatatgatgtaacatttca

SEQ ID NO: 20617 - DNA, 600 bp, Bovine  MMBT01724
gaggaaaaaaagaagaaagaaaggaaagaggaagggaggaaggaaaaaggaaagaaaggagaaattttttaatctttgtgaatttacaactttccctaaagaaaaaaaagagtgaaattggtgatggtgaaagcagtggtggttatcaatgctcagataaagttcagatccagtttagatacctcagcttctcctaggacagttttcatgacctcctcgccatctcctatttctggctttagggaaacgaactcctcaagattaaaaaaaaagatgacaagatgtgaggatggtctccaygtttcctcccctgctgaccctttctgtttattaaaagtatgaaaaattattgatgtgtatgagatttatrtgaccttcacatcaattaatttgcatttctttagtacatgctatgaggaggagatgccttagaactaggcagagatgtggacttgatcaattgcttcaaataacttgtattgaccatgggcacaaaagtctgtagtatatttatgttcaacttaaaggtatatttcttgactgtatgtgaatgacattcaactgaatagaaactaagatattacaatggagagatgtata

SEQ ID NO: 20618 - DNA, 600 bp, Bovine  MMBT04901
aaagtcatatttagattgagaagtgctgagtttttgtcacatcgtgcctggaacttggaacgaaaagcagaatgttcccccttcctgcacacccccatctcctttattcctgtaaacctagcctgaagtgacattctctgaccactagatggcactcctgcacaggagagtcacatcccgatttaccaagggcggggcggggctcagctaatctcccccgctacatcttctggaagtgacggccgcgcttggtaaacgcgctgttgcaggaggcaggaagtcaaatgctgctgctgctgmtaagtcgctttagtcgtgcccgactctgtgcgaccccatagacggcagcccaccaggctcctctctccctgggattctccaggcaagaatactggagtgggttgctatttccttctctgagaaagtcaaatagagttgtaaaagattttcaggaaatcaaatcgatgatgtttgaggtgacaaaaagcaggaactgcctgtctgcttttcacatttacatttttaaaaatgtgagttgcccgaggcatgactgtctttgagccacaggcaagggaggcaaattaatatgcacagaactga

SEQ ID NO: 20619 - DNA, 600 bp, Bovine  MMBT01107
aaaaaaaaacaaaccacactgacctcaagtgtgtgatgttaaaacagaacctgagtctgtgttgccctggcggaaaaaacacaccgacttagaagagttcagcaattgctcagaacgtggagtcatcatctgacccagcaaccccactcctaggtgtacacccaagagaactgagaacgcatattcacacagaaactggtacacaaacagcaccatcgtctgtaacaaccaataacgcggaaacaatccaacacccatcaacccatgaacggataaaccaagtgtggtcgagtcatgcartggarcagkatttggccacaaaaatgagccaggtattgacacactgctacaacacggataactccgaaaacattaggctgagtgaaataacgcaagacaaaaaaggccatgtattggataattctattcacacagaatgtccaagaacagacaaatccatagggatagaaagtagactagcggttgccagagtctgggagacaaggggagggggtatgactgctgatgttctgaaattagagagtggtgatggctgtgggtaactttgtatatatagtaaaaaccactgaactgtatact

SEQ ID NO: 20620 - DNA, 600 bp, Bovine  MMBT04124
aagaaaacagcctgaatctctcacataaaataacaagccagcacaaagcagtgagagatcagtgaastggagaaggaactgatgcaggtttgggtcctgactcctctcytagctcatttcgttcagatctttactcaaaagctgcttctgagtgaggctttcttggtcactcactcaaatatttgatacctcctagccctgaaaatttattctctagtttttttaaaaaattccttatcatttagtactttctggaatatttttcttatcttctttccctctgtctccttcacaagaatkaaagacccatacaaagcacagttttgaccgtcctgttctttacagtattcccagagcctagacagagcttgacgcacagcagatctgatgaataagtgaattaagttataaagtaagagagatggattggatgatccacatgatactctctagctctaacacaatgatactcacatgtatacatatcaccataaagctatggattacctgagaatacctcaagcgaatcatgccctcatgaccattgtagatgtacacagctccagagttctgattttccaaaggcgaaccaacaatcac

SEQ ID NO: 20621 - DNA, 600 bp, Bovine  MMBT03716
taccccaatgatcatctcattcttaagcttactaagaaataaatgaatgacctattgtggaagtgttggagatatggttagttgctgaatgtgtaaaaggtgatcaatacatcaaagaacaaatacacaaaaaaggaagaagcatacaccatgtgtacagaattatgttgacagggaagaatttgaattattatagaataaagtctgcgggaatgacattaaaataaaccatttcacaaagactttcaataagactgatgagaagctaatttccagagacagagaagaggaatgcagatmttttataagagaaaacattgagatgaagtcaacatacacactttaggagcctgtcatgacagttctccaggtagagcaagtaaagacactgtaactgcaacttagatcaaacctctaagagaaacaccaaaattacagacaaaccagaatcaggcaatctgaaragtggagraaaaaaatctatcacaataggaaaaaatcatggggaaataaaatcaagcagtagataagaaaacatttcatagtatcagatacaatggacatttattacatattctaggagtcaaatatcagctattc

SEQ ID NO: 20622 - DNA, 600 bp, Bovine  MMBT11305
ctcagccttcttcacagtccaactctcacatccatacctgaccacaggaaaaaccatagccttgactagacgaacctttgttggcaaagtaatgtctctgcttttgaatatgctgtctaggttggtcataactttccttccaaggagtaagcgtcttttaatttcatggctgcagtcaacatctgtagtgattttggagcccagaaaaataaagtctgacactgtttcccaataaaaatcatacatatttcatgaaactgcatgatcaactgtatttcaacatacagaaacagagcccaktgtactttagtaatataggtaatatggcacttaaggcttttcttaattaaaagccaagaatcttatttgcatttctttgaaggaaaagactgtaataaggacaaagtattggcaaagtgatgarccaaacagagaggaaattctaattatagacttcagaattcagtttaagatgtatatgtatgtcgctttatttttttttttttacagttttcacataactcrttatttattttggatatatttcattttaaagtatagttaatttacagtgttatgttaatttctgctatacagcaa

SEQ ID NO: 20623 - DNA, 600 bp, Bovine  MMBT13533
tggtacaaccactttggagaatacttcagaagttaggtataaaggtaatcagatgtttacctatgaactagtaattccactcctaggcatttgccaaagggaaggaaaacatattttcaccaaataaataaataatccctttgtaagaatacttaaggaaactctgtttatagtagccaaatactggaaatcatcttgaatgtccatttacaaaagaccagataatcaaattgtggtttatttatatagtggaatattacccagaaataaaaaggaacatccacatcacaatcaacaacrtgtgtaagtctcacagatatgaaatgatattgagtgacaaaacccagacacaacagaatatatacacggtgtttccatttaaatggagtccaagaacaggcaaagctaaccaacagtgatacagtcagaaagcaattgcctctgaggagaggaattgactggaaaggggtatgaggccacagtcttagattttactttgttagtcacactcagtcgtgtcctactctttgtgaccccatggactgtagcccgccaggctttctctgtccatggaattctctaggcaagaatatactagag

SEQ ID NO: 20624 - DNA, 600 bp, Bovine  MMBT05132
agttgtgctgactctttgtgaccccatggactgcagcatgccaggcttccccatccttcactctctcctggaatttgctcaactcatgtccattgagtcggggattgccatatgactgtctcatcctctgttgccccttctcctgccttcagtctttcacagcgtcaggtcttttcctgagttgactctcggcctyggtggccagaggcaggtgctgtcgtttgtgctttagtataaacctcagcagagaaggygtgtttctgttgatgatactctggagtgaatttaatattggcaatygcatttagtcatgtcactagacaggatgattcttcttgtgactgggatttcaaccgggatagaactgagatttggatacagatggcagttgacagggttaagtgtgggcctgagaatctacagaggcacttcaactgtgggcctgtctggaggtggccctaggaggccaaaccatgatgggggaagtgtgtgtgtgcatkgctgggggtatgcagtgatacattgttcactaaaaactatcaggagaagtcagaggcagtgggttctcatggggaatagtatgcagggtatggtrtgttt

SEQ ID NO: 20625 - DNA, 600 bp, Bovine  MMBT04058
cccatggactgtagcccaccaagttcctctgtccatggggattctccaggcaagaatactggagtgggtttccatgccctcctccagggaatctttccaaccaagggtcaaacccaggtctcctgaattgcaggtggattctttaccgtctggagtgcatattagatgagtttaatatttaggtagaggacagatagtacagtcttaacgtatcatgcttatggcttatcctaaagagatttgggaaagggagtaaaatgatgggattcacaagtaggagtacagtactatgaatgtagrcatgaattcatccagaagcaaggaaacmtttaggtccttcctcaatttctataattccagccccctctctggcacactttcatgggatgtaatttctctacagaataataatagatgatgacaaaaataagaatgaattaaaaatgagatgtgaaagccaaagggactccttggtagaagcaaagaagccctcatgtcttgcagcaggaatgcagagaaagcctagcatgaggcctgagatttatcattctgcatgactaacttcaaaggaggttaaactcagcagattggttgggccgg

SEQ ID NO: 20626 - DNA, 600 bp, Bovine  MMBT07665
gtccaggttaaagtctgacactgtttttctggtacatgcatacataaaatagaccaataataggaccctcttctgggatatgttatgatgactgaacgagatgatccatgtaaatgatcaatataagtatgaagtgtacagcactgagtgattaattcaaaccttaactcttattgtaaaaacccattttgtttctacattcagtaagcactgttgcccactcacagtgattaagagtagggttgagaagttactaaaccccaaatgaaggacacacccttattctactgaacaaccctyctgttcactgttactgtgaaattgaggaagagtctggaggaaagtggccacccttgtctcagggcaagttataaagtggatgtaaaagtaacaccctgaaaaaaattatgtcaaacatatgggactcaactctgacgactgggtttgtaaagcagaattaattaccacaaggcagaagagccagtcataccatgctagccacttacactatcaggtaaaatttcctatgaaattactgttgaaaagacactagaaaataatatacagagacaatctgtacatctacataactcacataca

SEQ ID NO: 20627 - DNA, 600 bp, Bovine  MMBT15674
cactcttctgcttccccatctcttcaccagtctcttctggaagcactttgttcataaatcatttgttcccgaattctcctcttgacatctgcttttgaagaaaccaacttaaaatgggcagttcttaaaatccaggtgtccctgagaagaatagcacctttgagayacaaacgggccagttcattatttgacaagtgcagtcccattaaaaaactgaaaataaaagtcactctgtcrtgtctgactctttgtgaccccatggactgtagcttaccaggcttctctgtccttggaattctycaggaaagaatactggagtggatagccattcctctctccaggggatcttctcaacctagggatcaaacacaggtctcgatttaattaaaaagtgcttgctccttggaagaaaagctatgaaaaacctagagagtgtattaaaaagcagtgatatcactttgctgacaaaagtttgtataatcaaaagtatagttttttccagtgtacgaatgtacgaatgtgaaagttggaccataaagaaggctgaatgtggaagaattgatgcttttgaattgtggtgctggagaagactcttgagag

SEQ ID NO: 20628 - DNA, 600 bp, Bovine  MMBT03633
tttttgtacagtttttctgtgtattcttgccacctcttcttaatatcttctgcttctgttaggtccataccatttctgtcctttatcgagcccatctttgcatgaaatattcccttggtatctctaattttcttgaagatatctctggtcttttccattctgttgtttttctctatttctttgcattgatcgctgagtaaggctttcttatctctccttgctattctttggaactcttcatttagatacttagggcccacttaatgaccttacwttaacttaattatcctagtaaagacyrtgtctctaaacaaggtcactttcagagacaytaaggattaggacttaaagatataagtttcaggcttcccaggtggcactagtggtaacraacctgcccaccaattcaggagacataagaaatgcaggtttgatctctgggtcaggaagatgccctggaggagggcttggcagcctactcyagtattcttgcctggagaatcccatggacagaggagcctgatgggctacagtccttagggtcacaaacagttagatacaactgaagtgacttgacaagcatatgatttcaggggacac

SEQ ID NO: 20629 - DNA, 600 bp, Bovine  MMBT04769
ttgccatctcttcttaatattttctgcttctgttargtccataccttttctgtcctttatcgagaccawctttgcatgaaatgttcccttggtatctactagaaggatttaagggataaaaagcactttcttttaaaagcaataagggaattttaattggagtaagtgtatgaataatacatcaaatatattctatcatttttattatacagaaactgctgaggtcttagagatgatgactgttaattaagtttattaagtcaaagccttaacagataaagaaaatgttaggatgaattmaaaataatatgaaatgagcttttttatcagtaaaaggagatttttgtagtaaaatgtctataagtaactggtactttagttgttcagcaggtacagtatacatagatcattggattaaaaaataattctatacttaatttaatgaggtgttcagaagttacaagtagttactttcagtctcattattcttcatacagtttagcaccgtcataccttttaggatgtttctgtcattgaaaatgacaaacatgttaaatataaaactacacatgatgacatggtttagaaaattatggatgt

SEQ ID NO: 20630 - DNA, 600 bp, Bovine  MMBT11327
gctaaatgaacacattcttcttttgtttaaaaaaaaagcctatttcaccatttttcttgaatagtttaaaaatcaaaacattaagaattaaataaacttagaatttaaaagctggataaatataaccccatgaacaaaccactgcacggttcttgcttttctctttttgcttcaaatcactgaaaacagagtcccaacctattgactggcaccagggtaagaattaatactgggagtatctatcctttggccacttattaacaacactttgattttgaatatagcttggaaaaaaatagsatggtatttcttagaatcatttataactcagactttccactaacttcatctggtttctatcctcccccaccatacaattagtctgaatatttgaggttttcctattgtctccagtaaggttcttggagacaaggtcaaactaagggcaagtctcacaggtcagagtattgttttgaaccatatgaakgtttctctaaataatttttaaaaaataaaatcactgagtaactgaagttttttcagtgttcaaaccacataggtgactaggttggggccaaaactcaagaccatattttaaag

SEQ ID NO: 20631 - DNA, 600 bp, Bovine  MMBT01839
acgatgcttgagtaggcagtcaaccaatgccaggtgttcctgtttcactggattatttgttcctatttaaagaatctttcatcaaggtttactgccaatagatgtagtatttctatgtgacagagttaaatagacccagatttgacttgatgtcttaaatcaccggggagatggaattgtgagatatttgttatgcaactgtatatttgttgtaagttcaattttgagtcctttatcatagaaggtagtttgactaataagtgtagttgacctgaagtcaaaatcaactctctgggtgcktctaagtatatataaattatcaaattatgctgaaaataacctctgacaggctcactagaagttgaaaaatgaactgtttcaaatcaatggagatagtatagacaccatgggatgacgagcaggatttttgttggtatttatatacatgtgggctgactggtcaacccacagtactcaagctccctggttgaggatgggagcttgcgctctaatcagaaaagatccaggcatctttgttacatmatttaaccttatcctaaattgcacaaaaggtggaaaagtccagcagagggggagctg

SEQ ID NO: 20632 - DNA, 600 bp, Bovine  MMBT07800
cccgtccctgggattctccaggcaagaacactggagtgggttgccatttctttctccaatgcatgaagtgaaaagtgaaagtgaagtcgctctgtcatgccaactcttagcaaccccatggactatagcctaccaggctcctccgtccatgggattttccaggcaagagtactggagtgaggtgccattgccttctcctggcagcctgctagactggcccaatgatgattaacttcaatgacttgaatcgctgaggaagagggaagctgcttccattttaattatgtctacaggagtacrgcacttttaccccagttcattgtcctgaaacaaaagacttcctgaaaggaagattaaaaaacccaaagtgtggtggtctttacttacaaagatcttttttcagtccattcagagccacaacttagctctatattgggaactcttggcaagccattggggtttgcaagcagatcagaagatagaaagaaagcatcattcagtttattttacttgggcaattaaaatgcattgagctggtccagatatgaaatagcatctcgccatagtatgtgttctgcataaaaggaactctgacatgca

SEQ ID NO: 20633 - DNA, 600 bp, Bovine  MMBT14225
ggagctcacaaatcagccatgaatgttcagcctgagaggggctacctagaggaagatatttaaagaagatagaagtgagttccctgaaaatctatggtccataacaccacatccatttttatagttgcaatcaacaagaaagcttgttctatttgctttccttgcttgataatataatttcagagatggatgaaaaatgctttcagcactagaatcaatacttctgattacggctgcttttgtgctcgtctctccccagtggaaacatagccaggaaagataggaagatctatggaaagyctacaaccctgattttttttatctcttccaaagttgtctgttctcatcaaatgctgcatttattttgaagaatttgaaggcagcctagggctcacagaagagacatgrtaacttggaggcatttgctatatgagctgtgctacctgaaaaactacagacccattcacccacctctgctacagaatcacatctttcccttcagattccacaccaaaggcatcttctgaaagctcttagtgtagttgagaggtgctccattgtcctcttaatctctgctcccaaggaattcttgttcaggat

SEQ ID NO: 20634 - DNA, 600 bp, Bovine  MMBT08485
ggtgctacttactgactggtgtctcctgagtgggggccagggatgctcttcaactttctgggatgcacaggacagctcccatggcacaaagttagccagttcaaaatgtcagtagtgttaaggttgaaaaaatagtaaaaaaaaaaaaatctcacstcctccagacagccttccttgattccttaaatggcagagatatgttctttggctctcatgcacttctgatcttagctgtcacagcctctcccactctgtggtccctgaactccagggaaagagcctgggtatcattgaacctamatctttggcttcctttctctctagcttgtgaatctctggaagtcagggactattgtcatccacacaggtgtctcagatatatcatagaatctgactcatggtgggtactaagtaaatacttgttgaaagagcaaatggatggatggatggatggatgaatggatacagttgtaggctgagactcaagaaaactaagttgtcttctttttatgtgtgttagttgctcaggtgtgttctgactcttcaygaccctacagactgtagcctgccaggctcctttatctatggaattctccaagc

SEQ ID NO: 20635 - DNA, 600 bp, Bovine  MMBT04318
caaacacctacgtgcagtgatgcagttttgggggtgggggactgttttttccctcttgcttttccttcctggtaagacatgattttatgcctttattccccattcagtgatcctaatggtcgtggcataaattttgcccggtgggtgaaacaccgcctctctgggtacttcttgttgttttggaggattttcttggaaagaaccaaacctgtggtttccttagagggctgcctggaaagtgaggggtccctgcccagccaggctccagacaagtgtctctgtctcttcttgcccaccccmctcagtgactgtgactccctctcccctcaatttgcaatctcttcctgttcaagaaaaagatgctgtaagaaagggctttcagagtcaagagaggtctgtgaggcacctgagaaggctttaggggagagtccttgaaagagttgagctaggactcttaatggtgcttttgaactgtggtgctggagaagactcttgagagtcccttggatgcaaggagatgcaaccagtccatcctaaaggagatcagtcctgggtgttcattggaaggactgatgctgaagatgaaactccaatactttg

SEQ ID NO: 20636 - DNA, 600 bp, Bovine  MMBT15847
atctcacatccagcctggtgttaagacagggcacccatttaaaacctttaattgagttaaaaataaagtggatttttaccagcatttgaaaagccatcaatgccagttaacccattgaccttggcctaggaaataacttgcttgtcttctacttgtggctgtgtgggtgtaaatatacaggaaacccatttaaggatatttgtttctatgactgatggatgtaactaagagatatgaaactgacagtgtggaaaatgtgtctcttttctcttttctgcactaaaacaaaaaagcaagcaraatttttcatctgaagatgagcgagagatttcataaagaaagaagttggagcatgtgatgtaaatacatgagattatcttttgtgcattttcaaccagagtcaaagaaatatattttcataaattagagcagatatctgattttaagcaagcattcttgtttaacatagagctagagagagatgggtatgcatttgatgggcagatgctgactcagcaactcatgtctcttggctcttattaataggatggggaatgggaggtacttggggctttcggaaggcaaaggctgagtcttgga

SEQ ID NO: 20637 - DNA, 600 bp, Bovine  MMBT17214
ataatacctaatgcactagagcattggaaattttctttaaagcaaatactttaccatttgcttccattataatttgagagttattttctagtggaaaaaaagcgtggctcccacacaatgaaaatcatcttcaggagtcctatcattctgctttcaaaatatgtgaatgcttggtacatttaattccttgatatattatacaataaaatgataaaatgtgcttaagttactattaggattgaatatgtatgaagatggaacacttacatagtaaacactaattattagcatacgaaaaastttctagacaaaataccctaacttttatggttatcagaattcacagtcattaaaatatttggttagtattattaaaggtaatcccgtttttctttgtaatttgtttagattgaatgggacttaaatgtttagctatgcactaggaatatcttagcttttctatttaaaagaatactgcagagtatcatgaaacaagtttgatgtactttcattctaacatttgagtacatatgatgtgctgtgactattcctttcttttcctcccccccacctctctcttctctctttcttaccctccct

SEQ ID NO: 20638 - DNA, 600 bp, Bovine  MMBT12474
ggacagggagccctggcggactgcagttcatggggctgcagagtcagacgagactgaatgactgaacaacaagaccagcagatacccagcttttcttgtagcaaacatttctaaagggactgattcatctccagaaatgcctggaggccatcggatgctagccaggcctggagaacattcccagaaatgcagttacctggaggggaggttctttcagtgtctgagatctctcagccctccccaaggccagggcagcaggtggaactcatccagccaaggccacaagggtgtcagttgatkcgtggtgaaatgggactttgaaagggattctctggtccctggcccataccctcaaagctaataatgattaactagtacaaggctatggagctggatagtctccatttcagtttggcttctccaccaaatactgggtaaatgtacaaccaagaagcatcttatcaggtgctattaaaggaatgaaaactactttttaacactgacttcgcaacatgtgataaggaagattaacagatgaaagtgttacataatccttggttaaacataggttgtaattaccctctgtttttcattgtgttt

SEQ ID NO: 20639 - DNA, 598 bp, Bovine  MMBT06718
  misc_feature (1)..(68): n is any nucleotide
nnnnnnnnnnnnnnnnnnnnnnnnnnnnnnnnnnnnnnnnnnnnnnnnnnnnnnnnnnnnnnnnnnnnaataactcccttagatagctcttcacagatgtaacactcttaaccctaaaagtcccgagaattgttaactatgctccccagggattatatcctttctcctcccccaaggaatctcattctgacatcaaaacaagcaagcaaacaaaactcaaataacttaaccctagctaggttccacaccatacggcacgtaggatgcaggacgcaggatcttttctccctgattagggaytgaagtcgtgcctctgcaccgggagtcaggagtcttaaccactggaccaccagagaagtccccgtgattgccttttaatgtcctactgacaattcatatttttctttcagtagttaaatataaaactgaaactaagggaaattactttttcaatatatacagatcatacttggttaagcaacatatatcatgctcagggtataaacattcaagattaacagaactgctttgaaaatgtaaattcatatgacaatgagttgctttctacttttcatttaaatttttaaataagctacct

SEQ ID NO: 20640 - DNA, 600 bp, Bovine  MMBT12892
gctaaagctctaatattgaagggtctggaccctgtgtcacagtgctgtgtacaaggacaacccagctaaataagatacctttgtactcacacagggttttagagttaaatttgggtaagacgacactgatataaagatacatcacaaaggccaactaagtatacacagttgtgtaggtacctaaaaggaaacgacctcttgaggtgacaagtaaaaactccatggaacatttaaaaatccattctatataaagcacccagattcacaaatgaaaaccaccacattaaagggctctagagrtgatgaacgttacataaaggttaggttgataaaggtagtaaaaccagctacaatttactcagcatttcctgtgggtcaggcaccatgttgagcatttcacatacattttcttacttaattaaatggctcaccaaaattatttccattttataactgaggaaattgaggttagaaaggttaaaattacttatccaaagtcacataagtaagtggtacgtctaagttaaacaagtcaaagcccgtgttttcaggccgcttatatgtactgcctctattctatttccccaagtcatttttgtt

SEQ ID NO: 20641 - DNA, 600 bp, Bovine  MMBT07112
tgtctttctgttcatattgtgtctgactctttgtgacgccatggactgtctgtggaattctccaggccagaatactggagtgggtagcctttctcttctccaggggatcttcccaacccagggatcaaacccaggtctcctgcattgcaggcggattctttaccaggtaagccacaagggaagcacrtatatatatttcttatcttttgaggtcctatacgaattaggtacacacttaggaaaaaaacacagtctcttgagattgtaatatgggagctagacatctttatgttcagaaasgttagaggtatatggtctgacagaggcagaacaacttcagtccccataattcagctactacagaatttgagaatagagccactaaattgatgatatggccatagcgtttacaaccagagaccgtctaagttcttatccatgaaaytcgtaacagctaaccttcttgaggactgctttgtgaattttcaatcagaaggacagtccccaaagggtggctgagtctggatcattgttatggaaagtgattgagtaagtaaaaatatgtgtcatgagaagaagcagccagtagcttccttttag

SEQ ID NO: 20642 - DNA, 600 bp, Bovine  MMBT04220
taaatagcaacgatggtaccgataacaaattagatgagggaagccagttcccttcaggaactctcaattcaaacagagggcatttatgctgagaagaatggaagatatgaaaggcagaggccaacagacaacagggacagagattagctcctgtcatcagtcacgaccgacactgggcatttctgaggttgttgatggttaaggaaagaaccttagaggagaaaatgaatctcttagaagatgtgaggttgcttaatctggaagacagaagagaagtttgaagaagacgactggagtgaygggagagaaagattactcggggagaattttgaactgactgaatcagagaggaaagaagatgagtttgcagtagttgaaagtaccatgacatcggggaaggtggtgtggtgatggcaacgacaatgatttcagagagtataagagtgcaacacaaaactaccctcagagataccaaattactttcatattcatcttttcatttttcccccataatgccctgggggtacatagagacatacaagtcagaattcatccaaaaagctgtcaagatcagaatttggggagaagggatgtaaaagt

SEQ ID NO: 20643 - DNA, 600 bp, Bovine  MMBT22308
tccagaaatgtgtttgcttggtattagttgaatcccttcctctgaagaagccctggtcctgggagctgtcaggaccccctcccagcaacactcttgctctctgtccgccgcaggctctggacacccactcccagcaccagcagaggcttgtcttcgatgacgggggtacagcccataaactgaaattgaatttttgctggagtgtggctgagggaaggaatgtggggtatgaggcccttacccccagccacttcctcgtcactctgggctgctgtctgtttcactgaccaattcccctcrgagtcgcatctgagcccctggtgtcacrgacacccagccccaccctccccatcagctaagctttcagtttagggagaaagggcggttgtggggatgggagggagaggcagagggagcagaaggtgatacgggggagagggatggcagggaaggtggacaaggaaaaggggagagatgagaagtgggggtggggtttggggagcgggaagtcagaaggatggagagagagggcaagaatcatacctggattcctccttcgtgccgtcaagcggattatcaatacataaagcgcgtgaatga

SEQ ID NO: 20644 - DNA, 600 bp, Bovine  MMBT18611
agtaggcacacataaatataaacaaactgcatataattccatgagaggattaggtcctaatggcccagcatccactctttgaattaacttctgtctcaatgcatcaagaatggcactagctatacaccattcttggaatgagaaaatatttgagaaaacagtcactcaaatcacttgtgtgttgtggttcaaatgaggaaaactggttgagaaaatttaattcatgagtgmatgtgaggataaaaagtctcacttcctctaagttgcctcctcagaccatccygtttcagagttagttartgatacgtcagcaaaattaacagatcgttgaatttccacacagttttggtaattctgctcgcatctattatgtatgtcatggggtagaaatggttaaaattgaaagacccctgcttaatgactggtgtgcacttaggagacagatacacagccatcccagtaaggtgactttggggaccctgtagttaatggctctgtaagcagatccggccttttaatggtttcacaaaaggcacatacacaattgaggctgcagttttgagtactgtctggtcctgataaggctggctgggaacaccc

SEQ ID NO: 20645 - DNA, 604 bp, Bovine  MMBT14383
  misc_feature (1)..(4): n is any nucleotide
nnnntactgactgggtctatgaaataaatatagtgaaactgtaagtaaatttagaattcaacctgttgttcagggtccagaattgttattgcataaatggccgccaaatgtaactatgctgtaggtcaaaagaaaacaaagccaaaaaacaaaaacaacacacacacacacacccccccccccacctcttcagctaagtctacaaggaaaggtcagaaaggtgcattttgtgttgctgcttaactttcaattcccaagggtacttgtttgagtgcaactgcatgtgtactgctttgagaaggasggactgtttggagaacctagaactttggtgtgaaataaaagatttgcaaagtactcttagggagaggagggagatccagacagcagagtaagaggatgtggaggtcacatccctctaggaacatatcaaaaatacatgtacaagacttccctggtgttcccatggctaagactccacacgcccaatgcacagcatctgggtttgatcccggtcagtgaactaggtcccacatgctgcaactagagttggcatgccacaactagagatcccacacgttgtgaagactgaaggttccctgta

SEQ ID NO: 20646 - DNA, 598 bp, Bovine  MMBT06845
  misc_feature (1)..(108): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttcttgagatttcatctttcagtagagaaagacccagtcaaaaaaagtagtttaaaggagtatgtgtgtgtgtgtgtgtgtgtgtgtgtaaatggagggagagggcgaaggatagtagtagtacaaatctatttgtacgtttgaggtcatgcttagtcaagtacatgattacacctttgtggcaccccrgataaaatccatctggtatctatcaagctatcttgttcttagagataaaataaccctgctgtctctataaagtaagcatcctgagaatcaatttgatgtctttttctctattatgtaatacaatgtccgtcatataataggtgctcaataaatatttgttgaatgagcagctacttgaaggcagtagctcttgctgcttaataatttaggttctggatttatagaaacgtgcgttcaaactccagtttcctcatttgctatctctgtaattttaggcaacttttagatgtttatctgt

SEQ ID NO: 20647 - DNA, 601 bp, Bovine  MMBT06256
  misc_feature (1)..(1): n is any nucleotide
nttatttttattgggtaagctgccatctaaagtatcagtcaggcaagcctgctggttcatccttcctctatgcccaacagctaaatgatgatgtcgtaacactatgggcaattcttggcatttacttcttaaaaaaaaaaammaaaaactaaaaacgcatagttggctaactccattcttaaagagcagcttatatcacttgtactctcctgacaccagaaattcaaaaagaaaatgtcaagagttacggagttctattttatcatcatcaaatatcctgcggctttagagcaattatcaytgcgctttacccatcagctaygcaatgtttattcctggttttctacggacacaaacatgtttaggaaatcaactacaaagataagtgtggccattggggacaattctcgtgctaacgatcattttcaccaaaagcagggagcagggttatgaatcatctgtgaccacttatgcttaagctgaatacattaaaatttaatggtttcgacacaagaagccagtcataagtctgcacatcaaggcactaatgtgtcgggcctaattgtacttagatgaagtgagtcaggaatgcatggcagcc

SEQ ID NO: 20648 - DNA, 600 bp, Bovine  MMBT21628; identical to SEQ ID NO: 4844

SEQ ID NO: 20649 - DNA, 600 bp, Bovine  MMBT12276
cacgctgttctcctgctcccaagatctgggggctctgctccttctcagaaaagccaggacgtccaaaaagtctgggagctgggtggccaggtccacagacaggaggggaaggcaccccactgaccagggggttctcttctcagttagaccaatggggtcactcagatgggtgatgacgatgcacgttagaaccgtccaagttccaaggagccgggatgggtgaccrtcagtgatgcattaatcccgctgggctggcctctcccagtccctcggggtcagaaggttctcctgaaacattcrgcactcagcagtcatgaggaacggggaccctaactcactccgggggaaccaacagaccaccactgctcctcttgtgctctgggggaatcttccggggtgtatcagtcagctagggctgcataacaaagcacctcagttgcccagcttgcacagcagacattcatttctcccaggaacggaggccggaagtcccagatcaaggtctgrctgggctgggtctcaggtgcagcctctctcatcggcggaagacactgctctggcctcacacagcctttcctctgagcacacgcagacagactg

SEQ ID NO: 20650 - DNA, 600 bp, Bovine  MMBT09059
ttgttaagcttttcaaaatattgcatgttcctgcgtcataatactttgccagtatctagcacctattattcttagaactcattggtgttcaaatgctgtcttcctaactcctatgtttaaaaatgattattcattttacaggtataaacttgcatcacagttttttacaaatatagttactagcttacactctgattttacagtgcttaatttaactcatgtttgtatggccattgaatgatatcttccaaattgtaatcacttctactgcgtcattgccttcttctacaatatcctacrtgatatgtaatttcatatgcctctaaccaattttttgtcatccactggtagttctctctgayacattgactgagccaatatcttgttgtcccccatcccttatttctagccagtgaccaaactcttgtaattttgcctcagcaggggcactctagttctgcaaactgtggccgtgggtcagttcctgccagcttccttgttttgcaaataaagctttattgaagcacacatgttcatttgttgacatgctgtctatggcagggtcgaacagcaaaggcacaaactggatcttatgattta

SEQ ID NO: 20651 - DNA, 600 bp, Bovine  MMBT02352
tcaatagaccttgaaataatgattgttatggtaaaaaaacaaaagcagaacacctaattgtgtggcctgctactaaatgacatgccctgatgaaagagagagaagaagaagggatgtgtgtgagggagagaggtaaacctggccaaatgaccccaaagctaacatcatcagtagcctgggaagagatatcctcttggactataacctgcgagtcaaggcctcctgagctctgctctggggaggtgaaggtgccgtttcttgcagtcctggatatgtgctttgttgcaggccccccacttkgcttgtctttgcagggctgtcaccgggtgattcataactcagtattaactgcagacgagggaggagtgaataggggaatttttttcatgtgacataaagtaaccrgcatcagggcttttccacagaagcattaattacccttgtcagtctaaccaagaacagattttaacttcaaccaaggaccatggtatttcattggcacccagcaaatgtgcaatgaaggctttgctcttcatccatgagtataataaggttaaagtctcttgtgatttatgatattccccctttctgtttaaacga

SEQ ID NO: 20652 - DNA, 600 bp, Bovine  MMBT03691
aatgatcaaagattttttcctactctatcacatgattgaggtattaaaattaaattcctttctatgcaagaagttcctaaaatcttaaacactgccttaaatttcctaagtactcatggaagagagggccttgaataaaattcccttaggcatgtaactagaaaactttatatcaggccatggaatagtgagatgaaatatcaagaggtcttgtaagtagtgtgattatataacttatcatccagtgtagtatgtaagagtggaagcaagactattaataattacacctataaacaggayagaactacctggctgttccagataaatgataacaaagagtcacagtgttgatcttgaggctaagaccctgctgacctctaatcaaatctggaacaagctcttttcaatattgcaacttcaaagaactcacagtctttgtttcactttactaatatcatccatctgaaatcctctacctcttagaaaaattgtgatggacgaaggcttcctggcaagtgtaagcatgattcaccgacttatcctgtcctgagtgaaagataaacaagtgaacaatcttagaaacatatacctaactttgca

SEQ ID NO: 20653 - DNA, 598 bp, Bovine  MMBT11997
  misc_feature (1)..(15): n is any nucleotide
nnnnnnnnnnnnnnnatctgatattttagatgtatccatatttataaaagtgtaaagcacaatggaattatgctggaagtctcaaataatatttttcctactttatattcatggaagagatgagctaaagagagaacaataatgagaaatggtggtgtgtttttctaagcacttaagacataattgccaactgaaaccctaaaaatgtttacatgtcattaaggtttgcttcttgtaacaattttaaattgattatgaagggattgggtttgtaatctgtggtagtatgtatcctagttsccatagtgacgtaagtagggttgtgccaaagcttactttgtttatatcttaaattgttggattacatcatcaaagcagataaaagatatgcagaactggtttacctgattttcttttggctagaattaatattcatagtagaaccttattaaaatgtrtttgtattgtaggtggtgtttgtatttttatgaatatgtatggtttaaaaatattttcagtatacaagaaattcaactttcccaataaacgttcaacttcacgtactctaaaaatgtttgccttttttctatccacataa

SEQ ID NO: 20654 - DNA, 600 bp, Bovine  MMBT21637
acaaaggaagaaagtgaaaagaaagttaaaggcagcttgagctaccaaaactaactgcatattgcaaaaggaaccatttcacttgactgaacagttcaaacaaatttcagctcctgagcattttaaacacggagagaaaacaatataaataatgtatgtgtgtgtgtgtgtatatgtgtgtgtacatacatatacatacatatatatctatatggctgttaatgaatcatttgcaagggacattttgaatgtaaaatggtgtgaatttctacactcccttctttctggctttccaggcamaagtcccatcaatctctaaaccctgacaccaggcagttcattgtttttcaaatttatgacatttttcagyccactgtttttaaactgtcgccctcagtgggtagctggcacaactcattgctactctcagctcccactgagctcatcgccctaggagtgatgtgctagcaaaatttccagttgactgatctccaggatggtaaacactctctgtgtgcttcctctgatgacatcattagttttgtcctccaaccttayccagaacagaaataattaagattgtgwttgtccatcccaaac

SEQ ID NO: 20655 - DNA, 600 bp, Bovine  MMBT10879
agctccccaacctcccaacatatgcaagtccagtcttttgcaaggaaaggctttatcaagtaggggtggttattgcaatagggagccacttaaagaccaagccaaggaaagtgtataagtagagactgctggatacatggctgggaaagaggaacgggagtttctaaaacctgctagaagaatcttgaagcttaacaaattacatgaaatgttgcagtaacaggaaaatagaagcagggaatgtttgcacatggggcagaaatctgagcctgagatagatcaaagaagttcaagtgtgcraagttcacataagtttagagactagatgtacttgtcacaacagcctaaagttatgtcaagcacaaaggttgattatccttgtcatttctcaactgaatgggatatccttttaagtaaaagttacaattttctatttaatcttctattttatatgaagacttactattatttctacttgtaaggacttacttgagtcataaatttagagaaggcaaagttatacatcagatgcttttcctttttccttttgttatataaagacagttttccagaagaaaaatctgttgtctgtcagcaagc

SEQ ID NO: 20656 - DNA, 600 bp, Bovine  MMBT04958
aagtattcrgagtatgcttaagtcttagcctgtaaaatatatctgcaactgaaatgttacctttttctgaatatcaaaaatctgtgtacaacttccaatctgatatggaatattgtacttcagatctcagtgagattatcttcaagtttactacttgttgaaatggtatttattgaaaattggacattctgtcacacacaatctaacttggtaacattagaagtgatgccaagtttcctacaagtcgtctctgtctccctgaaaaatttataaggggaatcctagcagagactggcagtrctaagatttaaatatttttcatgtacttaaactttaaaatttgtaaatttcactaatgaaagtaggtaagaaagtactgcatttagattaaaggacatgatgttaaaacttgccttacagtttttagtacatctcaagttggaataaatcaaaaaagataaaacttaatgagtctgctgttatttcttataagacacttgcttgtaaaaatttttctctgccttcatttatttttatgtttagtttaaaagctaaagccaagccaggaagaggaagacaagatgaggaaccccaaatcaa

SEQ ID NO: 20657 - DNA, 600 bp, Bovine  MMBT18575
catggaataaacaagatgaagaaatcattggttatcacttgataatgctatgcaatgttgaaaaattataccatttgttacactgaagtgtgtgctctttttaaggaagccaaactcttctgaaattattgaaactgtcccatctccactcctctgaatatcctattttgtggcacagatcaatacactgaagcttcatgattccctgaagggctgttaggacattggtagtgccacttctttatactcaaaacctcttgggggaaaactgctagatgtatcatctgcctagttctgctmtattcccttcttaaaccattgatctctgctcctaattctgcttcagcaggaatatctcttaaacagatgtcttctccattttctgtagacactccttaggtcttttgaacttaacagacttacaagtctttaatcctctattcaatttgttctaaaacctttgcttatgaatctatgtaaccagttttcaagacactttccttatttaaagaaatgtaaaaaacaaatccccaaattatccatgtaatatgaaaatgaagtatgattttgcatttaaaatgttttggtttgggttttaat

SEQ ID NO: 20658 - DNA, 455 bp, Bovine  MMBT19008
tccagtgaaatcatcatttctcagtgagaaataagcagtgcatttggattatttttgttacatttgaaaatttttttgagtgtggcccactagtatccacgcggaatgtggtaagaacagagtgctatagacacaaaagagaggacgtataagagggagaaaacagaggaaaattctactgccacctctttcccctctacacgatggcagatcttcagggtccaccacccaccaccaacaggaacaagttccaatgggctggctctgcatccatgtcccccagccccaccctctccacgmacacacctatcccacctttccaccttcctyatgattggctataggaaatcctggggtttcaagcttttctcaagctggtcctggcttcctcatccaacccattgaggggcctggcacctgagctgggtcctggagcaagggaatgaatgggttgg

SEQ ID NO: 20659 - DNA, 598 bp, Bovine  MMBT00511
  misc_feature (1)..(15): n is any nucleotide
nnnnnnnnnnnnnnnaggaagagataactccagatttttaagaatcagaaagcaattaactcagtggaaaccatttactgtaacttcttctccatcataatgcaagttataatcacattatggatctgtctacagaaagtcaaattccttaaagtaatgtcacttctgctgaatactacaggatcgatagagccaaacctcacacacagcaggaactcaataaatgtttcctggaggtaactgtgatggtggtacccggcatgataagcagaggatcgttaagataacatttatcccctrtcytttaactgatatagcctcttccctctgtttcaggagagggatctcttttgtgtttttcaaaagcatttccgagacaagtataaacagtgattacatttgccactgagtctaacacaacaactcagagtaagccaatgctgattattttgactggagccaaaagtccttaactgggggtgattctgcccccatgggatatctgacaatgtctattgccacaactggagggaagggctactggcactttatgggtagaggccagggacgcagttaaatacctgtaacatttaggaca

SEQ ID NO: 20660 - DNA, 600 bp, Bovine  MMBT13740
ttcctgaaacagtacttgaatatatctggccacataaaatcagtttcagagggaaaaaaagaaaaggtttttttttctaagtgtcaagaaatatatttcttatttgagatattttatagtaatattatgatacattttatcacatcaggaggtaaggtgtctttcaaatataaaaaacctccttaaaatgaaccacgtgccatgtaatgtattttgatgctacatttgcaaagcctgtctaatagtgtcaagaaatctaatattactgaaacagaatgcttgtaggaattatgagcttgratattaagtgctaagaactcttcagtttaatgaataaaagaattatcttgtcactaagagaataaattcaagccaataagcaccatacactgtaggtctgagtgaaaataattatttcctttgagaaaatcaaaatagatcctttaaaactgtaacctgcattagattttttttttttctaaatcctgcatggatttttttaaacacctttccaaagtagtctataatttagtttttatacagttatagtacaggtcattaaattaaccatcatttctgccagcacatgcattcagtaaa

SEQ ID NO: 20661 - DNA, 600 bp, Bovine  MMBT14912
tcttttgtaaatattaaacaagacttacaatttccaactcctctcaaataagaacaatgtatttttgtcttaaggatttctattggtaaaagtaagtagatcaaaccaataaaagaaaaggattaaattcctctgactcaaggtaatgcaactgttttcaatagcaagtgaattgagtttaattttgcttttgcagggggaatgatggcttctcagggaatttcaaccttttacaaaacaagtatagcacattcaacaaaaagaatatatacttatatctccttatttgagatttctgtrcatatcattaactccctagctgaaaatttttattttgtaatttcagaatcactgtacatagacgttaactctcatagcttttcagggctttattttcttatttttagagagcacataaaggaataaagatgaaatgaactaaagrtatgtycagagttcgtatcatgctgctgagagttgtacatattacttcttataattcagattaaatgtaaaaaaaaaaaaacttcctcataatgatttctttsatgtaaaaatattgataaaaaaagaagtactggatttcttgctctgaagtct

SEQ ID NO: 20662 - DNA, 602 bp, Bovine  MMBT12402
  misc_feature (1)..(2): n is any nucleotide
nntagatgacatattcagaagtgaaaattttaaaaatcttttgcctgcagagagaaatggacagcaacatattttatttcctttttttgttacttttactacacacacacacacacacacacacamatagaaatactatttctatttgcagagatagaaatgccagaatgagtagaaagtagagtcctgctgtcactgagagtacttgaatctctaattctgaatgagttatctgagggttgctggtaaataaaggaaaattcttgtcaatctttacttaatttgatgcacttacttatttrtatctctggagagaaactctctcaaaacagtggrccaataacatctataattaaaatactacacttaaagttttgctttcatttaagtcagacagatttattcttttaagtttcatatgaacacattaacatgaaatatatgcaacaaaatctgtgtaaggtgaatatatatatgagtttgagttttaaaaaaaatttgtcttggatctctatcatttctcaataattttttccatttttatgtggaaataaatcattgttcgttcacatttgagtatggtgaagtgtagtgacattcca

SEQ ID NO: 20663 - DNA, 600 bp, Bovine  MMBT02654
ggggctggagcctgagttagaagcatagttgacaaccatgacccgctgttagcatctggagttggaagagcggaggggaagtcttgcgagactaaacccttaacttgaaagccaaggcagggggtctttggaccctccagtccaaagccagatggtcagaagctcaggtgacaacctgggcctgggactggtgtctgaactgggagaggggcagtttggtgggactgagccctcgatattgtaatctgataccatccctgggtagatagtgtcagaacggagttgaattatagaacagamagctggtgtatggagaatgtcttgatgatgtagggaatacccccaccctggccacagacattggaaactggtattcagaacctaaaatatggatgagttggatagaagtggagagagggagaggagccatggatgcctcccagggcttgggtctgagctcttgcattggatagaatggtgcattttgtgctacgcaggggatgttaaaatcacattcaagtctgacttgaaacatttacaaattgggctgcacaccctctaagcgagtttatcatattaatgaactccttcccaaaataa

SEQ ID NO: 20664 - DNA, 600 bp, Bovine  MMBT22167
aaaagttgatttgaaagtggacatttgagatttagaaacttttcctccatgttttcagatacccagttaagacaaagctattacaagacacgcataaatcataattgctacccataactttgttaaaatttcctccagatgatttgacatagttaatggtaatatactgtaacaatgtttctcaaacttcagtcacttgagtgcatttttcagaagttagatcatacttacttatctattatttccttaatatagtcttgattcaactcaatgtaaaatgtattttaaactgtatattayttttgtaaatgaagaacacttttttctaatacgtattaagtgggtagctattcaaatatttgtgcttcctgagaggtctgtgataattagcaaagtaaaagttgctcagtcgtgtccaactctttgtgatcccatggactatacagtccatggaactctctaggccagaatacttgagtgagtagccttttccctctccaagggatcttcccaacccagggatcaaactcaggtctcctgcattgcaggtggattctttaccagctgagccacaagggaagcccaagaatactggagtgg

SEQ ID NO: 20665 - DNA, 600 bp, Bovine  MMBT15884
tgtcaactacatctattaaataaaagctgaaatctaaatgcattgtacaaaaaaagaggttaaaaaatgctaagtattttaccattgtgcatgctcagttgctaacttctgtcggactctgagaccccaaagactgtagccatcgaggggatggcctctgtccataggatttttcaggcaagaacactggggatactactccaggggatctccctaccccaaggagatgtctcttgtgactcctgcattgacaggaagatggattctttaccactagtgccacctgggaagccacatttyacccaaggtcatcctaattaaaagatgaactagaaataagaaatgaaatttagtaaacgtctgcctgactgggctcttaatattgcaaagtcttctaattggtattaatattacaacagagatgtcaattccagccttccatgctgcctagtacagattgcattttattagtctaaagacacaaatgatttgaagtgataattaaaatgtttctttagtcagtcctattttattccttgtcaactgattcaagatcacatgccattgtccagtgttacattccacactttaagcattttt

SEQ ID NO: 20666 - DNA, 600 bp, Bovine  MMBT16782
tccttactttgctccaggtgctctggccaccagaagtcagctccttccttttaggcaaaatccaaaaagtcacataaagtgtaactcctgcaaataaagaactaagcaggtccaagacctgtgtttcctgctagataattgccactcatatggcccaactctcctcaggttcaatatgggtgaactgaacccttcctgcaaacatagcctcctccctaccactatcccctgtctgtgtctgctagcaaaattctcattctccccagaggtaaccagaccctcagagatctcttgcctccyttctctcaactccactcctggtcaccaagtcctaaccagtctttcctgcttgctgctctcttcctctggccccagttctacaaacctcatacctggacaatgagacagcccctcactggcttccagccttcctctctctctgtctctctccctctggtccatagctggcccagagctcagtgagagcaaagccaccaaatcacctctctgatcacagcccattccacatgcccactgcgatgctggggtagacagtcacccataagcaaagtcatgtcctattaccctgtgatcaccagt

SEQ ID NO: 20667 - DNA, 598 bp, Bovine  MMBT03130
  misc_feature (1)..(39): n is any nucleotide
nnnnnnnnnnnnnnnnnnnnnnnnnnnnnnnnnnnnnnntgaacaagcttggggaatatcatcttaatgaaatgataaaactagaatcattagtaatgtgacaaatcagttacatgctctttgacaagatgcaatgagaagaatgcagcatcacttctatgctatgcctgagagaaataaaactggatactctccaaaaaaaamacaaaaacaattctgtaatccctcaaagtaccaagatcctgaaagtcaagaaaagaagaccaaagatagaggcaaactaaagagacacaactaaaygcagtgtgtaattctgaactggatcctttccttataaagacatcactgggacactgactgaaacctcagtgaaaggataagataggatggtattaatagcatatgtcagtattagtttcctgattttgatggttgctgtggttatacaggggaatatyctcatttgttaagagtacaatctagctttaaagtatgataggggcatcctgtcaaaacttactctcaaatgtttcagaaaaaaattgatttgttgtaacttttatgtaagttcaagatagaatcaacattttaaacttca

SEQ ID NO: 20668 - DNA, 600 bp, Bovine  MMBT04601
gtagtaaaggtctgaagaaggaaggagaaaggaatctcaactaaaggacagcccagagctagtttctggaacgtgttcagagcagtttttgacttgatctcaagtaagttcatcagagtaaatgttgaggggttcaagccttccttttatttttaggcaaaataaaaactcagccttcacagactattgtatattaaaaagtccttctaagaaggatactattcaggaacccctggaaatcgattttaaaaggttaattcttttcaatagtgcaccaactccctcctgctgtattttctktttgcttttgctttttcccccctgctttatagaaggtacatcmgagttgatgactttcttccatttcctgcttctctatgtatttgaaaattaattttgcctgtccctcccctcmgccttaagcagagtctctatttccaactaaagattttaattatttaaaggtcttagggagtttttattttctctatcatgaattgtcaaaagtcctttccttgaatcccaagtttctctttgtaacgcagatttaagcattttcattcctttagttccaccgagacctttagtaaatcttaatac

SEQ ID NO: 20669 - DNA, 600 bp, Bovine  MMBT06856
tcctccctcttgagtctccctcccttcccccatcccacctctcttggtcatcaccatagagttgtccttgaagcaccaaaggaaaagccttctgcagcctttaaaaaagcttttaagctttttttcctgaaggtcttcctgtgttgctgtgatttttctttaattgtgacaaaacttgcttgggataactttaaaacattaagctaccggcaacctacataagaaccaagatcacttctgatgttttaagaacatctttctctttaccagtcatccgtggaataatttacatcaaagaawtggccattttacaaaaacaaatcctcctaattcatgtgctgtgtaaggttcctacatcatgttgtgaatgccagattagtctctataaacctctgtctccttggctgtattccgaacttgattcatcattaatccatgccagagttttacaataataatacagtaaacacgattttgcatgttgactagcagtgtagagttgctgtgcctggtggtggtggcctttaaggaaggacgaggtaatatctttgaaaagaagaaagaaaaaaaccacctctgtaagtagttctaacatagttt

SEQ ID NO: 20670 - DNA, 600 bp, Bovine  MMBT08233
taaacacaatgcagttttctagaaattatactttgtcattaatttaaatttcaaggaggagctggtggaagtaaaaaaaaaaaaaagcaaaggaaaataaatacagttctctctgtaacagaattgtctttgtaatctctagtgtttggtgtgatataacaaacgaatttattatttctttagagagacgtgttcaagtggacaatgattcttcctcaatgaaaacttttaagaaatttgattgagatggaagaaataattctcttctatcagagggaattttgtaaccttatcaactcyctattttgtgactaaccaaaatccactgtacaatttaaaaaataagaacctattcattgctttgctcatttagcactataaccagcagaaattaagcctgtcaattataagcatatgaacagcttttattatcaaagagaatgacagaattctctactttaatgagtaatggctgaggccaaccgatacttcattcacagatgacaggacatcctattgttgatgctgtgtgtttcagcctggaagttatcacttatagatttactgtgcccctattataatgtaaaagtacaagtaaac

SEQ ID NO: 20671 - DNA, 544 bp, Bovine  MMBT07433
tattcccattgtttccctcccttctgaaattcttcagccttgccatcaaacatttttactatgctcactagaattatgcttttatgaaacattgatatgctaaagaatacaatttcaagctacctaaccattgcataaatacagcctggaaggagataccatagtgactcacataaagttaatgaaaaagaacgactaatgcatagcagagtgttagatggtctgtttttattaaatcaatattcgtgcataatttacagagtaaaatgtactacaaagtttatcatggataacgagagkcattcccttccccacacctctttccaccaaagtcctgctgcccagtggcaagagcttcagctttttagctgattctttcagtgcttgctttcatgttgcgaaatattataattaaattcagaccggatatatcaattctcttttaaaataggggaggatttaactctcttataccaataaatacacacacacacacacacacacacacacacacacacacacagttctctgttacccattatcc

SEQ ID NO: 20672 - DNA, 600 bp, Bovine  MMBT07042
agggataagcagagagcttcagatagagtcagttctaaattaatgcttgaaatattttttgaatgcatgagcacatgcctgatttcctgtcccaaatatattccagtgtaaccaaacaatagagctcttgaaaatcttcacaaattttaaaataagaaagctttcatatgtgacattatggtcaaatattccttctctgaagcaatagccttctttatatgcataataaataatcagacagaattctgccaatatcaactttatctagcttaatttttttttagtttttccaagcttctwtattaatctattttctagaataatatcccagatatagtttacaacccttttgttatactatttccatatcaagtcatggtattataattacattgtaagaaatatgatttcactggataaaacaaaattcatttgagyttgatggataaaactacagagctacttgcagaatcgattccatcccactggtatccaaaagtagttcagagggyacaccagaggcaactgataccttatcacaaatgaaaccctgtttctcttaatgcttacgacaaaactcactctcctgggcactcatgc

SEQ ID NO: 20673 - DNA, 515 bp, Bovine  MMBT14659
taagcataactgctacttacactggtgcatctgtagattgtgtttttgatgacacagacttattttgcctattctttcaaaacttcatactctttgttttcattattctttaaaaaacaaaaaaacatgtgstagaatgtttagagaaggcattcaaaattcaatgcaaaaaaaacaagagcaatataatttatcgtactgttggattcaacaaatttgtttagatgttccaaagcccatggacatgaatcaatactggattaaaagatcagaaatgttagcatatgcatactctactamtttgctagtgtttgaattaaatgagatcggagacaacacattattatagtctctgtgctctgaggttaggattgaagatgcctaatgatgcacttggacattactatgtattatgtgtgtatgtgcttaagttgctcagttgtgtctgactctttgtgactccatggaccatcagactcttttatccatgtattgagtgcttactaagtgccagg

SEQ ID NO: 20674 - DNA, 600 bp, Bovine  MMBT11144
ggckctggctgacagcccttggggaaaaccctctctgctacaggaaatatcagttatggttcagaaagaggcattatttcctttaagtcagtattgatcctccatcacattgtggttctaatgggcactgggttcttagaagtgccaattctcagatgaaatatgaaatagagctcctgccttttgtggtcaatggtgagcctgtggtagtttgacaggaggaagaatagagaactctggtgtcctaaattgactgcatctcttcagtcttcctgaaatttgatctctccttacagttcyttaccttttgctcttaactattactttgacctattaagcagctgtttggtttacccagtaataccatttctttggcaggagaaaaaatgacccataaatataattttaaagcactactgggcctacatgatagtaaagtgtgtgacaaatatatgtttttaatctatgcaataactgaagttactgctggccacctgcagcctttacccctgtggttttccttactattgatttactggtgctataaataattgtcttttctttgcttcatttttgctgtttattttactttttgtattg

SEQ ID NO: 20675 - DNA, 598 bp, Bovine  MMBT07889; identical to SEQ ID NO: 4610
  misc_feature (1)..(50): n is any nucleotide

SEQ ID NO: 20676 - DNA, 600 bp, Bovine  MMBT17213
tagaagctccgggatcgcggtcaggccctgagcccgctgtcctctccggtcgcgctgtacatagaaaccgttgctacgggctggaggatgccgtttcctttccgtctccggctgcaggtggcgcccagccttgtggatgctgggaagaacgtgcgaaggtggaagtcaaaacagtttttcccgttactagcgcattgcagtttgcgctggagatattactgacaaactgatgagtaaatgtgggaaatggatgtgagttaggatggtggagaagttaaccccaactaggaccacaatttycctaatcagagacaagttgcaagcagatgtggaagaattctaacgagcaaataaagtataacttgtgttttggagtttgagagttaacattaattgatcttgagaatgtgtatcctccccaccgcagtcctccaaaaaagttctcaaaaaagattctcagaaactttaaaacagggtttacgttgaaattctcttaattaggtaagagatgtctttatcatttctaacgtttttcactatgttttattcaaatcataaaacctcaggggtttcaagattcctttaattgaaggtaatcta

SEQ ID NO: 20677 - DNA, 600 bp, Bovine  MMBT20571
atttactttgttaggagtacactttttagagggccaagtcttaagaaaagtcagagttaggctttgttgagttttattgctgttatattagatttggtaatatactgtattaactgtgtgttcaatttaagctattaagttttaattgtcaaaaacagataaaatggaaaactaaaattttctttctccaaaattagrgaattcaaatatggtctaaaatgtattcatttgtcttatgcttttgttctctctctctgtctcttcaatgtaatataatatgcataaaacaccattttaacyctttagagacatacagttcggtggcctcaactacattcacattgttttgtaactatygccactgttcatctccaaaaggttttcatcatcccaaactgaaattctgcatccacaaaacagaaacaccccactctactcacccccgagctccaaataactgctaccctaccttctgcctttgtaaattaagatggaatttggctattctaggtacctcctgtaggtggaatcatatttgcacttttatgtctagctcatttcacttagcataatgtcttcaagtttcacccctgtagaata

SEQ ID NO: 20678 - DNA, 600 bp, Bovine  MMBT22432
caatattttgaagggtagacccacactttcttagtctcaatatgcaatctccacacccgccccctccaacagcatactttagttactgaaagtaatctctcaggaattctattcaaaatcttcaccttcaatggtttaattttctttctgactcaaatttttaaaaggaagtgtcaaaatataagaaaaaaattaaaacsatggaaataactccttttccccaaagtttttcactattattatactctaaaatggtaaaaaaaaaaaaaaaaagcgttcaaatttggcttactcttgtgrctgactttcatgggtctttctaaaaaaaattcttttcttaaaaatgcagagttaagaacttgcctcatggactaagttaaaaaagaccaaaggaaggtggcttcatartacattctgaagctggaaaggtaatgcaccctacagttagaggaggaagtactcaacttcacmcccaaatcaaactcagtcygggacactccagtattaacaatgagcactttccactgcagagattatctatatttggttcacatatactctgttcagaagtccatctcaatatcttttgataatttataa

SEQ ID NO: 20679 - DNA, 600 bp, Bovine  MMBT16739
tgtctaagactgctgataatgtactttttgatgacactgaaaacaagccaaatattcacaatataaaaccatgtgataatatacgtgtaatgtaactaaatttctccaaggttactagaaaattatacatatatttgggagataaagactttgaaagcaaacacgtgcaaccatttgagattccacagtcagtttgacataacatcatttacgaggaagaccaagaagatttttaaaaagggatacaaacaagcacaaacgttaaaacatttttaattcttagaaactcatgaaaatttyctgaaaattggcagctacagaatgatgtggttaacttggatgtgcgctttacaaataaatagcatttaccaacagtaaatgcattttaatgaaaaattacttgcacttatgaattaaggtttcataaaagaaatgttatctatagctgatttccctgattatgggcaagtttcaaatttaagaagtatttaaagttttaagaaggagaagaaaaaataaaacttaccacctcttctactaagtcttcaacaataagaccttgttcatctgttcttagatttgtaacccacatccatccat

SEQ ID NO: 20680 - DNA, 600 bp, Bovine  MMBT13546
cctgaccagcacacgggtaattctagaacctggagcagtgtgaccagtgctagcacgaaacctcaggcttgcatgacctctgtactatgtaatgtgtacatacgtgctatgcaccatgtacgggtcctgcccaggtaccgactctcagcttgcttcccagagaatgagcatttcctttctgtccaactttctcctgacttctagctatctgctttgactttccagagagaaataagtacagtctctatttcttcagcaactactctatgttaggtgcgttactcatatttgttatctcaytgaatcctcacaacatattggcaaggtgttatttctctaattttacagataagaggatcagaatggggtagcttgttttaaaccctacgtcggtaagctgcagatctcaaatttgaaaccagaatcatctgcttccaaaagttactttgaatctctctgggagcacccytggggaaactgtcctctcactgactctgtttctccatttctgaaccctgacttcactctccrccatctccatgagcctcctgtactgattagtaagatttataaacattcagcagccagttttgttaagag

SEQ ID NO: 20681 - DNA, 600 bp, Bovine  MMBT20216
atgatattgaaagaaacaaatctatgttaatacttctaggatcacaagagttaaataaaatttaactcttgtaaaatgtttacaacattttaaaatcatgcatagttgaaagcacacatttcttcatcttggcccccagaggagccagtgcagccaggaattagacagaaagagtgtgaagcagctaaggtggtggggggaagctgttttctgctgggagggaaggaaaggatctggggctttcaggagatataaaagtgtgacaggctgcaaggtggagggggaagaggagtggtgacygtgcctgaaataccgggggctgggatgcccctggggctggaggtgctctggtgataggcagtcagcatcctctggacctgatcagagggtgctcagtggttgcagataaataggacacccactcttcttctttctaaactgaaccaggagtgcagtctctggggaagagtcttcctttcttggcatactgaagtctccagcttgctcctctgtcccctgaagcttcctctcctcaggttttgcccccctcagctccatctttgtccttgcttggctcacctgtgtttgctcacctcagca

SEQ ID NO: 20682 - DNA, 600 bp, Bovine  MMBT00954
cgtaacgtatgactctggagaacacaaacaagtgctcaacgaacatgtctaatgggcctaatatgtgccaggcctattccagtggatggacaaagatacatatacaacactagcaccctcaagaagctcagccactggtaaagaaggcagacacaaggaggcaattcaacaggaaacactcagtggtaaaaccacgtgcgggttactaggggcacagggggcgggcatttcatggaaaaccgaccgagccactcttccattcgcaagataccttcgctctaaaatgagaaaagaatagaygatgcctagcccctctggacagtaaaagcctacaaccctgtgaatgtgagtactgacaaaaaagtcaagtctccaaacctcagctcatactattattgaagcacagtccctaaccgcacaccaaaatgctaccagactctgagtgacatggagggcctggcacctggcttacctctggtgtggcctgagcaactttgcagactgtttccattcctcccagcttccagtgcccatcttcrctcacaaacacagacgacacgcagacattgttgtgtgtgaggtgtccctgggaaaaaagaa

SEQ ID NO: 20683 - DNA, 600 bp, Bovine  MMBT15704
atatatactcacataatagcatatcatagggcttcccaggtggtgctagtggtaaagaatccgcctgttaatgcaggagatgtaagagacatgcatttgatccccgggtcgggaagagccctggagaagggaatrgtaacccatgccagtactcttgcctgagaacttcatggtcagaggggcctggtgggctatagtccttgggatcacgaaaagttggacatgactgaagtgacagctcaaacacacacatatactcatataatagcattataactgtagttcaatgttttgaataayacttttacagtagagattgacctttctgaaaatagcaatgggacaattgtacaggatagttttgcttacccaggttcgatgttcttcagaaataagactgcaacaacaaaggaaatcagaaggcctctgacacatggtgacagttctctttatgaactggaccatgttgacataatctttgaagtgcagagtatctgtgagatatcaagagaaactatcttcagatcttgttaatgaatgtaatctggatggtatagaaaaagattagatagaaaaccaagttggagaccttttataatg

SEQ ID NO: 20684 - DNA, 600 bp, Bovine  MMBT13179
ttttcaaaatacctaaactgaaggttaaaaagcatcaatgtttcagcggctaggttagatcctcatcagagaggtttggatttcttggaggattttcctaaccactttgcaatttccttcagtccactcactaaccttgaatcagacaatgtgtctgcacttaatggtcctttgacacacatatgctctacatttgagctggaaaggctataaatattttttccttgtcttgagccaaatatcttgcctactgtggatagctacagggtatttaaaacaataacaaaaatgttcatgtayttaactgagatatagcatgttaaaatatttacagttaatacaacaatgcttctgtacttgttttatgaacttggcctcaaaagagtaaggggaacaaagtgttaaacatgcatgagctattattgtatttgtctccctcaacaaggagtaatattgactataggacttgagaaactataactaatcccatgtctaagaagaaaaatctctacttatgtagaggccatgttcaaatgacccaaatgtcctcagaccccataaatcatgagataaaatgagtgaaaattaagtactattaac

SEQ ID NO: 20685 - DNA, 600 bp, Bovine  MMBT04900
tcatccacatttcaactctaattcaagtgccttttattctcaaatgctaaactagatgcatgggaaaaggagattctagaaaatgtagttgttggtctctcatttgtgatgcagagaaattaaatrtgggtagggatgatgcttaattgataacagacaatacagtatgagcatattttcatttctagtggtcatatggatattgtattttgtgttgtgtttgttgaattatcttgccaattatttgtctgctaatcttttttatttgtagataaaatgttttgatattcgagatacaarcctttcatgaatgataggttttacaaatagcttttcctattctgttgtttgccttttctctcttaatggtgtcttttaatgaatagaagttcttaattttaatgtactgcattttagcaattctttccattattgctagtgkccatyatgagccatttaacaaatctttctctatcatttgtccaaactttttaaaaattgaaaataaaagattctatttttaggtatgtgtcttgtaaacagtcttttgttattttatttccctctccttccctgagtagcttggtatttttatgctgc

SEQ ID NO: 20686 - DNA, 600 bp, Bovine  MMBT07638
aaatcagtgaaaatttgctggacagtatctttaagtgtactgtcaagacttaaaaatgcatttctctgtatgttcatgtttgttcacacacatatggagaaatttggggagtgctttcactagcacttagctttttcacctgatatttggggacatatttgagacagattaccaagtactatttgcaaaaggagtttgaagaggtccatattttatttaaaggaaaaaaaatctgaactttcaatcatataatttcaacttaaaattctttgactatgggagttgtatccayagagcaamaagtacagtgctaggcatatggatatgagccatatamataaaattgctattttcataatctttactttcgacttgggttcatctttgacctataaagggaaggaccatctttttggcatcttgkgaccagacagttgtgaatgggttgaaaaaacaggatgacttgtttatgggtctcctattttcaaacacatgaactgtaattgacttctgagcaatttctaagtataaagtgcattctttaagataggtgtctgaacttcattgaactctgactggcttaagctgtaagggaggttt

SEQ ID NO: 20687 - DNA, 600 bp, Bovine  MMBT05943
catttttatttcatctaatgaagacaagaaaaggatgtaggagtatataaaaaagtctttgactttctacctctgtataagaaaaagatgcttcatagtatttattcatttgcatggrtgtctctgagtgaatttcaatgcaaaattaatgagtgttgaattatctgtcaggtacagaggatcatactgattattttatataaccaaaaactatcagactaaagctgaaaatactataattatatatacctctctactgaagactaytcaaaacttattttgcattttaatcaattacayagttgaaggaagtctttcattgttctttcacaacatttttttaacttaaagacatttttattatttgaataaatgtgaagactgactcatatgaatgggtctctggattatagtctgtcatttcctagcctaataaggatctcaatacatttgctacttaaatttttctaaaataatttttctaattatatactgtggccagtccaattattgaatcactctttttttataataaaaaagggtaattgttccattgaatcattttgaatataaatcaaataaataaatatcaaataaata

SEQ ID NO: 20688 - DNA, 600 bp, Bovine  MMBT07123
ctcaattatacaaatacaaaaatctaaataaaatggtagtcaaatgttaagagcaaggacttttaaagatgcatcatggggacttgcctggtggtccagtggataagactcgatgctcccaatgcagggctgggttcagttcttgtttggagaaccaagagcccacataccacaaccaagcctgcacaccacaagttgagagcctgcatgccacaatgaagacccaaagcagccgaaaaaaaagtcttaaataataaagacatcatctttcttgaatatgcatcaaaatgataaaggatrggcgttgggacatatagaagaccagattgtgagstgaaaaatcattaaagctgggttatgagtacagagaagtttgttttgtaccattttgtctctttttgtatatgttttaaattcacataataaaaagttgggggttttttttgtaatgcattgtggccaatcagtatttaccccaggggaacttctttgtgtaacactctagggtgtcctatgtaaacttcttctgccttctctggaaaaatacaaaattatcacgatacttttatccgaaagcagctttgtttttagaggatttga

SEQ ID NO: 20689 - DNA, 600 bp, Bovine  MMBT11785
tctataaataattaagagctggtcttgggtcttattttatgatcaaaaatctgaatcattatgaaattaaaagtccctttgcaagttgtgttttcatttggcctttaataagtaactttcaaatgtcttctttttgtaaaaaaaaaaaaatcatatcataggttagaaaagggttctactgagcgatatttttttttccatgtgagcactatcattaagacaattatcactgatcaccttttaatgatatttcaaaaccacttgaaaaaaaattttaaagggtcacataaagctacatarcttatgaagctgaacagcacaaatgggacttttgcatttgttcagacatgtaccaggttttagttcctacaggctcacagacggttttctccttagcagtttgccaaatgtattttagaatgtccaaaatttaaaatgttgatgtatgtgaaccaactacataatgaaagaatccatgtaccattaaaatgataatgtgagtcactcctcagttccctcaaatatgttaagtgcaaataactagaccccagggagaggatcagaaaggtaaacaggtattattttgagtaaaaaagctag

SEQ ID NO: 20690 - DNA, 598 bp, Bovine  MMBT06487
  misc_feature (1)..(40): n is any nucleotide
nnnnnnnnnnnnnnnnnnnnnnnnnnnnnnnnnnnnnnnntaaatgagatgctggaagtactcagtatcaataatggccattattattgaaatcattattgctgacaagctagaatggaacaaaggtggaaaccaaaggaaagcagttcatcctctgaaactctcagaggctaaaatcgtagaacatagtacattttggttttatttttaagattggtattaagtgataaacatttcagttttaattgacagcattttcttctcaatatcctcaatattatacaaattaatagttctctytttccccataattgagcataatgagtgtttccagtatttgcttctacacataatgctataattagtgtctctgtatatatagcattgcctttgtttcttctgtttaattatttcctaaggaaagaattcttgggatgttatttatgctttgcaaacttgctgagcaaatttccatgccacacatatttttactacaattactcttggatttgatgttcgcatttccttttaatttgctgaggatttaatagcatgaaaatgatgccccaaagttggttttttttttttttttatttcc

SEQ ID NO: 20691 - DNA, 600 bp, Bovine  MMBT08419
ttatacacatagagatgggttgtatattttattttccctcacttgctaatattttataaaatcccaaatgaaaaaaatacatatctaaagttatttataataacaaacatgccattactgaaaaaatgctctagggtaattattgtatacatatcaaactgactgaattcaatattaagaagatatttacatatattctctctctctttttttttcttttttttctctctctcttttaaagcatcttttccatgtctatacttaccataacaaaagatgaagagaatacatgtgagattmttttaatcattatctactagtcattttgataatatttagttatcctcaaatataaaastaatgttaataaataagcaaaataaaaaattcatttatcaaatgcatgttcattcaacttgcattgcacaaataatctaagttactgttagatttaattctgaagccgtgatttgcaggagtcttgttttcatggtcaaggtgacttctggatacactgagcgaatccttacacagaactgcaccaaagagaaaacaacatgtgtcaaccctgtgggtggaggtgacacacaatttaaaatg

SEQ ID NO: 20692 - DNA, 600 bp, Bovine  MMBT12250
tgtcgtgacccagcgtgttattttaaaagtgagttatattaccacctcacccacttaaaaaataaaatttaaagaacattaatgtttttagtcgatattaaaaattatcacttataaatgtgatatatgtgctatgaaaattaagaaaggagaggaaggagataggaaatacgtgctcactgggagataaggaactaacacaactatctgaggcacaaaaacataggcccagactccagacttgagaagcagaacagggccatgctggcaggctttcctctgtctacaactctaaatccygrccttttcattcagataggagattcattccaactgctttcaagcgggtatcataaagataaaatcaccaggtagtatctrgggcttggattgcaagtctgagaatcctgttttgggatagagcaactaaagacttgaaaaatgaggctgatttttgttactgacaggcaaaaattagaattttcatcaattagcataaaccagaaggcattaggttgaggaacaagggttagtcacccccttgtcagtgtccrtgatacctttcattaacagatacgtcaatagtggtgtcctctggct

SEQ ID NO: 20693 - DNA, 600 bp, Bovine  MMBT06011
gttaagatgtcaataacagttatcctgttttaaccaacaaggtagcatgacagaaagaaaggggaaggtggatgggtgtcctcagataagtacaacaaagaacattttttcccaacaattttcacctttccagaaactagggagatcaataaagcaccaatcaattcttttaagaaaggcaaaataaagtataaaccttaaactccctcttacaagaaaaggagggggtggtgaaaacaagttgagagagaagacttkattcagtaagtggtgcggacattgaaatgactggttaactcyctataagaaacagttaagcccaaaccaaaataaatcccatacataataaagagttacatttaacacatacagatagagaggagagatatacagacagatgtctagggatgagggcttccctgggggctcggatagtgaaatggccacccataccaggatcctcatctggagaattccatggacaggggagcctggggcctacagtccactaggccacaaagagtcggacacaactgagtgactaacacttttcacttcacaactatggataaatgaaaaaaatatatatttgaatataaa

SEQ ID NO: 20694 - DNA, 600 bp, Bovine  MMBT21292
tggtgaagaacacaacagcccagagtttgccactcaacatgctcagtagatattatgttttgttgtcgttgttgttgtttttaggaaagaatggtgggcatcctgatgaacctatttagaagggtgggcagaaagaaaatggaataaagtctgcctcaattctcagtctataattctgacagctggaagttagtatgcaaggaagatgaatacaaacacccaacagcctagctctaaaagcaaactggtagacgatgtaaagtaagaattctggtagtcctgttagaggcaccactgtcrtcttacccaccttctgggtcattttgacagcaactaagcactaagaaagggaggttttgcccatgaatgatagagagcattcccttttccagggactgaaataaaaagacaataatccgagcctgaagcctgatacgtctgtctgggttatatcccagtgtgaagaggggacaatgggttggacctggcacatgctctcacgctgagactgtaagccaggaatatttttcctagaaagcaacccagtggggagcctctgtgagaaagtgaaatataaattattcatttccttttctttgt

SEQ ID NO: 20695 - DNA, 600 bp, Bovine  MMBT08553
gcctgctttgctgctcaattccctgttggttgctttaaagccaacaaaggttgatacccttggacagagagagaacagttacaatgctaaaattagggtgggaatttgactctgacattgttcaatgtttgccattcactctaggaaaactttgtatctcttgccatctgtcaacctagtagtgacaggtgtttttttttacttaattaatttttgtctgtgtgccaatatttgatgttcataggaatttttctgcaggataagtgaaaactcatattttgtagcattggtttgcatttrttattaaccgttctgattttgtggtgccaggcagatcctgtaggctctaaatgcagttaggatggtgagaacctttctgaggatgtaagttggcttttcaatggagtgggtctccgtttagggtcgtgactccaggcggtgatcttgagctggagtgctgaggactgcctttttccttactcattaactcagtcctgtcctgcttcacaggagtgccgctcctgtgttttcattaaattgacccagagggtaccccccccacacacacacccacagttatctccctgtctttctcttctg

SEQ ID NO: 20696 - DNA, 600 bp, Bovine  MMBT06390
ggggaaaagagtttgaattaatcaatttgaaccatagaggaaattatgatggcaattaatataaatgagaatattacacactcattggttcctatagacctttcaggctcttttctcctcttacttgttatgagatttcaaggttttttcccccagactcttggctttgctgcttgagtggcccgtctttattcctctcctccaaatcctcctgattgttcaaaggactccttaatgttcaagagagtgactgaacagttcttagtatttaaaatgatgtaaagccatcttcttttcgtraatastcagtaagggctagtatgtttggtttttgtattctctccaaccaccttagcaaatactctggggttggttgrttggatttttaatgtgagatatccagagtgggatctcttcagggaatgtttgctgctacccagcgtctgcagctcccatgacacactctcctcacacatactcacacacacacacttacaatttattcctctccccccactccatacctattatgaacagtggttgtcacacagacgtacacacgcacacacactccctcctccacttctctcattcacactc

SEQ ID NO: 20697 - DNA, 598 bp, Bovine  MMBT16474
  misc_feature (1)..(220): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcatatataagccaaccctgtctaggattgtgttagctgtgctgccaatttaatcaccactgcacacttgagtggytrctattagccccattttgtagatggggctgctgaggcccactgaggttaagcatgtgaactggtttgcatagtttgtgtctracagggccaggacttaatgctgacttaagaccaycttaatgcaaccttaatacaaactaagaaaactgtaagggagtagaggtagatttgaaaaagagagtactattacttgtaccaggatgggatagataacacatagtgttccagagtaagaaagttgcttgtttgttctttgtttagtaggttgccaaatatgccaactgtcacaaaggggtca

SEQ ID NO: 20698 - DNA, 600 bp, Bovine  MMBT01707
tgctgggacttaactttgacaagtaagtgtcaagtgacaatcattagcaaattgattcaaaccagatgcagatctcagattcttgccaaaatataatgatgctaattagatccttgacttttccttcatccaatatttaagtctaggaaagcttttattgagcagaggaggtttttttttttttttaagagatctgataaaatctaatgtggatgggtttacatcagatcctggtagagctatagggagggaaaaaaaccttctgaaataagtgacttcagtcagaagcttcagcccagrcatgtttttggaagaaagctgttagaaggacaatgtgtctcatcactgcttctccctaaagtccatktttaattattgatgtcactctttccttccctctctgcccaaacaaatataacatttaaacattaaagaggctacagagtcaatgactgaatggaataaagaatgaatggtttaaagaagcagatctctaaacccggttaccacctaagctctgacttactccatcactttcctcataggcaggatttgggggactttgtcatggcagaacactattcaccccattcaagccag

SEQ ID NO: 20699 - DNA, 600 bp, Bovine  MMBT06565
ctggtgggctgcagtccacggggtcgataagagtccaacacgactgagcgacttcactttcacttttcactttcatgcattggagaaggaaatggcaacccactccagtgttcttgcctggagaatcccagggacgggggagcctcgcgggctgccgtctatggggttgcacagagttggacacaactgaagcaactaagcagtagcagcagcagagctaggttacctggtcccaaattcccacacttgtaacttgctagctctgtgacctgttgatacgcctctgtctgcctcagtttyctcatctgtaaagtgggaacgaytgtagcaccttatctcaccgacttgttggggattcaataagctcatgtttgtgaagtgcttagggtcccctcragatatcacagtgatcttagtgatgactyaggaaagagaaagatgcaggagagagctggaggcactgagtttctgaagtcacagactgagacaagcgcgagccagcacgtgatggcggtagaggtggaagcagggtggaggctggcccctaccccggcatcatgggcgtcagtcgagcccactttgcagaaggcatttggctct

SEQ ID NO: 20700 - DNA, 600 bp, Bovine  MMBT20675
cagggaaagtaagcaatgaattaaaatgcttgtttgtttctctacaagtttatggtatagagtcatattaactctcaaatcacaactcagtttgaaagttttttccttttgtttatagtttcttctttgaacttaaatttcagttggtagaaaggggttaaaaacctgagcaattcccacttgatatctgggaaagaaacaagtacgagtccttgcagagacagaaaacagagggtttggatgtcaattttggtcacctagcgagaatgtctttgtgggtgtttttgagatggtaagaayactctggatgcatgaaatgacacctctgtgcccctgctgctaggtgtcccgtggcctgaccctacaagatgccaagagaagaggctcacttcttctatggttcccccaggaaagggcacagccactcttatgtcacggctgaagagtaagttcaaatccagacccagcggggttacagttttgctgtttgctgacacagcctctggcttccaccagcacgtctgtccgtaaatctctctagtgtttatttctccagaaataaacctggcaaagagggaaggagaccctgaggtcctacaa

SEQ ID NO: 20701 - DNA, 600 bp, Bovine  MMBT02371
aaattactttttaagttggttactttaagtgaaattaaagtaaattctgcctcatccgagattatcttctgttaaccttgcttttactttcatgtaatagttttcaaagaagcattaaaggatatggggaagacataggatttacaacaaaaagttctgggatccaacaaaatgaaatttacttaacttttctttttctaaggagataaaattttacagcctcttatatgcctatagagagttgaagccaaaggtagtatgatctaggtcagaaaaattacatgtttcttaagtgttatygctataataattctgtgttaaaatatttttcctttggaatatagaatgatatatcaactttcttcctcctctacttgtttttaattgttatttcattaggctattcattcaattgattggcatcatgagggcaaacaattcatgtgcagccattcagatggtagcttgactttatggaacctgaaaagcccaagtcgtcctttccagaccacagttccacatggtaagatatatgctttcaaaagaaagaaactctggagatgcagtgccactacttgaactaggaaagttggtatcagt

SEQ ID NO: 20702 - DNA, 598 bp, Bovine  MMBT02458
  misc_feature (1)..(142): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcatatttcattttagatcaaagacgtcaattcctttctgccaaagacaacctgcaacatatctataattgaaaaagtttgatttatttcttgttgcatttacatgagaatgcttattatggggaattctattataggatttgtgttttggctgwgttattttggagcaggwctaaggaagcagggctttggatgttgtcatcaaacagacattagtctatgattgggtacttctttcagtctcatctgtaaagaaagcagactggagctagaatgaagtcgtagttgattttttaaaaagagcagcaatcactcrtactagacaggagagaaggaagtttggtattgtgtagattacaygatgaccttaagttgtatcactttatcatacactcaagagtgactttatgttgctgttctgtgaaatggtrtatgttyaataagagaacaaca

SEQ ID NO: 20703 - DNA, 598 bp, Bovine  MMBT20680
  misc_feature (1)..(6): n is any nucleotide
nnnnnngatagtggcgtggtccacgttgagtactgtgataagggctatgatactattgaccacagagtcaccaaggaggggaaggtcagctggacttgggaaggtgagggaaggcttccaggaggagggggagatttcactgagtcttagaggaggagtaagaatgcaagagcagaaggaagtgaaagcatgttagcatgcatagcaggagaagcaggtacggggcttggcagcatgacataactattctctgagctctgagatgtggactcagctactggcttagccaccaactttgayaagatatttgatttgctgagtctcctcttccccatgtgtctcttcactggagacatatattcctgtcctctctctcattggaccataatgaaagttgaatgatatcatgagtaaaaatgctatttgaaaaaaaaaaaaaaaaaatgaagagataatgtcatctgtgaacctgtttctctctcccatttacaggcttgcaatccactccattgtaattctcccactgatatatttcataattgtacgaaagaaccctttccagttcgccatgggaatggcccaggctcttctgacagct

SEQ ID NO: 20704 - DNA, 600 bp, Bovine  MMBT15347
atttttcattttacttacgtcatcagccytaatgtacgaaacaggtaaggaccacttttttgaaaaaatgttttccaatatgtttactagtatcaaatcagcaacctgattttcttctgattctcattatgtgtaggttttagagaggagcagacaggtctacacgggttgcatttattccactcacctccaccagcagcaggtaagggcacaggcagtccatgacagctgtgggccacgtttcagtcctcatcttaaaccyccagcagcacatgactctggcaactgtttccttctctkaaataactttccccctttactctgcctggtcagtccttcatttctgcaggcttatccttgcttgtctrttcccactcagtatccacctgcctattgacatctctttccacttaggtgtctcagatattcttcacattcagcgtgtccaaaactggattcatttgttcttgaagagcratagccaggaagtagtttcatcaaagtctccccgtcagtaggacttaaggtcttcacagaagcacttgcctttatctggactgcttgtctccttccccaggaccaggaattgtctattagggg

SEQ ID NO: 20705 - DNA, 600 bp, Bovine  MMBT03952
atcactcaaagtttcaggccatcagaatgtgacctctccagtccttgtgcttcctacattgtgcaacactggttggtacaaggaaaatgccaatagaatcctaactggctctcaatacaagtggagtgatcaccatgcaaatcattaatccagactcatatcgtttattttaaataaaagagcattaacaagcctcttttatttgaaattccctttgtgtacgtgtgcctgtcatttaaaagtatgaccaggtgtgactcttaagcatttttgttagtagtataaactcctgctacattwgcagcttcttcctgacattagcatttcagttgaatggtaatcattaaatcaattttaacagaagcattgagagcattctttgattgcaatttttaagaaggtgctgtagggacttccctggtggtccactggttaagaatcaactttccaatgcaggggacgtgggtttgatccctggtcagggaactaaggttgcatataccatggggaactcagcttgcgagtcacgactattgagcccgtacataaataaaaggcgtggtacacatgaatatttcccttgtaatactgaaaactagt

SEQ ID NO: 20706 - DNA, 600 bp, Bovine  MMBT22564
ctgaagaaggtgttcccggaatctcaccggtgtctctgaagcagcggcttcccctcgaatttggccgacaccacgaggactcggaagctggacgcgcaacggttgggagtcgtgtcctccacttcctatggrgcagaatggcgtggatggtgccaagtccgccccccaggagccctgttcccctcgttggacgagctcaggccgctcaactcaccacgtgctccgcttccaggtcccgctgcagcttctcccggaggtactcggcactgagttccattgtggcagcccagggagggtggmagcccaccggggatgggaccccagttctgaccscagccacactgcttccgcccttactggcgccacttccgctgaggcacctacttccgcccttactaagacgtccgtaaactcagcacttccgccctatcccaagcccagttttccractgccttcggttkccgctcctgtcagagtcagyatgaggctccagcagactctaatcggtacccgccgcctgaacagcaacccgggttctgtgcgctggtttggacaccctagctccaactaggagagggtgcacgrgtttgcaytgctgt

SEQ ID NO: 20707 - DNA, 600 bp, Bovine  MMBT02985
taccccacattctcttaggggggaaagtattatggggtttttaacttctaagtcagctgccagaaatatgtagacaggaccttaacttactatctcttccaggaagatctctctttttaggaaagtcagagttgaaccattctttccttcttctgtgacatcagggagagacatttttgtccagaccctgagtgaagaccactggcaacctctgtaattccagaagatagcaagaatgcgctccaaaacaagggtcacatttctctctcctctctcaattcccaagtgcaaagagttttygttccaggttcttgttgctggccgtgtcacgtgtggaattgttgtcttcctaatgagactgtcacttttgagagtaggtccaaggccgctattcrcttgcctccttagcaggacctaaatctgtgctgggcccagagtaagtgcttaataaagacatcctaacttggatcatagatcacagactgtcagagctggaaaggattttggaaaccaccaagtccaacactctaattttatagatggtaccactccaaaaattcactttggaggctggtgtttatctgctgggaagagagtttc

SEQ ID NO: 20708 - DNA, 600 bp, Bovine  MMBT07387
tactacccccaaattgataccacatatgtgatgttattcaggcaaattatctttatcccagctccaatataaggattatctaaaaagtctctcccttacagaaatatttctggagtatatcttcagccctacagactctgattcttatgccgttactttggcaagcctgatgaaagggggtttattctttctttgcaagtttactttcatttagatgagcttggactaacaagtaaatcagaagcatcagcagtccctaacttgagacagtaactagtacatattttttatgttgtgcaytcagttccaagtgtaatatggctcatcaaagggacaccggacagcaattttagacaccaaggcttacaattagactttttaaaaacaggttgccaaatgagcacgttgaacaaaaattcatttctttctgaaatacaagtcctttaatcagagagtgccatgctatgcatcattcttttcattgaaaccttctggtgccagaatcctgtttgcagtaaacactcgagtgtgatagaagtacattccatcttcctgttaaggtttccatcctcaaatgtgactgtatatatacttttggct

SEQ ID NO: 20709 - DNA, 598 bp, Bovine  MMBT03519
  misc_feature (1)..(156): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattagcctccaattaaaataaattttaaaaaaagacaaaaaattttaataaaataaatcttctcaaacttcaaaaaaaaaaaaaaagaaacaactatatgatggaaaagtatacagaatgataagggttttgagatcttaartaaaatgtragatcttaaaaaaattcacagcctttacttttaaattaatctgataaatgttagcagttaaaaaatcaaataggatggggaacacatgtatacctgtggcagattcatgttgatatatggcaaaaccaatacaatattgtaaagttaaaaaataaaataaaataaattttaaaaaatcaaataggaataaaggtttataatgaaatgtagcarttctctgtcccctggtcatctatccgtagtcctgatctacaaaagcawcttgttttaaaacttttagatctatctt

SEQ ID NO: 20710 - DNA, 600 bp, Bovine  MMBT05241
acaaaaggagagttttcatgtcaatataatgtctttttaaataagtaaagggatatttgcatgttttttatgattatcacttaagacttggttcacataatctcagagttgactgaacactcccctctgacctcttcctcctcagggatcaactcaggtttaatagaagcttttgtttctatctatgcctttgacagctgggagattagcagggacttggctaattagaatttaactgtttgctaatgttccagtaggtttgtcgatcacaatctagtttaaaatggattcgaagttttmaaaatcttgaaaaaaaaatgctgtgtcagaactgatttaatttcttgaaaggattcaaacaagaatcagatctatctttatgatcttttcagtcacattccctaacaaaaccatgttttgaattggaaataagccacaatcctctttagacacgaaggctatcgaatgagagtggagtgaattgaagagcctccatggaaacatgagctttcatgagygcccatygacagcagccccacaatgacatgctcccatgcttcccaggtggcctaggagacatatgaggagacaagtctcatt

SEQ ID NO: 20711 - DNA, 600 bp, Bovine  MMBT04295
ttgcctggagaatcccagggacgggggagcctggtgggctgccgtctatggggtcgcacagagtcagacacgactgaagcgacttagcagcagcagcagcaktatacatgagaatatgagatgcatattttgtatgcatttgaaaacaggactagacctatgtatattaaaaagatgaggcagaaacaataaagtggtcatagtccagtgttggagcaataaatgatttgctgcttgtttgtgttcttcagtacattttttataacagtattttttacttgtagaatgaaaaagactctwgactcttcctacattcatctttattccaactttggaattattagtctattttggaataggttcctaagacagttattattttaatagcttcagaatctttcacaatattgagaaggttctctatatacacatacacacgcatatatgtacatacacactcacacttctttccaaatgcttctctcagcatgcaagtttgccgactttagagattagcctgcttacagattctctaagacatatgcattttattgtaactgaggtccttaccggctactggtcggggttttttggtaagac

SEQ ID NO: 20712 - DNA, 600 bp, Bovine  MMBT05291
attccctcatttaaggaaagctaagggaagcaggaacccatttaaaaagaagtcgtcttcatgtctgtctttgctccatagttgctagtcttctgaacaccttctgtggcacccgattcccaaaataagcctagggttgtccactatgggtaactgaataaattactgcctaagtttataactaactggcttttctcaacaaagcataataaaatagaaattaaataacttgaaaaatataaggaagtttagtaaatcagttagagaaaaaggggctcagatggcatataattaaaagayaaatagaaaaataaaggaaacatggagaaaacyatgttatatgtagattataagtcatgcatacgtggatgagaatgccaacaggaacaggctctctgtctgtaacacaggcccgaataatcctcaggagcccgtaccctttgtgacacttacgtgggctgctttatttaatctcccaacactccaggtccttggtcctgagaccatgccatggtagagatgtgggcactgaggcttgagcacaagtctaagccatgtgcccagagacaacaaggctggcgggtggggaacctaggggcc

SEQ ID NO: 20713 - DNA, 600 bp, Bovine  MMBT09959
gtgttacatgtggtagagggggctgagtgttcttcctgctttttacgaattcaaaatacaatgatggaagacaaaagtagtacagtgcaagatttgcctcacagatagtaggcacttaataaaaatttagtaaattgggggagcaaaatctagtaaaaatccaattctctcccctcacggacaaccagtgttacatttcttatatcctggctatatattttagtcctaacagtagggatgatcataccatctaccatagggacattgaggattaaactaaaatgccttagcgtaccattyctggaacatagagctcgtaaatctaatatagtaccaactgtggcctgatagataaattggttgccttcctttttatgctaataattgccctcttttttccctccaggtgtagatgtcagtatgaacacacatcttaaagcagtgaaaatgaccctgaagaacagagaacctgtacagctggaaacactgagtattcgaggaaataacattcggtattttattctgccagacagcttacctctggatacgctactcgtggatgtggaaccaaaggtgaagtctaagaaaagggaagctggt

SEQ ID NO: 20714 - DNA, 600 bp, Bovine  MMBT18353
agaggctatgtgtggtatttctagcatcttcctgattcacatcactttaaaacaggatactttaagtataaaatgtttaaaaataagatcacataagaaggttgattcacctgttcaaaaatccaacattaaaaaattgggggcagggaacctagtatctatgaagatgttaccttggatacagaatttctgagctgggagggatgttaacatataaccatcttgtttaactccttgattttagaaataaaaaactgaggccaaaggcactgagaaagttgatcaagatcactccttccrgcttataatacagaagggctacaacccaggtccactggctattgcacaccacctttactttgtaacgaatctgaactgagtacagaatctgaactaagaaatgcttcactttaaagccaggttctgacaccttatttctgtaaccctggacaggtgctctaacctttcaaaaactagtttttctcacttataaaatgaggtcaataacagcacctatttcatacaagctgttgcaagaatactgaaagcactgaacactgggcacatgaaaagtgatcgacccatctttccatctttcca

SEQ ID NO: 20715 - DNA, 600 bp, Bovine  MMBT05718; identical to SEQ ID NO: 4690

SEQ ID NO: 20716 - DNA, 600 bp, Bovine  MMBT07107
tttaatgatagaaattatcatagttgggacctccccgctcagagatgtcatctatacagaacataggcagtttggaagtgactactagtgcccatcagatttttgccccccaaaacctctttttccatgtgctttctccttcatttcttgactatgccctgtgcccaggtctagcaccattgtatccccaactgtgaatctttgctaaagtcttaaatctctcagggcctcagtttactcatttgtaaaatttactcagtgcccattctatmttaacaaattaaaaataggcttacatcwtatgttgcyctgagtctaacycaattttgtcttttaaaaaagtaacaagttggcagtctctgatgtgaaagaataccatcaaagagtcactctgcttccctagaccacacctcagcctgaaggctgggaaaggggttccgaggactgtcctgcgcaaaggcattttcaatgtatttcatgctatcaatgaagtatgcagtgcacacctgcctcttaggattatttctcaggttacagggaagctcagaaaattgctatttcttgacctaaaaggaggttaaaacgctttcagtggaaatc

SEQ ID NO: 20717 - DNA, 598 bp, Bovine  MMBT09414
  misc_feature (1)..(23): n is any nucleotide
nnnnnnnnnnnnnnnnnnnnnnnctctccttttgccttaagcaatctgctgtactgacaggggttggtcctgcctgtctttttttttttttaatcccttgctggcactggaaaaacctgcaaaggccccaagaagaggacagaatttccccctcagctcattttcataagaaacacgataaataatacatggcactttaataagaccttatctgaatggtttaatgaaaaacaaatacattatgtaaggaaccaataactgctctcagctgcactgagccaacactggtttgcccgtccrtttttctccsgaaagttgaaaactctccgtggtgattggattcctacagaccctttttgcaataatggctcccagtttcccccttagacttaggtctcgcagccgggggaactggaagccggcaaagggaaaccgtagaatccagaccatataaacgcgtctcaagatgatccggggccaggctgcattccctggataaccaagtcagaacgttcctgcgcaagtgcatgcaaacaaattcatgcaaacctgactacgcacacagccaagtacacagcccatcaacacagatacaaga

SEQ ID NO: 20718 - DNA, 601 bp, Bovine  MMBT04371
  misc_feature (1)..(1): n is any nucleotide
natatgagaagcaaaaattggtgartggaggggtagaaccaaagagccttgtagaagctctatctcagacattagtattgggagaggatagaaaaacaaggcgcaacagtaattaatttgtagagkttaagttccaagtacatygcttacrgttatgacacactggtctggaatgtgcacagaacacattgcacactctaaccaggttctctggagtgaaatgyaggaggaaaaaaatttttttaatgctcagctgatctaaagtgagtgcagctaagatacactattccagggtcttctsagatacagcagggaacaagcaagaggactataaattaaaaacacacagagacatttgaacatacagttatatttgaggaatgcattcatatagccagatgcacaattgcattagcttattctttggtcataatgcaccagaagtcctcaagatttctgaaagagttgattctatgtccctcaacatacccttgtaagtaaatgggagacaagtaggrcaacttgtactaaacacttttaaacacgcatggttagtktatgtttccaaattaacatccaaccatgtagatacataaatcca

SEQ ID NO: 20719 - DNA, 600 bp, Bovine  MMBT14115
tcagggacactggagagtatgaggatgaatctgagggaccaggtcatctcccagacccacccagcttgggtgcaattgagagcctgattaacgagaattgcatttctcttagtttcttctccactaggagcagcattctgagccatcccttggaagcatcagactaatctttttatagaatctactctgatttatttttggccctgagacctaccccctcaactcaggaagcttcacacagatatttgagatcaaagtgtccagaataattttggctctgtagtgaggtggttctgaagygaaatccctgtttgtagtcagagccagcctcatgttcgggcagaacccaccattgcttatgcgatggaacatgaagggcagtgaaaagaactttaaattccactggaatgtatttctctcataagtgcttaaaagttacatcagttgagagtaagagtatagttggatgaggtagcatgacttatcttcagcttttttaagacaaaaatccaaaaggaattttttcataattgctatggattagtgctaggttgttttcctcccagggaaagtctgaggtgaaatggacactgggatcaa

SEQ ID NO: 20720 - DNA, 600 bp, Bovine  MMBT06089
ggagacaatctcagaggagcacgtgcgacctgtggccagatgggccagatggggcggcaaagtgagcggccttcaacatgcattttgcctctagcagcctcccgtaataacagtaataataatgcacatcctctggtatttctagagggccgtgtttgaccacggggatgtctaggctactgagatgtgcctgacaactttacagagacttgctctgccttgatcctgttggcctcgggtctctttattctctgaggtggaatatcctctaaatcttagcactgaagaaactgggctgtstttctgagccccagagaccaggctcctaaaatagtacgttatgtaagtgctgtgttttgccactgcacaagaaattgttctagataaagtttattaaacgtggcaagagaaagaagaataggttttcattctgagtggtggagctgggatcctgccagcaccattgacggtgtctggggaaagccaagggagacacagacaggggctgccttgtctcttttcccaaaaatgcaaagaaaactaaatatagccgagtggaaggcatagcaccctggaagatactgaaaggtttaagttatt

SEQ ID NO: 20721 - DNA, 600 bp, Bovine  MMBT09834
ggcttaggacttaggacttagtaggcttaggactccttcagatattccctgtccggccacctcgttacccctgcctgccaatcagttttgcatcaataaactttatgttccaggctttgtgagatgaatgaaaggcaagcagctgaagtgtgatctctgaccttggcacgtaaacagcctacagattggacttgacagttaataaaggaaaggccttgcgattctctgatgcctttttgccttgattagattaagcattcataagctttggggaaatcgtcaactggaagaggaagaccycatgagacagtaattcacatctctactcstacaaccgttcagactgtcagcccttcagtcaataggcaccgacactggtgctgtcctattacctgagctcagctctgtgctaacctctctccagcacaggggcctcgaaaattcccgaagcccacactgtgccctcctggaagacagcgtccagtttggcagtcaggagcactcactttggttcagacaaatctgaacttgaaccctaattctgcctggtgacctttggcaaattatttaacctgtgtgccctcagtttcctcttggggt

SEQ ID NO: 20722 - DNA, 598 bp, Bovine  MMBT10620
  misc_feature (1)..(28): n is any nucleotide
nnnnnnnnnnnnnnnnnnnnnnnnnnnncttttaaaaattgaatattttccctgaatggaggggagagcatattggatttgactgtagtctatttttcttgagggtgaagtcatttttcttgagttgtgtaggagctgctgcagctttaaatcagagatttggtggcagagctgggcacatatgggccataaaatacccagattggagctgattgggatatcaaatggtgggaagacgacccggggtgacaagagaataggtttaccttgtctgaggaaaggagatgttgtttctcttcygtgtaggatgacttattaatgagaacacctgcaaatctgtggcttgtggaagacaatgactggaagaaaccttactttcaaggacaagtmagaagcttctttctttccttttttgtttttttaagagaaagcaggtaaattagaccttttgtagttgttcagtcataagtcacgtctgactgtttgcgacccccatggactgcagcacgccaggctcctctgtcttccaccgtctcctggagtttgttcagactcatgtccatcgagtcggtgatgccatccgaccatctcatcctct

SEQ ID NO: 20723 - DNA, 600 bp, Bovine  MMBT16614
ttaatctccactgtttttatttggttactaggtatttagcacagccccgttttgtggaaggctggccaaaagcacacttcaaattaatggtagtcaaagcttgctctactgaatctatattggagcatgagcaagaggttcattggttctaagttgttttatagggcttttttgtttttgttttaacaatctgcctcagcagtatatacagtataaagttataaatacagcacccgtgctaaggaataaattccacatttggtcaaaaatcaaattgttaggataaaagtcctaactttmgttaacattaagtcaaatatcagacgtgtcctcattcattcaacatgtatttattgagcacctactattaagtaaattaccagtcactgatgcacaatagcaaacatactaaatgaaagtctatcaatttgtgggtccatttttgtgaggagaaagagcacatcaacaaaataagttaaaatgtaatatattagatgacaataacagaggaggagcaaaataaagcagagaaggaaaaaaggcctagagagtaggccataggttaaatacaggtggccagggagagcttaccaaaaaggt

SEQ ID NO: 20724 - DNA, 601 bp, Bovine  MMBT04122
  misc_feature (1)..(1): n is any nucleotide
ncatgtaccatcaggcgcatgtatctggaaatcaccagggcagcaaaagtaattgccatccatagagaaaggaaaagcaaatcaaaaacaccagggatggtatggggaaggaggagggaggcagcttcaggatggggaacacgtgtacacctgtggcggattcatgttgatgtayggcaaaccaatacaataatgtaaagtaattaacctccaattaaaataaataaatttatattaaaaaaaaammccaacatttgtccaccgtcaatgctagatctctcaggtaagcatatttagaccstctttgcttattgygatagttaatgagaaatcttcwgttgccgtttttcctttgggtaattgtgtgtggtgtcttgtcctgctttttcttctcattgtcccattgtttaggttcgtgttacaaacataaaagttgttgaaggcatatcacctactacattccttctttatttttcccttcatcgtagccccttccaacatgtgtggcctttacacattacttttttccctaaaactatttttgattgtcatgtagatgtatagcatgaatatcagcacatgttccccaaagatggatttt

SEQ ID NO: 20725 - DNA, 600 bp, Bovine  MMBT14160
tccgcacaagtcatgaagaagtctgagcctcaagtttaccctgtgtaggctagaaggtgattatccagtattggagaggtgttaacctcctcagagcctttctccgaggattacagtctacaaatgagttgcctttttaactttcaattaatttctgcaccccatccccaccccagtcccgggagtgctatggacgctgagattttgccacactgacttttttaacatgacacccaagaagtgatcattaatatcagggtagacagcacataagcctcggctcccgccctgagagcccgygcccaccaacctgcccttccccaggtgtttcctgttgaatgagattgagaaggaggaaaaggagaagctctggtattactcgcagttgcaggggctatctaagcgcttggatgaactcccgcacgtggagacggtgagctccctgggttgccccggggtcgacagggccccgcctatggcgggaggcatagagcggaggtggaggcctctccctctcccgggagccccctcaccggggcccgtccgctcctcccagcagttctcaatgcagatggatctgatccggcagcagctggaatt

SEQ ID NO: 20726 - DNA, 600 bp, Bovine  MMBT09570
ctccagcttttagaatctgtcagataataaagatctgaaaaggtgaggtatgggagaggtcacagtgaccttcaggtctcaaggcaggataaatggacctggatggaaggaccggaagagaaatccagtctcagaaggaagatgggaaattcggttacagacacaggtactgagcccataaatacagaagctagacactgagtcactaagttagaaatgccagagttttgaggaatttcgctgtaatgagtaaaatctccagggcctgacatttctacccactgttttccctactcaacygaacaggtggaaggagaatgtgtgaagctgcctgtttcatagcgccaggaggctcgccctccacctgtggccggcccccgcgtctcacctggtagaggaatctttggctgaagtgctgcatggcgccctggagctggttgcgttgggactgccactgctcgtagttccgcacgtactcggctgtggggcgctgccatgtggtggtccgggtattgtggtccacgtagtagaacctgcctcgggggtctgtgcgtttctcccagctgaaaacatcaagctccgagtgaacacggtgaccac

SEQ ID NO: 20727 - DNA, 600 bp, Bovine  MMBT17098
gtggataagactaaggatgccaggggcaccaaagaggatggggaaaacgctttagctttttcaacagtcaaatatcagcaagcacacagacaaaggtcaggtcataatagccatgagacggtagaagggctttgggccacccactcctttcagtgggcagtattctctttgagccctttgtgcttttggatatcaccagcgggccagaaacatgatcaggaagaaaagtggctggggaaacaagagttaaaaaagaaaagggaaagcacctttagaagatgtgaaacaacaggaagaggrtactggtgagaaatgaacagaaacgtgactgagagagtaagtgatgaggacgttaccaacaaatgtctcaggcagcccagtgagtggatttcctcccccatctaaagcataaccaaccaaccaacctttgttcctgctccctrtgtgcagtcttcaagtcatgaccttgagtggrctcacctgcttattccaacatgaaacagttctgcagttccttattcaaaggggatattgcagaagggaaattctaaaatatccacccctttaactcaattcctatagggtcaaaaatgtcaatag

SEQ ID NO: 20728 - DNA, 600 bp, Bovine  MMBT09553
aaggagaaatggcagcttacttggatctactagactgtctatttttagtggcctaaagacaatcccctccacgaccccgctggattacaatgcaaacagaattagcctcccgaccttctcttccaggtcagctcatcaccaggtcacttctgcagccacatcccctcaaaccccatagcctcctacaaggacgacttctaacacatttgaactgaacgtgagtggatggatttatttcagccattttctgcctttctaattgtttctcctgaagaagtttgaagaccaagttggctttcytaagtactcagctttcactgtttattgctttggttgttttggctgccagttaaaatgctacccattttcagaaatgaggaaaatgcttctggcaattaggaaggatgcttgcttctaatggcattttaacattctaaattattaaaaatagagaaaaggaccaaaaaattctgatattggccagttctcggcttctctgtgaatgtttcaagtgttccttttttcattaaggaaacagagcacttgagcttttaacaagctggctgatatggaataactgacttgaagtacaggaccttc

SEQ ID NO: 20729 - DNA, 598 bp, Bovine  MMBT09995
  misc_feature (1)..(67): n is any nucleotide
nnnnnnnnnnnnnnnnnnnnnnnnnnnnnnnnnnnnnnnnnnnnnnnnnnnnnnnnnnnnnnnnnnntgtgctttgcaggattctaatgcacaattaatctcttactctagcatgacaaattacttccaccttctaaaaatagttttaaatccctacagtaaatcccaaatatcaaattagcatatataataatcccagaatcaagttatatggtcttaaactagattcatttttctaccaaaaaatacaagatcatagtagcatgatagaaattaagtctcacaaattatttcagttgmgaaagtgcgttatcccaggaaatgtaatgttgaggtaaaaggcatgttgctcatcataagaattgctctaaattttaattcctgctctgccacaaggcaccagaggcttcaatttaattcaaataaaagatagggacattaaacaatgatatacagagctgtgcaagtgaaatttctaatgatacacaggagtaagcactcctttcaaatcagagtattgattcctgatgcactataaatggtcatcaaaatattctctccatttcacagacagcaatttccctataatacatacgta

SEQ ID NO: 20730 - DNA, 600 bp, Bovine  MMBT19677
gactgttcctacacaggaaataacagcactctgtcaaaatctacaggagaaacacgtgttcaaatttgctgtcagggcctcgcatatctgatcggagagcgagaggggacaaaattacaggagtcgtgtaatctctgcgcaggacagcatccatggctcccggggtcagcaggaagtgagcagtgactcaaggctctggctgaatgcagcgttttttgccaataaacatatatatgtccaataaaatgggcatgtgtacattatgcgtagtcgctcagacgtgtcygacttttgcaaccycatggactgcagcacgccaggctcctctgtccatggaatttcccaggagagaatactggagtgggttgccacttcctactccaggggatcttcccagccccagagaccgaactcccacctcttgtgtctcctgcaatggcaggctgattgtttatcaccagcgccatctgggaggcccgcatgaatacgctacacgtgtgttaaaattccacgttgattctgaataacaagatttctcgtggaccctatgttgtcaacattttttttacccgagaagtaacaaagatgtgcactttatgt

SEQ ID NO: 20731 - DNA, 600 bp, Bovine  MMBT11635
ctttcaaaatgttctgataaagtggcttagcagcaggacttytgccattgactcaaactaaagcaaagaactctgaaaagtgcaattgttctgtgagagtcctccataggaagtagaaatgaacaatgtgttgaaatgtaaatttccttcagattcttccaaatcctsctctacagggatttcatttttcaaagcaatcttctatatttactactccacttgttaaattttaactccctgggccaagatttgtaaatgatcagagaactgtcaccacagggctaattcaggcatcttccygcccttgttacattctacctctttcaacctaatactaagagactgtatttgcaaagtggtgtggaagagactgtaaaatgcagctattaaaatatttccaatgatttgctaatataaaaagttaagaactagagccattttttagaaagatagaagccaaggatgcattctattgtaggtcattatcttcagcctccacagcccagtgtatttataaagataaaataaacttgtgaagcgattttgtatttgagaataatttaaaaagcaaattcataaggattctggcttattctccac

SEQ ID NO: 20732 - DNA, 600 bp, Bovine  MMBT03586
agagactcatctcacctggaatgcctcctctatgttcacctcatcttagctacaccttatccttctttttcaggctgaccagattctctcctcttctacaaagtgttcctttcacagttcaatccagagtgatttttcaacagtgaaatcttagcactaccagtctattttcctcttaaagcaatcaactgtattctgtactgtgatatttaatagagtgggggattttattcacctgaatttgagaaaagctgttttttaatgataagcagctagagcagggaactgaaagaacgtccytagggctctccagtgggaaacgtcatgtgctgtgagtgtgagaagaggagcaaagaactcaagtggagaaggagaaaaggatggaggaaaatacggtagtgaggagactttgtgggtagtgatagaagagctgccatgcagtgaaatcctagagtgaatctgaaatatcggaataagatacttaggaaattttataatgtactgtattatctaatcatctgtgctatttctacaagcaaattcctgaaagaacagcactacttttcaaggctatcaaaatgagatgtgtttctaatgcac

SEQ ID NO: 20733 - DNA, 600 bp, Bovine  MMBT04644
catagggcaaggcatacccagtcctgagttgctttcattttctaggaacggtctggttgccatgacacagaaagaggcaggagtagatagagatctctttgtccttcactctaaggatgatccaagttagaagggcggtattttcttgattcaggtggctgggaggcaagcaggtagggccattcctgccataagcgcctgttgaatcctaggaccagaaacagggcctgtggtgtggagtatcttgttgagacaaggcagagctctcgataaagaaaacaaatacttgggcagaatttytaagccataaaaatagcatttttttccagttctaaaaattatgtctttaatcattgttttaacaaggctaatgaattggtaagtagccaaaaaccagagctaagtttggtgttgtttaatgaaaaagaacatttttgtgtagaaagtgcaagtcaatggattttgtgctgtaaagatttcctttctactctcagcctaacctttgggtctaagccacccaaagatactcccgttttcacagtggcaattaaccccaggtgcaaggatcggtattctaaagaaaatcaacttgctaagctc

SEQ ID NO: 20734 - DNA, 600 bp, Bovine  MMBT06057
catttgtaaaggcaactatcaccaagttctctgatatcaagttgcgcttaattgccacaggcaaccagttacattcatctgccattccacaatttaatatatcctggaagtagtgatctcactacatttgggccarttaggatatccccaggggaactgaatgctgtactttttctttcttacgtctaatacttgcactttcaagtttttaatccaagttatgaacttgccagagttgtgtttccaagatttcagcacttcctgtattattcagatggaaaccatcttaaatctacagarggtaagtttagactaacaatgactctttgaaataaccagaacatgtatccacacaggctccatttctccttttctatttgtggattgcccccacccctcaacccaccctagccaaggacaatttccaaggcctattgactcatgcctatttcctcccatttttatttcctttgcttgtaaattgaaacagtgtttcctaattctttatggtttcaaataatttacccattaatagtttcatttaatcctccccaagtcaaatttatagtgaatggtttattctttttttttttttttttt

SEQ ID NO: 20735 - DNA, 600 bp, Bovine  MMBT05549
gtggcccactcttcatccaagttatccaatttggctttggaatgtgtggggctctcattctgttcttctttgggtggtgttcttgtggcaagaatcacataatccttttgtgaggaacacttgaaaacaaattagaaaagcttactagagggaaatgtcaccgaggaatgcaaagccttcatgatatgcaaaaactgagcaatattcatagcagcttaaattgtcaatacctgtattataatggaatgaatctacagggaaaccaatgttgatggacagccctacaatatttccctcacrtgttatctttcaatmtatttaataccagctccttattcatttggcatcatgaatatgcatcatgcagtgggcctttaaaatggtttactagatgaccgaaagaactgcatcttaaaaacgtatttatatatttctggctgcgttgggtcttctctgctgcgcgtgggctttctctagctacatgcacaggcttctctcactgtgtagcacgagctccagagcagaggctcagcagtcatggcacacaggtttagttgctctgtgacatgtgcgatcttccgggaccagggatcaaacccc

SEQ ID NO: 20736 - DNA, 600 bp, Bovine  MMBT22423
atcttcacagaagttagatttaccttctttccattcacccccctaccccgccaaaaaaaaacaaaaaaaattcatatctgtacttgaggaaatctggcccttggaggttggtgttgctgttgtgaaaagacaaacctcaggatggttttcatatcatttctttataaagaaggatactgttggccaatacacccgtttgtgtgttcagcaaactaagagcctgttaagtgccactcgttgttcttgacaggcaacacacctggatgtgtgttatcacagataaattctgggcagcacacrggggctggaagagctgagaaaagctgctrggtgaaggtaacatttgagttagagcttgtgtgtgtgtgctaagtcacttcgattgtgtccgactcccatggactgtagcccaccgggctcctctgtctatatcgaattccccaggcaagagtactggagtatgttgccatttctcactcgggatcttcckgacccaggragtgaacctgtcttacatctcctgcattggcaggtgggttctttaccactagtgccacctgggagagcttgtgagttttgattaaatgaccgtccaggctg

SEQ ID NO: 20737 - DNA, 600 bp, Bovine  MMBT22427
tccattcacccccctaccccgccaaaaaaaaacaaaaaaaattcatatctgtacttgaggaaatctggcccttggaggttggtgttgctgttgtgaaaagacaaacctcaggatggttttcatatcatttctttataaagaaggatactgttggccaatacacccgtttgtgtgttcagcaaactaagagcctgttaagtgccactcgttgttcttgacaggcaacacacctggatgtgtgttatcacagataaattctgggcagcacacrggggctggaagagctgagaaaagctgctrggtgaaggtaacatttgagttagagcttgtgtgtgtgtgctaagtcacttcgattgtgtccgactcccatggactgtagcccaccgggctcctctgtctatatcgaattccccaggcaagagtactggagtatgttgccatttctcactcgggatcttcckgacccaggragtgaacctgtcttacatctcctgcattggcaggtgggttctttaccactagtgccacctgggagagcttgtgagttttgattaaatgaccgtccaggctgcaccactaaagccagctgtgagtgctttt

SEQ ID NO: 20738 - DNA, 598 bp, Bovine  MMBT11496
  misc_feature (1)..(58): n is any nucleotide
nnnnnnnnnnnnnnnnnnnnnnnnnnnnnnnnnnnnnnnnnnnnnnnnnnnnnnnnnntttaaggtgcttgcgggagccatgccatccgtttgtggtgagccgaattagagccagattagagcggggttctgggttcccggctgcggttggctctccatggtgctccttccagccgaccatgtctcatcacctccgggctcgcttgctttgaggcattgaaatctattttcagacacgattacaaagaacactcggagcttcactctctccatagtcaagtttgtaagcaggagctttcytatcaacatttaggttcaagttgaaaaaattaagactcctgaagaccacattggtgctgtacttgaacgagcaaaaccagagtatatcagcaagacgtacaagattaattcttgggagaacgctgaggactttctggagaagctagctttccggacagggaagttattaaaggtgagccaaggtttgtgagaattcagactgggacctgcttcaggcctgtgtgcacaatgtgtggtgtggacctttttttttttttttggtacatgtgtgtgagcagtgtgaagtatgaaccttggc

SEQ ID NO: 20739 - DNA, 600 bp, Bovine  MMBT12085
ccaaatacggttcagcaatgaggaccagtatagaatgaaaaaaaaaaaattgggtgttttccttttttaatttttgtttctgtgaaaaacatcattaaaatagttaatattcacaggcagtatctgaggcaagagtaagtgtgtcaccctttgcagaaacatggagcatgtacaagtataatgttgcttttttttttagaatcgtgtgatatatttgaacatatagcagctataagaaaaaaatgctgccagtatgttggtaatggttgggaggatggttagatggctgcatrttgaatwaagcagaatcaaggtccagaagaacaaggctgaactgccacacacatccttactacctcctgcgtaccttgactccaagtattattgctccagtaacaccccaaaacttacagtgttctgaacttgatagtgtcttggggtatctgtayctttttttgacactgtaattcttgattgaccattagaattttctgcagtgtctcatatggtagctgctaaccatatgtggccaccgagcacctgaaacgtggcttacgcagcctgggaactgaacgtttcattttattgatttattatgta

SEQ ID NO: 20740 - DNA, 600 bp, Bovine  MMBT04247
aaaagatgcaacaaaattaacaaaatgaggaaaactggcaaaagcactaagagaaaatatgggctgtaataagaataacaaaaggagtggggcagggtgggggctggagatgcattgggtctgactgaatcagaaaagatttcctgaagaggggacatttacgctaaaatctaaaaacgatgcaatgcttagattgacaggcatttggggaatatgatcctctgaagcagtaaagagcttgccttgttaaggagttgaaacaagaccaggatggctgaggcctagcagacaggccatgawaaaacrtgagggtttttcctagagcattgagaagcaattgaagatagttagagaaatgatttacatggcctagttacatctggtatatttttcttagttcctaaagcaaagtaattaaatattgctaacttaaattttatttgccctgaagttttccatgatgcatttgaaataaagttttcaccaaccttcattgtttgaacatgttaatgctacagcgaaacttgatttgcttgactgtcttccaaagatcagtccttactgatctctcataaaactcagaaccacttaagcatccta

SEQ ID NO: 20741 - DNA, 600 bp, Bovine  MMBT20613
aaaagccttgaaagacaaaatgtactttagctggacatattattaacacacttccagagaaatatacttcaattaacaacaaaaaaaatttacagcagagaaacattcaaaaattatctgacctattttcatgcttttctaatatattacaaagtatttcctatatgacttttatttcccctctagtacctaggaaaagaatagtaggtgtgaatgtgtacttatgacttaaagggttaatgtggctctgtaaggtgaataaatggcctgaacaaatcgcctatagcattttcctaacakcaccagggcaacattctgcttcagtggtttaaatgtaccctagtggtttaaaacataattgcayttctctgaacacctaattgactacaagggactgacttaggtactttgaatacaattttattactttaattattgttcagtgaggtgttccaaagttttaaaacaaactgaaattttgttcctaagtaaagagaaaaacaatgctatctaagtttgcttttttaaaaataaaattccaactttacattagaacaagtggaaaattttaagtgaatttcagtgaactaatctttattg

SEQ ID NO: 20742 - DNA, 600 bp, Bovine  MMBT05757
aactcatttgatcttacatatcttactttaaaaagcttcccaggaaatgtcttttattttttatttcttattatattttgttattttactataacaattgggtcatcttgaagatcatgaatgatttgaagaaacagttaaacactgagataaataatttttatccaacccttgtrtcccaggagtgggaggaaggacaacaaatcagaaaatagtttatattattattcagtgagaactaaygcaaattgagatccatttaatttaaaatactttcatgtgaaagataaactgagagaygaaagagtaattttacaaacactgatgacaaatggtgttgtaattagaaagaacatgtgtatcaaaaaatgtttcttctctaaatcattttgaatgtactaatgacattggaaccatgtattaaatactggaaaaaattggaaataattacatgaagagcaaaatgaggctgtatgtatacagggattcccccaccccccsccccccgccttttttttagttatttattttggygacttaattttataagaatttaggagaggtaatgaaaagaaggagaactgagaatgttatttatat

SEQ ID NO: 20743 - DNA, 600 bp, Bovine  MMBT06000
atctttcattccataattagagacaaaaggcttaaaatacacaggcctgactatggttaggcatttacagaaactcattcacactcaagtgtcatcagtcaatcaatcagttagcatctataaatggcagacattagatctcttcctttttgatgagcatgtgtagggggaaagatagtagaaagacacttcgaaaaatcgatgcttctgcatatgtgggtggaattaccattgagacaaagaaagaggaacataaatggaaggttgagaacctcgaagacaacactgaagtcttcacakattcactcactttctcattgccagactgaaggcagaattcagtccagttcaattccacctttaggacataggtttcaaagaatataatctatagatgcttaatcagtgatgtgattacgtttgaagaacagagtgtcacactacagattttgtgtagaagagacaacagacatctttagcttactctttgacatctgaatgcacaggtgggaggcagcttttcatgtggtatggagtctgagggtgtcatgcactgaagaatggggttggacctatggttaccaggatctttgaatggct

SEQ ID NO: 20744 - DNA, 600 bp, Bovine  MMBT07770
gcccagtcctatttcatccatggtctgtccttcatggagtcctctgtcctccttactatggcttttgaccgctacattgccatttgcaacccactacgctattcctccatcctaactaatgacaaaatcatgaagattggggtggcaatcttatgtaggagttctatgctcatacctccagtcattattcgcctaaagttcttaaattattgtcacccccacatcctttctcactctttctgcctgcaccaagacttaattcgaatggcctgttcagacattcgcttcaatagcatctayggtctggccctggtgatcagcaacttgttgttggatgcagtgctcatcattatctcctatatcatgatcttgcatgcagtcttagcaattgcatcacgagaagagagaatcaagtctttgcagacctgtgtatctcacatctgtgctgttttggttttctacatcccaatcattggtctgaccatggttcatcgttttggcagacacctctcaccctgggttcatgttctcatgggcaatgtctatatccttttcccgcccttgatgaaccccattatttatagtatcaagactcagcaa

SEQ ID NO: 20745 - DNA, 600 bp, Bovine  MMBT00643
agatgaaatcaaatatctactgggatttgcatttataatctagatgtgtcacactcttttctctaatcaaaattagattctgacatgctttcaaatgtgtcagtgaaagacaaacattggtacgctgtttctaaaagtatatttggtcatacatgtttggtgtcatgtcaacactttctttagaaatggccacgtttgtcaagtgattgaaaatgacatgcaaattcaatattttctacatccccagtgtacatttttcagtattcaatttttaaaaaatatcttatccattaatccttygaatttatgtccttatgagggtccatggagtaaatggttcacttctttggattaattattttaaactttaaatttgttattatactaataatatccagtgtataaaaaatgagtggaaaaagagaaaaagtatatagcatagagaagataaaaatcactggtattcctacatttcttaaaaattgctaaaacttcagtatatgttcctccagattgttcctatatgttcccatagatatgtatgtattaaaaaaatcatattatacatatatattacctggttttaatttttatattcta

SEQ ID NO: 20746 - DNA, 600 bp, Bovine  MMBT15951
tgcctttacttatgtgactacatgtcatctcacttttctgagctgatccctttgtgtggtaacacatatacattttctagtacaggttctgacacagtaaacactcaataaatggtatgagaacaaatagataaattgcaattagagaaaraagttcacctttttatattgaaattttcactttatgctgagtatatttaatttggaactccttcatagattagatttatctagttttctctcttaacctcagaaagcatgatatctaatgctcaatgtaattatatgaaaatgacattygtgtccaaatgagacagaacaatttagacgagcattyggtagcagtgttttccacagttcttaagaaatctgttgttgaaaaaatgtcagggcaaagtrgaagtctaacaggagctgtgtaatcagcaattatttagatggattacttttcaaagaaacttactgtatacctgtggcggattcatttctatatttggmaaaaccaatacaatattgtaaagtttaaaaaaaaaaaaaaaagaaacttactgtaatggaacaaacagctgcctattaaaaataaagaccacagaaacagaa

SEQ ID NO: 20747 - DNA, 600 bp, Bovine  MMBT19043
atacagtaacatgaaataatgttttgttacttcatgctgctgtaatttccatacagcaaatgtatggaaaacttcaaaaataatcactgttaggtttaaacaaccaaatcaaagccaaccatttgataaaattcaatactttgcttctttgctatagagtaaaaagctttagaatctgaacatgattagtcatttcaactcctattgtagtatatgaaaacagcaagaaagtttgtttacatgtgttattctgagggaaggtcatactatgacataatctgataatgttgaaatgcaaakgcttcatttggacattattttaattcataggaaggtgaactaagttgtcaaatatttccttctctcttactcctaaaataacacaaaaaatgtggtaaccaaaaactcattcatatttaatcattccagaagtaactctatttcaagggaaaatagtttcagaattcacactgcaaaatagatccaaatttatacctggtccagcatttttttttccaactcagactctaaagaaataagcaagtaacagtaatatttataactgtgacagcattccttttccaccaagtcaaatttctg

SEQ ID NO: 20748 - DNA, 600 bp, Bovine  MMBT06192
tttcccattgtaacatagcaacttgatttcattgccgttcctctgtcatatgtacaaagggagatgtcaaatatcccaaaagagaatattccagaaggtgcagaggtggtctttagttagcctatgagtttgcagacctagagacaaaaggtaactacttcatgttttatgggagttgtatctaaaacttgattagatttaggttaaacaattttrgcaagaatacttcatgacaccacgtgttttatttgcatcccatcaggagacagtgtatcaccagagatggagagggcccccagygctcactggagttttcattcattgctattctctgcaacagcattggagagctgacaaagtagaaaaatcattttatttgatgggttactagtaacataaactgtattaatttatgtgaactgtttactattctttcctaatcagagaacagattatgaaaatgtgaagtaaaattcgctcagtcgagtccaactctttgccaccccacggactataaccctccaggctcctctgtccatgggattctccaggcaagaatactggagtgggttgccatttcctcctccaggggatcttccc

SEQ ID NO: 20749 - DNA, 598 bp, Bovine  MMBT08430
  misc_feature (1)..(109): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctcctctgcccatggagttttccagacaagaatactggagtgggttgccatttcctatgctaagggtatgtttcagcaattagggggtccaagagtgaatgggctggctagtaccagcaccatccagtccaggggaccagcttgagtataagatgctatgagacatcagggcaatgatgtcatccrgctgtgttatggttgctccctgaagcaaagacartgctgtttagtactatttcattctgtgaaaagtattggaaaagaaagttcaggctaaccagaaggattcaacattatctttttctctgaggggtgaatttgaactgcgtatggacaataagaaaattctcataaaatacattacatatttcatgttacccagggaaagctaaaccaaataaatctttcctcacagaaccaatttctccttcataacttgtttatatagttctaggttcatttttcctttgatttctctaagagg

SEQ ID NO: 20750 - DNA, 600 bp, Bovine  MMBT05778
aatgaacataaagtgataatatagagacatagaaactcaatataattctctatattagggtctattttacaaaagatttggcatttgagcagggcataaatagaatgttgtctgtgatatagtaatgaaattattttgtacctgggacagaattattattatttatttttatgtacaaagttttcatttttaatatctggttaaaatatgtattttgtaagcaaacccattacaggccaacaaaaaggaataaaagcaagaagaataaaaagcctacaattaccccttactgagcataarggtcaggcctgcttctttccttaaaggcagtgtctttttgccctaaagtatcagcttaggtctctgctcctaagcaccagaattgcatatgaacagagaaaccagccctgaaatgtgtgtctttgcatagcccattggctcatggactccaagtgcaaagggactcctttgaagcaccgtctgcacaggcccaagcagactcgtggtgaaatgttttctcttcctcctcccaggaaatggtttacattactgacagtgccaatggacccaaggtcctgcttggttgcacaatttgtaata

SEQ ID NO: 20751 - DNA, 600 bp, Bovine  MMBT09495
tattttacatgtggagtctgggaggcctccccggggtgggaccatgaaaactataagaaagctgggacgaaacaggagaaaataatctcagkcagtgggaactgcaaggatagagcatgtggtgggattatgctcagggtgtcccagcagcagatagaaggtgttgggagcacyggtatctcacactgccaggctatgacatgtaaagaagctttcaccagagtgtacagtaatgcgctgcttccttcatcgagagagtcttgttatgaagaaagtgtcagtggagcccagcagtgtgcytaatgatgtagttgaccaacgtcctggcccaagttcctcctcttatcacagacaggttgtattttgaggatggttagctggtcctgggaccacacactgagtagtcctgcagaagcagatgctgatggctttccaactagatccrtcactctatccatgcaggcacggtcctgtgttctcttacttaagagtgttcccagccctggagggacactctgccagagcactgggaattaatgtccctagaatgatgctcagcagtgagggatgggacagggaggattaactccccagcttcct

SEQ ID NO: 20752 - DNA, 598 bp, Bovine  MMBT06848
  misc_feature (1)..(113): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatttgcctaaaccccacaggaagccccagtatacaggaatagaatcaaaagtttctgattcctttcctttgctgatgccactaaatgtgtcaaaacacttcaaggtccttctttcaaagtagacggaaaacgtttcatcaaagtctgtgtttctgaaattcaccttctaaaggaagaatattttraaaagagttgctagaaaacaaatattgcagttatatgttttccaaagctactctttggaaatactagcttctatctctctttttctatccctttcgtttactgccttccgttggggcagggcttccatggtggcacagtggtaaagaacccgtctgccaatgcaggagatgcaggagacgtgggtacgattcctgagtcaggaagatcccgtggaaataggaatggcaagccactccagtatcacatggagaatcycatggacagaggagcctggcaggctacagtctaagaatygga

SEQ ID NO: 20753 - DNA, 600 bp, Bovine  MMBT05017
acaggaagaaacccttcagcgggcacgtgaggaagaagagaaaaggaaggagatcacaagtcatttccagaacaccctgacggatatccaggcccagattgagcagcagagtgagcgaaacatgaagctctgtcaggagaacacagagctcgcagagaaactaaaaagcatcattgatcagtatgagctcagagaggaggtgagaaccacatcagacaatttacaaatactgcatatagatctgggtctggtttgtgaaggttgggaggtcggttaataacaaagttatgatcagccttmtcaactgattaatatttaggtttggacttcttttactagccaaaataaaaacaaatgatattacaaaatacctggctgaaagtcacagaggatttcttcaaaactagaatcactgcaaagcagaggcaataaacaaggggtacaacatgaatggatttatccttgaaaataaaaaataatatttctcagccttttttaaactctctctacagaaccaagaaatacttcatgcatgccctcttaagaattagcatgtcatcgaaattaaaagtctgcattgtatatactgcacaaataata

SEQ ID NO: 20754 - DNA, 600 bp, Bovine  MMBT06025
acacagttagtaaagaatctgcctgcaacgcaggagacaagggtttgattcctgggctgagacgatcccccggagaaggacatggcaaccaacttcagtattcttgcctggagaatctcatggacagagaaacctggcgggctacggtcccatggggtcgcaagagtcagatgtgacttagcaactaaagagagagagagagcaccctgatagagaatgccaagactagaatggatgtgggggaagacacataggaagctagtgtcttaaccctaacaggtttcccaacttttcaagccmattcaatttaattatacaagggaaaacaaagaacttatttacaaaaaaaaacaaaacaaaaaaaaagaactgaatttcacacaccataaattttcctgatactattaaacagcatgacattatatacatatcttctacttaaaaaaaaaggatgtttatatttccatatgtattgaataccaaaattatacaggggtatatctacaatcatttggatgggtatgctttaggttaaagaaaataagtcccccatcccactgctttctcatcctttctgcttattcccaaaatgaaatctta

SEQ ID NO: 20755 - DNA, 600 bp, Bovine  MMBT21042
ttccacaccttggagggctccagaacagtgcccagagaagaaggctggtccccgctcccaaacagctgtgctttatctccctggccagctcagtgctaatggccttgatggccacgtccctcccwatgtcctcctggcctcctgttggctgtggccaatttgctcgtgatttaccactcyggggcgctgacccgtgagggagacacacgggacagaaggaggcagagcggacgtcatgcctgatgcgtgtgcacrcgtgcrtgtccgggcgcaagggtggggaggcgtctctccaggaaygcgctacccagccaggctctctaggactgggagcagggtctggcacccccaccctttmgctatcccatgctgattatggcactaggcactgtgctagagagaggaaggccaagggagaccttgagggctgccaggagccacaggctggaagtcaggcccaggagcagccctctcacaatggtctggagccttctgggtcctctgagaatccaggcatgcgcacaggacacacctcccagccgtgaacacatccacggccctgcccctgaccacagtcaacagaggcagcacaagcgtggt

SEQ ID NO: 20756 - DNA, 600 bp, Bovine  MMBT14355; identical to SEQ ID NO: 4808

SEQ ID NO: 20757 - DNA, 600 bp, Bovine  MMBT06163
tacacacccttgaagactgaagagagcaagaaagacacaggttaagggaagtttactgtaagccygtaggatgtatgagaacactccctgcctctatgggctaggacttgttaactactgtttatcttgtgagtggctgcatctggcatctttaaaaggggattatcgactctctttttgtttttattttgggaagtatttgaccgggtgccataatttgattttaatctgattttatctctgtagtgcttagatagtttaattgctggtttgatcaggcacctagaatgtgaattgttrgaaaaataacatgctgcattcttatagtcaggactgtttccatggattctttttcctgaatacaagcagttattcatgactctccagggactaaaacttgcaaaatagtattttgttcatctaaatattgtttaatagaaatcctgtaaagcaatatctgaaatcctaatattttcttaggtaagttttggcatgaggtcctatgcaatagaataattgaaattgaaacaaaacttaaatggtagacatcctaatatgtttcattataatatggcycttaaatattaatctcctgtaatt

SEQ ID NO: 20758 - DNA, 598 bp, Bovine  MMBT18393
  misc_feature (1)..(66): n is any nucleotide
nnnnnnnnnnnnnnnnnnnnnnnnnnnnnnnnnnnnnnnnnnnnnnnnnnnnnnnnnnnnnnnnnnatgtttggatgttacagcactaaaagatggctcaataggccagactaacctgtgttagcaactagaataatctccagaaaagaaaattactttgggatttaagatgatcaaaactgattacttttcaagaggcttagaaacccaaagctgtaaacacagctggggaaatacttgaatgtgggtccataaaaactccagtgaataatccatccttctgcctcatgacgtggacaytacaccacatacatgagcctatggggaagcagtaaatatttttatacaaccttgtttgtgaagagaggagaaaaatgtatagacatgcccacccacatctttgatgtgtgttaatatctttcttgttttattgaagtaaaggctaaaggattacattcagcccagcaagtaaactgtagcacgggaatattataaccaaacttataaaaactggatttatcttctcaaatttagagtgccaataggattatttttattggatgaaaaatcactgttttactattttttgaccaaaagt

SEQ ID NO: 20759 - DNA, 600 bp, Bovine  MMBT01133
tggaatggcggtcatgctcattacccgccttggagaaaagtcattgcaaatgatttgtaccacacgtcctgtccctggactttgtggattggttcccgactcaagggtcacctggtgactgtcgggagagttcttccactgaacttgctttgtattagacaatgactaagagaccccgaatgggtcttttatggctatttttatgtgagaaacagatgatacacagagtggcagcatatggtaagagagcacagagagggcggtgaatgaacttaagggaggaaaattgagggaacatgwtggagaccagagaaagggggagttaacagaaagaaaagaatgaaagggaaagaagcctgtaggagaggtgagatagatgttggcgttattgttgggacataagcagtactcttctgtcctgaacaattttccacaaagtctgtttttttttttttttttgttcacatgccatttcttacctttagcaaaacaccttgttgtttgaggtaacccaagtgttttcttgaaaatctgaaaaagtctgaagacttaaaatgaggggatgatgtggattggtgggccaccttccagggttttaga

SEQ ID NO: 20760 - DNA, 600 bp, Bovine  MMBT06954
tgggaaagagatggaagggaaagaatggattttacactttctttgcttctgtgccagtttctaccacacagagttttcatcaaacaaaaagtctaagacagagatggagtgaatttggacttaggattaagaagacttggagatctagtcttagtcgaatcacttattctctatgtgacctcggttgagtcgctaatcttctccaaacctcagtttcatacctgttaaatggggtgataataaatcttcctgcccccaccactgctgtgaagattaatttagatagtgtatgttaaggaygctacacattaagtacagtgtataagcgacacaaattcttactgctgtcacattgactaagaactttggaataaactcaattaaatcacttgaatcttcaccctcatcagattaatatactgatgattagtaaattaagttccatttctgcaaaacmcaaaagaaaaaagtatttctgagccaacacaatcttaggcccatctagggatatgatttatacacgttgcaatacccccaggagcacatatatgaaacttagcatttcttcttacttctatttcttttttatctcccacaaag

SEQ ID NO: 20761 - DNA, 600 bp, Bovine  MMBT16794
ccatttacctataacccaaataaagctagatttgccttgtgctcaatttctgtgcacagctgtattaaattctaatgacgaaaagaaacatatctaacaatccaaagcaataagaaaaaacaattcaaacatttgctggattctctttcaaagaaagtcaagggagaaggcatctatgtaataactagcgaaatagaggttaactgaaagcttctcattcattgcaataattatatcacaaaacatgagtcaagggaaaygagatcactccacctattttacagatgagaaaactaaggytcagggaactgagatggtcccagactccaaatcaaaacttccgactcctagtttagtgagcttgcttttctacacttgtgcacacacacaccaccagacttcctttccaccattctgcattataaaatactttttaaaaatttcttgacactaatggcagcaaaaaatgatgattgtcaatatgagttcaagaaatactcagagattcaytgacatttaattcccaaacctcagctaagtgtggcgcccagacwagaagaaacaaacatcaacgaaccatacacacattttcactcttgc

SEQ ID NO: 20762 - DNA, 592 bp, Bovine  MMBT16722
aagcagtactctgtccaaggaatgtaaaacatttttaaaaaacaaacaaacaaacaaaaaaacacctggacgacaaacattctatgccattctatgccatcttcactattggagaaggagatcacagtaatgtttatatgaagactaccagtggatttgaaaaatggttaataataatccccagggggaaagaaagaagataacagattctcttagtcttgaaaaaattgttaataataatccctgggggaaaagaaagaggacaacagagattctcttagtgatgagtgatttatgttraaatagccartgcactctccctcacttcctttttggagcattgaagggtagtggggagagggctgccctggtggctgccctggtggctcagtggtaaagaatcacctgccgtgctggagacacaggttcaatacctcattcaggaagctcctagagaaggaaatggcaacccactccagtattcttacttgggaaatcccatggatagagaagactggcaagctacagtccatagggtcgcaagagtcagacatgacttagtgactaaacaacaacagcagcagcagcgttt

SEQ ID NO: 20763 - DNA, 598 bp, Bovine  MMBT08417
  misc_feature (1)..(15): n is any nucleotide
nnnnnnnnnnnnnnnacacacacacacacacaccaggcgctgtggatacatcagcaaacaaaacaaacaaagaaacccaaccacagaagagcttaacttctagttgagggaaatagatcacagacaataaatacatcaaatgtaaataacatagtatattcaagatgatcagtgcagtggaaaaaataaagcaaggtgagagctgaagtgaaggaagggatgataattttaaaagaagtgaacaacaacgtaggactcattaagaaggaaacatttaattatctgaggggtttatatccmagacaagaatgattcaggcagagggaacagtgagcacaatagccctgaggttgaaatgtgcgctgtatgtttgaaaaatatcaaagyggggagaggtatgcgtacacagacggagggtaaaagtagtaggcagtgcacaaattcagagaggatggagcagatcatgtaagggtttagcaaaataatctgaaaaatattaggacgcattgacagattttaagtagagtcatacttgtgatggaactgtagaacatattaggttgctatggcatgagtgttttataagctgaaatttact

SEQ ID NO: 20764 - DNA, 600 bp, Bovine  MMBT02784
tcattctaaatcccttagaacaagaaaacagttaagcctgagggatgagaggctcagaatcaggcagtgagagaagccccaaactaatcatagctaccattacaaaattctattttgtgccaagtgctatgctaaattcttctatgaattgtataaacggactctagggaaagattattgatatcagatctggttattcagtgcattaaaacatatcaagagagagagaacaggcatcagagatgttttggtatcttgcatttacttttatgggatgttgaccttgaaatgcagaaagarggaagtctagtttgaagrcatatgtgaaaataggatcaggtttcagtggtgctaggttatactgataaccagttaaagatctagaaaacaaaaaacagcctccctgtatttgccttataaagccaaaaccacatattggcagaaacattcccacagaagactgaaatagaaatggcatgacatttcagtttaacacattctatttatttaagctgttattgatgtttgtccttgagacttttagtttaatttatcctccatgaaagaaaccttagttactttacattcatattgataact

SEQ ID NO: 20765 - DNA, 605 bp, Bovine  MMBT03688
  misc_feature (1)..(5): n is any nucleotide
nnnnnatgggcttcttacacctgtgtctaggtgaaagcagttggttaaatggacaccaacaaaacagcaarcagacgtaacctctcagataagaagccatgctccttcygcatctaggaaggcagtatatctgtcaccacatctatcctgaaaatactttaataaccatggaacttttttgacaagttcagatattgatgccaggccccgtttttagaatgctgaatatgcaccatattggctggcccaggagctggaagaggacatttaaaagtaggctaagactatacacaggagtgaatttkgggttagctactcctagaaaacgaactagtaatgatgtagatgtgccagctggcatttatgcagatttcatgttttactatactggaataattagaaaacttaagaggcatacatctttagtaatagacctttccagagaatttggcacatgctacttctcacatttacactaatttttattagtttttctttttgcgtgatctcgagtgacgtctcttactcagcaaattcttccttgagtaaagagaaaaatgagaattgggacagataaatgctagcccagaattatttctttttat

SEQ ID NO: 20766 - DNA, 598 bp, Bovine  MMBT04109
  misc_feature (1)..(105): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatagaaagccaatgtgtcctattggatgataaataatttgaaatttaatagaattataaaaaaatcaatttgctcttcatttcactggagacacaattttaactttttggtcagaggggatgacaattttctcatcaaaagggcacagctaaatgaaacagtaaggcctgccaaagtgtcttccatctcaargtccaatttaaaaataactttctgtcttctctaaagatatagaagcagtgtgaagagggccttgagcaggctccatgagatacaggttttttttccccaacccattaataaacactgacttgaactgtcttttaaagattgtgtggctccaggacctgttaaggctttctgtggataatctggaccacacagaggtccttggacaaagaatcagcttccaagatcccaagaacccagcggcatcacactaccctccagcttccgggaggggcttcttgatttagtcctacatgtaaat

SEQ ID NO: 20767 - DNA, 600 bp, Bovine  MMBT11185
agtagagaacaatttacctctcaggtgaggacgttacgtgaagcaagttattgtgagagacttgagtatttctagttttctataaattacctgttcttatctccagtctccttagaaaaatggcaacgcagatggtcgctgcacagcttgcatcaattgtgtggaataacccaagtcagcagcaatttctggtaagtgaagaatttaaccttacagtacaccattagggtataaaataaatgtggcctctgtttattacctgtgtaagaaaatgttcagagatatagtaaaagaccacakaggtgccatgataacacgtctatttttagctcttgacttattataaaatccccaaagtgccgttttttctttttctcattttgaacctaattcttcaacagcaatttgcaggaagttctggatcacagctgcctcaaatccagacggatgttgcactaccatcatgcaaaaaaaaagctcctcctgacactcctgtgaaggaaagactttttatcgtttttaatccacatcctttgcctttagatgtactagaggatatattctggtaagatttcagttccatagagttacattttattt

SEQ ID NO: 20768 - DNA, 600 bp, Bovine  MMBT00847
aatggcaacccactccagtgttcttgcctggagaatcccagggatggggtagcctattgggctgccgtctgtggggttgcacagagttgaacacgactgaagcgacttatcagcagcagcctcaaaaggtagctctgatgttcaggtcaatttccccattcataggatagaacctcaacttatctcaaaaagcaactacgatatttggcaaaactaatacaattatgtaaagtttaaaaataaaataaaatttaaaagaaaaaaaaagagaaaaaaaaaaagcaactatgcatataatcyattatcatagtttttacatgaaaaaaaaaagtgaatgctaaaatttattagtatttttttctggttgtccaattttcaagagatgtaacaaacatattttaaacaaccattgatttaactatggccttggtttttacttttgtaacaatatctcttctcacattctatgttgattgttatgctaaatgtttggcagtttactcatcatataaattggtcttcatgtagctagccaaaattatttctgacagccttttatatcaagcagaactacaatagtctgtttttggagtccaaggc

SEQ ID NO: 20769 - DNA, 598 bp, Bovine  MMBT20569
  misc_feature (1)..(131): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgcctaaagctgatgcactgatattccatttaaagaataactgcctggagatttcagcggccagtctactggatctgaaaagttgaaatccctgcaggggacttgaggatatatatattgaatcttggaatctggggaccactctgcctcagtgaccctcattgccrtacagatgtgtgacaaaagagatgcgggttgtatggatgtatccgcctttttacattgcactgttggccaaagttgcatgcatcactgctgaatgaaaacgtcagataggatcacaatgctagcctcaggtttgtaccaattctcattaccctagtcttgtaaacttggtgtatatcccacaatatacagagtactaaattctgtaacaaagacaagtgcactatttatcagagacactataattttgagataaatgtattatactatgtcttataaaaattgactatatattttact

SEQ ID NO: 20770 - DNA, 600 bp, Bovine  MMBT06286
gcactcttgtgtgtaatggttaacttgtcccttccttcactttttaaaacccttttgtaaagttttcaaatttgccatataaaaaagtggaacccttttataagacagctgctagttcagtatcttctaagtcagtatgtatttatatttaaaaacataacccaacaggtaagttccacgggggtagctaagtgctagttaaaaacactttcttttaacagtttggaaaagtttcatgagaagtgaggttttataatcaggcaagagaaggaaaaggggtttaatttcagaactacacayctctcttaaaaaaactatgtacttgcattctcacagtaaaaagattagttgccttcaatgaagtttcaggaaaaaaaaaaaacacacacacacacacaccttctattttctctgcactgaggagtaacatcttcccacagttacggaaagctgcacattaagtcccttgcttgctgctgctgctaagtcgcttcagtcgtgtccgactctgtgtgaccccatagacggcaagccaccaggctccccgtccctgggattctccaggcaagaacactggagtggttgccatttccttctcca

SEQ ID NO: 20771 - DNA, 600 bp, Bovine  MMBT01302
ggatccagtgagagtctgcaaagtaaaataaacacacaggcaattctaaaataaacacacaagcaattctaaataaacatacaggcaattcaggatatcctgtcttactcaataaagaaaaatatcacaaatacaacctttttgagagaaagaatgtagtagttgataatcctgaacctgaccatcgcaagactttacagagatggaggggccgggtgaaacttagggtcaggttccatggcaggaatgggatattgacgacaggtgacaggtagagctaagggacacgtattaacgccygggctaggcactaaagggtcagtgtcatgtatttgagcttgtgtgtgcatgtgtgcatgctgatgttaggggttgtgtatggcgtccctaccttttctaatgccatctaatagtttctccagaaactatgcgcagctggcaacagcaactctatggaggaaacctctatatttttgagatccataccagcctctagacacccaagaaggttgagctgactagtgccaggctagaagtgcccagataatcctaaatagtttgttctgcggtaacctaggaccactggtgtaacacatacct

SEQ ID NO: 20772 - DNA, 600 bp, Bovine  MMBT06054
gtactcaaaccctaagggctggtgtctgggaatcttacctagaatgtagaggagccactccttcccttcaaatgtagacagcagcctctcccactgggcttgccaaaagtagcaggaagcaccccaaaatctctgaagataccttgaaagaaaactcattcatgtttctgcgtgaagactggtgggtggacagctcctgaatccatgctctgcccgcagacctccaccgcaaggcccccagatcctgaattagagccggccgagcagactcaccctatgacgcagttccagtggaccatyaacaaggggaggctggagcccaggatgaaagccgtcctcctcatggagccccagatgtgtccctcctaggggacgacaagaaaatgtcaggccctaaccagactcctgccttcccaggcggctcactgctgaagcctggcaggagtgacgggccatcaagttctcagtcatgccagcatggcatatctgctgacctttcccagcttccacaggagactcttccttgtcaagagctctcaggcttgtgtggggaggtgagcatgaaagttagagcttaagggttgagggaaggaagagtgc

SEQ ID NO: 20773 - DNA, 600 bp, Bovine  MMBT08352
gtgttgatgtgtatgtattaactatgtatacatgtgtatgttatcatgctttattacctccagcccagggagttaaaaagtattctgagaagctctacaaggtggaaagagaatgtggactgtgcatttggtccatatgtaaatatggtcttcatttgggctgagatcaatgtgccggcatggtcaggttttggtgagggtcctcctccgagttcacagacatctgccttattactgtatcttcacaaggcaagggaagggaggtcatctctctgtatctcttataagaacactaagccyattcatgaggggttcaccttcatgacctaattgcctaccaaaaccctacctccaaatacaataacattgaggactagggctttaacatatgaattttagggggacacaagctttcagtcatagcatgtgtgtgtatgtgtatgtaaaagtcaatttatgtaatctcaccaattaggagctattattatatgaggaaactaaggaagaggttaagttctttcagttcaaaaattattttcagccaaggaaaatgttgtcccaaataagatcatcagtatcaatgttctccctactgatggg

SEQ ID NO: 20774 - DNA, 600 bp, Bovine  MMBT05204
tgcttggccaggtgcctccaggctatgggggtgttctggttgcagagcacacacacctctgccttcaggatgctagaagcttgtctgggagctatatcactaaaaaaaatcacctgctatgggagaagactctggaaaagactctgaagtttccttgaacccttgtacccttggcctggcattcccccagcactgtgctctggaatcccaaacaaggtagatccctcccttgattgggtttcctacctgttggtatggtcagtctctcctgctttgtgagtccctgtaaggtgggagccsatacatatacctctccaggtccttaaagcccacttcatgatgtgtagtgggcacctgatgaacactgtttgaatggacagatggttragatgctccccagagtgggactcctagaggcagcaagaggagaataggtgcctaggagggaagaagaagggctcctagcagtggacagtgactgctaaaggctctggaggagctggaggaaataaagagttccaggctcttgtcgtcttaattaggtggtctaaacaggaatgggtttccctgtcaacctctctccaggaactgggtccctcc

SEQ ID NO: 20775 - DNA, 600 bp, Bovine  MMBT12017
tttactgcatccttggtctatagcttctcttcactgtactaaatgaaacaggaggactttatctgctaaaccaagctaccggttctgttctttttctccaagctgtatctccaccctgtctctaataccatctagtcattttcacttatttattccactacctcaaaatcatcacagcccaagataaactgacctccgtgactctggcaccccctcccccaactgccagccccctttttgcaccttgctcctcagccctcttccaacagacccaacctggcgatctgtctgytcctctcmacagcactatcattaaacagtacaaaggcagtcatttttggatactcgatgatgggagggaggtgagtgcagaaaactccatgggtcaatctcactaaacgtggttgattctgtcttgaatctctctctcaacccattctctctgtgcccctttcaatgaaaataaagggatctataatctctagtgggatcagttttgcattcctccttcataaaggggccatatctggggagagagaccacagatgttaagggagatgaaaaagtttaataacaatgaaacattttctttctttaaac

SEQ ID NO: 20776 - DNA, 600 bp, Bovine  MMBT08374
aaatctttatttattcattcattcaatgaatatttattggataaataagtgtgtccacttattgagacagagagaggaattaagatgaggcccctgacctcaagaagcttaaagatgaggggtgggaaacatacaattaaatatggcacgtgccatgacaggcaaggtcacggagtacaccaaacgggtaaatgacagacctacaaaaaggcatgtctggaggcaagatgtcagggcagaagatggctatgaaaaggtcagttaagcttgagaaaaatgcagattgtgagcagtactacrgaacgtgtaaggtatgcaatcagggagagaagccaggagctggatcttaaagagctccatgacgactttctayggtgcccaggaggagccctgaaaggtttcagcagaggggtgacaggagactgtatgcagaggtgcttaggagagattagatgagggcaaaggaaggttgtaggtaagcagattcgttaggagccttatcttgataacccaaagggaaagggcattgagccggaatgaaaataagctcagtgggaacagagagtaagtaaaggaactagaagagggacttccctggtg

SEQ ID NO: 20777 - DNA, 600 bp, Bovine  MMBT10596; identical to SEQ ID NO: 4563

SEQ ID NO: 20778 - DNA, 598 bp, Bovine  MMBT21157
  misc_feature (1)..(44): n is any nucleotide
nnnnnnnnnnnnnnnnnnnnnnnnnnnnnnnnnnnnnnnnnnnngaggcggctagtctgatggggcctgcagatatggggatagaggacagaaggtctgggggaccctgtatagttttgggggtcttctgggcagaagcagcttggcccatgtccaagctgggtggacaagacatgtgcctctcccgatgtgggcctgtattgggcacacggctggcaatggaagggagaactaaagggggctcagctgctgtgcctttagctgcccccatccccagaggacccagggaagggtaggggyctggtgtgtcctcaatctctgctcctacaagtttagagagtccatcccatcacagctgcctcaccctgtcattgatctgaacaatctaattcagrgttccttcttttgccttactctgtctctctgttggaactgggagtatcaggccataggttctgtcctgccaaggccttgcagtcagggtggagtgaagcagggagctctataaggaggctgcgcgacagctaccagcctcattgccctcggggagggcaggtggatggtgtctgagtcctatgtccttttctgctttccaaag

SEQ ID NO: 20779 - DNA, 600 bp, Bovine  MMBT11132
tggaggctggggtgtgagagagaagggttaggccatagctgttttttcttctctctttctcatttcccctgagaaagcgaaaatactttaaaagactattatttataagaggtttctaaaaatcactgaatgacagatttaggaactggagggtccttagagttttgtgaccttatataaggccccatcatctctatactgtcctcaggacctaggcaggaataaggctggtctgtctccaagtccccttccacttctatgaagagtctgtgtccttgtggccccatggcatgtgagaayctgcatgaatgaaagtgactccatcataccttacttagtctggtggtctggcgatctaggctgagttatctgcttgggccatgccttctccaacctcgtgtgtctcagaatcacttggagagctagttagaaatggatagtcctgagttgtactccaagactatccctgaatgtgtgatatgagtcagggatttgtatttgtaatgaagccccagtgaattctgacatggagtggggatggggggctatgtgaaccctacttttaggttctgtggcttagccccttgcgagcatctgtgg

SEQ ID NO: 20780 - DNA, 600 bp, Bovine  MMBT17438
agtagaatgggagtattatgaaaacaaagagtaccttggtccatcagaattttcaaagaaaataaccctttggccagaccataattccccatagaaacaacctacatagagtcacatacagtgactaaattatgtttatgcttttattaagcaacagagctcattctgacaatttatctactaagactcatgccagaaaactgcttattcattttctatattctgtttggaaaacaaaacatgacacataacaatataaaagaaaactataatcccgagacgcatgtgcagtcactgtasaaaagtgttctaaattgtcttaggcctgtggcaytggctttccaaacagcatttaaacactgccacatgctgttcatctgtgtgtcttgcagcctgtggcaccggcctgacctcgacagaatgaatcgygcaccaaattaatgaagctattaactcttcaaaggaaacttccctggtggctcagatrgtaaagaatctgcctgcaatgcaggtaacccaggttggatccctgggttgggaagatgccctggagaagggaatggctacccactccagtattcttgcctgaagaattccatg

SEQ ID NO: 20781 - DNA, 600 bp, Bovine  MMBT09990
ttgaaatccgattactttgtggcttaatttgtgtactgcttgactgctctgcagtttcaggcaatttaacaatgtagacagtatatgaagatggaatgttaaatagtgagtgagacattcaaggcaaaaatgtcttgagttgtgttcattttttaaagcatctcgctgagtgagatgcaggctcgatgtaaagactccaagtaggcagattatataaaagtcagggaaggcacaggttctttccccccacatctctggataattagttttaccctcttgttgaattttggtgcctattakgctcataaagattaataacatggcgcacaaaatcaccttccctcctgtaaactgcatttctctctatgactgcaaataagaagaatcagtgagtttttgtgatgatctaatgctatcagaagacacatagagtacaggcccttctgagagatcccttgtcatcctaaaacccaactaaatgggattctgatatttcatagagctctattcccataaacaatgaattttaagagattgataagttgggtcaataaagaaaacaaatttagatattgtgtgccaaacactggagtttctctt

SEQ ID NO: 20782 - DNA, 600 bp, Bovine  MMBT03017
cacgtgtctcctcctcggtaattatctggcatttagcacctctcttcccagcacttgtaattagcagggaaattaagatgctgtcattctacctcccagcttctctctgttatgcccagaggcccagagaggggagggtatcagtacaccaagaattgagactaaaactcaggggggactgagaggggacatttgacaggagagcagtggtgggtcctggagggagcacttcctgccgcctgcagccacagccatgccttttgtctgaatttctggagtgtatgcaagggtactacgctstctcccatgggatgctgttatggcgctgatgaaaagactaggctccagtggagtctcattgccttcaccaagattttcacagaggctctttggtgcccacctcggtgctagaccctgagatcagggatgaatcagatacacccggagttgtagatggtccccagggaaaggatatggcatttggttggggagggggtacaaccataacacaaggctgaatgtgacaagagttgaaggaggcaggatcagttatagaatttggagggacttactgaagatgtgaattactggaattctaaa

SEQ ID NO: 20783 - DNA, 582 bp, Bovine  MMBT09549
ttacttatgtcataattcttacataaatgtaaggtcacaataaacagtcagcagatgatgaagaatgctcaatgataagtattcatttatcttaacccagctaataaatgtcaattcttagatctcagcctaggggttagttctggtaattctacccttataccatctgttttgtggtattctttttctctgggtcagtactctgcctaagatcacttccttcctactacttatatgctcttctctccaagagaatgcttaccaaactttccacttggatgtgcaatctaagagagaagycgctcactgtatttttatatatatatatttttagagggtttgtaccactgatcattgtctgagttgctcatggtartatacaccagcagataacgctcaggttaatttattttaaccacctgaataagtttcaaatataagtcattctctcatacacgacctttcccaatgcactattaatctttcaataattgagctttattagtacacatgtgtcaagccaactttttaagaaatgtcagacatctccaaataaacaggcaccctcccaatggtgtggca

SEQ ID NO: 20784 - DNA, 600 bp, Bovine  MMBT05564
ttctgttagctcccccttccaaaggcagaggcagctgacagaattaatctggtgactcaggcggtaaagaattatccacctgcagtgcaggagacacgggtttgtcccctgggtcgggaagatcccctgacgaaggaaatggcaacccactccagtattcttgcctggaaaatcccatggacggaggagcctggagggctgcagtccatggggtcgcagagagtcagatgtsactgagagactaacgcacacacgcccccaggttacagaaacgacaccgtgtcagggcaggcaagtctmcccctctgcctgcttgtccrccatccctcacgacatctcaggggtggcctgagaagctgccatctccatcacccatctgacaggctcaagccgtccatgttgccagggcgatcagccagggtctgatgagtgagagagaaaggccaacgaagcaaagaatggagggaaggagggagaagagaagagaagaggttgagaaggtaagagaacctggtccaggccgtgaatgccaaatcccaggtgtaagaggaagggacaccgggtgactcacggctcgggcaccacctggacccagtgagt

SEQ ID NO: 20785 - DNA, 600 bp, Bovine  MMBT04263
tctaggmccatgttcatgagcttcaatgaycatattaacattagagtaactctccagccatgtcagatactatccatgttgagtagtcaccttacctgaaagttcagattataaagtttaagtgaaactccatattttatatcccaactgatcgctgagcaatccctgcactttttctgtaaaaagcaccatgctatcttgaggaaaatataaaaataaaaatctgtgatcaccactgactacctggctggcaagagcagttacatgcatgtgcattgrggtgtctggattgattcaacsagagactggacagattacagttcttccagatacccgtggcccactctaggacttaatctgcaagaatatttgtatagaattgtaagggaaagaacgtgccaggttgggttcagaattccaggttacccaccatttctcagctacatgtgtctcttggcaaatcacagtatcttaaactctaatgctatttttaacatgatgaaaataattatacttactttataggttttaagagtcaaattagatagtaaatgtgaagtgccttgcagagtgcctaagagttaacaagtgaacaatcta

SEQ ID NO: 20786 - DNA, 600 bp, Bovine  MMBT11243
gggacagcctcttcctgttcccaccatcgcttaagatttttcattctgcttcgtttgaaagttaaaagtagtcttgaccatataacctcatactctcccatcccccactgtctgtttaggaaaagaacttaagtctaagggctatttcagcctgatacagctatgtttattactggagtagtacatctatgagacattcctggggaatcttagactgttaaaactggaaaagaaccttgaagtaatctaatccaggattctcaaagtggcctccaaaccagcggcctcagcaccacttargaacttgttataaatgcatgtttagggctccactctggatctgctgagcgagatactctggaggcagggcccagcaatctgtattttaaacttttaattttatattggggtatagtggataacaatgttgtgatagtttggggtgaacggcgaagggactcgaccatacatatacatgtatccgttctcctctaaacttccctccaggctgccacgtaacattgagcagagttccttgtgctatacagtaggatcttgttggttatccattttaaatgtagcagtgtgtacatgtccatc

SEQ ID NO: 20787 - DNA, 600 bp, Bovine  MMBT17515
taacttttgtgctccccacagaactctgaccatccagctgctcaccccactctccttgcttaaaacaaagagaaatgtaagccattacacaggaatcctctgtcatctctctatcagccctggaagactactttcttccttccctgagttcctcacctctctcgttataactgaagaagtacatattatcctgtatctagctcacttatactttagtcttcttatctgatctcagaggaaatcaatgtgttgttctcctccattatctgtctcactccaatgctgaacttttctcaatarcatgtgattccacttaagtttgctcatctgaaaatacagtgaaaacattaaaaattctcatttatacccagatattccatctccatctgtggatgaytgctaattccctcctgagcttcagtacacatcatcttcaaccactctcctaacacacgatgatcagcttgaactgaacacatccaaagctctraacactggctattcaacactctaagctctttttatatccaccctccccccccccaatgaatgataccactgttaatccttttcagaatgtcaagtgcctgggagtcatct

SEQ ID NO: 20788 - DNA, 598 bp, Bovine  MMBT21484
  misc_feature (1)..(106): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcactgagggatcctatctcttgatagagatgaccagggtgtttttacagcccacccttccttatccatcagcagctcctcccactcaatgggttgacatgaaccatcattccacgtttgggaaactctgtgggtccaaaagttccaggggagtcagggygtgtccactgaaacctcagccggaaccaagcrtcrttcagaaagtgaactgatgagctgtttatgtarccaggttcaagagcaagagcccaggcccaggcctgccgcctccaggccgcaccagttgsggggagaccctgggcgctgctcaccttgatgcggtccttctccttctgccacttctcagcttcatcttctatctcaatgatcttgagctgcaactgctccttttgcagtgacagctctgtctgtagggaaggagccggggttggaggagaagtcagggggaggaagtggaaaagacccagagagtcagggaggagggcccaca

SEQ ID NO: 20789 - DNA, 526 bp, Bovine  MMBT04630
acagagccaatcaatgttcgttccctattgtaaatgagccttgatgaccttttgttcacattaatgctgacaaactctgcatgatacatgactgtcccactctctagctcctcccaatagagttttcggcttttattccagtcagtgcacttactccacgtctatggatgtggcgcagggcacacattagtcgggggtgggggtgagggcgtggaaatggcagacaccggtctatactgtcaataaccttggagaccttggggaagatacaagggcaaataatctactgtggtagagaaragacagctaggaagcaatccctcagtattatctttatgatttgagatagcgtcaaaagacgtaatacatgagagtatttcctccatcaaggaaaaagcactgggaagttacctgcacaggtaggtgttgcttctttggttacaatttaagctggatgtagaaacccaaagaggtacactgggaccattaccttcttggtgaatgaacacaagggccatgacaattt

SEQ ID NO: 20790 - DNA, 598 bp, Bovine  MMBT19460
  misc_feature (1)..(80): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnctcccgcattgcaggcagacactttacccattctgagccaccagggaatcccaagattacatatgaagaagtataaaacaaaacaaggaaatacagtgtttctgagaaactacgagtagacaaattaactatagtctacattcttgtgacttttctttggaaattcacactcccataaatatgttgcatctcctgggtgtagatgtagttaaacattaayggaataacaacttaaggcatttctattaggcttcaaatcataattacatatgatttcttcaaaccttaaaaaagataacttttaaatgattgaaagtgttatacaatagacaatttttaagacttgttaacacaactactgtggaagatagaattctaagatagtccccacaattcctgctgcctgttttataagtcctttgtaatccttgggactatgaaggcaacaatcccatcattaagtwttgttatatggcattttgctttaataaagggaagctatctgtgagggcctgaca

SEQ ID NO: 20791 - DNA, 600 bp, Bovine  MMBT02781
tcacactcccataaatatgttgcatctcctgggtgtagatgtagttaaacattaayggaataacaacttaaggcatttctattaggcttcaaatcataattacatatgatttcttcaaaccttaaaaaagataacttttaaatgattgaaagtgttatacaatagacaatttttaagacttgttaacacaactactgtggaagatagaattctaagatagtccccacaattcctgctgcctgttttataagtcctttgtaatccttgggactatgaaggcaacaatcccatcattaagtwttgttatatggcattttgctttaataaagggaagctatctgtgagggcctgacataatcaagcaattcagttgctcagtcatttctgactctgcaaacccatggactacagcacatcaggcttccctatctttcactatctcctggagcttgttcaaattcatgtccagtgagtcagtgatgctatttaacaatctcatccttgaatgtaatcatgtgagccctttaatctggttccagaggtcagagatggtcagagacggakaagttggaataatttaaartacaaatggaatttaat

SEQ ID NO: 20792 - DNA, 598 bp, Bovine  MMBT09240
  misc_feature (1)..(18): n is any nucleotide
nnnnnnnnnnnnnnnnnncctgggtctcccacactgtgggcagactctttaccatctgagccccagggaagccccttaaacatagtaggtacttcataataaaaatggaaaagatgaataaattggataaagtggaaaatttatagtaaatgtgcctgtatttaaatatctttttttgtcgttgtttttctcatttttttctcttcccctttctattttcagaatatgagtgatgctatggcagtgttgcacaaactacagacaggcttggatgtaaatgtaaaattcactggtgttcgwgtgtttgaatatacaccagaatgcatagtatttgatcttcttgatattcctttgtatcatggatggttagtggaccctcaggtaagtacaaaatcttaaattatatgaacacaaatatagtaaaaatttattaatttggcaaaggaatctaggtttacattttctgatatttatatttttgtgtttttacatggaattagccacattgtgaggttaagagcacagtcccctagactgctaaatctgctcaagacttctgactataatttcatggagttagaggccagctacagagctg

SEQ ID NO: 20793 - DNA, 600 bp, Bovine  MMBT10367
tatgacaggaaaatgaagcacacacctctcgtccatgagaaactagcaaacttctcagccactattcaaggaattccccctcctatatatctttgtgcgggttatgccctgtacagctctagggggcctcattcacttcacagcctggttgaatgacgccccttagggttgagcagggcaggagttgtacaaaggttcttggcagccctatgtcccagatgacagggatttgactccttcaaccacagcccagcccagcccacagggtccctacctcccagctgttcgtggaggtccctytcttgcttccctgcaaagagactggccagactggtcttcccgacaccaggatctccgagcaggaccacgcgatagagggcctcccaagagctttcagagtcgctggattcagaggaccagccgttgggggcaggtgaaggttgccgggtaggggcgttgagggagactgactggcccagtcggggatgctgggtctgtgtagaaggtgctgtgcccagaaggccaggctggtggccccgggcggacaggggcagtggagtgctggctcggcgacgcaggggggtctttgcttcttgctga

SEQ ID NO: 20794 - DNA, 598 bp, Bovine  MMBT19814
  misc_feature (1)..(21): n is any nucleotide
nnnnnnnnnnnnnnnnnnnnnctgcatgtgaaatcacaaggacttcttgcaggtgctgctgctaaggccctatccctgggatctgacgaacttgctctgaagcacagctgggcctctatccatgtggcctgaacgctgagttcatttcctcaggactgcaattcccaagcttgctctgttctagcgtataccacttgcccagtctccttatgaccatcatgcactggcatgaaatgtttagctgggtttcgagggatcatgggtaactctctcggggtacaggttgtctagaggagagcrcaactaaacggrtgcactaaccgcctgaactaactacggataactacgttagcttgtgttacaaaaggacagtagcagcatctacccagkaaagcaagaacatgttcagtactcaatacaagagccaaaatgrtcatacagtgttctaggaataagtgtttacaccaaaatgcttagaatcaagtggaagagaccaggataatatctgtaagacaaagaagaacatgtaatgcatatgctcaattggcatgcagagagattctaataatactggccacagttctttttaaaaaatgag

SEQ ID NO: 20795 - DNA, 600 bp, Bovine  MMBT03747
ggagaactcaggccaccgtctgtggagatgctctgtgaaatcagagcagcttgtgaatgagcagctctttgacctgcgttactttcatacttgtgtttaagaagagccataggcatggggcacctttgattttaattacttaatccttttcacatgagaatagcatgtgaccattatatttattttcttagtgaaatccattcgcagtatacctgcctaccttgcagaaaccctctactatgctatgaaggtaagtgcatgccttgaatcttctatctaaattatctctstaatatgttytagagaacagaccttgaggtttgttttcccctccttaaaacaggtggttgaattctactacttgytttactttattgactcacccaactcaggagagtttgatgctataattgatatttttaaacaatgtgtgtctctctttttctttttcaaagggagctggaacagatgatcataccctcatcagagttgtggtttccagaagtgagattgatctgtataacatcaggaaggagtttaggaagaattttggcacctctctttattccatgattaaggtagtaaaacctttctttaaat

SEQ ID NO: 20796 - DNA, 600 bp, Bovine  MMBT10428
gaagaggagagggttcgctgtagggggtggaggctgcgaggatgtgcgggaagaggcagcagtgtggtggtcaggactgaggggagcagaacaggtgcaagtcacccaccttgcagggaaggagcgtctcagtagttatttccctcaggttattctggtcttcttggaactagaaataacccagatggcacctaggcgttgtgtccagactcaagctcaatgtggtactcgtggcgggcagaacaagggcactccaggaggtaaatctgacccccagaacccgtgatgatgtcacctgaygtggcaaaggggaccctgcaggtgggagtaaattcaggagatgatcctgaattatctgaaagtgcatgtgttactcactcaggtgtgtctgactctttgagaccccatggactgtagtctaccaggctcctccgtccatgggatcctccaggcaagaatactggagtgggttgccatttccctttccaggggatcttcccaatccagggatccaaaccgcgttccctgcattggcaggcaggttctctaccactgagccacctgggaagcccaagtaaatactttcaaagtcacaaacaa

SEQ ID NO: 20797 - DNA, 600 bp, Bovine  MMBT11114
acttttgagtgaaacagaacaagcactaagttatgcctgtacacatttgcataagaatataccatacacaaattcaggtttgcatgcctaatttcagacataccatcctagaaatgcacattataaaaaacataaactttccacgggccagaacgttttcctctccaggtgttgaattttgttttccctaaaagggaaagataacgatagccttaatttatatagtaccttttcccattctcctttccctataagatataggagtagctatttcatgggcacttgaaaaggcacaaatcytttcttccttaacgtatagatcctagtcagggtatcccagaagactggctctttaggcaaattctagaataaagtgaaatttgtcagtatagwttctctttgatgattgtctttcsctctcttaaagttaacccagttctttgccagccccatagcttagagatctctacacagacatctgtcaggctattccctctattccttgttccrtagtataaaatgtttcaactcacaaaaacgggcttgcactatcctgtctagtcttcatagtggtctcacagtttagtaagctaatagggc

SEQ ID NO: 20798 - DNA, 600 bp, Bovine  MMBT16758
cgttgtctacttgcttagccaagtctaagttgagagatmagagccctaaaagaggcacaaaaaagtgcttgtctggccttggatatgaatatataagtaaagctatatccctcataatatgaaatattccrtgaaatgatcatagagaaatggagtagatgccctggacttttaacatggccagttattcttttcctctcaaacccccaactctggctgtggagccgattatcccagcattttatagccttagttatgaaaataactacactgaaagctataaaagattaagtggctacrtatgattgttttatgaggtagaaatttgaagttaatctagttgactgttaacttgatctaaagtactgatatttgaaatatgcaagttattatctcaatttatggtaaatattattaygcacttgatttaaagaatcatatcactcttttaaaagaaaatcacaaaacagggttatgagaggaggtaattttcaatcatgagtggggaacaattttcttatgctagttttatctgttacgtatcttctcttggaaagttatttgtcgtcttataaatggaatctctttcctgatttaatt

SEQ ID NO: 20799 - DNA, 600 bp, Bovine  MMBT19469
aaagttcttcctgacccaggaatcaaaccggggtctcctgcattgcaggcagattctttaccagctgagctaccagggaagcccgtagctaccagggaagcttgtaaatgtgtttcccacacatttacaactaattcaaacatccaagtgcttcataaaatcaaatctgatgaccaatatttttactcaagcacagtcatacmactcaaaatggggaaagtgtggcagctagctcaagcttgatagaacattagagctggcacaaactttgaaagaaatctagtctaacttcctcacttytcaacggggaaacgaagttccaaagaggtgaataagggaaccagtctggctggaggacttgcctcrctttgcytctcatagctgataaacttgcctctctgcattctgttaagttcatgaaaatttttgcttaacccagaaaataaygcaagaacatttttctaagcatttactattttcacagtcactatatgatactyggatatttccatctttaagaactgcaaaagagtattgggcatttatcctaaagaaacgaaaacttatcttcamaacaaagtctgtacacaaatgcttata

SEQ ID NO: 20800 - DNA, 601 bp, Bovine  MMBT19471
  misc_feature (1)..(1): n is any nucleotide
ngtgcttcataaaatcaaatctgatgaccaatatttttactcaagcacagtcatacmactcaaaatggggaaagtgtggcagctagctcaagcttgatagaacattagagctggcacaaactttgaaagaaatctagtctaacttcctcacttytcaacggggaaacgaagttccaaagaggtgaataagggaaccagtctggctggaggacttgcctcrctttgcytctcatagctgataaacttgcctctctgcattctgttaagttcatgaaaatttttgcttaacccagaaaataaygcaagaacatttttctaagcatttactattttcacagtcactatatgatactyggatatttccatctttaagaactgcaaaagagtattgggcatttatcctaaagaaacgaaaacttatcttcamaacaaagtctgtacacaaatgcttataacggctttatacgtaataactaaaaaccagaaacaaactgaatgtccttcaacaggggaatggaaaaacgatggataaacatctgtgccatgaaatatgactcagcagtaaaaatgaaccattgatgtacgcaacatctgggatggg

SEQ ID NO: 20801 - DNA, 600 bp, Bovine  MMBT10174
tgatgacctcactgattaccagttctgttgcagaggctagtacaactattccaactctgactgattccacacacaaaccagagacaacagcctcagggatcatccactctgggactgaaacaagtccagctgttccaactatgactgtttcacctgggaagccaaatacaacagtctcagtggccacccatcctgaagagacaagtccaactttacccaggacaacccccagcgtttcccatactgaaacagacaccacattctcaacagccaccagtccttggacagaatctagttcascagtcccagctacaactgtctcacctagtgtatccaagttggggacctctctggttactagttctcggaaagaaattagtaccactcttccaacactgacttcttctccaggtcaagtggaaaccacagcctcatgggtgactcattctgagccaaaagccagtccagctagtccaactccacctgtttccactagtgtaccacatatagtgaacccacaagccaccagttctgagacaaaaactagtatggttattccagctctgacactttctccctttgagccaaagaccacagcct

SEQ ID NO: 20802 - DNA, 600 bp, Bovine  MMBT06622
tttgtgttgttgtaagacgagagacctatgaaactatttagtaaaaattaaggctgaaaactaaagggtgaacaaacatctgtgatttcatcgtggccttctaccagcgtagactgccgagtgtttgtggtttgagtcttgtgtctgtgagtactgtaggactcctgtgggtttccctggatcaggagctggttgtgaactgctacagttcatgaggatgaactgtcgtaatgttacaccaaggatggcgtttttggagtaggagaaaaagcagatgacagaaactagaggaaaagagaygcatttttttctgaaagtatgtagactgcctgcagattgtgtgttccttgcctcctcatttgcatctcacccttgtggacgagttaacgtaacctgtgtgggaatgacataactttcctatctctcacttaattctgactgcatcgtgtgaggggactgcacggtggcccacatttttctccagggctttctgcggaagtgagtcaatacgttgtttctggctttacttgctggccctccctcccatgccagcgctgggtgcattggaattttccaggtatatcattagaggaggcagca

SEQ ID NO: 20803 - DNA, 518 bp, Bovine  MMBT06854
gaaaaattactgaaaatgaaactactaagtcaaaaaaaaaaaaaaacttaagaaccttcttccaaatgactatgattgtgcaccgaaaaaacagcagttttaacaaagcttgctgctttaaagactttgtttttaaacaatcggttctaagaatatttcaactctagaaaacggcttgtaaattaaaagaaattctcataaagccagaaatctgtattgtgggaaaagcagaatcaagccatgttttagccagaaagcatcatctaaagaatggagacttgaaccacggtacacagtaargcaasagaactaataatttatcataggaagctgaggaagaactattattaaaaacaccagtggctttttagaatagtgaaaattcattccacatcttttagaaatgtaggtgtcacttataatcttccagatcaggtttatgttcagtatactggggtttaagggagaaaaaagatgccatatggctggctgaacaatacctgatcaaaaatgattta

SEQ ID NO: 20804 - DNA, 598 bp, Bovine  MMBT00936
  misc_feature (1)..(73): n is any nucleotide
nnnnnnnnnnnnnnnnnnnnnnnnnnnnnnnnnnnnnnnnnnnnnnnnnnnnnnnnnnnnnnnnnnnnnnnnntctttgaggggttgtgttttattcccctttgtgtcactctatacctgacacagttattatatacctggcattcagtatacacttgtttactgaataaattcatatatgcagaaacaaatggctcaagtaaccattaataatgttaagagatttgaggggaaaaactatatatttttatttaatattgtggctagaaagtgacacaaacaactagctctttaataaaygagtctaaattattatgataaaacatgcaggaaatgtgtccatgagagcttgataactctgaaaaagccacagctgaagccattatccttatgttgttcatctcttgaacgattttaatttctgtgaggctgaactcttttttttttttcccttcatttcctaagaacaattgactctgcttgcctggcctgaggaaggctcctgggtatcattgctctggcaggtggttttcatttgcctgtccagagatgctggcacaactgcaaacacagctcccatctcactcccagccatatc

SEQ ID NO: 20805 - DNA, 600 bp, Bovine  MMBT08447
ttcatttgtcacatttactaagcactgaagaggttgtaatacagcatggaagataaataagcacggcctctgcaataaaggggcttgcagatctagagtcttacgcatctctttagatggaattccttttagaaagatgtgtgttgatgggacacagatagacctttatgagaaggtgaaggcctttgttttcaagcaaaaatagctttgtcttgggttatactacccttggtccaaaaactactacaaytggtaaatagtttytaaagggccattaaatgtcatcctaagaacagttayagttttatgttatgagtgaaagtttcattgtattcaacaagcccaaaagtttctattttgggaaatgtaaatcaataataggaacaagataatcaaccttccccaacatcttyctgaaaagtataaccaactctttaaccagtattttattagtttatttcaatcactactcacttcaccccttgtttttttacattcctcttctccaaaatgacacctakgggtattcattcattcagtcgtacctcccatctatttattgcttgtcatcactaatacacagtttggggcacagattaa

SEQ ID NO: 20806 - DNA, 598 bp, Bovine  MMBT10830
  misc_feature (1)..(3): n is any nucleotide
nnncccaacatagagaagttggaggagtctgaattgggcatctcccaggccctcttggaactggagatgaactcggacctcaaggcccagctgcgggagccgaacataacagacgccgaggaaactgaagttggtggtggctggaaagctatcatcatctttgttcccattcggcagttgaaatctttcctaaaaatccatgggcagctgctgcacaagttggagaagttcagagggaaacacatcatcttcatcgctcagaggagaattctgcctaatccaactcaaaaaagttgtacraaaaataagcaaaagcatcccaggagcctcactctgactgccatgcatgacaccatcctggagaacttggttttcccaaatgagattgtgggtaagagaatccccatgaagctggacggcagctgactcataatggtccatttggataaagcacagcagaacaacgtggaacacaaggctgaaacattttctcgtctctacaagaagctcatgggcaaggatgttaattttgaattcccagagtttcagttgcaaacaaaaatgattaaataaaatattattcacaataaaaagccca

SEQ ID NO: 20807 - DNA, 600 bp, Bovine  MMBT04743
gaagataaaggaaaatatacttataagatgtaatctgaatgtatataaacttgaatgacaacatcagaatgacaaacttcagagataactttggacacaaattgtgaggacagctattactattttaatactagcgcaataatagatgtttttgcacttgatataaataataataatcaattgtatttcaaaaaatctgggcagccattaacatttagaaagctttgcaattccagttaattttacaacagaagacttttctacttcctacaagttacaagtcaaaaaaaaaaattctgytaggttatgtacattagctttcaaatggcatggagcaaaattatagatytcttttcagaaacaatatatgtaaacacagaaaatactgtcaatttaagtctactctgttacattaygtacatagtaaatgaagtgcaaaggcrtgaaaaatacttacctccccaaattcaagggggtctcttttctagagaactattgcaattaaagagggagtgaattactctgtccactttgccacatatttctataatctcaaaatttctttgtaagttttggagttataatgctttttaagttttt

SEQ ID NO: 20808 - DNA, 598 bp, Bovine  MMBT11926
  misc_feature (1)..(50): n is any nucleotide
nnnnnnnnnnnnnnnnnnnnnnnnnnnnnnnnnnnnnnnnnnnnnnnnnntgtatattttttataaggtatttcataaatgcagtcatacttttttaatactttgaaaaataaatattggcaaaggactgtcatccaaacatttataaaatccagtggaacatagaggaagtcatattatcttttgagcctctttttggtagtttcgggtgctttcgatgaacttcctgcttttgtgccctttccttgatccctgctctctagagatgatatgtggcttsttctggaggctttagcacaygctgtcagctctggctaccttccctccatcggctcataatccttaggcctcattctgtaaaaaaagaaatctaccaaagtgaatggaacctaaaggtcaaagctgaagtgtgccaaaaatagctctgagttagtaaattggtgcacccacaaggaaacaatagtcaaacaacagacagagctcgcctgcgttcttcctggaggcaaagttcaattgctctctaaagtctctgcgtattttgtgttaagcctttcacactgttttgccagttcagacccttaggaagttctggatcacc

SEQ ID NO: 20809 - DNA, 504 bp, Bovine  MMBT01514
ctatatgtattatttcaaacttccaatttaacgataatgctgtgaatctcaaataatatacagggaaaagttaacaattttttacaattaatttgtgttccttttcctaaaaaaattaaaaactagcaatgttcccatcaaagaccaaacatggtacaagggtaattcatagaacattaacttcatcttaatgcatcactattccaataaaatcacactttctgcactaacactttttggataagttcaaactgtggctgagtgtctgccacatacagacattctcttgggcaccaagayggtgaccataaaaagtattcaaatgatgacacctcctgagaagtaaaagggagtgttaaaatatattacattagaaaaatttttgaccacaaatgttttcttttaaaaataaaaattccatttaaaaactatttttaataaaatactaaaacttggtttcaaagatgaaaaacccaggacatatgctaaaaaaagacaggatac

SEQ ID NO: 20810 - DNA, 600 bp, Bovine  MMBT01366
aaaaaaaacccagcctggacactgtttaaatttcaatcactagatttgtgtgactctgcgtgaggcagagttctaggtggaagcagcaggggaggcttgtgaaggtacaaacttcaaccgcctgtttaggaggagaggatgaaaggcaccttcgaaaaacaacacacccagaggtgtagaagatggccaaaattcagcaagttgaggttattccataacctttaaaaaaaaattctattgaagtatagttaatttataatgtattaatttctgccgtacagcaaagtgattcagttataygtacatatattcttgacattttcttttccttgtggtttattacaggatactctgctatatagtaggaccttgatatttatccatcctgtgtatgacagtttgcatagcctttctttttttgtagaaccctttgtctctgatacacggtctctgctgggtctcatttgatacagtggcgtcagacttgaaaactctaggataagaggatggagggtctgacctgaggggtgctgcagagatggctgaatctagaagcctgaggtggaaccctgcatgctcaccttgcagagggggtgctca

SEQ ID NO: 20811 - DNA, 600 bp, Bovine  MMBT07238
ccaaggaggtcagcagagagagcaatcgcttcctcatcatttcccttgtgaatgaagccttcggagaccagatgcatccacttcattataattacgttaagtgccgcctgattgggcgctgttcatcacccctccggaaagcrgcttcgcccagtggacakacaagcagcctgcttgggctcagcgcacctccctctcatccgtctgtgtccttggcaatggctgttcgtggtgcccaaggctgtcctctggaggagaggaagcagtgggggtaacatgtgtggcctgggttgactcccyctcctcctccctggggctcagagtaactgtgcacaatcagctgcaccatgagacctctgcaccctcatccagctcttaacttgtcaggatgtcgggaggaaggtgaccttggtatccttacaggtgaacctcctgggaggttccttttgtcctgaggcatctgattgtccttgctgcgggattctgtgtcctcaccttgtaagaaaatgaggtctgccccatccttcaaaagggccagagcatggtggagactgttctgatgtcaagggcggccttttgtaacctcagttgtctatgcgt

SEQ ID NO: 20812 - DNA, 600 bp, Bovine  MMBT09554
ggaggtgataattgcttaattcatttctgccctttccccctcggtgctggctaaagcaccttccacatagtaggtatcctgtaattactggtttcaatgcctgtctgaatgaatgaatatatatcatgggtaagtgggaaacagacttctgcattcatttttcaaacataagcaaagggacaatcacatagatttttaagctcatatgtattccaaggattgagtctagaaaaaattactaatcagggttcttttctcttttcctttgtagaccatactctaattttttttttcaaaccrgaagagagaatgaagataagacagtgattctggttgagtttggataattatatttttcacactgcttagcagttaagattgacaactactgattatctaagacactatgtatttttcaaaataattcacaaaacaagagtaataattggatataattgcaaaaccaatggacagtttcagcacactcctgaatttacagacctcagtttccccaaccataaaataaaaggtatggaattgatcggtgtttctcagtgtttgtttcctcaagacatacaacataattcatacagggttcat

SEQ ID NO: 20813 - DNA, 600 bp, Bovine  MMBT02158
ttttcacactgttggtgggaatgtaaagtgatgcaatcactgtggaaaaccttaaggaagaaagaatattaacaaaaagttatttatcactgcatttatctactgtctttctcccaacctgacaggaaagcagaggttattctctggagaaataaaggcaaaaaggcctcacagttatggccaccamacagaatggaggagagaagtgtggcaaaggataaaaccagaggatgacaaggtacactagtgaaygaaggaatatgcaaccccctttctctgacccactcccaaaatgccacyatatagcacaaagtcaaagaaatgaagaattcctctctggagtaaaatgaacaatttcagaaaaatgcatctacgagtaataacatttatgagtgttccaatgaaaagaccaggtcttccttctaagacctgtagcagcacatctcaaattctggtgcctgtacctccttatagtcacaaaaattactgatggcttcaaactatgcaaattacaggtatcaaattgtaacattttagaaattaaaatgggaatttaaaaatacttattgattcatttcaaaataacaataacaaatctac

SEQ ID NO: 20814 - DNA, 600 bp, Bovine  MMBT02021
gcaggagacttgggtttgatccctgtgttgggaagatccccttgaggagggcatagcaaccccactcccgtattcttgcctggagaatcccatggacagaggagcctggcaacctacagtccacggagttgcaaagagttagacacgactgagcgactttcactcactcagtcaactttatgaaaagctttggtctcacggacgtgaaaggtgagccccgggaccagaggcccagcctgggctccccactagtccccgtgtcctctccccggccagctcctgcgtctgggaaacagttckctgatgacccctcaagtgtcaggaacaagggatcacgttgcatcctaccctggccctatggttaggctgtgggaagaagggagggagaacttgggatggagtgggacgccagagcgcaggctggtgagcggggccagcctgagtctttcctgacagcctgagatctataaataagccccccatcccgcccgaacgggagcagtcagacacgttcattctccccaaggtctgccgagtgctgcggtgattcatttcctcgtcgtttcacgaggtactacgtgctgaaattctttttctttg

SEQ ID NO: 20815 - DNA, 600 bp, Bovine  MMBT17118
tgaataaaaaatattggatttattctactttaattaatgagtaactgaatatttgacagggcaatacacttaaccctttcatataaagtcaactgccaatgatttcacagatcatgttggcaatggcaaagttattctccggaccaatgtcattctctcagagtatgttttgcagcagaggtgaaatcttagctggattgcaatttattaactgcactgatgatacagtaagtcttgattgacctaactatgcagagtaccctggagaagaatacaagttttgtttaaaatgttcagcayaccttgaataaaggaagaaagataaaccagatgtcatgatgaggggaataagggacttawtattccctgtcagagggtaacaagaaagctgaggatgttagaggataataatggggagtaaataaaatgatacatttctgtttgtccctgtttctctgttggttgctgtcgttgttcagtcgctcagtcgtgtccgactcttggcaatcccatggcctgcagtgcagcaggcttccctgtccttcaccatttcccggagcttgttcaaactcacacccattgatctggcgatgctatcca

SEQ ID NO: 20816 - DNA, 600 bp, Bovine  MMBT09558
catgccacaattaagaccctgtgyagccaaataaataaatacttcaaaataaataaaygcgcccactarcaacatctcagagctgatgtaaaggtagtgagttccctgtcactggaggtatacaagcagatattgatctaccgtatgcacgtcagcagccgggtaccagcagctctcaactaaagccctggacttctcaatcactgaagtccctccaattccaggtgcgctggactctgcgaatttcaaatttgactcccaccactgaggtcaaaaacatccacattctgcccacacagstctccgacactcagactggttttgcacaaagtggtaaaataacartttaagtatttcctaggtgtcagaactgtgaggagcaagaacaaattaatcaaccaagaattccttttcaatggttttcaagccagccagtgtctgtcaccaaaccacaggtgaaatgctaataaaattcagcttgtgacaacagcataatgatttaactatggcctgtttttaccaagaaatatatatatataatatttttccaaacatggccttttcaatgtgtgaatttttttttataagaacaggattaga

SEQ ID NO: 20817 - DNA, 596 bp, Bovine  MMBT17606
tggggtggtggtcatgggtaaccatcatgacataatccaatagtggatttcagctgcataaccaccagctcttaggagctgataatgtccaagcagggatgaagtgactgaggattacagaagcaattcctacttggtggggattagattgcagacctctgagaccttgcaacattgatatcagcgctattaaacacacacttgaatccccttcagctggtctgacactggacacggtggagaggtgggtgttgggggtgtgtggctctgttgtcatagacttttggtgaatggggtggygaggaccttaggaaatatttctagcagagcctcatcagtccaagcagtctgatttaaaatatattgcatgggacttgcctgatgtccagtggttaagattccacacttccacttcagggggccctggttcgatccctggttggggaactaggatcccccatgctatgtgtccagaaaatacatgcagtgaagtgaagtgaaagttgcttagtcgtgtctgactctttgtgacccatggactatacagtccacgatctccaggccagaatattgagtgggtagcctttcccttctct

SEQ ID NO: 20818 - DNA, 600 bp, Bovine  MMBT21900
cgatcccggggatccgggtgggctgaggagccaagcggtgtcactctgtaggactgcacgtggaggaggasccgggaggaagtgccagccagtccccaagacaagggccgtgtgacgcgacccccacgtccatcgctgccccgggaggtgggcagcagacggatcgtccggaggagccacctgcagagccrggctcccggagatcrgcgtcccctcgctgccccgtcctgacacctggaccckgtctccgcacctgcgtgattctccagggttcctcttcactgtgatttacctttgatytagccatttggtacttgtctcttgatgcctcrtaatgattcttgacaaatgttaatttatataaaatcaggaatcgctgtttttgtattgtttgcagcattgtgagccactttattattaaaaattatttaagaagaacctgggtttggaccttatttgtgcccccgtggactttaatgtctgtcacacggacttgcagtttctcacgtggactgtgggtgaagcatgacctcacacttctgcagcatcccggaccaaattcttaccccaggtcttcactgggcttttcagtaaagaatc

SEQ ID NO: 20819 - DNA, 600 bp, Bovine  MMBT09931
tatccattaattatctcttgcatcaatgatgcaataaatggatgaatgaagtagatcagagctagcactgaaacgactgcagaaataggaagacgtgactcacagccttgcaagtaaaactgtggcccrggaactgccaagggtgaggtggaatttcaaccagccatggctcagaaaacatgtgaggctcccctgatgttttttgaatcattctctggctcacttgattaatgctgtatctcactttttaccattttaatttctttgaacataaagggtaccctaaccactctcccattyccacccccagttaaagcaaaccacccagacatgctcatgagacttgggcccacttcttcaggagtgtgttgcctgtccacagagcttccagtcagcactcagatttaagtaaaggctccctggaacccatccacaaagatgtgctccattaccaaagaacttatcctccagcttcaaaagggaataaattttgtgtgcagggaacctgctgcatggggaataagaaatagtcacttaagtttataaaatcttgcatggtgctatctgcttcagttttctcttttaaagctagaggatgac

SEQ ID NO: 20820 - DNA, 600 bp, Bovine  MMBT20971
acccaatgctgagatccagttggagtgctctgaagtgaccagaggccacagacccctccatcccttcttgtccattgtcttgaccactctaagagcctggagggcacctccttctctaagaagtccctaggttctgaaagcatagtgaatccatgccttgtgttaatttcactgattagaaccagtgctctcttacccctctcccttgttaatctcagaggttccacccttagatcccagcccagcaaatgtttgctaaaatgttgttgtatgaataaatgtgactacccatctatctcyatcctttcacattgactgtctcaagtattataagggcaacctttttagcaaagaaaaaacaattacagatattagatggccagagaagacaaaaaaaaaaaaaaggtggggggtggggggggtggtttctactaggagaagctcaaagaattatgaactgatatattagtgataaactctctcgtccagaatctcatcaacattctactaactatttattattaactttgtactattgttcttcactcagtgtttgctctcctctgagaatatttgagcccgagtaaatctaaattcttc

SEQ ID NO: 20821 - DNA, 600 bp, Bovine  MMBT18906
caacgcaggggctatgggttcgatccctggtccgggtagattccacatgctgtggagcacctaagcctgtcccccacgacttccgagcctgtgctctagggccctccagtcacaactactaagccctactgaagcctgtattcctagagcccatgctccgcaagagaagccaccccagtgagaagcctgagcaccgccatgaagagtagccctcagtctctgcaactagagaaagcccatgcacagcaacaaagacccagtgcaaccaaaacaagactcggaactcctaatgctgggggygcaggctggatccctggttggggagctaaaatttacatgtcacacagcgtggcctcagtaaataaatcccactttctatcctcaaaaaatgttagagcagataatcagagcgtaattcacctaactggaaacatgacatctacagccatttgcgattgtactaggacttaacctgcttaccaaggaaaacaggtwraaacagaaagccctgagrcccagtgcagctcgaaggacaggggtgcagtgctgctctcaccttgcagccactggtccagagtgttgtcagtagtgcatttgaca

SEQ ID NO: 20822 - DNA, 598 bp, Bovine  MMBT03532
  misc_feature (1)..(42): n is any nucleotide
nnnnnnnnnnnnnnnnnnnnnnnnnnnnnnnnnnnnnnnnnnttacacagacagcattatggagagagggcaggcaggaaggagcactctcactcacacatatagtgatttgtcacggcagcaacagttattggccgaacacataatcaacacggggctacagggctactcatatgcctgcactgttttttcctttcaccttctttttttcaaagatgaaagctattttgctgacatatctaaaaacattgttttgattttgataataaagctctttataataagaaattggaggtacayttcactaataagttgtaaatacattttctaataagaaaattcagtactgctctaaaaacttccgggttactttaactgctacttcgcaatcatgaaagacattgtgacttacagattgtatctgtttatctgatatgacacagtcctgtgaagtgggtacaagtaagcccatttcacagctgaggaagaggagcctcgcagagatttacataatctccccaaagtcacggaggggcaaaagaggggcacagcctaaaggcttgggctttaatctctaagcataagytctttcttccac

SEQ ID NO: 20823 - DNA, 600 bp, Bovine  MMBT03622
tccactgccgaatgccatgtccccatttgctcttcagataactattaatctctttacacttatccccctgctgacaagagcagctgttagtctcgcctctgctctccccggacttcccacagctcccagtcctcctcgcctccttcttcacctttcccccttgacaggtgaggcagactgcaggtgagacagctgtgagagaaaaaaactaaaacgtgaggccctgatgaaggtgtccacaaccctggctgaattaaagctcttaggtgtctaagcctgggggaatggtctaggaagggracygaaaagaaattattatttgtgttcaagttaagggtcagtatacaaagcactcctgagcrtcctgtaggaatcagataatgctcccagaggcacgtgcttccctgaagcagtacaattagggaggcagtcggccctgacaaaagggacaaagaaattcgctgagcactttctcacaggcagtaaaaaagcctgttaggtcaatcctgtccttctcctcctagctacacagaatggaacttcagctaattgtgggcctggagaagaacaaagaaacatggccctttgaatttttttttc

SEQ ID NO: 20824 - DNA, 604 bp, Bovine  MMBT06879
  misc_feature (1)..(4): n is any nucleotide
nnnnttgatggtggtacactctgcccgctttatccccctggaaaaagtgcaggcgaagcttccacttgggaaagaactgcttgacaactgtcctctgtgtccccaacaggctgacctctcaccccatattttgtttttatctctattrtttatggtttgtttgcttatgttttgctcctgctggaccatgcatttctactggagacatggagaatcctactgagatgacatgaataatatggggcaataatggcacggttacacttggcctggatcagtggttttcaaagttctggttgcatcmcaagtgcttgttagagaggtgtactttaatccccagtccacatagtctcattcattttgaggctgggagatctgcattttaacaaccctggtgtccctgatgcaataggtcaggtgactccattttacaaaatacagtctgggttcctccagtctcctctgtcctcttactactttgggctgattccctccagcaaaggaagagcctaggatggtatttggtgaaattcaaatcagggggacrcatttgggtaaaatgtcctgtcctaaaagtcaaaggcacaggctaaaattataaata

SEQ ID NO: 20825 - DNA, 600 bp, Bovine  MMBT17077
atttataaggtccttgaaattaagaatggtgtctttttcatctatatcattcccatgtgtgtctaatactataccctggcacataatagatatttagtaaatatttcctatgtgaataaatttaatgtgtaatcatttctgtgatttgtttgacactgtcttctcctgacttctctcttcttcacacttaycatmcataaaattggggtgatagaataaagaaatgttaagtgtgaaccgaacatgactctcaccaggctgtcactgttccccccacatgatattctcacagtgtccagygttttaaattctccatgatctgtattttttcagaatgcttagaagtatcttgcataccaagcaggaagaaaacaaagaaactgcaggattttgtactgtgcagagcactacattmcacttatattatcacatcttatttctctgcacagtgcaagagagaaagtctgtcatcaaataaacatttagcagtttctgcaacatyrtacccaaaatatatagccataaagaataacaatgatatgtgaaactgtagatataattctctgctccagaagtagtatttgcctgacctggaaagta

SEQ ID NO: 20826 - DNA, 516 bp, Bovine  MMBT16896
gataataatagaaagccacatgtaaagcacagccaggaaatgacttgatgtattcgagtgttcaaacactcattttcttattaagaaacatggtctttactagccacaggaaaagctccwtgctacttttgcctgctggaatgtaggatacacatttcattggtctctgttcctgaaatctgtggcttgaaacttggagagcagaaaggtcattagatttagctggcctaaaataatacttcatgaaccaattccgattgtcaagtaaaagcattggcttgggatctaaaaacctgtaaktctttggaatgaattaattgacatctttttaaaatgttaaatttatttgcaacatttaggaaaatgtgtagtctccatgaacacaggactgccttttaagtgaaagattttattttaagcctgatattgaacgttaaaagacattttgccttttgcgtaattgataaattgacagattatcagaagttatcccccatccgtatttcgtcaaggcat

SEQ ID NO: 20827 - DNA, 600 bp, Bovine  MMBT21760; identical to SEQ ID NO: 4672

SEQ ID NO: 20828 - DNA, 600 bp, Bovine  MMBT10876
ctcatgtttgaattgcattgactttatatttcctaacagaaatttagtaatttatagattaagtattatcatgaaaatagaatcttcctcctgtccccattttttcctgataaagaatttctccatagaactataaagatggtcctcttaaattcaaacctgaaaaatgacccctgttcttggccattaacccatgttttctagctcttacattttgaaatgtagagggagtcttttgaactcactagagaaaaggtattcttcaacagagaaacaaaacttttcttaaattggcactcrtctttctttaccttcaactcattaaaatagtgtgaaattagtttgtaggccatcatattgagtttttaatgtacctattattaaagcgtgttttttctctaaatgagattgtaaggtccaagagaatatttcaaatctaataattggattttggattaccttattccaggagtatattttctaaattttttctgaatgctattaaatgaaccttctgaaacattttcaatctaagttttactttgttgaaactgacagctccaaatccacttgcttagttctaattcaaacctctatttt

SEQ ID NO: 20829 - DNA, 600 bp, Bovine  MMBT09094
accacactcagaaatattgtgtgctgagtaggagggagagatggaccacttcgtaagatttgtctccaagcagagctgagtgcgtgacctggtatagagatggaagatataaagatgatcttagatgggtcaacacaacgttaattcatggtcccttgaagccagtctgcctgtcagtgtatcacttgaaaaaggccatgcaaacctcaggaccttctgggtcctgcccacagtaggtgcttttccttgaatcttgtggaaggaagcctggtcactcttagcatccatcttgcacatccytgcagtggacacatagaccaggccatcactaagagcccatcagggaggatggtgtggggatggagacaggcaggatgctctttgtcctcaggggactcagagacagttggggaaacgtgtgactacctgtagctaattagattggttgatgtgccctgcgaaggcggaggtgggtttagatgggggagggtggggggcgttttgccatgagtcttgagagacaagtagggatttgtcaagcaaagatgaagcccagaggcataccaggcaggagggaagaggagagcaaaggtgcagagg

SEQ ID NO: 20830 - DNA, 600 bp, Bovine  MMBT16479
cgcaggttggccggcctctgaggcaggactctgacactggggttataaatgtttctgtctgggtgcattatctaaattgttatgtatcaccctgggtaatggcaaaagtaaaaaccgctgttagctcagtgaataaatcctcgatgttgatcaatcatcgcgtggcgtcgactcttttaataggcacaatttacatggagacttggcagcctgctccgtcttctaattgcagatggaaaacggatgccgatctctgctgtgccataaaaatgtaaactataaatgacttaaacacttgcrtgctcccttccccacccagcactcatttccacctcgtatttagatacaaatcggagaaaaaaactactctcrtgtgagataataacttttatgatgcggggctcccagcttctcccatctgatgccctcagtccttcttggagccatggtttcaccaggtctctctccatggggaaagcatcctttgtagctacacagacagtcccctgcctcttaagtactttgatggtgttgcatactgttaagtactctgagttattgcccctgtgctcattaatgttcctgagggctgaagggatt

SEQ ID NO: 20831 - DNA, 600 bp, Bovine  MMBT23122
tgttgtgtgtacagttcatttcttttaattactgagcagtgttccattgccatccatgacatcccacactacagttgatgttcccattttcctggtggacatcacttatatattttaagattaaaaatgagatatagcctccagaaaggaacaatggcccataatcacacagttctgaaaagatggtggagagatggtcacacatctgaaggagagttaagtgctagtacagaaaatctcatatacttctctcagctcctcattttgctttccctgggaattccctattagagaggctgrtgagattgaaagattttgacttttcaattaagatggtgctgagacctcatgattttgtttgctactttaattcttttttttcaaaaagcctttcttctctctcttttactgcaggctttgcacttctgggaggacacccttgttttcttactacggacgatattcatttgggtgtgaatgaaagtctcacagatacagcccggtttgtaaatcttctcttggaagcttatttcacaatttatggatacatcttaaaaagaaaatatgcttcrctttamctagcggttttccctctcagca

SEQ ID NO: 20832 - DNA, 600 bp, Bovine  MMBT12884
ttaaaatttaaatgtaagttttatttattattaaacaactctctttaaagtgctaattgccagtctgcttgaaatataatcatgtatagatgtttagaactctgtgttccaaaggttatttatttatttattttttttttttggtaaatatacatatcacagatgttataacaagagtgtgtcaatgctaatcacacttatcacagatggcaatttttaaagtcattttttgctgcccatgtctttcttgctacatgaaacctactttctgaaaactgctgattgccattatctactaaratattctaacatccacatgtgttcatttmctgctttcctgccgaactccatgatttttggytttgattactcatcaatgtagattcttctttaatattttcttcatgactttttctaaatattgaaatgaaaattgatccccaaagcaaatattcttgacattcatatattacttaaaaaaaaaraaaagaaaagaaactaggaaaatgtaagcttagatcctggtgtttagatgtgtctaaactccttatttgaatcactaatgttatagtatgagggcaaagcatttgagctgaaaat

SEQ ID NO: 20833 - DNA, 600 bp, Bovine  MMBT07578
ttagagtgaaacacagattatggaggggtaactggtaattgtaatgataagatctaacaggtatgaccaaggggatgagtgactgaggtacattggagaagagaatgttaaggaagtagcaggtaaagacattgaaagcattatttccatttaggttggaattccaaacaattaaggcagaagtgatgttagcaaaaactggcagtaagcaagatactaaggtcattgagacatgaggggaaaatgggtattaacaaaagaggagaataataattccaaaggacctcagactcctgcagraccattctgagaggaatgttctatcatagaaaaatgacttttttggccagggaagaatggatacatgtatatgtatgattgagtccctttgttattcacctgaaactatcacaacattgtttgttaatcagctataccccaatataaaataaaaacttaaaattattcacaacctaaaaaaaamcccaatgatttatgagttatattaaagaacaattacttaatgactttatatctgagtctcagggcctgtgtggattcttgatttaagatgaatttaagaaatttggggaaatttgg

SEQ ID NO: 20834 - DNA, 600 bp, Bovine  MMBT08594
gtaccatctcttggtagagtcctttcttgggatgtagttggttgtttctgcactttcagcttcactggcaaccaatgagaatcatcaaactggaaagatttaggttcattagtgatagcaatgatcacatttttctttccttttagacgactaaatacattgaacaagtgtgcctcaatgaaacttgatgtgaacttccaaaggaaaaaggtaggtgcaatttactataccttactaagaccatggctgtaccagcaggacgagctgcgttcacaaattaaaaacaacacamacctaagsgaaattctgaaatgactgaccgtaatatgtgtttattctccaaaaatctcgtcttatcataagcatcatgattcagcccgacaggaacctaggctaacatctgtttcactttgctttagttttgatcagagggtttgcatacaaacgtaaaatgccttgtttatgataatctttcagaagtttgtttagctgtaaatatccactctatattagactcaagttctccggtgatttgtagattaagagaatgcaaaacagaatctatggggtgggctatgcccggtgtcttctgcttcattc

SEQ ID NO: 20835 - DNA, 600 bp, Bovine  MMBT05356
ctggaacatgatatcaaatttcattcatgtttagtttccttatctgttaagtggagagaataatacttcaaaggggagtattaatattaagcaaaatatgtaaagtactggcttattggtatgtggatgaataaagtcctgaatgaagaataagaaacaaataaattgaagagttgagatgggttggaggtttaccagggtgactggtaactttatctctggagccttacagggtgactgataacttttattagtggggaggaagggcatcaacacagatagaacacacagaaccagagkcagggtctcagaacgggaatatggattgttatgggaatggcaagtaattgtggctctgtatacaaagtatttgcaaaggccaaatgtaaatgataattgtgtagaaatgtggctgggcaattttagtagttagaaattatatagtttataagaatatctcaagagtgtgaattgttacttttttatttaatatttactttttaatacttactaaaactgatttccaaatgtgttcaggcaagcaactatttcattatttcattatgatatttcatcctaaccagtaaaagaagactaagg

SEQ ID NO: 20836 - DNA, 598 bp, Bovine  MMBT17072
  misc_feature (1)..(114): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttgtttgacgttactggagccaagttccaatagttcaaaggagacactgaaggaatacctgccacacactgcttgagcaatccagatgggcacactctgtcctttctcaagatcaagttcaaaacaagtccagagcaactcttaccgctccaaaaggctgggaggtgcagtttgtacaaggrgtttgaaaatgtagtccattgcctttattcaattgttgagagasatccagtttygtgctctttcctctctctgccttctgaccatcgcatcagtttcttccagcttgcttaccaaggaaacmttttattcctggtaatgaaacaaaatgaaaacaaaaatgaaaaccttccctccttccagtacctaggaatatttaagaattattctaggaataagaatttatatgcatttcattgttgacttaaaaataactaacttctaatagaaagtgaaaagtgaaagtgaagtcgctcagtt

SEQ ID NO: 20837 - DNA, 598 bp, Bovine  MMBT09564
  misc_feature (1)..(1): n is any nucleotide
ncccagtgtgctgtccccagtccctgccagctgactatctgctgtcttctcgtggttcaaaaatagaagtcatattaaaaaataaattgaatagttttctctccttctaagcagggagagttcttactcttcatccttttgaacctttaagatttttaatatgttgcctattcaaaaaagcaaattaagaagttaaatagaaaggaaagaaggaagggagggaaggagagaggaaggaaagaaatgccagttagaaaagccattgctggagatggagcagagagaccagagtttagattmtgcgattccataaggaagggctggattgcgcgtgaggtgagggacagcggagccaggtgagtggccagrgcttcctcaaggcctctaaggttgtgtctgaggtagtccagggctagaagccctgctcttcctgttctcctctgaaatgcagactcagtctgtactggttcagtgttctctctggttctaatgtgtatttctgaaacatgacattaaactgtaataagtaaatttaaacctcctgagcacattccgtgagcattcattagtttgtagtttatatactgacaacatatat

SEQ ID NO: 20838 - DNA, 600 bp, Bovine  MMBT04666
gttatcatgtttgcagttattactgctactatcatattactgtgcgccttgtctgttactgtagccttctgattggtcttccagcatctggtcttgcctcttctccctgcttctctgacgatctaactgctgtttgtacccagaccctcaccatgatgacttgtacctcaatgccagcagcttcctggccctgatcaatggggaaagagaccatcccaatgccactggtaatgaccccaggctcctaccttggtcccattttctgcttctctgaccttgtatattcccctttccaacctrgcctgacccctgtgactaactcaggctctcttattcccaccctgtagcttggcggaagaactttctgcgtttgggccgcctggtgctgattgggggccctgatgatggtgtcattactccctggcagtccaggtaataagggactgtgtggcctgaaggttggctaaggacaccccaatcccagccaatcttkatctcatttctaaaactggcctgcttcttccactgttcagttaatcccccccaccctccattcatcgtcacccaagacgaaaacctgggagtcatgtcccaacctct

SEQ ID NO: 20839 - DNA, 600 bp, Bovine  MMBT08364
gagtttgagtgacttacaaagtacacatagccaataaacatgggctgagacttaaacttagagatgaaactcactgatggatccaactaatatgcaattatatttgtgttatctacagacaagtttataatttgcatgtaagctgttactttcttggtggaaaaataggaaactttcaaatgtggaaaaataggaaactttcaaactctgtcccaatagttaaatacctagagggttcttgcagctctagtgactatcttaaaaaggactgtcaatttctttgggaattctgcatactgyattcctcacttaaagatgcataattcacatttatatactgaaggctctgagaaatctcattgggaagaagtcttttaaacttcaactgggacttgactaactcatttactaagtgtatatattaagtgtatatattaaggtaaaatccactttatgaagtcttcgtttactactagccagttcagtttctgctggagatgtaaaatgatggtctaaaacttgaatgcatttttgaaacaataatttaatgagtttcttaaaccacaagatcatatacccacaaagatgcttggggatttg

SEQ ID NO: 20840 - DNA, 600 bp, Bovine  MMBT11343
ccatgcattgatttaataggatttagtggtacaccatttatcttttgctcttaaataatccccaaataccttctggaactgaaaaagataattacaggcactgactagcataccaatgtcttattaatttctttaaaccaacatcactaatacagtcttctgaattagtgaatttgcagacatgtgcaagagatgtattagaatactaagacaatttatttttaagaaagtactgatttatttattaacagtttaataaagttattatattttcaatcaccaagggccaagtacatcatwtttacattctggcacataaaagggagcacaactttgcagagaaatttacaatactattttagctcttgggctttggtgtgggctgcagaaagtaatttaattgaaagttagcatttttttctttatgtgaaatatttgttgaactgtcaaaataagattgtaaaacatgttttaatacaagatgacttccagtagcgctaaatgattttagaaaactttgattcaaatatctacttaaacaaagctatgaaattttcactttgcctaagttcacaactttaaattttctttcgagaaaac

SEQ ID NO: 20841 - DNA, 600 bp, Bovine  MMBT01870
gggccagggctcaggggtgagtgccatgtggggggtggggtgcatttctgtggacctgggtggaatgggggaacttctttttccttggggccccatgggtatgggttagagaagcccatggcaagcccagtacctgcccttgccatgctgatgaatggggccctagagggaacccttgggagctgaaactctggagcgccctcccaggtgggcatcctgtgttcacagagcaagaggtcacctgtacagtctcctaggaacaaaaccaagaggcctctgtccccaaacagctcttgacaycaagaatgctttacagtctgctctaatatgagttagagaagggaaaagaagttctatccatcactcctgacagcagggaaagagctgagctccagtatgacttgcacagaagtgatctgggcttttgaaagggagaatgagagaggagggaaagcaggggctctgctgggccagagaatgaaaaagtacaaaaggctggtgagtgtcagtacaattaagctatcagtgtctgcagccagctttctcctcccacagagagtgggggacagaggctctgtcctttctgaggattacatttta

SEQ ID NO: 20842 - DNA, 600 bp, Bovine  MMBT11168
cgaacagctcagctggccaaaggcccaggcaaaacaccactgtccgccaaggacatgcctgggcctcccaaggccctggtcggccccttctggcggctgagtgctgaggtttgtgtgtaccttttatggttcctctctgtttcccaacactttcttgcaaaaacctccactcttgatctgccattaactttagcttcttcctctagcccccagacactttatcttttttatttagtgaaagtgtgttagttgctcagttgtgtccgactctgagatcccatgaactgtagcccaccaggytcatctgtctatggtatttcccaggcaagaatactagagtgggctgccatttccttctccatttttaaagtgagtgttaatatactaaaagagttaaaaacaaatgagctcagaaaaggaatgtacaggggaaggaagttcctgtcctgctcccatcggaggaggatgacctccaacttaacccaagggtataaggagccccgtcctgggccccagaccccctgccaggctgcctagctgtcaccctgctggggccccaggtgggagccaggaagccccccagctcctaagccccctccc

SEQ ID NO: 20843 - DNA, 600 bp, Bovine  MMBT10473
gccacctgatgcaaagagacaactcactggaaaagaccctgatgctgggaaagatagaaggcaggagaagaagggatgacaatggacgagatggttggatggcatcactgactcgatggacatgagtttgagcaaactccgggagagggtgaaggacagggaagcctggcatgctgcagtccacagggctgcaaagagtcggacatgactgagcaactgaacaagtctttggctgcagtgagggagccagtatccatatctggacccagtacatttcagactatccatatcccttagtayctttaaagtttctaatactaaaatagcatgaaaatactcctaaggttgaagatccttacaaagatgctcattttccattaagatataatgctgtccttcaatgataaggataataaaatctcagagcagtggtgtaaggagagaatgggacaaattgttgagagtaccactaaaacatatacactgccatatgtgaaacagataatcagtgggaattttctgtatgatgcagggcacacaaacccggggctctgtgataactgagaygggcaggatggggtgggaggtgggaaagaaagt

SEQ ID NO: 20844 - DNA, 512 bp, Bovine  MMBT22642
tgtgatattcccaggtcctaacacagagtaggaacttgaccaaatgtacaactcacaatactgtccctgcttgagcagctcagtcaaacgcacaccacgactcaagagttgttgagtggcagcatcaaggtcagaaccgaactgggcaaaagcagcaacctcacgatactgagccaactccagtttcatagtacctgccacctgaaacagaaatggttaactcaaacaatacaaaaatacttcaatgacacagaccaccayacaaatacatttttatttttaacctaakgacaaagtgayacaaattacctgtttcatggccctggtttgggcagcagatccgacacgggacacagacaaaccaacattaatggcagggcggatacctttgtagaacaattctgtttccaagaagatctacaatgtaaggaaaatacagaggcatattagcaagcttaaagaaatcaattattttcacaattaagtcactatagcaaaaactgaagccccaa

SEQ ID NO: 20845 - DNA, 600 bp, Bovine  MMBT01774
aattggggatatttggcttagagaaaagtgagctaagagtgactttttattgttgtaaggaatatggaaggttttcagtcagttatgtcttgtactcatagaaacagaaatgaccttcagtcaaagcttttgtaatgaacacaagggaagagtctgttggccagttacagaagaaggccaaggactgtctagtcctagagatgttcaataagaaatttagaaaatacctggaagtcatggatggttgacaaatagagctcagtagcatctttgaatctgagctgccaacagaaacacacratgcctatccatgagtaccatgggaagccatgagtcagataagaaggaagaaatataaagactatagaagaaaaacagaggaagaagaagaaataaatatgaatgtacatctgaggaagtggtcaagttagcattcacctatcagatacttctgaaggtcactcgtgacctctgttattttgtacaatatagagtgtaatagagttgtcatcatcaaatgccatgcttgtttagaagtgacccaagttgagcatgacaaacagaatagccaagagtttcaggcactcactctgaatgcag

SEQ ID NO: 20846 - DNA, 443 bp, Bovine  MMBT07050
tcaactagggtgaggactgtcagataacctctggtataagtcatggccttggtgagggcatttcttatggaacgatgacagcgggaaccaaatgcaatrggttgaggaacgcataccagctaaaaagaaatcactgagcatatatcactttttaacaagttctctagcttagaggacagaaaacaaattcacttctggatgaggaggctcgatttaaaccgctctaaacccctagcccctaccttctacctcccacccacacccacaccttgctcttttgtagggaactaacatttgcakcactcctattaagagacaggccctgagttcctcatattcattatctcactttattttcacactagccttgttaggattatttcaaggttcaaagagattgagtcacacaaccaagaaagtggaagaaaccaaatctgaactca

SEQ ID NO: 20847 - DNA, 598 bp, Bovine  MMBT11596
  misc_feature (1)..(15): n is any nucleotide
nnnnnnnnnnnnnnngtcacgcgtgggcagtgggggcaccctctgactcttagattgtgcccctagaatgacgtgggtggcgaaaagttgctgcagaagaagtggaccaccttcctaaaggcccagctgctttgcacccagccggaacaacttcccttcaacgttatccgtcacgctgtcctgctggcagacaattcctccaccgatccccaggtctacgcagtctttacctctcagtggtgagcaactaggcgagagcgtgggggttggaagtgggatttggggtcagctccctggccsgccagggagggtaggaactgatgtgagcgaagyacaaactccacacttcacatatgaagacatttgatcatcaccatctcccaggartttgactcacgcccttaatgtagggctcaatgtagatagggaaaataaagctcagaaaggttcttattagtttatgtcctgcctggttccaaaaaggataggaggcagcttacaaaaggcaaacgttaaaataaaataaacctatgaggaaatggaaataaaaggagaatgagagaacccagggatggagtcygcacattacagatgatta

SEQ ID NO: 20848 - DNA, 600 bp, Bovine  MMBT18648
ttgctgcagaagaagtggaccaccttcctaaaggcccagctgctttgcacccagccggaacaacttcccttcaacgttatccgtcacgctgtcctgctggcagacaattcctccaccgatccccaggtctacgcagtctttacctctcagtggtgagcaactaggcgagagcgtgggggttggaagtgggatttggggtcagctccctggccsgccagggagggtaggaactgatgtgagcgaagyacaaactccacacttcacatatgaagacatttgatcatcaccatctcccaggartttgactcacgcccttaatgtagggctcaatgtagatagggaaaataaagctcagaaaggttcttattagtttatgtcctgcctggttccaaaaaggataggaggcagcttacaaaaggcaaacgttaaaataaaataaacctatgaggaaatggaaataaaaggagaatgagagaacccagggatggagtcygcacattacagatgattatcacttatacagttggggatgctgggacacctgtagctgtgaacttcctagtggtcatagcatagagcgaaacaccatcaacaacataa

SEQ ID NO: 20849 - DNA, 521 bp, Bovine  MMBT11494
actgcccayccaccctctctctatgggccctccttactccattcttacacttagtcaacagtgaataaaaatttattgagtacctgctttgtgctgaaaatgatgctagacacttggggatacagcaatgaacaatagaggcatggacttgattttgcaaaattaccatctgcagacactcatatatccacacacagcaattctgcaagataattcccccaaatatcatgttcatcataactgccaattagggaacactcagcctaggccaggaaatacacatacttcattttgttttaycctcaaaacagtcagcaaggtaggcattattatccccattttccagacaaaaaaactaaggacccagagttccaattcttcgtccagagtcacataaccaataagtggcagagcttggggttcacccttggctccacgttttcaacctgtcctccccatcaccatacatgccttcagctgcttccccatggataaaagctcccagcatcgtgtctccagcc

SEQ ID NO: 20850 - DNA, 600 bp, Bovine  MMBT12186
gctgtcataaagactgagtgagtaaacagtgcctgcagcgcagtgcatgccgtgggtcctcagtcgtgtccaactctttgagatgccatggactgccctccaggctcctctgtccatagaattttccaggcaagaatattggagtgggctgccatttcctactccagaggatcttctcaacccagggatcaaacctgagtctcttgcgtctcctggatcgacaagcagatgctttaccctgtaccacctgggaagccacatatagttggcacagtataaatgttcacgctcatcttcatygtcattcttctggatggactccttggtgcagatggatggctggatgaacaaatgggttaatgtgaaggatcaaaatagttcatattgtgtcagttattagtagatacatagtgatgagggtattctagagatataaaagtagcaattcagaagggacaaatcacacagcctgctcccctctctgctgttcctccctgctcttgagccccccacaaaacccttcttttcagagcttttgctgttgacttccggaaccagaatgtctagttaatgatgattttgcagctcttaatgcaaatt

SEQ ID NO: 20851 - DNA, 600 bp, Bovine  MMBT08701
ctgaatgtagcgggataatcagggtagagaatttattgtgggggtgattaaaaagttgcatcagaaacataatgatccaccctttaattactttgctttgtagtaagcttagatcaatatcaactgtttgttttattcaagctgctttattttgcctccttaaagaaagcattacgtgactatgcaagtacaagaattaagagaaacttaaacatttggcaggaatggtagaaagtgtgatgaaagtgacatacatttggtctttgcaaagaaaagcttgtgccattgcaaaaatttaayaggtcatccagagtaagagtcataatgagatcatcatccttagctcagttttcattgaagtcctgtaaaatcatgatgaacatatgaaaatggaaacacttgagatcatgtatgaattggtgtttttaattgaattttggagtgtcagttgaatgcagttatccagtagagtagcttaattagttgccacttctcatctttctctggcttctcattgtgaaattgatactagctttttaaaaacaaaggatgctccagaagcaaacctgagttctcatcccatgccaaattggaaagaac

SEQ ID NO: 20852 - DNA, 598 bp, Bovine  MMBT05550
  misc_feature (1)..(66): n is any nucleotide
nnnnnnnnnnnnnnnnnnnnnnnnnnnnnnnnnnnnnnnnnnnnnnnnnnnnnnnnnnnnnnnnnnatacaactgagcttgcaatccaacctgacatgctttatttgggaatggacatctttaatctgctcctggcatcagtgcaaggcaaactatagagagaaacaagctcccagccggcttctcagatgaacagggaaattcgatcttgacaagaaaagaaaagttggaagaataaacaggcccaacaggattcctgactgttcaggagacagcctctgtactgagcacagtggaggraattacattttttggtgaacttgcccatttttttacatcacattcctcatccacagggagtatttaaaccctgccacattaagcttttataatctgggccatttgtgacttgcagatacatagtataaattaaatccccttgtttattttcttcaataaatcacagaaaggaagcctttgtatattttccattttaaattactttatccaagtctatctgaagattttattcaattatcatttgactgaatactattctgaaatacatataactgggatgatgtctcagaaagaatga

SEQ ID NO: 20853 - DNA, 600 bp, Bovine  MMBT09889
aaagccactttgaggagcaccatgcagtcaggcccatgacaccccccagattccagggcagtgatgacacaacctgctagtcagatatccacgtgagaatttgttttctccgcccacagacgctacaagtgcaacagctgcctggagggacttgagcgtctttggtgttcagaggagccacggcttctaagatccccgccagcccgctgctcaaagatgccacgactaatcatcgccatgcccttagtattcactggcccctcgtgggggctgcatgaggacctgctggtccatgcgccrtatgtaaaacacttggaaggaacaaataatccccacgcaaacagcaaaaggagaggcaattttcatcagccgagacaccataaatcttcatatgttttatgaatctcacttacatttcttgtccgacttgtgcataaaacttctccagatttatacagccaactgcataagtcattcccttccccaacgggctctatatcttgatgaccttttagaaaccaatgactgcttttctgttgttatccataattggaaaagcactggagataagaaaatttatggcaatgaatgatctacctg

SEQ ID NO: 20854 - DNA, 600 bp, Bovine  MMBT09896
acccatgtctcctgcatcccctgcgttggcagatggattctttgctactgagtcacctgggagcccagccccctccacagccccaccctaactgtggctgtacagttgaggaaatgcaactacctgtcgcccaaaggtccttcagctatggaagccagcatcaccctcagcctcttccttggttcatgctttgctctgcacctgccatctgcctgctttgcattcctgatgaaccaggagttatttaaggataggacttgtgccatggtgctcccagagctgtatggttaccaagcttckgatttccctagactttgtggttgcccctggcatcctgaaaaccccccagtaggtgagggagataagaaggaagcatacaagtggcccttttggttgaaaaagtttcggccagcccccttacccctccaactgtccacctcctgcccattggccagccagctcttcgtcctggaaggcagaacatgctggggccaggtggaggggcagcaggatcctgagctgagcggatgcttatttttaggagcttgcgggcactgctgcccatgctgggcctccgcrgcattctctgcagatccatcc

SEQ ID NO: 20855 - DNA, 600 bp, Bovine  MMBT13129
ttaaagaataaatgaagggacccttgaataaaatgagcttcgattctgacatccattagcaagctgttaccagttttcatctgtctagtttaaatgtaggccatccatttggagagagggaatggaaaaacatggtacaaaggcctgatctgttcaatgctttkgaatcaataattaaattgtaatcacttataaaacatttgcacaacatgatggagaatactggattctgactttggctttgtccccatattgttatgtgagattaacttttttacctaacaagattgagcttggttycacctacattaatatattcaaactttatgggacaaagatcatattttctttaaatctgatacagtctagtatgattctgatatgattatatatgtgattgggccatgacaatatgtgtacatcccagggagccttttaatttggtatctttggtagacagtttaaagaaataaaatattgtctctttgattaatttctagggaaagttgttggaaaaaattcaccctctgtgcctcaggcaacatacctctggctccatatttctattgcactctatattcaaaaggtctgtcattaagt

SEQ ID NO: 20856 - DNA, 600 bp, Bovine  MMBT08804
tagttacttcagagactacttacttaccttcatgatatccacccttggagaaaagagatcaataaggcactcctgtctgtgatcctcagagttgaatttctgccattttccccaaaggacacacatatctggaactcatttcctcttcgttacaacaaagctaaggtccttggccttcggggaactactcaatattaatttgtttagttaagcttttacctaactgatgaggtggaaagagtaattgaattggtagcaaattctaatacatattcatattgctgtacttctgaacatagycatacatttccaccacagcttcattttattatttagattttacaatgatgactactcagtatttccttaaaatctaccgtgaatgtatttctcatttctgaaattctatttttcaaacatcctgggcagattttacaaggcacagctaggttattaaggtttctgctgtgttatgcatttaaatccatcatggggtattttatacatttacattagtaaagaaagaatctgatgggacataattttgctataaaataatagccatgctgtcctgaaaacctagtgttactatggttcttc

SEQ ID NO: 20857 - DNA, 600 bp, Bovine  MMBT20938
atatttcatgtaatttattgaatgctctactggaagtaaaaaacagaacagctgtaactatatcgattgtgcatcatggtgatcatgtggctgcctgggagccgcatctctgcctcttcccagcatcagaagagagcatcacaggtgtatcattatcccagaaatggtcaaaattctaaatgtgatgtatagtttctattgaatgtgatctctttcacaccatcattaaactgacgaatcattaggtcaaaccattgttagctggggaaagtggggtaggttcgaagaacctctacaggygtcttaccttgagatgtgttgtgagtgtgatcccaaggtggagcctgatcctcaaattcagcagagaggttacttctagagctccaggtccactcaaaatcatcaccacgggctgcttcaaaccaaccacagctatctgtttcaaagtcacattcggtaactgaaaaagaaaaatgcagcttttcggtagactcttgaaggtgatcacgtgtttaaaagggtagacagagctcaatgggaatcaccttgccacatttgcctaagtaaagttttatttgaggaagaaaaggatgatatctg

SEQ ID NO: 20858 - DNA, 600 bp, Bovine  MMBT03276
tgtaaatgacaaatattagaactttttgttacttctgttatgatccttccgttggacaccaatagaactgttttcccttgtataagccccagctctgatattgtataacactgaccgagactaggatactggattcatttgcaggtcaaaaggagggtagttatatttcaaaataaaaaaacttgtatttagcattatattctactaatactaagaattaagtgctatagtattataagtattaagactaagtgttatagtctactgcagaaaaagaatgcctattgagaatacaatgakataatatagtaagcactaatgtaaatatgcaccaggttctatagtagtgcaaagagaaacagcatccactgtgcttaacctgaaacatcaggaaaatttgctagaggacttgagtagcaaataaatatgaatctgtaaaatagaatgggaatagtaattcaagcagaagcactagcatgaagacaggatgagctgcgtgaaacagcatggtatattcaatgaaccggaagcatttcagtatcagtaaaggaaggtgggaaccacaggaaaaacagcagactggacatggaaaacctacta

SEQ ID NO: 20859 - DNA, 598 bp, Bovine  MMBT19500
  misc_feature (1)..(120): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcctgtgcggaacattggttcccttgggtgcacaggaatatagaaaagagaagaaacacatcgtgatgttagtattgggagctttcagaccatccaaggctgatcaatagagacactatattggatacaaagttgttccctccctgccaagcttttgcttgtggtgtttttagtccrtgtatcgtgttcacctattattaattctcaaagattcttttttaattatggaggatcaagcctttcaaaaaataattaattacaaaacctacttaatattcagaggtgtcaygcaagcctataactggcattctctgttggtggtttaattagacaaggaaatgcaaaaagctgtcacttgagggtgggtggctgcaggggaggggagccccagcactaccagttggccatctgtaccagacacaaaagcacgactcttcagctggcctccctcacaggaagctccccatttttacca

SEQ ID NO: 20860 - DNA, 598 bp, Bovine  MMBT19501
  misc_feature (1)..(8): n is any nucleotide
nnnnnnnnttatcctgtgcggaacattggttcccttgggtgcacaggaatatagaaaagagaagaaacacatcgtgatgttagtattgggagctttcagaccatccaaggctgatcaatagagacactatattggatacaaagttgttccctccctgccaagcttttgcttgtggtgtttttagtccrtgtatcgtgttcacctattattaattctcaaagattcttttttaattatggaggatcaagcctttcaaaaaataattaattacaaaacctacttaatattcagaggtgtcaygcaagcctataactggcattctctgttggtggtttaattagacaaggaaatgcaaaaagctgtcacttgagggtgggtggctgcaggggaggggagccccagcactaccagttggccatctgtaccagacacaaaagcacgactcttcagctggcctccctcacaggaagctccccatttttaccagctcatccactgacaattcctttctgcagcgygtagctggaaggcagaagatactcgggtgctatcatttcaaatgcaataattcatggatgtggaaaaacaattaaaaaca

SEQ ID NO: 20861 - DNA, 598 bp, Bovine  MMBT17384
  misc_feature (1)..(70): n is any nucleotide
nnnnnnnnnnnnnnnnnnnnnnnnnnnnnnnnnnnnnnnnnnnnnnnnnnnnnnnnnnnnnnnnnnnnnnactttaatgcctctgactcattcctcaaagacatgcgttttttattgttttggttttttttttcattattgaaaaattgcaggccacgcaaagctagagacttcttggtccagggaatgtgtcagcttgctttcatttagcacaaaaggaaggcttttaagagagatttagagaagccagaggccttcttgggaatggtcccaaagatgatgaagaggctggaaagatgragctcagataaaaaaaaaaacaggagagtttttggtgacttcactggggacaatgggaaaagttactttccctccagaaaactgagaattaaaacacaaattgtgttcctctgcccagagatttcattaaggctgcctggwttgtttggggatacagggacctggggcatgcaggcaggatgtaaagctgaatcttgcaggtctttatttttaaacttttatttgtttatttattttttggccatgccatgccacatgcaggaacttagttgcctggccagggattgaacccgtgtct

SEQ ID NO: 20862 - DNA, 600 bp, Bovine  MMBT03075
tctacttaattttgtaaaaatagacaaaccaaaatctacacacaactcgtcagcattgactgagattaatggcacttttttgccaaaacagggaaaactctaagtaaaatacaaatgtatgtgaagtgtcatcaccaacagattacaaacaatatttctgtagcagatgagcccataggccacctgcaagctcattaacgtctcagtttgagaaccactaatggaaaacactttcttttagacactcatttctttatttaaagactctctttccctatccaggtgtaataatcttcctcrttgtcatggtttctaacagtaagtgttaaagaaacagccatgattcaactccagcatgagccaagttagcttcaagagtttaaaaacaaaacaaaacaaaccccctcaagctgtcccgtaactgcagatacttctcctgaccttctgctaaataaccattataacaggtgagaggacaggaatggagtcgcatcagtctgtcttaattcctagaaagatgactaaagtagagccctcaccatcagctaaatacacttacttattatttttgcagtttaaactttttattttatattgggg

SEQ ID NO: 20863 - DNA, 598 bp, Bovine  MMBT02585
  misc_feature (1)..(63): n is any nucleotide
nnnnnnnnnnnnnnnnnnnnnnnnnnnnnnnnnnnnnnnnnnnnnnnnnnnnnnnnnnnnnnncgccttatgaaagagggctctctttctccttcctccatctgaggacagtgggttgtcagcagaaggccaccatgctgactgcacccagaccttcctaaactgtgagaaatgagtttctgttcttcagaagccactcagcctgtggtgttaagttatagtagcctgaatagactcaaacacgtgaatccctctagatttgcaaaaggctttttttctttcatgcattagtctaccggycactctccacgtcaggcaatgcacccatgaacatgtgagagaagtcaggctcatcaagtccaggtgacatcatgcccaaggtcacactgctggaaagagcaggggcagagctgagaggagagctgaggttttctagctccgtggtgagcactagctcttctgcccagtgctgcccattgaaaacctgattccccctcctctgctcttaccatggttgcagccgaggccaagagtgaccctctgatgatgtgaggctggcagctgccttgcccaggccaggatgctctgggaacagctg

SEQ ID NO: 20864 - DNA, 600 bp, Bovine  MMBT02796
tcatacctaaactttaaagagcattatgcggactctacatgtgtgtgggtaggtggggaaggagggaggaggagggagagaaagtggtgagagagaaactatattttcttctttattttcagttcaacaaagtattcatgttacagctcaaattacaggtttcagcatttggaaaggctcaggaatgttttccttagccattcttgaaacatcctctgagaaactgcctgctttctaaggctcagttattgaccattctcagaaatgggtttctatatttaataacctaacacattcctmtaatattaaatttttcacatggaaattggtagccctacttgaattcgtctaggctcaatgagcccattgtttgcaatgattatcactctcagcagattcggaaatgcttgcacaattcatgtccaaagaattcttcaaaatatttttttatgatctttacttttggctttgtaaaagaacttgggtttgacaaatgtgttccaaattcccccaatttgtcatctgtaggaaagattatttgaagctaagtaggaacaagactgattaacaaactgggatctgataacaacttttagagtg

SEQ ID NO: 20865 - DNA, 600 bp, Bovine  MMBT12538
acctccacaagtcctattctttcactttcctcatatttattctataatcatattttattatcatcactaagattatttctagttgaaacagcagatttatccaattcacattttagaaagtatcaattctatatgtagcaatatatttaggcagtttttgagtcaaataataacatattgagaaaatataacaagattaatgttaaaaacaaaatagaaacaagtgcctttctaatgcaccagcataacatttcttcttctctggttgttttgtgatttgtactaaaattttgagtaaamttgtatgttgttatccttaaaataatggaatattttattatttaataataataatgcttaaagaaaaatatttcaaggaaacatgaaaaggtcaaaataaagattcaattaactacaaaattaatcagtatctgtcctgtaattatagtattataaagatatttacccaacaataccaagaataactttttatgagtaaaaagttttttttaagtaactgctatatttcaaggaaaaaatgcccttttaaaccaataatataggatgaataaataaatacttagaagacaaaggctggtc

SEQ ID NO: 20866 - DNA, 600 bp, Bovine  MMBT12302
gaaaatttaaatttcagatttaattttctcaagcaagaaaggacacactagaagaagaggggaaaagagacactaggaaaagaaaagggatattatattgtgtgcaagttctaccccataaatcttaagatacctgagagacttgaaatattctcactctttaataaacacatatagaaacatattttgctgttctcaaactgtactttctcactattactgcctttgggaataaggggctcaaagtagaaagaatttcaggtttagttttcagggttaagtttccataagtacttacakacataaaacaggtcaaagaagaagggcatggcatggtagcacattctgaaaataaacgacccccataatgaataaatattttcaataataaatttggtcatatatttaattggtgaacactttcctttaaagtagtggaggctactctaaccataggtaatttctaagaggtctaataaacaacaataaacatgagtatttatattcaatgcttgagaattttcaaagcaatctcacagatgctaatagtaaccttattattacaggttctcacattgtttccacatagctgatagaaac

SEQ ID NO: 20867 - DNA, 600 bp, Bovine  MMBT10124
agatgttatgcaaaatacactttcaaagagtttctgaagaacatgtgaaaaacaaagtattactcaaatccaaagaatcctatttaataaaggcwctgctactagcrgctatgatagccaaaagacagaagagaaatgatagaatgattaagattagaaacacaatgcaccaaatatttgtttaaataaaccccaaaagttggttgcaattactttatcaacaagctatgaatgcatctggagcaaagtatctaaatcattttgataatcagattcctgaacagtcacagtcccacagtygtaagtgcaaggacagtatgttatatattttcagtgatagtaaagggrgaatgtcacaaactagacttaataaggaggtaaagagaagcagttccaatggaatgaatgaggtgatcagtgcacataaacatcagattattgatcatggaaatagtattttaagtattgaacacctgattctgtattcatttataactatttacttgcaataatttagcattattgatttttaaagaaatgtaagccaatgtattctcaaatgataagaatagggtccatcttcacttatttttataatag

SEQ ID NO: 20868 - DNA, 600 bp, Bovine  MMBT04447
acaatgcaatggacgaaaagaggtctttgggaaccaaagtttgagttgtcagaagattccactttttttagtatcacttacaaaaaaagacttatgtataaatataaaagttagttttgcatcataagacctggtaattgctagtgttaactgttttactggttatagaaactctccatatctttatctataaacttaagatagatacttacatttcctacatcaataaacaagttgctaactagaatgtcagtgagtattcagaaggtatttgctctgtgcctgagacatctgaagcartaagyacatcgtttttattttcaaggaaacaagtcaacttgtcttaaatatacaaaacttttgtcctaatcaaatttttgcttaatttttttgaggtttcagaaggcaggctgtgagtgaacagcagtgagatgtccttgaggaaaaaagatggaaataagaagggctaggtggtgaaagaggccagcagagaagacatagacttaagtggaagcagaaatttctgaatgagaatacatctgtcctctcccattcaagactcaacttcacatgtctgatttatgttttccaggtaacagt

SEQ ID NO: 20869 - DNA, 598 bp, Bovine  MMBT07863
  misc_feature (1)..(67): n is any nucleotide
nnnnnnnnnnnnnnnnnnnnnnnnnnnnnnnnnnnnnnnnnnnnnnnnnnnnnnnnnnnnnnnnnnntaatcactagctagattcagtaattattaacattttactatttgcctcacaaatgttaagtcctaagttaaacttcagcataaaattcaaagtgtatttaagaggactcaccttttctaccttgtcataatttttagctttaatctgcagagaaacagaagaaaaaaaaatagaattaacactattctttttagagtattaaaacactatctctgagtgttttgattaagctkgtaaattcacttctatactttcctattaattctgcctttcaaaaataacaaataatagaagtctgaatccaacatggataacatgcattgtaaatatgccttacataaattaattttacatgtaaaaatgttatacattcaatatgttgaaattttgtgaactaaaaattttgtaaaacagtcacaagatgaataaagaaatacaaacaaggcatatttgaatagagctttgaatagatctactaaagacaaaacttgtactttccctgaaggactacgactaaaacaaccctgagta

SEQ ID NO: 20870 - DNA, 600 bp, Bovine  MMBT20376
taatttacttctttgtcttggttagtgctgagatctctagactgggatctctaatcccctggactgggattagattccctaatcattcaaaggaaaattcagagattatctctacttcactgtggatacgagcatctgaaggacgtgtgtgcatgctgagttgtttcagtcgtgtctgactttttgagaccccagggactgcagcccaccaggtttctctgtccttgggattctccagggattgaacccacgtctcttacatctccagcaccggcaggcaggttctttactgctcgcacygcctgagaagtcccatgctctcccctaattcttgaatacgaagcaacagctcttacaaatccttcattaaataaccatttagctatcaaggtcatgaaacagaatgaaatgaaggacttagtcatttaaagctaggctttatttgtttatttttaaaagcaacattcattgtcactgttataactgcttctgctgacggaaagggaaatatcactacctagtttctttctgcccgagtgttagagtgaagcgacaaggtaggtgattaaatagttaatcccactgggggactgtaagtag

SEQ ID NO: 20871 - DNA, 600 bp, Bovine  MMBT12041
aaaaagcttaaaagaagtagaatttctcaaaatcccatgctggggatgaccatccatctagctacaacaaatatatccttttcttcagtctaccaaacacctaatgattagccgcaacactaaatacaaacaaaattcatttggctaacacctagctatctatttaaaatctttagagaacagaaaggtgattaattaatgtaaattagttatgtaatagctagagtaaacataatgtgcatgttcataaaacacactgcacttgctttacacatctgcaaataattttcttaacttacraaaaggaaaatataagacaratacagtaaatttcagattttgcctcattctccagcatatagcctctgattctgaatgatatataaacaaattctagtcttaaaaaccaaataagcaagcatacatcgaatcactttactgaacaaatatgtagagaagtatgttgaaaattcagcaaacaaaaagcactttcccccacagttttcctacttaatcacaagtgaagtctgatgtctaagtagtgaataacggtttgtaacttttgaccttctgttggtcaagttcttaccagtgctatgg

SEQ ID NO: 20872 - DNA, 600 bp, Bovine  MMBT18846
tttactgaaactttccaggcttttctcagcatgaacactttacacttctgcagtaaactagactgctagagtaaggcaaaggagttgtcagtgccacgctgctgcatgctgccaaggagttcagggtgggaggtggtgggagaggatggggtttctcatcycttccaacccaagcagaaattaggtctctcacctgagcatgccaccgttcccccccaggccagcagtattcctgctcactggtctaccttcgggtgccctaaaagatcatcctggatttctgctttgtcattttagttsatgtctctgcttctgtcccagtcattcactatgaggaccccacctctgagaccacccccctgccatgtccaacccccacaatttacaaaaggggaaataggaccaaggagaaaaggatcacagctcaaggtcacagcctgcaggtctggtgggaacacacgttaggaatcctgactcgtaacagggggctttgtcccatccactgatctcagccagaaagaaatggtcttgccactgctgagggcttatgccgagggccctttcctgggtcctggatgatgtgactggctaacacataaa

SEQ ID NO: 20873 - DNA, 600 bp, Bovine  MMBT06811
ttctaagaggaatggtggggggctaagtttaatatacagtgagttgggatagaggtttttcttgaaataattctgrcatcttttgaccatagcctttatttgcagagttgctgcagccattgagaaatttggtttaaaactcaggaacagttttcaaaatgtattttttaatttgtaagaaatttatagaaattttaatctttatgcatattcatttttgtatgcatgctgtatttaataatggcactagtgtgtatttctcttaagtgtttttgttttaattttgtgcaatctcttttrtccaaagaatgaattagtctcatgcatctcaagatagctcaacacatgataaattgctgttgtcctaagatttgaaatacagtttgctgttaggagcattaatatagaatcgtgtggatttcttctttagtaatctgtggctattctagttttttttttaaactaatgatgcaacaaaaatagataatgtagagaatcaaaattgttattacctataaccagctatttctgtttctgtgatatatacccaagagatgcttgtatatattatgtgacacagttggaagtcttgtggtatga

SEQ ID NO: 20874 - DNA, 600 bp, Bovine  MMBT20056
ttgtcgatctgactgtccaagcagtatttgaaaccatgcaaaaccagtggaatttaatacatgtttcttttctgataacaaccagacttgtacaaattagggcagcawgaactaatgctccctgaatcagttgaccattgatgatcaaaatattattaactgtcagggacttatctctaacaatggtcttttagtctccaaggcagttatcatactgaaaatcacccagacaggtgagaaatggctgaccacacctataagcaaggccaaatttaccccttgggtactttaaataattgrcttactcactgcccaaaatggattctctgactggccatggaatttcaaggttaaagattttaggggatcagggaatgagtcagaatatgcaactcattgcccataggaaatgatcagatgatgtaattataacctacttggggatgttccatggtagagactgcagccaatggtgagtgttatctaaggactaagtcctctatttcttgggcacagaagcttgaccaggagcaggatataaagacacagtgtattggctaatcaatgtaatttcggtaactatgatttgaaggagcgtat

SEQ ID NO: 20875 - DNA, 600 bp, Bovine  MMBT10839
tcctttattaccattaaagcaaggaagggagggagagaataacaaaagtggaaatgagattttgaagtatcaagggtgaaacatttttaagcaaactgcaatagatcctgaggctttcaaaggttgattcctcagacaatttattgcagaagatttggcttctgagataattggtcttcttagtcctatgactctcctgagattgccagcttcccccatctggattcacaacatggacaggtgttttctgtctggaccaaattactttaagtgttacattcatggcctaatgtctatttmaatgcaacagatttttgctctgtgacctttaacatgtctaattccaattctgatagagatgggaataacacaattgagaaggtgcttgccctttgctgaatgatgtgtattgagatttgcaaacaaacaaacaaacaaaatccctatgctatgagcgagagagagagagagagcaagagagaaagagacmaatgcaggacctattctaataaattagatacttttatataagttgttaacctaagcttatttgtgtaaccctattcttttggctttcttacatttttcatatgccgagag

SEQ ID NO: 20876 - DNA, 600 bp, Bovine  MMBT13341
aggacaatgttagggttcttgatgggcaataattgatgataccatgggtaattgtgggtgtaaaattactcttctggctctgtaaatgggaagtgtgctgttgtgggaaataatgcaataataaaaattaaaaagtggtggtgatgatggtagtgacaccggcagtggatgactaataacacagtcaaacctttaactcttgggtgtaaacactgctaccatgacaatcagacacattctttggtatttgagtaagaaaaatctcaacttctccatcaaatactaagccaaacagattgyttatgtgaatatgtgtgttcttatccctagaacagacagctgaagagaggttatctaactaaaaattactatttttttttcaaaaactatcctacagatgttaaaatgaatttcagagaatatctaatgcaaagaaaaatcacttaatactcttttaagactcttcattgaawgtataaatacatatattctaattatataaaayatattgcatatatatatgacagtgttgcagtgttatctgtgactttctttataattgatttgtttctaaatttttaatatatagatttatcatca

SEQ ID NO: 20877 - DNA, 600 bp, Bovine  MMBT22245
agaaggagtgtagacgaagctacaaattaaaaataagaagttaattctctctgttgaaaatagagcccccatccattttcttagagaacttgtaaattctttcactgtctctttgaaatgtatgyaaatcttttcaaaatctaaataagtctcccgccagctttacaacctaggaatgtctttctcaagggcctgagagccatttctttgaaatgtaatcattaaaaatgatagcacccctatctcccaggttctgcagaagagcacaagcctaacttctgccggttccttgctccaagytgtaaaacagcctyttgccataaagatatgagaaggttttacatctgctttggataaagccaattagctaacacaaaaggtcactccttatacaaaacgaatttagaatgaactgtgtgygacaaattaygctggcaggtgctcttacttgagaattagttatttatcttgaaaacatgtatgtaattggttgtatctgcttcattgtataaaagggagagatttcttctgtctttgcaacctcctagtggattgcctgtgatgtacactcaagctctggtttaatgcttattcagtaat

SEQ ID NO: 20878 - DNA, 600 bp, Bovine  MMBT11776
ttttcaaaatctaaataagtctcccgccagctttacaacctaggaatgtctttctcaagggcctgagagccatttctttgaaatgtaatcattaaaaatgatagcacccctatctcccaggttctgcagaagagcacaagcctaacttctgccggttccttgctccaagytgtaaaacagcctyttgccataaagatatgagaaggttttacatctgctttggataaagccaattagctaacacaaaaggtcactccttatacaaaacgaatttagaatgaactgtgtgygacaaattaygctggcaggtgctcttacttgagaattagttatttatcttgaaaacatgtatgtaattggttgtatctgcttcattgtataaaagggagagatttcttctgtctttgcaacctcctagtggattgcctgtgatgtacactcaagctctggtttaatgcttattcagtaataaaattgtttcttttctacctttgtgaagagatttctaggcaggaagaatattttgtttttaatatatcctcccaaaagggcaagggcagaaacaaagaaaatagttaagatatcgatgtgatactccag

SEQ ID NO: 20879 - DNA, 600 bp, Bovine  MMBT09205
ggatggtctttgtgtgcwcaaccagcagtgtcaaccatagtgatattgcgggagctgtttctcagtgtaagcaatctgatttcagtctacatttttcacaagtcaatgctttagacttmttgagaatagtaagagtcttatttatcattagattcctccccaaaatacacggaatgattttgtagttaaataaggtgaatctattgtatatatatattttccatagttatatcttgtgttcattactgagatcttatcaagttaacaaaacaagattccaggagacttccttggtgatasagtggaaagaatctgcctaccaatgcagggaacatgggttctatccctggtctgggaagattcaacacgctgtggaacaattaagtccacgtgccacaactaatgagcctgtacactccagctactgaagcctgtgtgcctagatagagcctgtgctctgcaacaagagaagcatccacgatgagaagcccgtgaccacaacgaagagcagccccctcttgccgcagcccacgtgcagcaacgaagacccggtacaaccaaacataatttataaaaaaaagactccagtgattactggtc

SEQ ID NO: 20880 - DNA, 600 bp, Bovine  MMBT09479
ggttgtgatggtaccttaaatgggcaggtgaaggagcccaggagaaacataagcagttggtatttttcttgcctgctaatgaacttgtattccattcattactctgataataaacaaaaaatataaacaaagcagatacaaacaaaaatacccagctctaccattatcagtcaaaaacccacccatgtcagctacttttctttaaaaaatgaggtgccagatgttgggctaaatatttataagcattatatcagtaatcttcccagatcccttagaactcatcattgagaacttagaaawcattgaattaggcaaaatttcacattagccgtggacaggatttctccctgaagttrtagaaaattacaagttgtgcatgcacagtcctgtccaactctttgtgaccccctgaactgtagcctgccaggctcttccatccatggaattctccaggcaagaatactggagtgggttgccatttccttctccaggggatcttcctgacccagggattcaacctgcatctcttgcagctcttgcattggcaacaagattctttaccactgagccacctgggaagcccaaatatttataagcatt

SEQ ID NO: 20881 - DNA, 600 bp, Bovine  MMBT11973
aattgcttttcctagatattcctcgctcttcctctttatcttacataactgtctgctttctgagaaccagaacaaatgtggtctcaattaagttttccacaaacatcagccaaaacctcttctctggttctaatatcattccttgtcctcctccgcccagctgagacttgggcttttctttgaagcccagcacaaaacccaactctcccaggaggttttcctggcctgctgcaccctcgtaataatcctttctttggaatctctgccattctagagcctgggctacacacactgaccccrtgttgacagcctgggccagtccctccaacctcacgttacactggaatcgttcagtaaaatgtttgcagaaaraaaaagaaacgacctcaagttgttcctgcatcatcctaggtatgccctcctggtcgcttcaattaaargatacatttttgagagtycaagctcttctttatccttgcttccctttgctgctcatcaaggcacttagatgaactaccccatctcccttcagcttgattcagcaataattcacttatacctctatcattaaaaagggaataaccaatcatctttttcatg

SEQ ID NO: 20882 - DNA, 494 bp, Bovine  MMBT19126
ccttgtcctcctccgcccagctgagacttgggcttttctttgaagcccagcacaaaacccaactctcccaggaggttttcctggcctgctgcaccctcgtaataatcctttctttggaatctctgccattctagagcctgggctacacacactgaccccrtgttgacagcctgggccagtccctccaacctcacgttacactggaatcgttcagtaaaatgtttgcagaaaraaaaagaaacgacctcaagttgttcctgcatcatcctaggtatgccctcctggtcgcttcaattaaargatacatttttgagagtycaagctcttctttatccttgcttccctttgctgctcatcaaggcacttagatgaactaccccatctcccttcagcttgattcagcaataattcacttatacctctatcattaaaaagggaataaccaatcatctttttcatgtttcctcaccataactccccaaacttaaaacatc

SEQ ID NO: 20883 - DNA, 600 bp, Bovine  MMBT02848
tcatctctctcaggattttattttaaaataggaataaaattatgagtaaaaaatgtatggttatatgtttcttatagtttttatggtgcattactaatccccaagagagatgtatcagatttattggatcatggcagctgtttaccaaattttatctaaagggccgactattgattagagcaacttgtgagaaacattgttctaaatggtcaattagcagcacttttacccaaatcctcagttgagatttatgctaaatcacatgaaattgccaacactggaccatttctgaccaactgraaaggaatgatttcatatggttcaaataaaaacaatttagaacaattactcccaaacaggagggaattttgaaatcttaaattacagtaaagaataggatgattatctaatgaaaatatttcaaatattctcaaacgacgctttacctaacttactctagaaacaatataaagctgcttaaaggcatacatagtactcaacaaccaaaacaaagaaagtaaaaataagaaagcaaaattttaaactcatgatcttggattttttgtgcaaaggaaggccagattcaagagacagactctt

SEQ ID NO: 20884 - DNA, 535 bp, Bovine  MMBT08951
gtacataatattataatccatagcaacactaaagaacaaagacagatgttacccacaaagattctttcagtccttaaaccaactacttaagccaacagtttcatgcgttaaaaaaataagttccatgtagattctagtaagatttccaaaaagcctctggatattttttcttcattgtaacggagttatatgttattctaaagtcttgtaccttgtactttttaagccgcagtaaatttaggaaaagaatatctgagtttatgataacagggttactaaaatattataaatgcaacataytatatacattattactttctgcatttagataacagtaacgtaatgaaaagtcactgtataactaaggaaaatggttacgttgatgtacttgatatcccaaaattcccatcacattggtaataaaaagtattttaaaatacttttaaaaagttctattttaagcaagtaggaattttttaaggtttagaagttaataatgtgggaagtatcttagccatttttatttataaaactg

SEQ ID NO: 20885 - DNA, 600 bp, Bovine  MMBT01874
atcttgggattttaggaaactataggaagaggatgaagttataaggaaaaggagaataaatcagaaaaagttagaaagaatggtggtctaatcgctcttcgtcagtagattgagataggcatttacgaggaaaaaagttaggttttgtttggtttctgtacaagtgtgggcactgaatgctaattcttgttgaaacacatttatgaaaataatttgaattactagacagtcttggaagcaacacagcacagtaagtgggtaatgactggagccatttttatattctttgcataaactgtyataattgttgaccattacattatgaaatcaaaagaaaccgaagctattgcacagaatgtgctacgtttacagcctcactggaatgcaaattcttaccaaattgagtaggatccttgattttgatggttgattttctagttagatgttaagaccagtaattctaacaaaggttaagctttcatattaaaaaaaaaaaaatcactgactgttgcttttctatgctaattagttcttttgaattttcatttttactttaaacttgaaagagaaaaaaatatattctgaaaatgactttaattc

SEQ ID NO: 20886 - DNA, 600 bp, Bovine  MMBT08312
atttttgcagtggcagctccccaagctcatctcattctctcccaataccttaggcaatatctgaagcaagaaagcattgacaagaaaagaaaagagtttgacgccaatggctggcagctcttcagcaagaaaagccaggtacatttcatcttggtgagatggaaatcctgagattagagtattggttagaaaaggagtatactgcttgggccctggcatccttctaagtgtctggcctgacctcagccagggaagatagagtagagtaagctatctgtgggaaaatcaataatacatttyttatgaagaactaggttttctaaatgcccagctattttgctaaactttcatctatgggagaaaatgtttgcagactggttggcccttgtgggagggaccagcttttacacccttgggtatcatagaaatctcagatagtctcctgtgtgataaacatgaagtacacaggctggactgagatgctgaatttttttgctctctgagcctatgttgttctgagtgggggaccaggaccatctctttagaattcagggaaacctggaaaatttatatcctttggttcttatttataattgaata

SEQ ID NO: 20887 - DNA, 600 bp, Bovine  MMBT01148
ttgtctctaattaaaactttcttcaactgtcattgacatcctatttttcaagaaatttttatttaatatgccatatcttactactgaatcctaataatcatgttattctatacatgttctcaattcaagtaaacattaatttttaatctatatacttagaaacargtattcagaaacaacctaagtggtaagattccaaaacagataaatcttaatatgtatgaacataacttttcttttttgacttatctagtaaaaattcaaacagcaaaacctacttcacctacctcgcctaccctktgcactatgagtggagaaaaaagcagcatcctataaaggttcattttagtgagaatcctatgcctatgactctactgatattaaccccatcatctttttaaaaaatatttatttggctgtatcaagtcttagttgtcacacatggaaccttcatcattgtggcatgagggatctagttccctgaccagggatggaatccaggcccctgtcctgggaacatggagtcttagccactgaaccaccaggggaagttccctaaccccataatcttaagctttctaatcaaataatcatgattgt

SEQ ID NO: 20888 - DNA, 600 bp, Bovine  MMBT02067
gcctttctcctttacaaaggcagacttgtaaaatggatctcaatagatgagaaggtgctggttgggtgagtgaaggggtggagtggacacgcatggctcctactccagagcggatgagcatacacagagaacagcatggacacagctcgaaggcctggcagcttagagcgtgctttgcttagggcaggtgtgtgggggtgaaggaggagggggagtgccttgggagaggggscctggtgggtacgaaggggtctcattctgcaggatcttatatggcacaccagagggcaagtgttcccygagacaytggaataataaaatcagagtcagaggaagcctttgcagctgttgaagctcatcccttttttcaagtcattagaaaaggaagtaaaatrtgacgtttgccttcaagctgacttcagggctctcacccagaatgatcgtcagaccctcagagaatttgtggtggtgtctgtgggctggcagacagagctgccactgagaacacacaggtgtggggatgactgcctctcagggagcacagaggcccgaccttgtgccagaacaggacaagtccaccgtctactggacgtgcagcct

SEQ ID NO: 20889 - DNA, 600 bp, Bovine  MMBT18153
aaatacaaaagcaaaattgcaatcattgtatgcctccccccaacacatacacacgcatagactccacccacaccaagtttagcaccgggtggctaaatgtttaaaagcccagacttgaagccagacccatgggttcaaaaccctgatttttcactactggctgaatgaatttggacaaaacccaggtgccttaatgtccttagcaataaatcaagaataataatatcacctgcctcatatattaaagtgaacaaatgtatatatatatatatacatataaagtgcttagaatgatgcccrgcaattggtgttatgtaagcaccagctgttattattagatattctttcasggtttaactgagtcccccaaagcccctgtggatcctggttaagaattacaagggggtgtgagatcacagactccctgagctggaaggaagcctcacagagatggagagcagggccacttcagccaggctctccctggggccaccccaccccccaagttcccaccctgacccacaccctttcctatttacacccagacggaggcagcctatgcgctgactcacgcttggctcagaccaagccattgttctg

SEQ ID NO: 20890 - DNA, 598 bp, Bovine  MMBT03742
  misc_feature (1)..(111): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcttgagttacaggggtgaaaaagagtgtcttttgttatgtacagtaagttcctttaaactttgcccaagtttatgctaatgaagtgactcgtatgggtccctagatagyttcagacgggggctggttgctagaggagaagctctggtgctcaggacccttctggaccttgtcctgtgtacctctscatttataataataggaagtaaagtatttctggggcatgtgagtcaytacatcaaattataaaacctggggaggaattcttgggaaccctgatttgtagccaagttggacagatgtgtgaataacctggcagttttgtgggactgagcccttaatctgaggggactgtacttaaccctgggtagttggtgtcagaattggattaaattataggacacctacctggtgtctgcagaaaattacagaattgcttggtatggaaaaacccacatatctgatgtcagaggtgtttgagaaaa

SEQ ID NO: 20891 - DNA, 600 bp, Bovine  MMBT07699
ctctgaagagtgcttagtatatgcttctacttataaatgaactcctacaacaggcaacactagcccatgattaaaaacaagaacagtgattgcctctagggaatggggcagggtgacaggagcctggattacacaggtttatgtagtttatgcacattatactctgtgatttttttaaaccgtaaacaaatattaaaatctagttaatgataagcacactgaagtgtttagggctgaaatattattgaagcctgtgagttaatctaaaacacattttttttttttggctgtgctgtgcartgtgtgggatcttagttacccgaccagggatgaaacctgtgtgccctgagttggaagygtacagtcttaacaactagaccatgactttttaggaaagtccctaaaatatatgtgtttttttaaaagctagattgatgaatgactrtagtgcaaggagacccaagcagtccattctgaaggagatcaaccctgggatttctttggaaggaatgatgctaaagctgaaactccagtactttggccacctcatgcgaagagttgactcagtggaaaaagactctgatgttgggagggattggg

SEQ ID NO: 20892 - DNA, 600 bp, Bovine  MMBT13973
tttatcattccttaattcacattacattggcccattgctgmttttcatcagtttcaataccactaaatgctgagttcatatttcctactctaaagtaggtatccctagactatttgtttaggaagattgctcttcccatctctgatttgagtttccaagggtggggcacagcaggagtggcaacacgttgaaatccctgataggaaggaccagaggagcggagtccatctctgagaagaggggatggtgaccgccggctggctgagcaggtgtagaggggctgctttgtggctgctaatyaaggcctcttccttgtcagacttctgaaatagacaagcggatcttggacatgggttctggctatgtaagctattttttgtgaattattactgaaaacctagtctaaattgataaaggcaactttatttctccttagtaagtacatgaaataggtatccagctttttcttgggcacaaactgtccaggcaagacttttgagtggcccttgagcttgttctacactgctggcctcagtgctcctttctgaaggagaggggaatcctacttaaatgtgtggcttgatatgggactgttttcgt

SEQ ID NO: 20893 - DNA, 598 bp, Bovine  MMBT03098
  misc_feature (1)..(90): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttttttttgcctgagatacagctttgaggagaatgtcagggggacactcttgttcccccctttcctatgacatgataaacatcaccccatgccatctggtgtcaccatgcattcggtgccttaattagacttatagcactaaatgaactatctctttgaaataacagaagtacctcatggtctgttatcacaactttatgggctccyggagattttggaatctcagactgtgaaccacccatccagtccatccctgatttacagatgaggaaagcaaagcctccaaactccttagtcaaatgatgtatcagtatgttgaccctctgtttttgaaatctgagaagggaacagtgaagcagtgggaagggtggggtgggggaaaagtgtggctatgttgaaaatgtcagtgatagcagagaaaatatttgcctgtgagaccctgcctgtctctttggacttctttgtaatggttaagacaacccaacagggctggagtcgttagtga

SEQ ID NO: 20894 - DNA, 479 bp, Bovine  MMBT13285
acaccctaagcttacagcagtgcacagctatgaaatgttgttttaccgcaacaagaaaatyacagcttgcttcagggactgtgagggcctgttctctttcacttgtggttttgctgcagatgctacttctttttgtgttcttttttgtacccattcatttctcctctccagctccctgcaactccctttctaaagtaacctgtgcttgctgttttgcattcagccatcatgtgttcagtgaagcctgatggggttccccagctgtgcaggacagacgaagtcggggagctctgcgtgtgygcggtggccacgggcatgtcctactatggcctctcgggtatgaccaagaacaccttcgaggtaggtggcaggtgagccccatcagacagcttttgccaggtgtgtggaatagatgtaaaaggagatggtgatttctcaatagaacatgttcatggtaattaaaatggttgtactttctc

SEQ ID NO: 20895 - DNA, 600 bp, Bovine  MMBT11825
cccgccaggctcctctgtacatgaaattttccaggcaagaatactggagtgggttaccatttcctccgccaagggatctaccmgatccagggaccgaacccatgtctcctgcattgcaggtaggttctttaccactgcaccacctcggaagccccttaacctccttaccctgcctctgacgcttttatttgggattttgctccagttaaagccaagagtggagagagacccttccaagcttctcccctggctctttgcagatagaggtacaaacacgagcttcttgggtcttcagtgccygcagggaaaatccccaaacccaccacctaaaatgtgttgcagattccgagtgtgcccatataaagtcgccaacatagctgaagactcagacgttggtcatcaatcgatgtgctactagcatgagctcttctagctggcatggaagcttctcaagggtcagcagcagtggcctccgttccctgtgggtcacaattcacgtgggtcttacctccctgcaggttaagctccctgctctgtaggcacggggccggggcgggggcgtctggggctgtgtgactggcaggcccaggcttccgggcc

SEQ ID NO: 20896 - DNA, 600 bp, Bovine  MMBT21627
actacagaaataactctttcttgaggggaaaagaccacttctatcactagtcaccttgggccctgatgcttcaccaacatttgaagttcttcccagaggcttcttttcttccaggacaactcttatcaaatcttgaatgttgactcaaccccatgttgatggaaagtggaaatggcacgtggctaaatttgacccccagcccctttgcagtgaggtaaagtcatagaactggttatcaccaatggaatataagcagaagtgatgtgttacttctggactgaagaggttaatagtggttaycgtttctccgcatggtttctcttccccatctgctggcaggatgacacctcggcaacctgaggccacatagttaagatgacagagacacagcatgaacagatccagattcctgagttacttgaccacagacatccacactggattatgtgatactgaagtctttatcatgttaagatgctgagatcggggggttgtctgctacagctgttttatctaaagttacaaattaaggtaacaaggctgaaatagcaagaaaccaggcctaaggcaccatagaatttgcactgtaatggatgtaga

SEQ ID NO: 20897 - DNA, 600 bp, Bovine  MMBT18362
atttttagagggtatgccagagacaaagaaaatctgcttggagaagcattcacagaatgaaataaaatatacgtctgtaacctgtagcaggagttccctctgatgccattattacaatatgtatgcttgctttagtgagtactgaaataaaagagttcacgtactgtaaaaatctattaggtagagacaatgtggattatagaattcacaaagatttctttaaagaaattaaaaggagcggcatttcagattttccactaaactcagatttttgtttcatctcctttctagctttggtgycccttatgttgagtaattttcccttttgccaggacaatcaccaatcaacagctcctcctctcctttcctcatcatttccattgttttatcattctgccatgtaagaaaaacaagaaacaaagggtggaggagggaacaacgtgaatagtgtatgtgactgataaatgattatgcttctgaaaaggccacacggcgtagtaacagagatcacatttttatagtgtctgtactaggcactatccttagcacattacatatgtgttttacatataagtgtataccatatccatatatactcat

SEQ ID NO: 20898 - DNA, 600 bp, Bovine  MMBT01840
ggatagccattctcttccccaggggatcttgccaacctgtctgtcctgcactgcaggcagattctttaccatctgagccatcagacactatagaaagagggtgatgaaagacagaagctccccagctatagcagaaagagagagaaaggcaaggctgtgctaggaatccatctcttgctttttcttcatataaagactgtcatggtgatggacgattggtggcgtgaccactgtgcttccttatgaagatgctggaaggagcacagaggaaacactggtgggaaatcttcactttaggawgcaacacacctctgttcctcacagaagagttgagaaacatcagaaacactccctgacccagggtctctcaaaccttagtcacttaccactgtcatcatttttgttctatgcaagtaacagctgtatttgttcttctttgatatttttctataaatacatctacatgttttgacctaatactagagcttaacaccaagtgttcagtatataagcaattayttttctggatacaacaaaatagcctcagttttgtgctgtattttgtggcctgaaagtgcattttttcactatgatatttct

SEQ ID NO: 20899 - DNA, 598 bp, Bovine  MMBT21009
  misc_feature (1)..(147): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacttataataatgaaagtgaatgctctgaattttactaagacattccatgcaagaattaattcattttcatctagaatctaaaatgtgctttcatgtttctattgcatagttgtttttttgctgtataacaacggtgatcacataacctttyatccaaactgggacacttttgaagatgaaagaagtgttatgaataattatacaagaacaatagtcataaatatgaactgtcctgggcaaacccaggactggctatgattcttgttcaaaatgtgtatttcattttaaagtatacttaaattattggagttatgtaaaatttgaaatgggatgttcgttttgaaaagaaacatctttgtctctttgaattagatgggttttaatcttttaatattctatacttggtgaactatccatcttttctttctagtttcacctttccttgttat

SEQ ID NO: 20900 - DNA, 582 bp, Bovine  MMBT02559
gcaaccactgttcttatttctatccacatcgaactttcttaaactatgtaattggaattacacagtatgtaattttctataatctttgactcaatataagatatatccctatttttgtgtacaatcagaagttcattacttattaatgagtgctataccactgaataatatcttcaagtgattatgccattttacactcccaccagtaaggtcaattattccatttgttatggaacatgacatctttgtcatgatactatcagtttttaattttaactatttaggtggttgtgtagtgayagctcattgtggttttaatttgcatttccctgatgatgattatgttaagcaccttttatatgcttcttgtcctttcagtatgttcttttgtcaagttttttttttaagttcttgagcacttttatcgggttatcatcattattgacttttatctgggcttatgctttgttatacatatgtgtcgcaaatattttctcacaatctgtgccttcatcttcttactaatatctttggatgggggagaatttttaaattttcatgaaaactaagtcaaagattttt

SEQ ID NO: 20901 - DNA, 600 bp, Bovine  MMBT02782
agttaaggagctctacaagacagagccgtgccctgacatttatcacagaataagcagaaatgagccctcatcatgcccagctgataaacagcctttggtgagctgaactcatgttgctgatccgctaattgtccagctatattcatttgacgttgctgagcctctaaacaaattaaggttaattggaatcaggaatggatcagcaaccttggtactcaatctgtttagcagttctcctcaactcattacttttcttcttttagctcttgcatgaccaaagtgccactcattctacctgcmtctattttgactgratcttattacaaaatgtttcaaaagggaattatctgggggacacgtggcaaatcacaactcagtagcatccagagactcaacgcctccaagagacaccttgtgaatgttgttttcatgtgtctttttcaagtaagtctctatctaatccttcagacgtttcattttctcatttgggtcctctttcggtagaacagaacctagtcctagaaaggacttcaacatatccatctgatctagctcctagtcagagattgtattaaatgcatttcatagattaagtaaaga

SEQ ID NO: 20902 - DNA, 600 bp, Bovine  MMBT08106
ctgcgttgtgactcaagtcctgagctgaggcctaatgctgcactgagagctgagttccaaagcgctttcggcagttgggagcataccacttggggtgttaatatttgaatacagaaaaaggaagctgttatttcaaatgcctcacaatacattgcagttgagggattttatttcccaataattttagcttaaataaatgaatttttctctttttagatatggcgagagcttttttctccacttcatgcactgaattttggaattgggggagatacaacaagacatgttttatggagactwaagaatggagaactggagaatattaaacctaaggtgaaatgaagcttttttttwaaaaaaaaaaccttaatcttaagtcttttgcagagagttaaattgtcagaaactggtagtttttaagaaaaatttcttctgggacttccctggtggtccagtggctaagatttcatgctcccaatgcagggggcatgagtttgatagtcaaggaactagatcccacatgccacaactaagacctggctcagccaaataagtaaaaaaaagtgtttaaaatttttttttcagttgcttctttaaacc

SEQ ID NO: 20903 - DNA, 600 bp, Bovine  MMBT16723
tacaaattatgtaatgattttgccattgctaattatatttgtatgatggattctgtatcagtcttcattataatgtaactattgtttgaacagaatatagcaagttaactggacagtttatgccttaagatcctagcattcttttaccaatgctcatttgcattctcatcagtatgcatgaggttttcactgaactttaatactcttattggaatataacacactataatgagtgtagaagtgaacatgcaagttgaatatcccattaaccactaaaaaagactagaagatgcaggtagraaaacacttgatgaggcataccttcttcaaacttcagtaagaactgaaaatggctaatacacttttagaagtagcatcaacaggggtttgaggtaaatgagacctttatcactagattcagtaggtgaccattcagaacgaaattataggtttacacaccataaagatcatatataaaaaagaaatctgtataaactgtattaaaaaaaagaaaaaaaaagatatttttaactatgaaaactcttcaaataatatattataaaatgagttattttctaattattgactctgaaaagtttc

SEQ ID NO: 20904 - DNA, 600 bp, Bovine  MMBT13207
caggaaattaaatccgtctgtcgcctccacttaggtcaaccgagcgctcacccacaacctcagagagccaaggaattctccacgaagagggcatttctctccccatcccgtgaaataacaggcacgtcactgtccttcagtgtgccctctgtagacagcctgacactgggctaaggttttagcagatgtgttctatagtacataaagaataggtattttgttgctatgtccctctggcctccgtaattcttggctcgtttccaaaaagactacagaagtcatcctggccccttaagtttygaaatcccagtccaccaggccctgtacaacagggaggctgagctgtcccctgggaccatctggcagccagcagacaccccctccagctttgcagtcatctctgcttccactgaggagggtgagcaggggagggtccgcagcagggtttatttatttattttttttagtatttatttctttttttttctttttttttttaaattttatgcagcagggtttagatttgattctgagggaaaatcaggaaggtaaataaatcatgggaaagaatgtgaacagcatctgagtgggagctgccac

SEQ ID NO: 20905 - DNA, 598 bp, Bovine  MMBT04546
  misc_feature (1)..(123): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctgcttctgtctccacctctgaccactcctctgtccctcctgtgtcctcctgtcctcatcccagagaaggaagtagttgccagttccccatcccctctctgggagccaacagctccagctcaacctgagactcccacctccatgggcttagcccacacttccccagagcgagcygtgtgggtagggagtggccagaccagatttcccttctactgactcactgtgaccttgagtaagtcacttcccctcaagggcatcactcacccatgcccattataaggggttgaattgaactagaggtaagataggggatccaagccccaaagccagcttgagggtcagagaatctttccattcagagggctgacctctgagccccagctctcaacaattccctggtggctcagatggtaaagaatccgcctgcaatgcaggagacctgggttcgatccctgggttgggaagacctcct

SEQ ID NO: 20906 - DNA, 600 bp, Bovine  MMBT01683
aagaaaaataattacaagctgaaagatactggcaagtattacactcaatataaagataaatacattagccataaataaatctttatataaaagctcacactcagggcgggctagcaaccagcaaccatacattgtgtcagctacagccggccactaaacaaagggaatgaaagtktgctagtaatgttaaartcttgtaaaatatttcatagttgyctcatgctttttttcctctttactgtacttaaagggggcatgtgagaggtagcgatagttccaaaggtccaggccagaagtgasaaaaattaaactctaagatctgttcttaaaatattggatgtactttactaatttgatttacctaaatttcatcttttacttacactagagttcagagatataaaaaaatgaaagcagacatttattctttcagcccgactataagcttttaccagcagtttcagacatactgtatttatctattctcttagcctaagaaacaaacaaaatatgaaacataattatatcatttatttactgggctgaacaagtacaatttttctataatactcatgacaaggaaagtagatgctatttatt

SEQ ID NO: 20907 - DNA, 600 bp, Bovine  MMBT16931
cacaattcttgagtgaaaattgtttaactgataaccttcaaaggctaaatgaatctttaacaaaattcaaaaaagtaataacatcaatcattagattttcctattccttaaaaaacaagttgtaagtagtactagttagtagtattactaatagtactagtatttaatcactatacaattaaaaaaaatccctccctataaaatctttaccacatttgattaaaaatataaagtgaaataaaatgcattgtgtttatactggatcagtgaaaacccttgaggatctctcttttggtcctyaatgattctttaaactagtatgtctgtctgttataaaagaagataaaaatataaatgttttgcactgttggctcataattctgggcacatttgttgtgttgctaaatatggtggcctagtttacagaaaaacagaagctgtttgtaagttgtcaaattaacacatttaaattaagcattccaaagacactaataacagctgtgtttttaaatatttctttgagccattgcactctctgcatagaaacatgtggcacagtagctactgctactgcaatgagttctgtatggagtgacttta

SEQ ID NO: 20908 - DNA, 600 bp, Bovine  MMBT09536
ggtgtcttatgagagctcattctctacttcaagcttgaaaaacagcatgttcttttgtyttctctttgtcttctttctgaaacattctgtactgtgcaccttcagagaaaaaataaaaagcctcgattttatttaagccactgttattcttggcaccaaatcctaatgtatgcagaaaaagatgatgttctattcccaactgatttgagttgaatgtcagtttgaaactataatatgtggtgtcaggatccaggccatttctcctcctataactgatgggattttcttttttttcaccaytaatcattgctaaattttattgaatgcttactatgtgtcatgcactattctaagtccttgcacaataatttcataaaaaccttagatrcaaccctatgkaacagctattacaattgctcccaattcattatacaaagccttcatcacagagaaattaaatatttttcccaaggtcaaaagggccactaaatgttgagactggtatgaaccatgtggactcatgaggcaatatccactttgttaatcattaatggttaagatatgaccagcatagttttacatggggtggcggattcagct

SEQ ID NO: 20909 - DNA, 600 bp, Bovine  MMBT16493
gcattcttggtttgaacaattcatgaatgacttggaaagtctatggcatggtaatttgcaactttgctgaaacaaattccagtcatacacctgctggaagtcttaaatgtggaaaagagacattcatctgggaactgagcctggtttaccacacagtatcaagaattcaatgcagtttccctcttttccacttgtgtctgctctcaaataaacaatagggggctgaaggttgttacttcaacttttcattgtcaatttgtatgtataaattttgaagatttgaattctgagggagatggscttagagatttttatttcgtackaaaaattagaattaagtaaatgtctctctgaaaacaacacacatacatacacatacaacctgttgtgctggagctttatgctcatccaagggcaggttaaagcgtctgcctccaataagggagacccgggttcgatccctgggtcgggaagatcccttggagaagcaaacagtaacccactccagtatttttgcctggagaatcccatggacagagaagcctcataggctatagtccacagggttgcaagagtcggacactactgagcgacttaacc

SEQ ID NO: 20910 - DNA, 600 bp, Bovine  MMBT19882
ttttctatggcatttgaatgagttccttttaggggcaatactgggaactatatgaccaaacaagcaactgtagtatcaagtggggcttaatgcagtgtggtcttgagctaagctcttggtatgatcaasattcttcaacagacaagaaattgtagggaatacagagaagcacggatatgtgatccagattgtttttaaaattgtgctttctgaaaattccactggtcattagcagctgtgtaggtccctgaatcatttttggcctggataactaggactaacagagatgtgataaatgarggaggtattaaataaacagactagaaagtcttttccattacaggtttgtaggcatgaaaaccgaacttggggccatcattattgagaataagtgagtgaggtttattgaagaaagccacttatggcttgtttttaacaatggatcacactcaaaatttatatgtatattgtttatttgcctgtatattcttattttaatcactgtctctgatttgtggcttaaaaagatttagaaaacaaaatattcctcttagaaacttttttgatgaggcacctttttctaaccactcttccatttag

SEQ ID NO: 20911 - DNA, 605 bp, Bovine  MMBT08371
  misc_feature (1)..(5): n is any nucleotide
nnnnnctttcaaccctacaaggcagagagagagagagagagagagagagaatgcagagcttgcgttcagacagactgctttgtttgtgcctgctgattctaaattaatctgtaggaagatttgcttctagagttctgatttcatgttcttgggaaggtatatttttattgttgcagggattacagatccttttttaagtttatctgctttctaaaaggaggaacgggattaattataagcccattttgagagtgctactcatttaaatccattctcaagaattatttcctttttaaaatcaaggsccagtttacattatgcaggtagaatggaaatagtatagaactcattccactgtgggctatttattggtgacaagatgaggggtggtgcccaggtggctgaggtaatcacactgttgcgttgatctggggatggggagggcaatgatgtcgtgctgtgtttgtgacatgcctctcgttctcaccagtctacgcctgcaagctctcggaccgggaacatccactctacctgcgtttggtagcaggtcccagaacagacacactcagttttgttctgcgcgaacatgaaattggagaggtaag

SEQ ID NO: 20912 - DNA, 600 bp, Bovine  MMBT20334
gggaacaagctggggctctagcctctctgactcagtgacccacatgctaaaaaacagtcggagcagctctgccttagccagtccaggaacagggcaggaagtccagcttttggcccactcgtatcctagcttgcggttacagtgttgaaagcatgcatgtctggaaagctttttccccgcctcccccttcatcatctgtggcttcagtggcaatgtcaggaaaccacaattggcctactccacccccacccrgctgcctccctgggtgccaagaaagaaagaaggttaacagtccgtttygatatgctggaagccctcgctgctaacagtaacagtccctttyyctcacctcataggtcctggtggtcgacctcgtcaacaatcggttcctcaggcaggtgagtaagaagcaacccagcttcaaccactgcttgctctgtttgcacctctttgatgtttagagctcgcctttccagctctgtggtgggcctggaatcccaaagcaggccagcaggcggggggcagtccccggccagggcttgactgaggacaggacagaaggcaggggccaaagaagaggggtttggacaaaggattgat

SEQ ID NO: 20913 - DNA, 600 bp, Bovine  MMBT03097
atgttgctaatacctaatttttattaatggattaatagtgtgcatatttttctgaggatttccattttgcttgacatatttttgatattcattctttctatctcatgtagcagtagtcatttatttccaatactattaatatataatattctgttgattgtgtacattgtcattaattattttaacccttatgaagatttgggttgtttttgctattgcttctgtgatgaatctgctcctataggtcccctgatgcatttgaaataattcctttagggtcatttcataggtagaagttgratttctgaaaactggtgatacacatgaatcctaaattgtctccagtatggttaccaatctgcacattcaccagcagcacatgaaatccaatttataaartcaagtytttctgaaactccaatagcatctatgatgaaactcctcttcctgtgtatgatagggacttctgtgtattccatgaatggcttcaagatcagtccattattcacatctatctttgatacatttatactttcttctcttgagtttaagttgctgagtaaatctatccattgagtttctattgttaataccatgatg

SEQ ID NO: 20914 - DNA, 600 bp, Bovine  MMBT06239; identical to SEQ ID NO: 4858

SEQ ID NO: 20915 - DNA, 600 bp, Bovine  MMBT20082
tatggaaaatgagatatctgggcaacagggaccagtggtaaggtaagatgcggagcccagggctggtagggataagaatggaagagtcagcatctaaaagtctgcagctgcaccactgggatcctcaacaaacaagcagatgtgatcacaggagtgggtctaggatgagtagagcacatctagcccttcatcctgcttatatatagcagaagctaccaagtatccctcttaacacccttaactgctgacataagccagagcatgtttctgttgcttgcaacccagatccctgattggtgyattgcttttgaggtgtctatgggaacaggtgagaaggcttaatattgccattagaaatacagcttgaaatttaggaaggatgtctgagcctgacgcacaatattcagtcaaaagtgtgactacatatgacttcacaccagggagggtgtgaagcataaatcccaaagaagactcactacaacacctagcaggcatccaacttcacatctgccagtgtcttgtgctgagatgacattggcacagtcttgatacccatgagtcccacttctctacaaaccagggtcacagtcactgctttag

SEQ ID NO: 20916 - DNA, 600 bp, Bovine  MMBT20360
tctggatgtctgtgtgcattatgctagagaagcagcatttagaagttgattggatttagaattttcttctgtattttctacacaccttattaaggatataaattgttattaactgaaagtgtaactgtttgaatggcccatcagcttatgtgcatgcatgtttttgtttttttaaatttttggccactcctcatgcaggatctgagcagaggttgcacccatgcagtagaagacctgagtcttaaccacaggaccagcaggaaagtccccatgcagatgttttgaatgaagaactgtttratttgaaggattcagacatttacaacttagttaagaaatttataagttttaggtctagaactgtatgctgttttttgaaattatataaggagattgctgtgggttttacctaaacgatttgaaatttccctttgtatatgtggattaaagtttaacaggtccttatgccagtgttaaaagtaagctagttcatagtagtgcaaacaggatatgaaaaaatttttaaaaaatatttccccatgcaatttacctacttttattactggttttcaattttttctttctgattgtccatcaagc

SEQ ID NO: 20917 - DNA, 461 bp, Bovine  MMBT14951
tctggatgtctgtgtgcattatgctagagaagcagcatttagaagttgattggatttagaattttcttctgtattttctacacaccttattaaggatataaattgttattaactgaaagtgtaactgtttgaatggcccatcagcttatgtgcatgcatgtttttgtttttttaaatttttggccactcctcatgcaggatctgagcagaggttgcacccatgcagtagaagacctgagtcttaaccacaggaccagcaggaaagtccccatgcagatgttttgaatgaagaactgtttrgaccagggaatttaaactgaaggaaaaatcaataaaattaagtagattttcctcagtagcctggagtgtatctttatgccagtgctaaactgcatttaagatctttttttttttctttatgctttcacaaaaagcttttaaccttattatagaaattaaaa

SEQ ID NO: 20918 - DNA, 598 bp, Bovine  MMBT18818
  misc_feature (1)..(150): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaagggtgaactttatttcttttgaggtaaagcgatgaacccaggcaaagcactcactctatcagatatgatttgaaacagctgaaaaataaacctctgacaataagattttaggacagaaacgctgccagagctctaagtgccttcragaataataaaaagaaagtaaacaatgccagaggccagacgaacaaaaggaaaattcttacttcgtttgttctcatcaaataccggagaaaaataatctgtgcttaggcagttctcctggagtccaaattcctgccctgtgatcatcattctgtttaagctctgtgctttcaggctgtcataaaatgccttacgctgctggaaggggccaagatggttttcgatctaaagccactgagagcctcaaggcagattctaaaggccttcaccacctgagccgggccatctgggctcttcct

SEQ ID NO: 20919 - DNA, 600 bp, Bovine  MMBT03374
tcatttaatgaacagtcaagtcgacagccatagtgaaacagcaaccaggaaagaaaaacgaattttgtgacctgaaatacattaggaaaagaatctgaaacattttgaaaaaccgacagcagtcctgtgacagcttgactgggacttggatatttatttccactgaaaacatttctgtatgtctgatacatacaagctattgtttttgacaaaataaacaaaacaggtacaaaaattattagatagcagagaaaatgcaattcatctaaacatcaactgaggtcagttgggctgaggctmagggtgccccatgaggtccattccagatcttgtactgaaaattcttggtctttcactgagaataaatcatcattgtacttttgagaaaaaatcttcaactctttggctgtggtgcatctcactagaagagagggagctatttctctgaaggaggtggagaaggggcagagatgatagaaggagcttggggggcccttagggtcactgaaatcaaggcaggacaccccaacacacccaggacatctctacctggcattcagcaaccccaccctccacagagcaagcctgccagggcccata

SEQ ID NO: 20920 - DNA, 600 bp, Bovine  MMBT09175
attattcaagaggaattaaaagagatgctaaaaatactcctctatttgaactttgttatgttaacaaataaactggattagagtccttaccctgtattccaaaggcctgcctgtgttccaagggccggcttgcagctcattctctttgcccctggacacaggaggtgctatccatggctggactgtaggcttagatggctctgctctagaagcctcatcagtattttcatcaaaaacaataattctagtattactttgcatctgttgaggaactggattttggagacctctgttctggcytggagctaagagaaaaatattaaactttcaaaatctaaatttaaaaatcttcaccaatttagatgcccaataaggtacacctgaacctttcccaaatcaagattacttctactaccatagaatcagagatttttttaaataataatttttaaaaaccttaatgcatcaaataattaatttttaagtctattctgcatttgttacttataccctccccttttccctcacctgtaatcttttacrtatagatatccaaaaaacaaattctgtatcttccttcagtcatcattctaacattgt

SEQ ID NO: 20921 - DNA, 600 bp, Bovine  MMBT08879
tagaagaagtaagtagtatttgcattttaattgtttaaaactttgaaatacaaatgccaggaccattgttctaactggactgtgcaggctttaggtcacttgtggcccacttgatgcttgggagctgctttttgtgttatgttgtactggggtcgtagagatggacaatgtgacaactgattctaggaattcttgcatggtgcttaaatctcactggatggaggagcctgtaggtgcttggtgctggtatcagacaccattcccaaagagaatgatgaaaatgctttctgaagatcaacstaggatggtatagatagtcttttcaaaaatgactaacaactcttagtgccaaagaagtatggcagtatcccactcaggatatcaacttttcagaagaggaaggtgtaatttttctgcagctggactgggttgctagtttgctgaaacaggaaatagagtttgaaaaacagtaattgctgctactaaatattgatttttttttttcttcagaaagttaccctccaaataacctaaaatcctttctcctctgccctgcccgcaatgttcacagcagtatcttctcactattgaatttcatca

SEQ ID NO: 20922 - DNA, 600 bp, Bovine  MMBT02046
ccttttaatttttcacagggctgcaaatacagcccagagaactgtacattgaggccatgcgcatatggttttatttactattgcatgcaggattttgttgggctataaaagaaatagatttcagctgaagcaattagaacagtaccttctaagaccactgtgcacatgagcacgtacccctggctgctcccctggaagagcgtgcgatgcactgaaaggagatgaggggaagcgtgggaagctcttcctctgtttctctaaccctcggaacatgctgtttgtgagcctaaacatgggcgrtgtgatcggcaaggacaggctgacacgcttgggtccacacttacgggtaagggaaattgaactgaatttgtttgtggatgcggattggagagagaaacagaagactgtatagaaaattaatttgctgcattttgagtccctttctctctcttttaacctgtcaaggcaaattttccaatgtgtttccayccacagtttagcataagtaaaaatgtctagaaggcactctggcaatgtttttgaagtctcctcagctcccacaagcatcaccatgtaaagcccaaatagccctgaaaaagt

SEQ ID NO: 20923 - DNA, 601 bp, Bovine  MMBT16971
  misc_feature (1)..(1): n is any nucleotide
ntcgccttcagttgaaccccaacaaggtctgatgaggagacaccacattcatgaggctcagttcacagcttctgaatattaatgataaaactccaccaagttaacttgcagatagcaacgagcaacacagaaatctggagaggtgaaaactgctgatggtgctagaagataaataccaggttctccatctcattttttgagctgtgggagaattaagacaagagaggcggggaagggagggagttgttgttaaaacaggatttgtcgaaacctgaaagctgaaaatgctcttgtgtcacartatacagaggaggaattatttgggtgctgacagaaagactttcttttcttttaatattatgttttagtccatagttataatttatttttgaatttttatctatgttgggagatacagtttattacttaatgtccccaattaaacaatgtggtctgaaatatttttaactagattgtgctttgcaaatgatagttcagtgagactttctttttatcctggtgcttctgacttgtgtgaaatcaagatttacaaaattggtagctttcagactaaaaattcaaaagacaggtttaaacatat

SEQ ID NO: 20924 - DNA, 537 bp, Bovine  MMBT18608
acatttcctaatgactagtttagccactgtacttagtttcacagaacagactagtccattattaagcattataattctagtttcattacgaatattctacggggagcagagacatttgtaaaaaatatttctatatccataaataccaatagcatgtgtaaaccttggggttaaaaggggactccttaagggaaagttattttgcttttatttcaaaggttacaaaatgcttcaatayttttaacctcctgatattctaagtatgcatgtaatttttttcctaacattttttgaaaacaytaaaaagtaggagacaatgagttatgatctgatacctaattgcttactaatagaaataccagatgccgctcaatttcatggccctgggaggtatattgtacaatattcaatattattgtaattcatttcatcttttcatcacaaaattcaatgagttttttatactcaaatataaagggatatgtggctcaatctattttttaaatgaccctcaattagaagtaggataaccttcta

SEQ ID NO: 20925 - DNA, 601 bp, Bovine  MMBT01596
  misc_feature (1)..(1): n is any nucleotide
nagcagaacctggagaaaacagctgaagagtgagcaagagaggatgaaggaaaacaagccaaaaacccaaggaaaggtgaagggtgaaggatctaggttagacaccaagaatttacttycaaytgagtcctgagtacttgaacccaagcttggatgtctaaaacatagagcttttccttgcaattcaaaaagtccttcctttcagtcctattttttccaagttcttcatgttccaagatttcacatttcactaccccactcatttagtacgtttaattaatttctcaatatttttgtgtaygcattactgctttctgcacacatagacatactaggatgaaggaggaggttctgctgattggtatttgtaatgtgctgagactgatgaatgaactcatacacacaccgtcaccatcaccaataataataacaacctctgttactaagtgagagtctcacctcctgtttattgagcatctattatggaygaggtcttcaattatgaattttataaacatggccaataaacagagtagaaataacatttctcttttatagagggaacaagtaagacttcgagaagttaagtgattggctgaag

SEQ ID NO: 20926 - DNA, 600 bp, Bovine  MMBT02077
tggaccagaggtcagaattattcccgtttggaagtcagagtcgcagatccactggagtaggagtccaagccttccctgaagagccctttttgcagtgacacagagaggaaaaccagatgtggattcatcctctccctgcactgctagatctcaagctcctctgtagattaaagatttacacaggctccctctctgttagtttactgatcttgaataaaggaattctagacaagttctttattcggtacaacttgtccaagaggtatgcagtatgtcataaaagggtgtctgccagattgyttcactgatttttaaaccaagctgacttcttattctgacaaccacagaataagagtttccaaagcttgaaacctaacctactgaatatgaaatgcaagagtcaggtaaattacaaagayagatgatagatctcagtgactgggaaaactgaggcttggggattggcctcagtccagaacttaccctgaatgagctaaggttctcctgagatcatgtgacttgggtcagaccccaattataacttaggatctgctattaaatgtcatggtaccctggaggtcacactgcatttctaagtct

SEQ ID NO: 20927 - DNA, 600 bp, Bovine  MMBT11424
cattttcctcgggaaaaaatagaagattactattttccttttaattggcattgtgtttggagaagtataacaagaagggaatagctgcctgccatatatgcttgtgacagggagcttatctaatcactaacctttgcactgctattggctattattcagctttagaaaaatcaggtaccatttattcgcttggcttatgggggaactgtagcagcctgttttttatttattgactaggaagaaaagcaggcagtgggttaaaggatattgttatttatcattatatatatttcagtgttmttctctgaaagtaaactctttattaaagggtactgattctcctcctcctcctcctaagtcacttcagtcgtgtcmgactctgtgcgaccccatagacggcagcccaccaggctcccccgtccctgggattatccaggcaagaacacttaatgcaatatttaaataagcccatgaaaagtagaatgggtagaacataaagtagaaattgttttaactacaaaggaaaaaacttataattccattgtctacagttaacatcaacattatggtcaatatcttatgcaaatttttttcttcatt

SEQ ID NO: 20928 - DNA, 600 bp, Bovine  MMBT01233
tgatgtggactaaaagtagtcgtagctcagctggtaatgaatctgcctgcagtgcaggagacccatgttcaatccttgggtcaggaagatcccctggagaaggaaagggcaacccactgcagtattcttgcctggagaaccccacagacagaggagcctggcgggcttcagtccgtggggtcgcaagagttagacacgacttagcgactaaaccgccaccaaagtaatcttccacggaggtcgttttaagagtttctcagcgtccacagagtgtccttagcccaggcgtcgaaacctagygtgtgagtcactcattttggaaccacttgtctgaggaagagaagtgtgttttgtttgatcacgtgcggccggcctgtgrgatcaggacccttgctcctgctatcctggccttgttaactgcacagagagcttttgtttctctcgcttgggtttatttgcagagacggccctttcctcgtgtttctctctcagtgataatgagggrgtgcagtgtacatacattaggtggtgctgtctggctcctgacttgttaatacagctttatgtcgctcacacctatggagagagagtgaaaaagca

SEQ ID NO: 20929 - DNA, 600 bp, Bovine  MMBT19048
tctcaaagtcctacagtctccagggtgcttcataccaggtgggcacagatattggtggctctggaacagttcttgggaatccaagattwccctacttagctaatgtgctttttttatccaaagcaatcggcactccccatgatcagattccagtacactctttgaagtgtcatccagttgattatcttctatactcacctttaaaatacttggactattatatgtagtctgtgtaatgttttacctttagagaaaatttagcatcctttgaagtaaggtttcagaaggacctaatcctcyttttttaattccttgaatattcttaggcatgggtttttgtcattgagtttgtacaattttaagttttaaaagaatttagagctgcagttaggtaatacagtttcacaattttggttagtacgtgtggaagtggtatgtaaaggagtcaaaatggtataataaagtgggacgtcattgagtgtaaatctttttttccttcataccttcttagtccaggtccatcgtgttggctaatacaaagatctcttttttgtaagttataatttatattttgtcaaatgtgatgagagtaatctgctg

SEQ ID NO: 20930 - DNA, 568 bp, Bovine  MMBT04492
aacatccaggctactacatactagctgtgtattgtttttaaataaactaagtacctttatctttctgtgacctaatttctgatctttggttgtttggttatttttttctttttcctccctcacgcaccctcctgcccatatataaaacaaggggctgagctgaatgaccttaaagtcaatatggagtaatgaaaagacatgggcttagggatctggcaaatggggttccaattgtacaatggatataatacaattactatggggattaattagtaaatgtacataaagtgactattattrtggataatccttaatgggaagtgggtgaatgatctttccagtttgcttgctttttattgctatttttgttgcttttaatctgttttctttcccatctctcttactttataattcttttttcaaatgatatcgaacctctagcatggtctccttgaagctttcaataagtagagatccatatgtacaatactctttatattgtaaagtaaaaattcatataatttaagggagatcactgatggtgattgcagccagaaattaaaagaca

SEQ ID NO: 20931 - DNA, 600 bp, Bovine  MMBT20684
aatattcctcagtactaatcacctgaaacttacaagttggaactattgagaatagaactctgagcttgagrtaaagtttaaagaaattgatgaatgaatttccaatagtcagaatttgggcaaaatttaacacttcatatatagcagttgtaaaattagttccttgacagaaaaaaattacaaggctctattatgggttcaacaacactccttagtgggttagcaattcattaattacagcagcatcactgaatatgtttcagtaataagrtactttattctgtctgtaaccatctttayataggtatatggaattacatattctataatatctaagaatgtcttaggctcttctactgataaattgggaacaatggatgtgaattaattaaattagtgaaagaattctggacacattaaaatacaaatgtctatttctcatacatgcatcaaatattttaatcaaaggatctcttgttggataatgtgaaagaggacaacatagtaataagactatttgagtacattttctcttttgaactgttcttgttcttagcttcctctgtgcatcatacaatactccaaaattttaatgaactt

SEQ ID NO: 20932 - DNA, 600 bp, Bovine  MMBT13642
atggaagataaaattgagaaaggcagtggaggttagaccatgtgggtttctgaatgctgtgttaagcaacacagagaatttcctcgtggtccagtggttaggactctgagcttccactgcagggagttcagggttagatccctggtcagggaattaagatcccacaagccatatggtacagccaaaaaaaaaaaaaatacagactcaattcagatcttatcccctctatttccctcagtggatgctgagttttttcaatcaggaaatgttaaaatatactcaacataaaacacaaagccraactctgaccttgaaacaataattataagattttcaaatcaataactgtgattcataaaaacttgcttaagttattccattgattaaatgccacagagaatgctgtgaactatttaggtgttagatatctacagtgcttgtcttctaaaaatactcaatttgattaatgtagttaatctagttttttaaaaacactttctgtatgcaagatactttgttagcctctgggaaatacagtatttaaagctttctgttctcaaacagttttgcaggttacaagagccaaggcagtcacaaaac

SEQ ID NO: 20933 - DNA, 598 bp, Bovine  MMBT03871
  misc_feature (1)..(117): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagttggtaaaagttccaaggatagaagtttatgtttagaaggaagataggtagatggttttaaaataaatggtgcattgtggttgaagacatttttctcatggtagcagtctttattcatggaaggaggctttacagactctaacatatcctggaaatctcaaatttatgatgaggttactktgtggaatgttgttaaaaaattctgtgcattttcatagtttaamttattggctatttaaaataaaggcatgagcaaaatcttgacttatagaatactgggttatgttatcacttcattgtttcattcattatattsatatccamaaggaaaaccaataggaaacagctttaacctcagtaacattattctayttttgtgtcagagccctctctaaataaaagtygcagtggtagcaaaatagatagaaaatttatttcacttttcctagcaacattttgcttattcattacctaatta

SEQ ID NO: 20934 - DNA, 600 bp, Bovine  MMBT01058
cagtgtgagtgcccaccagtgcccaccactgtgtacctaatagatggcacatgcgtggtttcaccctccaatcacacgacacttcagtaaacctccctctgggtcacacgttctctggrttcacctcggcctccccaggcctggcacagcagcaacatgtgacatctgttgaaccsattgaaccaacgtgaagagaactagattgtttgtattttaactttccaaccagctcacaggctctaagccatcacaatcctgatcttaaagctcctcacaagattccctctaagattttgctcyrtacagttggtatacartgagcatttgagaagttacatctgcatatttactggcatrtctctttgcaaatcttcagtttagmgagctgaaatgatacctgtaactcctttgttacttgaagttttcttttttcagcttgttcaagtttttctttccacattcttttcaaagaaaaacaaaagtttaaaagggttaaaaaaatatctagatatataaatgattaagaatcaagagataatcaacaaaacttagaaaaccactcaggagtattcaaacatcatggtctggggatgagctgct

SEQ ID NO: 20935 - DNA, 598 bp, Bovine  MMBT18919
  misc_feature (1)..(136): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatttggctcactaaggtagtgagttttccacatttgattattttggactgcctttaatataaaattgttagtttggcttattctgtgsaatcagtatctaaatgggatttgacttttaaacattttgaggggaaagtaaaaggagtttatactaccttcayttacttgctttttagttcatagtttatggcttattgtacaatgtaagtcaattgaaagtattgtcrttatagaggctgacaggatagttctggctgggacccacagaatggttgtaccttgtgaagaactgagatctggggttctcactctyaactttgcacatttagraactgaaaaatgattaggctttttggggagatgatttatattaatcagactcacaaaagacttactcattcactgtcagtccatttgacatactttcactgaactgtgtgctggcagctcttatgggat

SEQ ID NO: 20936 - DNA, 600 bp, Bovine  MMBT20533
tgctaactgtataaaatcttcactgtgtcatgtggatgtgttacagaatctagctttttctgcaaaatggtttctaaacatggaagcatcttatggggactattattagcttagaaactgactggctctaatttgaataatgtgaaatatacataagaaaagtgaacaaaatcccaaaggttacttttggttcaaaacagtactgtggcttcttttgtttatctcctttcgttccccagaccttgttaaaggagaagacaatagtaaaaagctagaaagagcacgagagacaaagcggayagacgagtagtaactaacctaatgggcctgggaagttaaatgctaagtgctaagtcacttcagtcgtgtctgactctgtgcgaccccatagacagcagcccaccaggcttccccgtccctgggattctccaggcaaaaacactggagtgggttgccatttccttctccaatgcatgaaagtgaaaagtgaaagtgaagtccctcagtcgagtccgactcttagtgaccccatggactgcagcctaccaggctcctccgtctatgggattttccaggcaagagttctggagtggggtgcca

SEQ ID NO: 20937 - DNA, 600 bp, Bovine  MMBT05800
agcctttatataatggagctaggaatcttggccccagacctcatgctctaccattacatcatattgctttgtctagtatattgaaaatctcttcctatattttttaccaaattggctaattgaattctcattaattgtattaatcatagtgcaacctcttttatctgttcaccaaatatttatcctatttgtatgtgttgtatcagctgtatcagagcctatttgtatcagttgctcttaaagttgttagaagtagtgaggtctgagattttttttttagtgggtaaatgggttaaatcytaagggaaagatttactatgaagtcagtgaaacttaagcttcatctgcacaagagctttccaaaaccctgggagtggtcccaagtcaatgttagcattgtcaaatgcttttgtaaattaaaaaaaaattagatatcattaacagcaataggtcaagattgctatctcttactacatccactcactctctgtcacactttcagtattaggcagcattggagtggccagaattattctggggatccagttaaagggaagtggagtcaagaacacattcagcttgagttttgcataatatata

SEQ ID NO: 20938 - DNA, 601 bp, Bovine  MMBT11307
  misc_feature (1)..(1): n is any nucleotide
naaaacccagatgatgttctttcctgttttatccaccagaagcccaaatattggggacatgggagctgatattacatatacgacactgcccagaaaatacaaaagatacttaataaaagatatcrcagcaaaaaaaaaaaaaaaaatccaaaagtccttaattctaaaattcctagctcatttaacattcttctaaaatggtcatcagtaaatagaaatataaagatataaaagtgatccaagacttcgctggttttccatgaaygtaaagatggccattttcaggatcaagacccaagayagacttggtttcacactatagacrttagctcacataaatcttytctggctctaacacgggrttataactaaagacccacactaagcacacagtaagcattcacagaattaatggaatacctgttaatagcactggctgcctgggaggaaaatccaaatttctctgtaaagaaaactctaaaatagagaggggggaaaaaaataaaccctttagagagaattattctgtttttgtaaaaataaaagcaaaataatactgaataaaatagtcaacttccccttctttctgaactgttttccc

SEQ ID NO: 20939 - DNA, 600 bp, Bovine  MMBT20008
gtaaaataaatggatttgttgcacagatcatgttaattcgaaggcgcacagcaatatttccgtttttaagttttcagttcatttagtgcagtgaaatctatgactactatcttcttcaaaagaaacttttaacacacacacacaactctttcagggagtacacatggcaaaaacctggatagtataaaagtatccaaactagttagaaattacaaaaacatattttattgaatccatatgctaccttctacattttcacagagcttttattaatgatccaaattcagtcttcaacaacayaaagcaacagttgtcttataaaggttgtagttaaacacctttactctttatcttacaggtgcactgagaaaaacacttaaacagccagtgtattaaactgttctcatgcctagttaggaataatggactttcttttctctggaagtggtctttaatggcattattgttatgaaaacatttttggtaaataacagtactaaaatttgtgttataaggttaaattagcaaaaattagattacctggaagggtcctagacataaatcagtagatgaaagttttttgtttttttcttgaagagg

SEQ ID NO: 20940 - DNA, 598 bp, Bovine  MMBT01009
  misc_feature (1)..(108): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttctcataataaatctaagaaaactgtcggttcaatcagatgttattattttacttaccttcctgtgactccacttgtgtagtgggcatcactgtggctgttggggtagtagtaggatttgtaacagttgcaggtgtaaccattgggcggatactagctctgggtgttgacttattcccagccatagcygcagctgtcactttacttggcgtagatacaacaggggttggcttgatattggctgttggtgggtctgacatgctggcacttatrgaaagaaaaatgtgaaaataataattcacaaaaagtactacaaacattccttataaagtacaaatactccaaagaaagtaaagcacatacgcttactgaagtgaatgtccagtaattattaccttaatacacattcaaactgttttcctaacactgctttgagtagatttttggcagattaggaaaaaattaaagrcagtaaatactattgttc

SEQ ID NO: 20941 - DNA, 600 bp, Bovine  MMBT15602
cacccatgtttaattaatcatcagttcctattgattgctcatcagtaactgattctcccctggaacattgcaatagcctcctaactagtttctctgtacccactattggtaaatattactaataacgatgccaaatgatgccttacytatgtgagtatactgctgaagactctgccatttcttctcattgcttttatgtgaaatttctaagtcctaacaaatggaaagtttgtcaccactttgttactccagcttagttaagtattcagacatcatcttcagggaatttttttaagccartgagtgggtttttgttatcatattgctttacacacattttttgtacttcactttcatatattacaacaattagtatatcattttctcattccatctagaacacaatatttatatattgaatattttaattaaaaatttaatagctaatatatgaaagagtatcatgttgagatatgaagttcacaacagctatttgttttctgtttcgtttaacaaggagccagtatttgtctgatttcttagttatgagataggtctgggtgggtgtctgtttctcagattgtcagaaagtagtggggg

SEQ ID NO: 20942 - DNA, 600 bp, Bovine  MMBT11561
cagctttagctctccactgatctcttcactgtggycttgcctagaggatgaagcaaagtcttcagcaactgtgctaaaggcttgttctgcctcattcttctcagtgtgcaccatccttaccatctgagacttatgattagttactcattaggtaggctattataattcataaactaatatggaatcatgaagaaaatggtttagcctttactgaccatttctaacttctcatgttaaaataatttctgacctcgtcaacacagaagggagctaaacagaagcattacctcaagatcgttycattgttcaaacagagaaaccataaccaattacaattcctacagcttgccttacacttcccattctcaggtaacatgtattaaaccacaattgttttagttatgatggaaagggtcagtaacacaatcttcttaaattctactcttaatcaggccaaaataaagggcacaggcttctgtctgacgccaatttaattacatgaatctgaacatgccaacttttaatagttagcaaagtaaatcttccatgtcctttaagactgtaaatgatactgtgaagttatattgaagggtataacac

SEQ ID NO: 20943 - DNA, 600 bp, Bovine  MMBT19295
agagacctagcattgggtgtgagagtgaggcagttgtaaacaggtactttaatagactctgtccccctggattcctacacacaactctaggggaatgtggcttctccttaccttcagctgttgagaatcactgcttgtgatgagaactattactgatgtggagccagaaagaagtccaatagccactgtctcaggaagaagaggagagctggtcacctgcttctttgtctcagttatcttcttggcctctggctatacacttaaggtcatgttcagcccacctcgcacctcaaaaatacycaaaacagctgttcaggaagtaggggtacatttaactttcttccaacttgattttcccatctgaaaatacaaagcaagtatgagacacggtgaggcatacccatatctctcaggttttatcattttcagtgggctccacacatcttccaactgccattatctacaagctggtgcttgaagactttatctgaagctctggaagctcactaggtccaagataacatggcagctcagcagttctagaaatttaaccaccctgtcccacagccccgagcttccttcaaccaatgaatgatggga

SEQ ID NO: 20944 - DNA, 600 bp, Bovine  MMBT02889
gcctccacttgagattgctataagtataaaatacacagtgaaaaataaaaataaaaaaataaaaaaaataaaataaaatacacagtggactttctaagacttagtaaaaagaaatactaaaatatattttaaaaaatattgtttgtgtgttgaaatgatacatttttggatatattgggttaaaatacattattagaattaattttacctgttcccctttacttttttaatgtagatagtagaaaattttatatgtggcttccattatatttctgtgagaccaacctgatgcagatattyatgacaatccccatagtccatagtattgggtactgagaactccagtgttccatggcatttatattaagcccatactgtaacagggactaaatctatattattgggttatgacaataaatgcttttatgactttaggaagtaatctgaccactttgtgactcagaaaacagatttgttgaccaaatggagttgctgctaagctgctaagtcacttcagtcgtgtccgactctgtkcgaccccatagacggcagcccaccaggctcccccatccctgggattctccaggcaagaacactgga

SEQ ID NO: 20945 - DNA, 600 bp, Bovine  MMBT03889
tgaactggtacaacacagagaaatgcaatgctgtctttccccattttttatctgttattaagtatgccaatatacatcacagtaaagagcaagaaatgtttacagcagtctgtgaattgaaaagacatgcatgcacttcagcatatggatctatttaataatataaaagtataaacattgttaaaatatcaaaattattgctgaagagactaatggtcatttttaagggaatgctgtttttaatcacacttttaatttgcagaaatagtgcaaagagagtccagagaattctcataaacycagagcagggtttctgctgtcattaacatcttacatcatcaggattcatgtatcaccattattgaagaatgttgatatatcattgttaactgaagcccacactgttaatacttctgtaacttttgcctgatttttttttttttttgatcccagcctgtactctcaaggaccacatcacatttcattaggctcttctgggctatgagtttcatgcactatccatgttattgatgaccttgaccattttgagtactgcttaggtataaagcccttcatttggactttgccatttttctcatg

SEQ ID NO: 20946 - DNA, 567 bp, Bovine  MMBT12328
agctcgtcttagctggagcacaggggtgcctattctgtgaagcaataagcagtctgccatgtctggcaccactggagctccaagttagtcatctgtaggaaaccagccttgatttccattttgcagagagtgagtgagcargaagcacaagcacacaggattgtgtctgttctctacttctcggttgtcatggcaagtattgcaggtaacagacaaattagacactggggaactacacagtaaagccccaatgattggtagaacttgctgtttatggtgattagaaatacaaaatacatyaaacttcactgaaactttgaagaaaatgctattttaaaagsggagaaaaagaagatggaacgtcaacccctattctgtggacatgaggggctgtcctgacaccttgccgttaacttctctttccacctgcatgcatgctgccatggtataaatgattaatgctggaagggtactcttcatactgagaccagtggattaagaagtattagtaagttgacttatactcagaaaccaacacagtaagagaactttcttatagcaaatcca

SEQ ID NO: 20947 - DNA, 598 bp, Bovine  MMBT11173
  misc_feature (1)..(29): n is any nucleotide
nnnnnnnnnnnnnnnnnnnnnnnnnnnnnagaatttctggggccctggagagctattttctagggatacctttaatttccttcgctaactcccagttcctccatcactgtctccagcttctcccacatgatgtcttgcccagatctgcatctcctacactacaccctctaggtgtttccaaataatccaacctggagtagcccaaggggcttagtctgtgagcacacacccccctctactggacaaaacactaagacacacgcacagttgggaaaggatcacagaattctccagtacaartatcctattcactaccctyactttgcacaagagaragacrtgacaaaaaccaacagaatcacagaaggaactgaaggcaaaagctctaactctgtaccattgttatcccgtgctgttcaacagttcaactcacaagaacagacgactacatgactgagctcatggaggtctctgagttgaaacattctccaaggtgcagccatcagtraagaagyaaggtattggttgaaagagtcagaggagctggtctctagttccagttctagcatctacaatctctgtgatgctaagcaagaca

SEQ ID NO: 20948 - DNA, 600 bp, Bovine  MMBT01479
aggagcccactttgtcctgctttgcctggcaaaacaataatgctatccttttctacttcaccsaaaactctgtctccaagatttgatttggcaatggtttatacaaagactgaactttgggcatcaaatgctcagtaattggtggctactgtggtgtatgtaaatcaaatacaayacacatgtgtatcatttattaactactccaccttatataaggatttgagagctatatttaatgtacacattcatatgttcatttcatgtttatcagttatcttatctgactgattcagatatcarttggcattctgtgatatcctgttttctacatcttcatctttaaaactagcaataatattaaattaaaagaaacatgtaaaccgtggtaaatatccagtttmagtaaactgaaaaacatgttaaacaactctaaatagatagactttttcttatctttttcttcttttaaacaggatacatgcctatacatgtaaggctttgtcttttttaaagttaattgaattttttggtttgtgtaaagttaacagagaagatataaacctttataaaaaaatcatactacacattttcaatattctc

SEQ ID NO: 20949 - DNA, 600 bp, Bovine  MMBT08145
ggcttcagtagttgtggcccatgggcttcgttgctctgaggcatgtgggatctcgtcctggatcagggatcaaacccacgtgtcttgcactgattgctggattctttaccactgagccaccagggaagccccttgctgtcaagtctttttaccttaccattttccagtttattaacagatcaaaacctactgtggagataagggtacaaatcaagaacttttgcagctgacattgtagggagaaagttaatgacggaaagatatttgtgtcccaacaacatcgagatgaaataaaagacwcctttctaagggaaactgaagaataagaaggaagtgttacagggagaggctggaaggagtttaaaccatagagtggatcctctactgaatcaggattagcaatggtgacttcacaatattttcctaagcttttctttactggagcaatggcagaaaaaaattaggggtaatgctctaactggcagaatctgtcatctcacagaaaaaaatgtacttatgtgagatgatggaaattaactgaacttactgtgatcattttacaatatatacatgtaacaagtcattgtgttgtacatcttg

SEQ ID NO: 20950 - DNA, 600 bp, Bovine  MMBT18098
gaaagaattaaaaataaaacatcactttgacaaagaaacctaaacagaaagaaacacgagaataaataaacacaactgatcacacctaagagaagcagaaggtggagagtaaaaacatactaagaatcagaaagaaaaggcttctcctttctgggaggtaagctgttggtcagcacgcctgagaggagacttggggtgggcaggaaattgtctacatgaagggggagctgagcaaatcaatacactgaaagttctgggtgaggcttctcacaggtgagaggagagttgtaacaggccaasgcggggggcctggaacaagcactgtggtatctgcttagaactggaggtcatggggttagcccaaggtatttcatatatttaggaagacagaaatactgaaaagatacctttgtttgcatcactgtatatgccttgtaaacatactgtccagctctgttttctgagagggactggatgcaatgtcatcgcaggagccatgagcgtacaaagcatccaggttcggtttctaattattattctccactaaggggaagcaccggtcacgcaggcactgaataaatcttctcctacagtgagaca

SEQ ID NO: 20951 - DNA, 600 bp, Bovine  MMBT08078
aagaaaagaccctgatgttgggaaagattgagggcaggaggagaaaggcacaacagaagatgaaatggttggatggcatcactgactcaatggacatgaatttgagcaaagtccaggagatagtgaaagacagggaagcctggtatgctgcagtacatgagatcacaaaaagttagacatgacttagtgactgaagaacgacaagtccatgaatattttgacttctgtcatgaatgcttggagaacccacagacccaggtttagaacccctggaaagaactgacttcttatttctttctrkctagtctcagaactctaggcttttgattttggcactttcttcccaattacccctggattctgccttacaggtcatgactgacctaaatgtagtttaaacctcatttttctttcccccctctataaagattctcttactttcatagagataaacaatatgtttcaaattttactctttttacttctgtaggagccatttgtattatattagaagaactctttttattataaagatgtggtatcattggccacacagtgaagagtagaattataggtttctcctcttttataagatcttag

SEQ ID NO: 20952 - DNA, 600 bp, Bovine  MMBT19949
atccaagtcctcccccgttgcatattccgccgccacctcgctctgcccgactcagccaaaatctgaccacagcggaaaagtaacgtgtaaattrcctgcgctccctccatacgtaggatctgcggccgctaccacagtccccaaaccgccgctcacccccctccgcgagcctcgacagccaacagttgcgccacgaaacagcaacgcgcccgagtcggttccgcactccctccgaactcggcacctcacccgcgcgcgccgcggccccccaacgcccccttcccacacgcggctcgcagrgacgtacttgttgtggggagtcacgttttgcagcatcttgaccacggggaaccggcgctgccctcagccgcggaaagtccgggtggcctcggttccccttacctcccggtccagcataacccgggaagtggggggagggcgggggccgctgccctcggccctccaggcgacaaccctaccccgccgggctggcacgaaagcaatctcctccgctgtccctcggagaactcccagcagcttggcgcgctccgcaggaggcggacagcgagaaaatggcggcggcctcagctgaggcgggcg

SEQ ID NO: 20953 - DNA, 600 bp, Bovine  MMBT19014
ttcatcagccaccatacacctggaaaaaaataaaaataaaaccaaattaatgtcttaattaccaaagtcaaccatttaaaaagttttgattaagcgttgttaagtagcttgccacaaaacagtttacacattatagcactaagccagagagaggtgtttataagtgtgcataagaataagggcctttcctracttacaagactctccagctgccaacggcatatggttatgtgggactgttagtttcagatacgctgtttcccaatgcccacccatgatgatagctacaatgacccttcraaaacgtgagcaaaacagcaagtgattgtaccaatgacttccctccttaccagtaagtaaggtttactggtctcccctagagattagacagatgctgtattaaagtgcattaacatgttttacaaaaaattatattaatatatgctatattatacatgctaggccactttcaagctgaattttgtattctactattatttcactaaattttctcctccctattctttcttattaacctacagaagtaaattctatccactggaaattgaggacaggggcataaactaaggtcataattag

SEQ ID NO: 20954 - DNA, 600 bp, Bovine  MMBT23243; identical to SEQ ID NO: 4561

SEQ ID NO: 20955 - DNA, 598 bp, Bovine  MMBT18204
  misc_feature (1)..(74): n is any nucleotide
nnnnnnnnnnnnnnnnnnnnnnnnnnnnnnnnnnnnnnnnnnnnnnnnnnnnnnnnnnnnnnnnnnnnnnnnnnattaaaagtgtattcttaaatagtttcttgattaagaacaaatgcctcattaatctggaacatattgacttgagaacacaaggtaagtcaaagaagtaatgactgacatgacatggaacacaatatgctgtgttcccattgcaaaagctttagaagaacagactccccaaaaggtcactagatacagcgaattgaataggaacccagcgtcacccaaagatgcaamggtaagctttcaaaaatctatataacagaggacattgtgtgcctgtatcactgaaacttttccatctatagattctgagtgcctcacatttatttcagaatgaaaaaacccaagatctaaaaaaactaacataaaacatatttgcatataaaaaataatgacatcaaatttttaagaaacttggtgtctgtttaccctactccatctctcaagttttacttaaatttgtgaatagaaatttaaagccaacacaaatagctttgaagataattctaacaacataattggatgtggattc

SEQ ID NO: 20956 - DNA, 600 bp, Bovine  MMBT07963
gtgcaggtaagttacctatgtgtgtcacactagatggcccacaagactcccctcaaatcctattcattcatcaatcctcatatcggccctacatctctgcagatggaaaaccatgggcagacagaggctggacactatgtggacttccaggccacatagtggtggaaacctgatttgtctctcccagcccagtaccctactcaytgcacayaggatcacacttccccatggggggaagtagtgccacgtgggcactacagtcctggccactacccagatagctccattactyaccgagayagggaaatagtcttttacgtacttccataagatccaggacctgaaggcctggatgtcctgcctccatgccatggcrtgtctctgtccaggtaccaccaggtggcatacaggatagtgaagatccagaatcttgtgaacaggaggcctatgaagaccacatagcagataaaggctgggaagggaagcaggagcattagtgggcactaatggccagggtgaaggatgcactctccccatatgcccagcactggcagcastgtcctgtccagccctcaccccrgggggaacaggtcagcctcc

SEQ ID NO: 20957 - DNA, 600 bp, Bovine  MMBT21917
tttatcccacttagaatgtattttgctgtgtattatctaaggtaaaaagataagtttgtttttccaaagagttaaagtcaactgtcttagccctgtctttaaatttttttctctatcttaaacactattaagtgaatttattatctaagaaatcctgattaggcaagctccgaagatgaatagtatccctgaataggtttctaaaacagaagagtatttacatatcacctttcgtcttttgacagtttccttatttttcttgcctgctatatcctgttttcttctttgtgacaagggagraaagttagacaaacttgtttaaaattggttatatttcctaacaccacatactatttcagatagtgatttataaatacattaagtcagtttaacatctttcccaaatgaccctgactgttcatgatagaactactgcagatccgttggtcagatcttaagtctgaaccttgactactcaataaaggcacaaccagatgaagtgggcagtgaatttggtgcacatccttgtcacaccaaagccttaataatgttttgaagttttaagtcctcagagacaaaaacttacaatgactcaccagt

SEQ ID NO: 20958 - DNA, 598 bp, Bovine  MMBT05834
  misc_feature (1)..(145): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgtgctgaataggctaatcaccaaaactgttattaaataaaccaacaatttaaaaaaattcttgagtcttatggtgattggatgtttctgctgccacagtgattaaaagactctgtgaattaactgttgtatgctcatatcctgagtggtaktggtggaggtcaatgagggctgatagaataaaaataaagtaaaaaatatgatttcagaatgtgagtttatatctagatgargagactgaataaccgtgtagtgctgacagtraagtgcagcagttcagggaaaggcaagataaataactgtgtgggccagagctgtccatcagagaggaatgagagattttagaagcatcttttcattttagagaacataaataacagaagataagagtttcagccaaataaaacattcttcattggggaaggagttaggtagaaaatgtaagaaata

SEQ ID NO: 20959 - DNA, 600 bp, Bovine  MMBT05521
cacctgcaaatcatataacttggtcaatcacttcacaacctctctctggctatcacaggctgggcttcacaatgcctgatacagcatattatgcaatgatgttccatgttgccagtaaaccatggctttatgccaccgttccatacagcagctctatttagctttatttattggatttttaaatcctcttgtacagtaggcattgatctctcctgaggttgtgattatagctttaactattgacacttctatcagagccaacctcaattctttgccttctgctgacaagaaatggtaatyattccaacaccgcaatctctgaatcttgaacccccgtcccacatactttgccctgcataaagagtacacagatgttggttagctggtttcctcagcaaaatgtagtcttcaaagagtaaaggtaaatctgtaagggtaagtctgactggaagcactgaaaatgctctgagacacayatgcatttaaaaagctgccttcttcccactcaaaaatttcatgtttgtcattatccacctggagcactgtctgtcaagttattgaagtaattgacagtgagaactttcttagaagagattctac

SEQ ID NO: 20960 - DNA, 600 bp, Bovine  MMBT19282
gattccagcaccattggacaaggcatcctgaatgatacaaaacagcaagacactcattttcgatttgggggataaataaaatcctcactaaccttacagcaaacagtcattaaagttataataactcctckagaaaggttaaaaaagacagaggacattccaaaggaagtgtccagcttccccgagagctgcttggggagattcataagggagccctgtaaacaccaggagcatcttgctggctgcacaggtggctttgcatggtcaaacacattcaaagacccgacagggaagcgaggygaatgggaaaagcctttcacattttttaatcttctgtgttgatttatcttcccctgtgctgagagtggaagtaaggcattctcctcgcctcctcccaatttcacctccttcccaacttgtacatgtgcgcatgcacgcatgcatacacacacacacacacaatcaatttaaatttataattcattggtgttcctcttcattcaggtttcagtgactcaattttagggaatgcaaatccatgttcttatgccacctgccctggctcagtgatcacttgtcagtaaactgactttaaatgaa

SEQ ID NO: 20961 - DNA, 600 bp, Bovine  MMBT12706
tgctgaactgaacctgattctgatttcactacaatttttataagaagaacaaacagatgtcttaataaaatgaccaggtggcttataaacaaagaagcatcatcaagttttgtgtacagattaaaaactatacaaaacagctatagaccagcaatgggttttactattttttccattttgtgtacattcttgtttaatacacataattaaatgatcgttttgttactaaaatcttctgactcactcattaaaatcactttattttcaaaaytgttgaactcacatttcttaatatgtaaytcacatttagtaatctgttgtttatctcagctttcaaaatataattaatctgtactgatctacttgacacacaaaatgacttttggggaactgtcatcattaggctggcattgccttcttcccactaaaactctactttggatttaatttttttaaaaaagcttacaracaaaaagagcatatctcttgaaaaataaagaaatattaattctaataataaagaatrtacaaggctccccaaatcttggctcattttgacattggaaaaaatagatcattagagcacaaaggctacattct

SEQ ID NO: 20962 - DNA, 600 bp, Bovine  MMBT01615
gaagagcagatccaagaggaggcaacaaaacaggaacttatttaaaataagtataagacttatttcaaatgtttccttttaactctaatattatctattaagaaatcatgcatagccaaaaataataaactttataatcccacatattgaataaattattttattaaacataaatatgccactaaagcttccagaggaaaaattagagttttttttaatgacttgaagctgtaaaatttagaaaaataatttagggtagataaatatgcatactgtatgatgattccacttatatgtggratctaaaaaaagaatgcagatgaatgtatatgcaaaatgaaacagattcacagatataaaaaaatctactgattggaaaagaaagggaggagttgtaaattagggctataagggatacaaatactactacatataaaacagtaagtgacaagaatgcatgtatagcacttatagtcattgtcttgtaataacttttaatggagtatgatctgaaaaaattctgaattacagtgctgtacacctgaaactagtaaacagatataatattgttagtttataattcagatttaaaaagaagaa

SEQ ID NO: 20963 - DNA, 600 bp, Bovine  MMBT05605
atttcctacattgctactttaaggtattatgttattatgaaatgagtacgtaaggatccaatttcacaagagtgactgaggcgatatgtgtgcattttaaaagcgtaatcaaggtaaaattgagttcattttccatgaaaatttcatgtacagctactgaaagaaatcatttctggcagaggcattttaagggcaaaaagttgtaggtgcaaataatctaaatggtaaatgtatttgctctctcatcttgaaggtaaatttcatgtttttagcactaaaaattcattagcactctctttyccctcctccttagctcaactggacatcagcaaacctttgcataaaattttgaaccatcaccattgcaaaggcttctttgattcactcccagttctgcttggttcaggattcatatagaggatttgcagattcctcccgcaaacaactttgagggctggaactcattcatctaaagatgctaactgtaaggcctytgtgccctrtttttaacccacaagttcttaccatgaatccatacctcatttaaaggctttgtgtactgcatyttggcaatttgccaatgcacagtaaaactatctg

SEQ ID NO: 20964 - DNA, 519 bp, Bovine  MMBT07087
ggctcgacactactctcactttaatttatgttgacaccatccttgccatttgtcaatgaagtaagtaaagagcatccaggaagacatggactgaatacatggcatgaggtaagagtatattcaatcaaattaaaacctcagtgttttgttttaaattacatttttaaggtgctgctgctgctaagtcgcttcaatcatgtccggctctgtgcgacccgatagatggcagcccaccaggctcccccatcatttttaaggtggtcctcactaaattccactttatgtaagtggaaaatatgraagatttccctgagatctgatgaaaggagtactagattacctataaataagaggcatatgattcacagaccatcagaggatattcctagttatattacactgtattatatttttctgtagtgcttactatgtgttagaacatctacaaaatacctatgttattctgtataatcatgccagcaaccctatgaagtagatattttcctcctttacagtaag

SEQ ID NO: 20965 - DNA, 600 bp, Bovine  MMBT02504
caccaactttgatttatactcagctttaaaacatattaagtcttattctcctctcactagcagaagggagctgctgccataaatccttgatagtgccacttactttgtgtaaggactgttctggattgcatgacagatgtaatcccagctcaggggcaggaaaaatgtgatgggagaattctctagtgtcctctaggcaaagaaatgtatggaataggcctttcattaccaaggagaaattaagctaattcatttgtagtgctaaaattgtacaatggagaaacatttttttcaaagatytagccataaacaaaacaaatagaacattttttaaaccaataggatccaagtammatcaattacagctgctcagaaataattatatttgcaatcatattctacatattatgatgcatatcagtttttctcatttatatcaaagacataaggagtctgcattttccaaaacattaaataaattaaaaaaaaaaaaaactaaaggtctgatgaacatgacttagatcatgtttaaaatttcaatatgatttatttagtaaatacagaatacatagtttatcacaaagtactacacagttttta

SEQ ID NO: 20966 - DNA, 600 bp, Bovine  MMBT19167
agcacacagcccagggatgcttattacacctctgaataaagaaaaaatacatgacaaatgatggggtagatagatgatcaacgatactttcttaagacaattaatgtctcttcactaaaaacaaacttccttctctactcacagatacatccccatacttcactcaaccaaagagaattggaacttagcacttctccatttttctatcaaccaccactcccagatgcagtgcattctggggacctcccatggcatgctaagccacagggaaccttgccctccctcccacacctgcagccytttcttctgattctttytaggaccatcttctacaagaaaycccaastgtcagacctagaaggtccatgaatgaaggaaccagccctggtttccacctgcccacrctgacccagctgaagaaggctgaagctcacaacaaatgaagcatctcccgtctgattgcttcctcactgcctgtctgacccaggctcaggaagcagatgaaagtgaggacaggatcattaggaatcaaatctgtacaaatgaggttgcttacagcagattaaaaaaagcaactcagggtcctttttctgggtattg

SEQ ID NO: 20967 - DNA, 600 bp, Bovine  MMBT11182
tccctgcccccgtctgtggaaaaactgtcttccatgaactggtccctgatgctaaaaaggttgaggactgctgtcttaagagtatacagattcttctcttccttcctactaacagaacttgacataaatgcttgctaccagacttttatccaattgataatcattactattaaaacaacctgcaaccctcatctgcttccttactcgttatatactttatttatctttctccttagcatgaaccactggataatataccataaaatccatctgttattagctgctttccccaactagaaygtaaactccacaagagcaggaattactttctattktgttctatgccatttckcctacacctacaatagtacccaataaaataataaacacttaaatttattgaatgaatgaagcgtataaagtgtagtgcgtaagtcattgttaagagtgggggaataggaaaaagaaagaaacttggactgacagcctaaagactgtggagaaaattgagacccatccatgatgaacaaactatgatggacaacaggcaaagggaagaccactgataacacttgcgacgggggcagagataagggaaag

SEQ ID NO: 20968 - DNA, 600 bp, Bovine  MMBT04388
tagtctggtgagggtaaatatactaaagttcccattctccactagctattttgaatgtagcttaacacctggtttgctctatttccccctaaacaaatgtattagttactatgttagcatagtcagagactttccaagaaatttagcttcataataccaactaaaatagttctcttgagagaatgagccataaaatcacttttgtaaaagcatacaagttattttttgtacaattaaatttatctagaacctacagggcaaggggtaactcaaatttgtttttttttwwattttttttgkcatcaaaaccaacacaagaggtgacaagtcaaggccttaaaataatcatgttgatatttcaatgacagccttatccataggagaatacattttattttccaaatccactaatgtaaattcagcctttaccaaattaagaacattttaatctcctcacagtacactctgactgaagatttaggcaccttccaaatagtagtgattagtattcaaacattcttgcctttcagaaaatgcttttgaacaaattgatgtgtaaattgaacaaactatcagctccatctcattattaaagaacag

SEQ ID NO: 20969 - DNA, 600 bp, Bovine  MMBT02893
aaaatgcagaagtacaacactgctatatttaaaatgggtaaccaacaaggatgtactgtgtagcacaaggaattctgctcaatggtatgtggtagcctggatgggaagacagactgggggagaatggatacatataaatgtatggctgagtccctttgctgtctgcctgaaactatcacaatactgttaatcaccattgttaattggctatacaccaatacaagttttgttttgttttktttttaaatgtagaaatacaaaatactcaagatgggacatttagttccaccagaatgagaycagtaagcactgggagtgggtggggggtctgtgcagggttgtgcggtgtatgctctgtacgaggagggaagcactccactgaaatctaaattctaccttctcaatgtctctgcctcagcccctcatcttcacacttctgtgatcactagcatagatgataattccatgataagtctcatgcctggactacttttaactgtcctagattcccctttctgcagtcttgcttgtctcatattataacgcacattacagagagtgaactttccacgaacgaaaatctgagcacattgctgtatt

SEQ ID NO: 20970 - DNA, 600 bp, Bovine  MMBT10786
tagccaacctctggttgcaattgacaagggacgacagttctgacatcaatattgattaatattttcctttacacgaatgagtaaaacagaagtgaaaccacagagaagaatgccagaacctcactggtttgtcagcgacgtgaacaacctcattgctgaatctgaaaataccttctggaaaataagttcttggtttttgtgctagtcacagtggctcaactcgagacatgactcacgtttaaattaaacctgctttactaacatttcttccatcattaaatcaaactctgatctgcagcrtgtgccgatgcctgcgggtaagtgctcctagtgtggaaaaagtcagtgccgatgtgaagtcatgaaatgcactagggcacgtttccatcaagcatcggcatatgcacatacatacatcatacaagtatgacagacaaaactagcaccaagaccacaggtaacagtacactatggtagaataagtaggaagtgatgcatggcacagtggtaaagaatctgcctgccagtgcaggagatgcaggtttgatccctgggtcaggaagatcccctggaagagagcatggcaacccactccagtat

SEQ ID NO: 20971 - DNA, 600 bp, Bovine  MMBT14016
aacaaaactcatattggccttcattgtgtgcagtgtgctaagtcacttcagttgtgtccagctctttgtgaccccttggaccacagcccaccaggtttctctgtccatgggattttcctggtaaggatgctcgagtgggttatcatgccttcctccaagggatcttcccgactcagggattgaacctgcgtctcctgcactgcagtcagattctttactgctgagccactggggaagcccttggccttcattactggctggaaataccccttcaaaatccaaatggtaaaatatatcccrcacaatatctaaaaagtcagcatctctgcaaaaagaagamctgaatacctaggactgtagcactgtgaagtgattaaacatgcatatctggccttccaattatacacagaacaaaacaattttgtgctatatttcttgaaatgcaactatctgttatacaaataagaggtctcccttcacactagtttagattcttgaacargctagttattaacaagtcaaaatccagaaattaaacacaaccctcatttttagcaactgagtcaactctgggtggaatggagcactttccagaacagc

SEQ ID NO: 20972 - DNA, 600 bp, Bovine  MMBT01311
agcctcatacagttaacgggtggatctaggcccaaacccacctgcttgaacttattttcagaaaaggtagcaggatatatggaaaggtcagacttcagacttttgaatgtcacaggttggatgagttatagatttctcacctataaaatggggataatgatgccaacactgatgaactcacaaaagtaataaataagacataaaagacctggtagatggcagggagtcaataaaagttcttttctgtctcttctccctttctcctctgctgttgtaatgccaaagaagatgaagcttaayagttctatgaagacctacaagaccttttagaactaacaccaaaaaaaaaaaaagatgtcttttttagcacaggggactggaatacaaaaggaggargtcaggagatatctggagtaacaggcaagtttggccttggaatacaaaacgaagcaggacaaaaggctaagagttttgccaagaaaatgcactggtcatagcaaacaccctcttccaacaacacargagacaactctacacgtagatatcactatatgattaatactgaaatcagaytgattatattcgttgtagccaaagatg

SEQ ID NO: 20973 - DNA, 600 bp, Bovine  MMBT14259
cataataagcatatttgtgtgagaaaattcagaactcatcagctccatcaaagataaagtcatatttagtttctccacacgtcaacaaaataaagatatagcttcctaatgattccaatctattatttgttatcactagattcatgctttaaaaatgagaaatgttgacttcaggattccaatttcccaaaaaagctgcagtaaggaggctgcttctttagtttattgttacttgaggccactggagcttgctataacccgcttatgagcactgaggttggtacacaggcatgcatgctyagctgtggccgactgtgaccccatgggcagtagcccaccaggctcctctgtccgtgaagttttccagggaagaatcctggagtgggtttctatttccttctccaggggatctatctgacccagggattgtacctgtgtctcttgcatttcctgcattgatggtgagttccttatcactgtgccacctgggaagctatacagagctagagctatggattctttaataggcatacaaattttgtcatctgcctaaatgcttcttgcatagagagaagacaggatgtgttttccataaaatat

SEQ ID NO: 20974 - DNA, 600 bp, Bovine  MMBT08996
ggctactctgtccctgggatttcccgtgtttttcactttctaaaactgtgaaatctttctagtgctttgaaatttacataaactctatctggctagtatcactgtggaactgagcagggaccccatgggaaacttcccagaacacacacctccccttccacccacaccatgccccccacttgcctcttgtttgtagaaaaactactctcccaggactcccctgtgtcacaaatgattagaagaatgtgaacatgtagtagcaaaagttagcatctgggccaagagaactggtaacatttkaacaatagatcagtcatatagtagaggcacagactcttttgttcctctctgtaagacataaaaaactgtgtcaggagcatgttgttgagttgttttgcaaatattgaaacctccaccagatggagaagtaactgaataatgaccacatactcatagcccctagaccaactggatcctgattgttggtgatgttaacccctaagacatcaccatcaaccagtcagagattcctgcccaaggtgagcacacaacctgcagctttccccctcacattgcctttaaaaacrtttctgaaatcca

SEQ ID NO: 20975 - DNA, 600 bp, Bovine  MMBT20839
tatmgagtaaactgtcaaggtgacacaaaacttgtgagaaccaggmgatcaaacaccagagtccgcccttctagaccctacgatctacagcccccttctctgccatcgcatgaggacactcttaagaaagacttttctatgaatgaatgaatgaagtgatgatgtgagaaggacctcacatggctgctgatgctgtgtccatcaacagtaaatcctcccgcctccccgctccccrctccgcccgctgaggatggaggaagcatttagggcttgctgtccaatcctggaactcagtccaakgctctgcatattttaaaatgttgtgctgtaaaaacaggagaggaacaaggctctgtgaataattcaccacctcgcctcagagaaattaaaaatatatttcactgcaaaagaaaagtcgttgttatttgggacttccggggacttggacagaacacagttcctaatggaagaactgcattgatcctagtaactatttttttttttttttcccaagtgaaatgggaggtgggggaagtttaaagaaaagagtacatgttaatgccacactcaatgtagaagtgatttcattttcattttatg

SEQ ID NO: 20976 - DNA, 600 bp, Bovine  MMBT15918
gcaaaagaaattaagatgtatttctcatttttgataagggcactctttcctatgctctattaatagattacgtttttaatctgaaaaactaaccactggggttagggaagcccaaaggtaggggaaactgcccactttcagaatgcagattagaactttgaaattgcacccagatttttttttccttttggttagtaggcctctgttgttagagtagtagttgcaaacacatataggtttgccagtaaccaactcacaatttgtgcaaagttgagtcttcgaaactgagcaaatttgctytcaatttcccgccagcgcttgctgagctggatctgagttgactccactgccattgctgccccatcctcagacaagccctcagcttgcctatgcactgcattcagctcctctttcttcttctgcaactcacgatcaatttcctattgagcaaaaccaatacagggcccagggcagttagctaaccacatgaatcaacctatcccagcacatacctgtcccagaaatttcacaggctgtcttcattttattttcactgttcataagttacaagtatggaagccaacactgtcatcttcaagg

SEQ ID NO: 20977 - DNA, 600 bp, Bovine  MMBT02722
taatttctttgaattgactatcaccttcacaacatgtgatatgagatgcctttgcccggtaggaaaatgtcaagaattcataatcattttcatgttcttgtcacctttgttatccatcaattgaggcattgtcatctcctcagcaatgtcaatccctctttttctagcaacactacaactgtaactttcccaacagacatcttagaaaattcacatacttgctgagttttagacagagtaacttgaaatcctgagtgtcaggaataagaaacattctaaaacataggggtggacaaaaarcacctgatatgctttaataacattgttttgaatagctgcacatcttaagaaaactgtggagactggcagaagcaggagtctaaaatgctgaatggagaccagctcctttggatcaggagctggattaggatccagctcctttggatcaatatctcctgctgatattgattcagctaaatagccagacacatatttcaaatcttcaaagacttgggaggtagatgaccctaaattattttaactaatgttcatttgacattcagtacatcttaacccttcttgcacttacaacaataaatc

SEQ ID NO: 20978 - DNA, 600 bp, Bovine  MMBT00937
tttaaaaaatgatgctcacagtgtgaggataacgcgttagcagcagaggcagccagtcctggcatatctgggtaagacaccaagtggcctttatcattggaaccaggataaatacatacttatacatttttatgggttttctagtttatttctaaagcaaataggtaaatttagagtgaatcagttaatttcaaaatataattcattataaaaatttcccacctttttcccacttagaaagatcacagatgaggtgcatcttagaactgggctgggatggagctgagaggaagcctgtcrcttcatttgagggttagctgcacgggactcaccacaatttgaatattttcttctttcttgtgcacagtctgatgtccttgaggttgtctgtgttctttatggcctggagctatcgggcccattttaatttgactgttcacwttgtcctctgaaattatgaatarggaaagcatttagagccataggtctagttctgggggggaaaaaaaagctggctctattttctgaggttccttggctggttatttttcaaaccagaagacttcctttccatgatgtgaaactctaaattgccagaat

SEQ ID NO: 20979 - DNA, 598 bp, Bovine  MMBT08278
  misc_feature (1)..(4): n is any nucleotide
nnnntgataagctaagtttcctgaatcaagctgttgaatttgaacttcactcttacacattatgggtttatcttgtaggtgcctaagcctatgcatcagcctgtaggttcttcctctacccttccaaaggatccagtattgaggaaagaaaaactgcaggatctgatgacccagattcaaggaacttgtaactttatgcaagtatgagtcattattaagtgaatcttaaatgctagttatggggctactagcttctggtctgaagcattaaatgaagtcgttaagagcatatattctggwgttcagaatgagtacaaatctcagctctgccacttgctcactctgasagtttaggcaagttacttaactttctgcctcagtttcttttttgaaaaaaaaaatgaggataatagttcctgttcctgtttgttgtgagtaatgaaatgaattaaacatgtaagaagcttaaagtgctcaaatgatattgctgctatagctcattagtagtttctactcagactgggagaacctgtactatgcttggtatttgatagatgccattgtgtgtaaataatcatgacatttattgtcctcaaag

SEQ ID NO: 20980 - DNA, 600 bp, Bovine  MMBT22831; identical to SEQ ID NO: 4846

SEQ ID NO: 20981 - DNA, 598 bp, Bovine  MMBT01659
  misc_feature (1)..(26): n is any nucleotide
nnnnnnnnnnnnnnnnnnnnnnnnnnttttcccctaagattaaggctcggcttgcttaggattcaagggaaatgtatcctggtggttaatttcacagtctgaatctgtgcgtgctcagttgttcagtcatgtctgactctttgtgaccccatgaactgtagcctgccaggctgcctctgtccatgggattttccaagtaagaatactggggtgggttgccatttccagggaatctttctgacccagggatcgaacctgcagctcctgccctggtaggtggattctttaccactgagccayctgggaggtccctgatttcacagagcactctgtaaattcccattcttgttactttcaaccagctgctgttcttatgttcaacgtgcactgtccctagaagactccatcaggctaatctttgctgtcaggttttaggaaatccaagcgttgtacattttcagcagctggcgcctgtgtctgcaggctggcagctgtcacatacttgcctgccggtaaggtttggaatgggggtcaggcagtataagctctgccaaagacacctgtctgatgatttctgtcacttttgctttttgtctgc

SEQ ID NO: 20982 - DNA, 600 bp, Bovine  MMBT07723
tgtttcataaggttcaagctttgctccaggtcaaagtgatgcctgtccctggctctgtgtgcaaaagcccattgccagcctgggttttgtaaatcggtgagagcagtgtggtagggtttgggggttccgggggtctccctcatcttgtcctggggggcctttgctacatctgattcttctcagaggccacctaagtaagtcaacagtcccggtggactcccggatattttctgagcctcaccttgataaagaataaaaatgttttagtgcttgatttgatttgtttgctggaagattagyacaaaagcaggaaggaaaaagaatgtgtggtggaggtgattgctggagactggcagagggttatttacggatttttgctgacagtccttgtttaaaggaattccctgcgagatttatgaagcctttccaatttattgtctttccaagtaaggtaagcaaataaataggttattctcttttattatgaacctcgccaaagtaagattaaaaataagaggaaacagggctccatttttttttttttttccagcccagtgtgtttctggaatttggaaagcatcttgggaaggctttttgttt

SEQ ID NO: 20983 - DNA, 600 bp, Bovine  MMBT15621
aggtttttgtgtggataaatataagctttttatgaatgatttcttctttccatcttttaccagaatgtcaaattcagttacaatcactgttacatgaaggtcaatgtataattatcttctgtattaaccttatttgcctctcaggacaaagtctaattcaggtgacatagaacctgaatctgttgttttggcttttctgtcagtcttgtaatgtgatgcagtagttctacactgctgttttcatggcagaataaaaagggttgatatctttatttgggaggggagagaagtggaaggaayggtttgtgagtrwccttactttagatgagctatgtgagctcttgttaccctttctataccatgcctaattggatcagtaaatcataccaagctgaaagctatatatctwtgatcaagtgtgttttaaatatcttattcataaacagagatttattcattgaggctgcattatttggtatttctatgtgttatataaagtagaacatcaagaaaattaagtcagaatcagacaactgttcaaatactagaatatgcaaatgttagaattattcctaataaagagctccgaatatgagataa

SEQ ID NO: 20984 - DNA, 600 bp, Bovine  MMBT18190
cccaagtgattctctgatcaatgaggacacagctcattaagactatgagcaatcttatggataggggacagttgccaaatttcatcatctttccccacggttggaattttcacccacagttcttcctgggcagcatgtgctgtgaggtccgatgtcagagtcctaggttcagagtggcattcccatgcgcacccagtacgctatctgagtgatatgtgatggctaactgactttgggtaattcgcttctcttctctgagtctcagtctccccatctataaaacggaggtgaccactgtayrtagctataagacttgtgaagattcagtgagagaggtgaagcaccaggaacacagatggggcttagtcaatgttgagtgcctcacttgcttttccagtggaatcagctctcttctgttctgccatttccagctgggctaaggaggtggcctctatccttacccaggactgtagggtaaagggaaatatattwaaaatatctagatgagaccctaattctttgctagcagttacataaattctaaagtcatctccatctttctctgccctggctagcctccagagcaattaaacattgatg

SEQ ID NO: 20985 - DNA, 600 bp, Bovine  MMBT03972
agaatttcttgatcttaactcatgtataattctctaaatgtgtctggctaccaaaagttaaagatattattccatctctcggtgagataaaactgaggaagcgagcgttgagtctaccgcaagggcatacgtcgccttcacacatttcttaaccaaagcaatgtaggctrcatgagctaaatggtgttgtacgtggcccacatttgcatatgcatattgtccagtgacactcataattgcatcaacaaagcgaggcagcatccgtcagccagggttcaagccatcacgaggcactcacaytgcagcccccgtcaatctccaggtctgctttccctcagtgcgctgtatctgtattccatatgcaaattctccagtgaatgattttcctgttttgtaagctagactgcacctgtaacatgtgggattgagttaaaaatgacaagcagacaagcacaggcacattatcttgacaaactcagcctccgaaaattaccctgggcctgaattattaaaataacaaggaatatttcactcagctgtgcagaaatgatcctaattgtccactttagctaaatcctttcagtctctgagatcggtcaa

SEQ ID NO: 20986 - DNA, 602 bp, Bovine  MMBT09640
  misc_feature (1)..(2): n is any nucleotide
nntacttgtctgcagcttcctatctaaagcagggttgccacgcagaggagtagagagaagataaataatgtgggagaaagcctctgaggagcctcaaactaattgcctgaaatgtcgggattcactaagggcaggagttggagccagctttgttaaaattgaaagtgtactgcgtgttagtaatctttgtatgagatcagcagtgcccatctatatgggttgctggcagtcattctccctgcatccctggttgatgcgtgggtgtctcatctgaccctgcctacctttactcgatatcgggyaggaatccacaggccctcaggggtgacaagtttggggctccttgggagatgagctaaactcacctgactcccttctcattgacaaacaggctgaagagcttaaactggccactcagctgaccggacctgttatgcccatacggaacgtaagtgggcatgttgggagaaccatggatctggggttggattggagggattctgtgtggcagccggggcccatgttgagatttactggtttgtgaaagacctacctgccctgaggagagtcagctgcatccagacagatgggctccttgagga

SEQ ID NO: 20987 - DNA, 590 bp, Bovine  MMBT08246
accaaatcacttaaaatatgtttgctttggatttttttttwaatcactttccttggaaaacttttatttttgttttcttttctctttacatttacttatgtaaatccttggctyttctgtattttgttaatatgaataatttaaatacacctagggttgcattcttctttggtttgaggctaaaggtataaccattagaatcacagactrctttgagaagaggatactgaggtagaaatcaattgatatgaaatgttttcttctttgataactttatgatagaaatgagtgagcaaaaaktgatggataaaatgccaaagaccagaggtggggcttctgtgaaacttatgaactgaataattaggccttgaatagccaagacttgagtatgcaagaaaatttgctaatgctcaatgtgttactagcatacaaatagttgttttaagaaactatggtagtttttaaatttwtgaattcattaattttttaggtgtgtcaagcctgaagagaagtctcttggtgtgggattacatgcattttgtacacgagtattaggtaaaaataattacgtttcccaatatcacatcaga

SEQ ID NO: 20988 - DNA, 600 bp, Bovine  MMBT10347
tgggaggccgctttgccataatcaatccagcgtggggtggcaaaattgatggtgtctgtatccaatgctaatttaaaattggctcttgaacagaaatgtgttgatttcagtgtggctgtgaccagccgtccccactgacagcaatgactttcctggctggctctcttccagccccgtgattgacttggtcagttgaaaacaaaattcaaatggcagccactaaatggtatgaaatatcttaattttaacctaaacagagggcaacaacagcctccaaagctacagaagccagggctcagmggatgatccaaaagacaagaagaaaagtcagtttaaagaaaacaatcagtggctgaaagctattaagttcactcttctagttcaaagagattcgaaatggcaatttgtcaggcaactgttgtcactttagacgcccctggttgtttgctttgaagcccttgattgactgcaggagcctgggccagattcttctaaggacaggatttccacagttgaacacatttatgtcacagtaattatgactcttcccaaatttaatcaacaaaggcataagagtgcaagtttgagaaattatgcatg

SEQ ID NO: 20989 - DNA, 600 bp, Bovine  MMBT12134
cctgaataattacatatgcagtacaatttcaccttcctcagacaatagattataaattgacagtatcatatacttgagattgatcttgagttgatctcgaaatgtcccataaagtataatatcagaacaacccaaattagttttatatggatacttttcyttcttgtttctttgagtgagcaccagatgaagcatctggcttatttttaggggccatatgatacaaaacaaacacacacagaaacatatagcaactttaaacactagaattagaattaacacaggtcatgtgtacaagaygtgacacaagggacccagactacactgggaagggcagcttcttgtcaaatcatgatcatgctggctgatcarttttgagtaaaagagtgacagggggtcacttgtattatttaaatagttatttctttttcccttttttgtttcaaaatgaacagaattgaaccagcctaattaaatgtgtaaacgttaccagtctactatatgttttcaaaaagaaaatcaccccgtattactctttatgtcaacaagtactaagtgtaaaatgaaatactgactaggtataatattttgatggtaacc

SEQ ID NO: 20990 - DNA, 598 bp, Bovine  MMBT19490
  misc_feature (1)..(3): n is any nucleotide
nnntatgtgaggctcattatgattttgtccccttgtacctttccagttttattgtttattactcctctctcttcaaacatgttctcgagcctagccaaaatgagtgacttttacgtagtctggtttgtgctttatatgtgcttacaataccttatactttatgatctcacggacttctttaataattcacgttaggtgctccaactccaggaaaccttgcctcccccttctagtctttgctttatgctctttctctgtgctcccctagcatctgtgcatccctcttttgtgacatttacyataccgtcttgtatttacatggtttatgtctctgctttctcattagacagatttttaaagaatatttatttgactgcaccaggtcttagctgtggcatgtaagatctttaattgcggcatttgggatccagttccctgaccaggggttgaaccccaggctccagcattatgaacatggagtcttagccagtggaccaccaaggaagtctgtgtgctaagtcacttcagtcatatccgactctttgcaaccctatggactgtagcccaccaggctcttttgtccataggatcctccaga

SEQ ID NO: 20991 - DNA, 600 bp, Bovine  MMBT18363
cctgggtccagctttgccttaaattcaaccccaagtaatggtttctccattttactcagagcctgaaacttactcatttataaagaggcttctgacacaactggagttttccagtgagcaagggttaaaaggtcggtcagtaataatgttacctctaccctctgaatatgaaactgctagagttcaaaggtattttatctatcctgataaaaacatctcattgtttttcacaagacactcaaaagtaaggttcagaggggatgtacggctggcgcattatgacactaacctcttctagcrggagatatcaaccacttcattggaagccaatgactgaaaaatacaaggaaaaacatgagacgattgtgaggtccaaagaaaagggaatcttgttatcccaaataagcatctttaaaaattactaagttctattgttccagtgatgaaattagtatgtctttgttgacctaaacttaaatttgacacaatgggtaaacttgagcctgaggcttttatgccattatcagagcctctgtcagtgagtgctttaacctaattacatttgatgcagcaaatcaacaaaaccactgctggttatga

SEQ ID NO: 20992 - DNA, 600 bp, Bovine  MMBT08100
ctacaagcaccccagcatgtgtcttccgacgtgtctctctgyacagactctgactgtccacagctggggctcttaatcagagggaggaggacagtctaagaggccctagggcaatgattctcaatcctgactgcattagaatctcctaacgtgttgtagaaaaaacagatgcccagatcccaccctggaccatgtaaatcagagtctctatgtgtaaggcccaggcctcagaattttataaaagctgccagaggattcaaatgtgcagccagggtggggtgtatacatcaattcagaggrtgtaacccctagaaatggcagctaaacttgtgtatgcgtgagaataggtgtgtgtttctggggtaagacatcatagtaaaagtcacttagtcatgtccgactctgcgacctcatggactatacggtccatggaattctctagaccagaatactggagtgggtagctgttcccttctccaggggaatctccccaacccagggatcaaaccctggtgtcctgtactgtaggtggattcttaaccagctgagccaccagagaagcccgaggggtcagtttcagacaattctttaaaatatctg

SEQ ID NO: 20993 - DNA, 600 bp, Bovine  MMBT10337
gctggcttgcttcctcacttgggaagcagacctagtttaaccctctgccccttccattgcatgagtgcagaataggaactcacaaactcttccacccctaagacaccaggtccagttccccttagtaagtccctgctttgtgttcccagaattccgtgtcctactgccctccctgtccttttatctctctgccatccatgttcctccctccccctctcccttccccgctccctctctttgataaccaggaggccagagcacggtccaggggacagccaggatccccggcccattggacartggctgtgctatctttgtgggtgtggcgagcttgatatggctcacttttcataggacagctgccactttaaagacgtgtaaaggacttccctggtggcatagtgggtaagattccacctgctgatgcgggggacccaggtttgatccttggtcagggaagatcccacatgccatggagcaacctgtgagctgctactactgagcccacccgcctagagcctgtgttctgcaacagaagaagcccccacaatgagtagcccgagcgtggcagcaaagagtagcccctgctcgctgcaacta

SEQ ID NO: 20994 - DNA, 600 bp, Bovine  MMBT22462
accatggtacaggccagacccaggggcttgaggctcagacaaagaggaacaagcgttctaaggtgggtggggagtcacggaggtgatgaccctggcttggacctcaaaggctaggaaggtctgacaaggtagaaacagagcaaatgacattcacaaagaaggacaaaagttctggaatgggaaggcatgggatatgcatggccagcagtgaggagtcactttcggctggcatctagagaatgaacagtggggttggaaaagtgatttaaaaccagattcaacagccacatgctggactayaagattcagagtttatctgcagtgagcaaggggcaggtgaggtagtagacacaaaatgtcgaaatcaaaacaaaagtcacccagggtcctatggtgagttaatctgtggcccagccaggacttgaatgcagatttatattgacacaggcaaagctcctagacctgacgctaacccgacagaaatgggtctgtgggaaagtgcttcaggccagggatggccagatgcttctctgggaaacccaggagcctgagtctccaaggagccgggcgtcctaccttcgacaaatgggtcttgtcgag

SEQ ID NO: 20995 - DNA, 600 bp, Bovine  MMBT03697
ggcaaaagcaatgaaataatagtattctaaactatcatcaccacagaataaagcacaataaatttaccatttgttgtttttgctcagttatgtttgattctttgcaaccccatggactgtatgtagcatgcagggctttcccatccttcactatctcctggagtttgctcagactcatgtctattgagtcaatgatgccattcaaccatctcatcctttctcaccccctactcctcacacctatcaaagcctagtgaaaaatttcaaagccatccagatsataaaatagttttagatccytaaacctgggctgctactgctatgagagtgagagatacagacagtgaaaaagacagaggaccctaaaatatgcttgtggagtcaatgttaccccttagttgcatttttactctctgtgcttaggtaatacactatcaagtctttgctaattttcatagggatttacctataattgtacaaattcctgtaatgattaccaacctaacagttgctaccaatatataattagcttttaaatatttaataccttaagagaccacrcagataattaaattattttgagaaaaaactaattcaagt

SEQ ID NO: 20996 - DNA, 464 bp, Bovine  MMBT14104
tgctgacctttgtttaattcatcctacgcttcctagaagctacggacacttggaagccacgtggtggcaggcctgtggagcgatttaatgaagcatgttgtggaggaggtttttaaccctctcctttgcaaatcgtctaagacagcacttctgaggtgtcataacaagaccccagagcaaacagagacgttgaacaggcttccttccttgactagtctagtaaaaatagctgtgacttgcattaaacggactggtccataatgtaccacgtaaaacaaagtgatgccatttcacgcacckcaagtgaaacccagcctcattatcttaaacttcccctcacagacacagagaatttcagagccgtctgagatcttaaaagtcgttcttccaaacttctaattttaccggtgaaggacccaaagcacagagagattgtcatttgtccagggcaatcagcagggcca

SEQ ID NO: 20997 - DNA, 600 bp, Bovine  MMBT20047
attcattaatagggaagatggtgtttgggatcccaaggagactagtgaagttagaattcacagagtggaatattggagaagacagctacacagagaatgcctggagttctacagaactcctttgagtcttcatatgtatactgagcagtggatgcatataagggaactacatgaggccagggaaagaattatccaaaaggattagagggaacaatccctagagatcacaaaggacagggaatgcagccctttcccaccaaccagggttgaaaatcttataattagtggggcactgagtamagtacttagaagggtattgcctcagttgtggggccttagactaaacctgttctggtccttttaagcttaaaagaaagacttgaaaggatcaaactatttccaagtaacttatgatgtgccagaacaacactcaagaatattttaaaatactggatttcccaggtggcatagtggataagaatccacctgtcaatgcaggaaacatgggttcaatatctggtctgggaagattccacttgcccaccacaactactgagcctgtgtgctgaactactgaagcacgtgtgcctagaacctatg

SEQ ID NO: 20998 - DNA, 600 bp, Bovine  MMBT00946
aatgaaatcagattaaaatgccccagtcccagctccagccttgaagtgggaagaatgcaatgaatggtcaccctaagtgtggtatgtgtgcaatgagtrrtggtttagggcagtagctgcaacccaggcagcccatcagtatcccctggggagtaaaagtacacatgtccaggcycccccagaccctctgaatcagactcttgagaggcagaatctggccatctctctgattatgaaaatttacccaagtgattctgatgtgaaaacctcagttcagagttgcctactggaccttgaggraaaataggtttaatgaatagttgtctccgtgactggggctgatactctgcrtgtgatttgcagctcaattttgcagcatctggctgcttccctgagttartgtccagcctccaaattgatgtcttaactcacactttcatatgcatagaagtygtcttgagatcttgtcaaaacacagactgattcagtaggtctagggaagggcatggaaatctgaatttctaacaaactcccaagtgatgttgctgctcctccagggactacagtttgaaaaacaaggcctccagggaagaactggtt

SEQ ID NO: 20999 - DNA, 598 bp, Bovine  MMBT08729
  misc_feature (1)..(62): n is any nucleotide
nnnnnnnnnnnnnnnnnnnnnnnnnnnnnnnnnnnnnnnnnnnnnnnnnnnnnnnnnnnnnnatgtaagagcttatttaaaatttaatctggaggataatatttaaactgatacttaaaggattactaacttgcatgaatattgatttttgtattttcactatgtaagtgggcactttagtgaatcttatttgttggtgtaatagcttttcaattgatttctctaaggtttaaaggtagactattatgtcaactactgataatggaaattttcatctcttttgatacaaattattgaaayttccaggaaataattaaatcatatcagtaayagtgggcatcaaccttttactyttgcctataactagagaaagtcaagtcatatctcatttgtgtgatgtatcttccaatactacttttaatgaaaagaatatattctgactccacattatttataagttcattaaaggtagcatcttatccaagatacatatgaaagagaatttggattcaggattcttaaaatgcaggcaataaccatgtacttattatgtgaagaaaagctgttacttttcttgttttaatattcctaccaataa

SEQ ID NO: 21000 - DNA, 600 bp, Bovine  MMBT04619
aaagaactcttcttaccatttaagatcttctcaagtttgcctccttaaagcaagatggcttcagtggtggtgctgacatctacgcaggtgtctgtgtggtttctgcactcacgtgtgtctgttgtttctctctcgtctcccacaactagaactcaggggagaaggtgagcaaggtgagcttggtggacctggcgggcagcgagagagtgtctaaaactggagctgcgggagagcgcctgaaagaaggcagcaacattaacaagtaaggggcctgtgcgattcccacggtaaaccccagcrtcccaccagcttcctgtgtgtctgggcaactggtccccttatcaggggtcagatggctctgatcacaggtgattcagagtgtgtagctttactgaactgggttaaagaaaaacatcagcctgcctctgttgagatgcatgaggtttatttaagtgaaacagcacgaggcagccgggctccaacattgtccatacaaacgctcagaatatcattgtataatgtaatttctcttaggtcaatgcaagtcacagttttatatcaaatcatatcttagatctaactctaggagcttattctaaa

SEQ ID NO: 21001 - DNA, 600 bp, Bovine  MMBT05899
ttatctctctgaaaaactcctaatcttgaagaatacatagttggatgagcaaagaaaaaaagaaccagtcaaggtgacttccaggtattttggaggaatgtgtgcttgttctgaaatccctgtatctacaccacactgatcctgtctttgattctaaccttctttaccaaatactatggagcatattggtgactgtccaaaaactcagtatatttagataaccagacaaccaagcaggataaatagaactattcatctgtgtgttcatctttgtcctttccagggaattgtttaattccyagtgtgtgagtttatcagatcaccctgaatgatgttactttgagataacttcataacaaaggaaattttaggcattttcagcttggaaaagagtaggtgccttaggaaaagaaagcagaggtgtgagaactggccttttgtcccggctttaccctgaagagagggcttggaagaaggggtagacctaagagagcctggcaagtgtccaggggaggtgagccactcctcatgttagctcacaaggaaaaagtcagtgaaagaaaaatcagatcaaattcacagtccagcccacagccgaat

SEQ ID NO: 21002 - DNA, 600 bp, Bovine  MMBT19648
acctcgtgtgaagagttgactcactggaaaagactctgatgctgggaggggttgggggcaagaggagaaggggacaacagtaggatgagatggctggatggcatcactgacttgatggacgtgagtctgagtgaactccaggagttggtgatggacagggaggcctggtgtgcttcgattcatggggtcgcaaagagtcggacacgactgagcgactgatctgatctgatctgactgagattttggtgttttcagtttttagtttattaatcaatttgtggataactgacttcctaagamtactgtcttccaattcatgacaatagaatgtttccactaatttaggacttaaattttttkttcctggtaatgtttagcaktttttactgtagggttcttgcatataatttyttatgattttatttgtaagtaggttttgtttttggatactgtcataaatggaatttattttttgaacttaattttccaattgcttgtggccagtatatagatgtataactgattttgttataccaaccttgtagcttatgatcttactaaacttacttattagttctagtaattttgttttaggttcat

SEQ ID NO: 21003 - DNA, 600 bp, Bovine  MMBT22671
catttctttcgaaatataagattgtgcttttaaaaagagagagcatttttagtttaataagcttaatccttataatttttaacttcagaaaaatgattcacagccattctgtctttttagctggaaacagtacatctaagcaaagaacttaaacatcggtcttcatagttttactaacagaatgtcttttttccattttttagaaacttttgttttggaggcagcttttccagtgtctttggtttggcatgctacgtcgattctgcccttctgcacctcatctctcatcaggacactggyctgtatgaacctcaacaccagggattctcatttcctgttggccagtggaaaccctagaagaaggtcagagaaagggagtggcaagagatgaggactttcacttccactcaacgcttcaaagtcaccttcggctggaagcatctctaggaccatgtcccaagatgcatccttctgggttctggtgacttctctccaggagcacccagcactgctagctggaggtcactgccttgtcctgtgattccgccacactctgctcataatttgtaaatatcatctttattaaactttccctaaaga

SEQ ID NO: 21004 - DNA, 600 bp, Bovine  MMBT11186
gatgctacaaagtaagtattctatatcttttaaaaatgaatcttacctcatcagggctaggaataatatttacactaacaacctgatcacaaataatagattctgaatgtattctgttcaaccggctccttagttcagcattctggttgagtgccttaaaataacaaaaaccgcacatgtaattgcaagttattgagcaaacataaagcagaaccagcacacaggcacactttagacaacaaagtctaggatgcttttagctgtaacttttggagccaccacaggccagatcccaccagkaagaaggaaagaaatggctcagagttaaggcattcattttttgcaatataagactactacttagtagattagtgggttgaaaagagtttaaggatttcataaaattgattcgtggaattttctctcctttatagtcaggcccactatatccaagcccagtctaccaccacatacatataacattttataccctaggataaaaactattgattcttttttttccctttttggttccagtttctaaagtttgggcgttgtttcaaagccagatgtcttataaattatttgtaaatggaatga

SEQ ID NO: 21005 - DNA, 598 bp, Bovine  MMBT08986
  misc_feature (1)..(49): n is any nucleotide
nnnnnnnnnnnnnnnnnnnnnnnnnnnnnnnnnnnnnnnnnnnnnnnnntgttggtttgctctccctgattagacggtaagtttgtatttattccctcagtcatcttaatacgctgaataaatagtttgcaagaattacctgattgacttcttggatagggttcttttgattgattgccaagaaaaattctacttgccaagaaaacacatgagctgtttggataaatcagaactttgaagtttataatctatacaatggtgtccaggtcttacatgtagtaaggtaggtaatgtgatagraataatctatacctgtagttgagttttatttggaagaaaaaattggaaataacttaaactcctgggctttttacccagatttcatttcctagtgatgaacttgtattcaaagcttggactcaggatcctggcatgtgactttggtattgcatgctaaatcagaacttcaaagagtttttctgttttgttttgcttttaaaaacagggsaatgcccttcttagtaaagtagaatctttttgtttgcttgtttgagttgtattggggttctcccaatattttctccttgcattctgcttt

SEQ ID NO: 21006 - DNA, 600 bp, Bovine  MMBT05364
ttttttattgagacatcaaaagctacacctcattaactaaatagttcttttgtattcaaaatgatgcagggccacagccaaggatgtatttcaagttgactgctgcacaaaatatacacaaagctggaccatagtttatcagaaacatatttaagccaagaaatgtgcaacatttcaaaataaagagatgggcaaataggtttcaggcaacaatatatacaataagaaaccactaacaagatagtataaaatgtaaaatttaaggtgacaaaagagaaagaatggtaaaaagaacaattwatgataaaggtgtaaaaatcttactgcaccagaaaaaaacagtcaaatatgcagtgtaattattgtacatgaatgaaaaatagcacaaaaagcaattattatgggtggttttaaatacacctctatcaacattagacagatctactagatcaaaacaagtacagaatagatagggcttttgtttctagtaacatggcagcctaacattacctaaaattgcagtaaaagtatttaaatgctggacaaattgtaaaacattcttgtaagtgatatgaacttgaaataaaggtaaatctgtag

SEQ ID NO: 21007 - DNA, 598 bp, Bovine  MMBT10472
  misc_feature (1)..(134): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatggtgaaaccatcccttactatggtgtcatggttcttactacattatcaaatgtcaccaagtatgaaagaatcctgttaatgtctacttactgagtaatgttgtaaaatttcaactctcatgagcaagcaaattaggaaatccttacaatttctggacctacrtaattcttcctagtttcatctgtgcctgttttctctcatgatgcgatataaccaactcctgctagcctgtaaaagctgattattaaaatattgaggaattttgtgagccacagccattggtggcttgcaataccaatggtgggagtatttacaccccagaaattgacaaacwctataaaacagagtgtttaatttttctgtttttctggacacacaatcagatttcccagcatacctgactctcagtcaaagaagaaaaataatttcctcttatttcctgcaaaggacatgggctctt

SEQ ID NO: 21008 - DNA, 598 bp, Bovine  MMBT14796
  misc_feature (1)..(187): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatctaataaacatctgttttttctatgtgcatttgtgatgccatctttatcatgcattaaattttcatatattcatgaacatgactctgagaaacattaggaggatgcagktggcaaaatttgccatcaggaagakgaagtagaaaataaatgtctatgaatgactggtcaggccacataaaatyacatcaatttcactcttgcataagacattgatcctgcccttatattacccagattgctaacataaaaagttgataaataaaagtacagtggaatttaaaatgtttctttgaaaatattatctctttgcttctcctagtcaaggtctgaaacaaccaatctcccacatactgtgacttttcagagacttcaatctccctacagatttcccgagctggttgcattt

SEQ ID NO: 21009 - DNA, 598 bp, Bovine  MMBT19226
  misc_feature (1)..(162): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatctaataaacatctgttttttctatgtgcatttgtgatgccatctttatcatgcattaaattttcatatattcatgaacatgactctgagaaacattaggaggatgcagktggcaaaatttgccatcaggaagakgaagtagaaaataaatgtctatgaatgactggtcaggccacataaaatyacatcaatttcactcttgcataagacattgatcctgcccttatattacccagattgctaacataaaaagttgataaataaaagtacagtggaatttaaaatgtttctttgaaaatattatctctttgcttctcctagtcaaggtctgaaacaaccaatctcccacatactgtgacttttcagagacttcaatctccctacagatttcccgagctggttgcatttgttactgttgcttatcagaatacac

SEQ ID NO: 21010 - DNA, 499 bp, Bovine  MMBT19227
ctggtcaggccacataaaatyacatcaatttcactcttgcataagacattgatcctgcccttatattacccagattgctaacataaaaagttgataaataaaagtacagtggaatttaaaatgtttctttgaaaatattatctctttgcttctcctagtcaaggtctgaaacaaccaatctcccacatactgtgacttttcagagacttcaatctccctacagatttcccgagctggttgcatttgttactgttgcttatcagaatacacacgtccctttagctattgtagccactctargtttatttctcttagcagactgagtttgccattatttgtcataagccagaatctgctcaatgccctcttcatgtgtctcatttttcctaaaacttcccaaactatgttattataatcctttcttctgtgctgcagccaaggagtttttcttcatttatagaaaattattttgtcatttttcttttcgggtgggcttaag

SEQ ID NO: 21011 - DNA, 598 bp, Bovine  MMBT10885
  misc_feature (1)..(48): n is any nucleotide
nnnnnnnnnnnnnnnnnnnnnnnnnnnnnnnnnnnnnnnnnnnnnnnnatttaagaatgatgagagaggcatttccctggtggtccagtgaagactctgcactttcaaagcagggggatgcaggtttgatttctggtcagggaagtaagatcccacatgccatgtggtccaaaaaaaaaaaaaagaatgatcagggagaaaaaggtaagtaaaaattaagccagtcatagtgtgagagaaaagtgaaatatacagccaagagtctaattttttctcactgtaaatgcttctaaataactktatatgaaagtttaatttgcttattgactgcaacagtttgtctccagtaccaccactttgtgaaatgaattgactaatatgtcacgtatctgacctctttctccatattctcccaatattccctaagaattaacctacctttttcttgcaagttttggttaatcctgtggtagttacaatgaaagaataatagcactaaccatcgtttgtgtgagcaggcactgtgtaatcttgacaacgtcccttcagactactctgggagatccatgttatccctgttgcacagacaagactgtag

SEQ ID NO: 21012 - DNA, 598 bp, Bovine  MMBT16148; identical to SEQ ID NO: 4616
  misc_feature (1)..(25): n is any nucleotide

SEQ ID NO: 21013 - DNA, 553 bp, Bovine  MMBT11665
agaaccctctgcctttgcctctgaccacttggaaatgagttctgggctttatcacatcccctgaaaacagatccaacccacgaagcattagtgagtaatgtagaactgactacaattttatggggagatgaaggagaaagctacatgatacaactcccagcaataaataaagacaaagatctttgctttctcttgtcagagttcctctttagtcatggggagggtgagatggtttgaaggcatcacccgacttaaaggacgtgagtttgagcaaactccaggagatagtgaagaacgggraagtctggtgtgctgtagttcacggggtcgcagagagtcggacaccacttagtgactgaacaacaacatgggcctctgggtctcctccctccctctgaatctttccctaaagtagccactgaacatctcctcctttcctggtcagagaaattcagctcacttctgaatttcttcatcaaagccctcagctgattgtaatgtccaagaatgccagcattttccccataaaaatgaacctctctctgtaggagaa

SEQ ID NO: 21014 - DNA, 600 bp, Bovine  MMBT02726
cggagcagaaaaaaataaataatcccaatattatgcacaatagcttgaaactctgttggttattaaaatagggaaggagatcagaattaatatattctcctggggatttagagtcctcagggactcaccaggtttttttttttttttttaagttcttcagactataatatgaataaaaaacactgaaatcatgttttcaagttctttattaaaataagtatttaatgcaggaaaaaaatccaagtcataaatgtgactacagggaaacaatcatcaaaaagtgttgggagactctgaatygtatttgtgtagatcataaaagtcttagaactggagttaaacaggaagttagaggtcatttactctaatcttatgtctgaggaaatgattctttcttcaaatacaatatacacaattacagtacattttcatttatctgagttctgagttactcgaaagctcagctcactattttcccacttgacttttatgaaaaagaaagaaattataaataggaaagaaaattaatacacttaaagataactctgggatacttcaacaccttgaagtgtcttttcagccatcagaaaaagatacaat

SEQ ID NO: 21015 - DNA, 598 bp, Bovine  MMBT07365
  misc_feature (1)..(18): n is any nucleotide
nnnnnnnnnnnnnnnnnncctggggttgcaaagagttggacgctactaagtaactaacacatactatcaaatctactgaatatcttagcttagctttgcctcagaacacctacatcagcctacagttgggcactatcatctaacacaaagcctgtttcataatgtagtgttgaatatctcacataattgaatactgtactgaaagtgaaaaacaaaaaggcygtatgggtacagaatggttataagtgtacrcattgtttacccttgggattgtgaccatgaagctgactggaagctgcrgctcactgctgtggcccagcatcattagcccaggaaaagatcaaaatccaaactgcaaagcatggtttcccactaaatgcatatttctttcacaccatcatagagtccaaaaccattggaagttggagactttctgcactacaaaaatggcaacatcctttgcatccctctaacttgactaaacctttcatgaggaccctcctttccttgggaactgggctgatggaggaaggtagaaagggagagatcattgaaggaggaattttaaactaataaagatttctctaagcatttttta

SEQ ID NO: 21016 - DNA, 598 bp, Bovine  MMBT10729
  misc_feature (1)..(44): n is any nucleotide
nnnnnnnnnnnnnnnnnnnnnnnnnnnnnnnnnnnnnnnnnnnnaattaatgttcttattctaaaaggcaataatcacatggttctgccaagattataccctagaatatcatggaagtctacactagaagttaggaggactagtctaaggaggactggtctaagattactcctgatgagaaaaatttaaggacagaaacttaaatcggttctatccagttcagtttaatctggatagcctatcagaacaatctgcttccccaatctctgctactaaaagcagttgagtgaattacttaaycttctctgtgcttcagtttactcatctataaaataacttctcctgtgaagttaactttggtcaagaacatgtaactatggtaaaaaaaaattttttttttaatcatgctcaatttctttacaaagtatcttggagttcttccaatctcaccttaaatgtcaaggatatgcaccagttattgtaacagatattgccagctacattcatttctaatgatggggtcttacttaccactctaatgttatgctttttggaaaagaatttttttcagaactgtgagcctccttagatatgggca

SEQ ID NO: 21017 - DNA, 600 bp, Bovine  MMBT09241
gaggaaaaaactgggagaattccccaatttctcatgaatgaggctgacactgcagtttcaatacctttgtttgaaatggaatcctaaacattaaatccacttatatttaactaaaaacactgaaaaacattccagaataaaaaatagtatccaattatccacatccctggtcccctcaattggttgcaatcatttacaacatgagaaaatcctaaatacttaattwaaaaaaaaatcacagaccattaaattacgccactcttgcaggggcaaaaagaattacttatttggtacataaaytttatcattagattttttttctccggaaggaactgcaattttaaaaaattaagaagaactcatcaaattccacatacctggtcatggtagctggtactagaagtactattcgctccacaaggtggttgtacttgtggaggtctttccacaggacaagtaggatcactaaaggaaggagaaactgggacagctgggtggggagtatgatgatggggggggatgatgctgaaaatggtggccatgctgctgaaagcaacttgtgtgtggatgtcctaatgcatggtgattctgcgatgaccc

SEQ ID NO: 21018 - DNA, 600 bp, Bovine  MMBT16405
tgtgttttctagcctgatactggctataaaacctacacagtgtctttccctgaactgtgtcttgtagggaaggagaatccacaggctttgagaacagatgcctgacactgtgaaacatgatgtgactatttatttgcatcttttcattggtaatcaagcatgcaaggtcacttcaccgtatacgcttataataagaaattacagatatttttctctgctaggtttacaagattcatcagttaggctatgacagaggaagaccattgtacactaggcaactttagttctacttgccattarttgggggaaaaaaagcagctgtgccatttctgaggaagcattatgattctgcatattytttagacatccttccgatggagaaggtgttaaactgagaccattttgatggtccaaaggaatcaagtctgtcctttctatataacttgtattaagaacaagaaaaattaagaataattgtatacaaaacaagtataaatttatgttcctgaaaacatgatccctaaatgaacacactaatatttggagacatctaaataagagaaaaatgacgtgatattaaaattcaacctgtcacgatgg

SEQ ID NO: 21019 - DNA, 585 bp, Bovine  MMBT10701; identical to SEQ ID NO: 4640

SEQ ID NO: 21020 - DNA, 598 bp, Bovine  MMBT04938
  misc_feature (1)..(4): n is any nucleotide
nnnnatatctgtatccccaaatgatctttaccctcttggtgcagtcatcaaagctctgatagggaggagttagaattagtatctgagccatcagagattctgagatgtctcaaagaagaaaaaggaggggaaacgtgttaactttttgtgttatgttaatgagatccttcatccctgtcaccttaaaagaagcctaagacacatttctctctctgattcctttttcttctccctctcctcctccttcaccaacctcccccatatctaaaaatgaaggttaatattaagcatcacattaayagttgtcaaatcaatcatgatttcctctgagttatgttacacagagcaacatgctttatcagaaatcaaagaaaggacagtgccaaaagtggatgagctaatgtaaaatcacttacagggcactctggagacagaaactcgtttaatatttaatatagtcattaacctaagaaagagaaggagatggtaatggatggtctactccttttgcctacaggacagggtactgaagtgagctgtcccttctgggatcacagtcacacaagtctaaaatctataaagtgggtcacaggtgaag

SEQ ID NO: 21021 - DNA, 547 bp, Bovine  MMBT17159
ggcagaacctttcgttttggttgtttgggaagattttcagaagctaaaagatttcaccatgtgtgtttcttcgctttgcgctgttctggtttaagctctttttttttttttccctacagaggagcccaaacctgtaattctattgccacagatgcgttaaaaagaacccccctcctcatttctgccccgtcattgaacacagctttcagtaaccctgagcacaagaacaggaaggacattggcaactcaactgttaaactggtctgtgattatgtttccttgagatcactctgatgtcaycagtgtaatctgagcctggagcttttgttcacactttaaatagcagtcccggaatgattttgctacagactctctggagagcctgggagctgaattcccgaagaatcccccatccatgaaagctaagccaagccacccggccttcagcatgtccacctcgctgcgagtcagcccgtccatccacggctaccacttcgacacagccctcacgtaagaaaagctgtgggcaacatcttcgaaaacatag

SEQ ID NO: 21022 - DNA, 600 bp, Bovine  MMBT09607
gcagtctttgtggctggctcctttcacttagcatgttttcaaagttcgtcagcaccgtggcacgtatcmgtgcctctttttttatgactgaatatgtacacactgttttttgtactgcttttccgtcctcctcatatatctaaacatctttccawgacattaaacattcttctgtgacatcattttaaatatttgcctgacaatctgmggtgggrattcatctccagttgcttacccatttccctgatgttgaacagtcctgttcttgcattcaaaatgaccaccaggccagacattacygtcaattagggtgctgctgcctaggctctgggcttggttttaaaggctacagaggcttctggctccagaacttccttacttcatgacttaattcgtttaaatgaaacccagttgagttcaattcaattttgatggctcatctgtactgaacacactctatgtaccaggtacgttgctaagcattttattttctttacctcacttagtgatcaaaacctatgcaagagatccacacgttagcctcattttacagatgaagaaactgaggctcagagaggttaaggaatgtgcccaaggtca

SEQ ID NO: 21023 - DNA, 600 bp, Bovine  MMBT15551
tttatttttcttgcagccatcagaatttacctccagatcatcatgacaataaattgtcttccttcaagtgtctaaccaagaaaatcaaggaagcctacaaaacacataatttactgacatgtgggcataaaactaacctaaaaagcttatgtgtttttttataaaaataaaatcagacaaatataatacctcatggggttatataatattagagcagtaattttctttcagagaaatttggtcagattattggttagttggcttaaccaagtgcaccagctattcaatggcagcactatrtttaaaactcatgtctctaagcctgcagccctctacagttttactaacatgatggcacttttgcaacaatttacttcattgtatccaaatctcttgacatatttggacaatatttatctcctatactttactgcaaaatgggtaattttgagataggttggcaattccttgccrctgctaagtcacttcagtcgtttcygactctgtrtgaccccgtagatggcagcccaccaggctcccccgtccctgggattctccaggcaagaacactggagtgggttgccatttccttctccaatg

SEQ ID NO: 21024 - DNA, 600 bp, Bovine  MMBT07525
ttaaatagctaataataaaatgtcaaaatacaaattctattagtatcttcttttaaatttttttaaaaagcatccttgctaacatttactacatatgaggcattatgcttacatatgagtcatacactttaccagtttacagctataaacatgtttgtaattttagaattctgatagcaaataatcattttataatcataaaataatatcaaacaacagctatctaaatagttttttgaatcttcatggatgcttacacagctgggctttttaagaccactgtgtgcatgataattgcakagcaataattctaagcatgttgttttaaaaacaagcagactcttggggagttaaagatggagtttgtgcttttttaactaaaaaaataatctagaggataaagtgtataaaggctcccagagtgcaatgctgaaaatacaaatttcagtttaaactagagaaggcaaaagctaatgttctcattgccacgtaaattttctcacattatacctgggtagtgttcttgctctaattatgttcctacatgaatgccttattacatataatgtcagaatattacagggagataaagtgtgtctc

SEQ ID NO: 21025 - DNA, 600 bp, Bovine  MMBT03801
gcggtaaaagaagtggtcacactggtttaaaggcaacattccccaggcaaccagttgctaagccaaaaccacgccaaataaacaatttgctttggcattttactgttgaaatttgataggcagaaaaaaactagaattctaattttgcttgagaccagggggtattgaaatagaatgctttcaaggaaattctggtcatatgtaatactgtacttaattttcaacccgaggttattctcagattcgttgattgtataactcctaagtaatcgcctcactagagtaaaaggaaatgacaamgtactcaagggaagagggacggaagaaagttatttcctcwctactctgtaccaagaactggagycagcatctaatttaattaacaaccatcctggtagtcgaataatattgttattgctttgcagaaacaaggaaagaatcccaaagcagctaggcagcttgccagggctccaatgactgaggccacaattggttccatgtctctccaggtggtgtctattcagtaatggtgatggcattctggaaaagcttagaggcaaaagcccactgatgtcaaacacttgtttctcaaaggacgac

SEQ ID NO: 21026 - DNA, 600 bp, Bovine  MMBT08895
atttataaaatcatgaaaacatcattttaaaattcctgtttaggaaaagaagcaaagtatctgcgagaatcttcacagtacacatcaggaacacattgttttctacaacaaatggtagcataagctatttattgtcaagttttctgttaaaataaaatctctatattttaaaaaacttcaaatcgggacatgtgtccagctcaagattcaacttatccatcatcagaagacaagtgagactaatgaacacatttgtttggattctgcttctatttctagagtctattaccttcgtaggastcattagtgtctgcttgtaagagataatatgcttgaatcatacaaatcttgtatttcataagcagaaactcagattcatacattattggtgaagaattaaaattattatagatatgtaatattcttcttaaaaatacattatgtagtcgacaaatagaattgcagataggactgtctttccatctggacacaatagcaacacatgtatcagatataaaatgctcacatgtgaggatacagtaagtcccctacatacaaacaagttccagtccaagagtgcattcataagtccaatttgtt

SEQ ID NO: 21027 - DNA, 598 bp, Bovine  MMBT22630
  misc_feature (1)..(129): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctgctgtctaaaagacagaatgccagattttttaatatctcttgaaagcagctctcccagtatgccgcttatctcttcagatatgtaatttaataataggttccttcttttttatccctctcactgaaatgatacctatagaacatcattaatacctcacatttatayggtactytgagttcttcaaagagctcgttcatctattatcatgctgtgctttatttcatacaacatcccagtgagtgggtagaacaggctattgttattctcattcagagatacagaagtacaggtaaagaaaggtgaaatgatttcctgaaagctatgcaaatgattagtaaatctggaacaaaaattccacttctctgactcccaatgtcactctcttttctttatctgcctcttcaaacctgtaatgtagtttgctcatcttcagcatttarattccawtctgaggctgagtggt

SEQ ID NO: 21028 - DNA, 600 bp, Bovine  MMBT19940
tggaagayggattcttaaccaccggagcctcaggaaagtcacatccatgacattattaaccaaagacattattagcaataggaagaagcccctagtcactgagcatttattatgtgtaaggcactgagctatgtgtatcacaggttattttcctatttagctctcagaacaacctcgtatggtataggttctttttatttgattgaggtatgacacagtgaactgtctagctctcaagtgtagagctggatgagtcgtgacaaatgcaygcatctgtgccccttgtctggccatgaccayggcaggcttgctcaggcccctkcccactcaattcccacaccattcgcactagctgtataacctcagattcgttttatctgctcaagaacttcatataaatggaatcatgcagtagtgtgctcctctagctctggcttctctgattcagtacaatgtttgtgaaattcgtccaaatgggtaagagtgggacacagtccttttccttttttttgttgagtaatattctattgtgcaactactaacacagttcatcattctcacactgaaggacatctgggttgtttacagtttgggggacat

SEQ ID NO: 21029 - DNA, 600 bp, Bovine  MMBT04887
cggagttcactcaaactcaaactggatttaataagcacaaaatatttttttttacttaatatatatttattggccatgtgtgtgtaaaatactrttgagagacatatgaaaatggataaggcatggtcccttctatacaatttaaggagggagataaaactggaaataatttagggaactgatccaaaagacagatgaagtgtggataacagcaatggtaaacatggagctagttggtttcctttattcatccttgccaggatgtatacacatacctactgagtgccaaacagtggccaragcaccagggaaactatgaaaagtctgtccaagcaccaaattggagctgcactgttatggcaagacagaatcactaggaactgacccttcctgggtgtagaagctgggtgcagtctgcatggaaaaagctatggtagtctatagagtatttagccyttgtggtttcagtgtgttagcttgaagaagtagattctctttcaaagtttcttacactgaggcccaggggccacttcctcagaattactgctggggcttgttaaaatagatttctcagtccttccctaaaaccgactgagtaaa

SEQ ID NO: 21030 - DNA, 600 bp, Bovine  MMBT20719
tgcgtccgtattttgcctgctgtcagttccgttcatgaaaagcaccccagaagctttattcattatcattctgagtcatttctctaccatgggggcagctctaatgcaatttatatttagttcttcctatgcttctagttctttacatcaagccctcctgttagtggtaaggataagtgagccattggaaaaggttttgaacccttagtgaatttcatcctaaaatataccaaaatgctataatctgtatgcaattttcattaagaacttccaccacctgcttgctgaagccacagcacmgctccactcataatcaccacgcagggggcagcattagttaacgtcattagacaaatgttgaggttttcttttgcgtgttcattagcaccaggtggcaagaaactgctagacataggtgaggaatttggggagggggtgattgaggattatgcatcatttagtcactcaactttctgagcatccttgaaaaaccaaagagactaatagaggagtaattttctgtttttttttttttttttcagatacttcaggatcagttctggtttccaaatagagggtgatctttactagctgggtcat

SEQ ID NO: 21031 - DNA, 600 bp, Bovine  MMBT08186
ccgggggggggagctgggcacttttaggacccaagcaatgggacctcactaggatctttaaataaaaactttgatgattttctgattctgtccagtatctgacaactgtcaggaagggactaaaagtcacctacccagattgcatttctcagaaattattataatttagttttgtacattttaaacattcttttagtgtatttgcaaggctgagaccatattcacaattctgtattctttttttaggcaacattttaagtaacatmattactgatctttgaaagcattaaaaatcagtcraatatttatccgacagttaccagttagcccacaattatttatcagacacttgctrygtgcagatttctacacaacgttctctggagcggacctgcctcaaagtgtacttttattattgcacattgttgtccgactctttgtgaccccatggactgcaccctgccaggctcytctgtcyatgggattctccaggcaagaatactggagtgggctgccatttccttctccaggggatcttcctgacccagggatcgaacccaggtctctagcatttcaggcagagtgtgtaccacagagccg

SEQ ID NO: 21032 - DNA, 523 bp, Bovine  MMBT12712
ttgagtaggttaggtgtattcagtgcattttcagtttatattttcaatttaagatggttttttctggacataatcccattgtaagtcaaagaagatctgtatagtaaatgtaacttgctttcatttgaattagaaattctgttttttattcctcaaaagcatataacttcttttctttataagtcaattttatagwgatatagattatttacaataaaatacaaatacactcatttcaagtcttgacaaatgtatacacctgtctaatcagcactctaatcatgattctaggtttccatycctctaaactcttctctcttgcctgtgtgcaatcatttctccctttctgccctgtattaaatagttccattgattctacgcccttcaatgttagccaccaacctactaaaaatacttctggaagtaggtggattataaaaaaacaatcttcataaatgaaataaccttttcaagctctaggctttcttcctgtgactgtcattcaatttacttttcttttagt

SEQ ID NO: 21033 - DNA, 600 bp, Bovine  MMBT21959
ggttaaaacacaccagcacaggttgtatcctagagtaaagactaactctgtcagcgtggtatgagtactcagtggaacaaacagagtgatccttttactgagaagtgacactaacattatgcccttccgaacttaaaggcctctttctggcaccaaaccaaaagggcacctaagttcctcaggccttatctctatatgcaaaagagcttgatgaaagatactgagtgttgaaaaaaacacaaacaatggaaataatgaaggaaggagattctgtactttcaacaatgagcaaggaaaackccacacaaacatgcttctttccgtcttatgcccacaagtatgcagcagaggaggtcttccactgtaaggctgcagagactggcartgattttaaaaagcatcwtttcttcctccatgttgtaaaaatttattttttatatcacccacaaagaactaacttgaaattaaaaatagcatcaaattttcttttgtgaaatctttcttcagactgagggaaagactcctcttgacttcactacctagcatacaactccttcaggacaagtactgatatatgatgacactgtgattaatggttac

SEQ ID NO: 21034 - DNA, 600 bp, Bovine  MMBT02873
aataacctcagacacttagagatgaatgttgacacacatctcttccaaattactacaagtgttaaaacttctctggaaatacatctagctaataagcatttcatattttgagagagataggttttgttaaatttttgactgcttagagcattttacaaataaattatgaaactcttcagtgtgcggtgtgtggaaaaatccatgagtcctaacaagcttgtttctctggaagatgcagaatttaaatcagtctattgctgatatttatgtacaaactctgctcacaaaatatttagcccrtcagcatctgccactgccacagacagattcagatcagaaggcctggttccttcccatgaattttaatagaatgtcctcgcagctgaggattggccagcgtttccaaatggtgatgaatgggaagacagatgggcccttggagtaacagaaggccgagtcttcaaaggtggcaattgctggcattctctaacatcagtatactcactctcgatctataaccaggcatgcgacatcattttcctcggcgataatgttagctgatctgacatcttcactgcagacaaaaacaggaaaagtcaa

SEQ ID NO: 21035 - DNA, 600 bp, Bovine  MMBT02803
ttattctcacttggcctataatatatacgttacactcattttcagcctgccatttatattttcaaaactaattatcttactaccatttaaagtaaaatgaattttactttaccatttaaagtaaaataaattctgagaatttagttgcattttaatgttttcataaacaagcaacagtattaaacaaaaaaaagcwatacacaagcaaaacacagatgcaggtagagaataaggtgtcgtctataacactaatgtttcaatttttcccatttgtaatccatctaaagtgtacaaacacaygcacaaacacatgtttagatattctcataatgtcataacttttttaatcatgaaaaatactgccctcagaaaatatatcctccacattaaacatgaaatattaatattttaatttagcatttattaggagtgaaatatccaaggtgacagtaaagtaattataactgcagagtttgaaggcaaagtgtttggagttcgttcttgtgtgtattctataacatggttcatccttaattttctgacctgtaaaatgaggataatagcaacaccatagagaggagaaaatgtaaacgatctggc

SEQ ID NO: 21036 - DNA, 600 bp, Bovine  MMBT04852
aaaacccaaattcaaagaccggatctgctatgtctagacaggtggtactgatttaacagttaaattattaatcaaatatctacaaaggataaacgtcatcctagattctaatccaaaatctgaattcatgacatctaagtgaatgaggacttagttcattctttcttctggtttctctttctactggactttgtgatattggtggcttttgaactgggcattaaagagttgccctcagtgtacaaaactggatatattgggtagaggaagcttaaaggcagagacaatattgtgctgacrtacagacatacagatcagcaaatgatacatcagttcatgctgaaaatgactcaaatatttgtgttaatttattttgccatattataaactataaccactgaaagttaaaaggctattgttcaaatgactatctttctaaagtatcactgtcaggttttttgaccaaaaggaaatctatagtaccactgctggattttaaatcattagagaacatcagtgtttttaagtaacaaaacaataaaacaacaagagaaagttttcttgacatgggatttcatgatgaaaatcttaaatattatg

SEQ ID NO: 21037 - DNA, 598 bp, Bovine  MMBT19666
  misc_feature (1)..(6): n is any nucleotide
nnnnnntaagagggattgatgctgaggactacagatcactaattctcgtcttaattaccagtgaagaagcagcagcatgcattagggccggaagatactactgaaaattcttcaccggctgaagagactgcttcggcaacttttaaacagtctatctgtccatttcttcctttaataaacacactgaaattaaaagtctctccctccattacctaagagactactgatattttcagttgtttaacctcctggtttccttcctatgttgccattatacactgtaaaaaatgaaacctgaarttaagtgaaccaacacaaagcaaggcatgccagtgaaacagagcagactgcatcccagaagtcagcatctaaaactctgtcagaagaacctaagtcatatacttttaaacgggaaaaaggtacaaacaagtacaaaacccgtgtgcgtgtgcttacttagcgagctgtactggctgagagtggacctcactcgtctggagatcggggatgagctgagataacccatgttgcggtgataatccatcagctgttctgagcgtttcatgccaactgttggcttcacagcttcaagcctttt

SEQ ID NO: 21038 - DNA, 600 bp, Bovine  MMBT17478
gggcccatgagactcaatcatggattcgatgatctggccactgcacctcccagcgaggtgagcctgttctgtggcctggtagccagttcccacgcgctggaggagggccccctctgtgcttgaactgcgatcacctggggacctcggtctttaggggccccagcatgcagacctttccttccttaacttcccactcgagggggccgacttcttacagatcacaaagcttagcaaagtcacgcgcatccagcgtgccacagcctgcacgggactaagccgagagtgcttccgaaccttgcstccagtgctcgtcccccagcctgttactgactccgcgaacagacacggatcaggtttctgctgtcggaggctctctgttgaggccagaggaggccagaggcaggtccacacccggacgacacgcctggaggggagagctcgccagagcrccctggaaataggcttggagagaagggcagggtgggctgtggcagcccagagagatgggggccaaaggactcagaatctgatatagcggggagccggcaccactgccccaggcctggggacaccctggcttccctggaaggcccttcacct

SEQ ID NO: 21039 - DNA, 600 bp, Bovine  MMBT07432
gtgacattccaacctttggaattaaaaggatatttatacttctataacaaaataatcttactttgaaaaaaaaatggatgcagaaagcacagcaaaacttaataaattcacattgagtaggagaaagacctaaccaaattagtggcctgaattatagaatctttaaaaaatttaataktaatttaattactttcagattcatggagttccttggagaaatygctttggtaagtagctaagaaaaatttacaaatagcacatcagtgggtaaataaagcaatatttctaaagaatccaccrtggactaggatttttaagtggttttgctccctgaagtatatgcasgttatgaatttgccttgcaaaaaaatgattctctatgagacataggagagatattcctgatttttaaattatttgtggtatttggaagtccttcatttactcattcgttcttgcattcactcactaagcaaacgggaggtcattgtactggggacccagtggcgagttcaacgtagcccccgctgtctacatcctgtgggctggagttaaggaagtacattttaatgaataaatatgtagttaccaattatgcta

SEQ ID NO: 21040 - DNA, 600 bp, Bovine  MMBT10582
ttctaaaagatgggaggaagggggaattaaaaatagatttgttgtcgccgtaacactgcaagccacacacacgacaytgatcagagagaatccacgtggctgagtattggacatggaggtaccagtggactcatttctcacccacaaatattgactgtgcagtaagaaagcctgcgagtccaagactggatcatggaccttcataggccatgagtgggcgagtcagcaagcaaaatccatgcctctcagstcacatccaccyatcgcccatacacactcagacacaaaaactgaccaagycccccagtcacctctcctaagcttcccagtgtgtcctggcccactcytaacaagcatgggcaaaggccacgactcctcttaacagtgaacctggcccaactctctgggccagcctcttgatggttcttatatggacacaatgggaggcctttaaggaaccagggagagagagggtctaggagggaccyacactgttcatcttcaggtagcaccaagaatctgagggagcaggcttcttccttcctctgcacccacatcccttcttctgtgtcttagtttctgtcacacacctttaaaggc

SEQ ID NO: 21041 - DNA, 600 bp, Bovine  MMBT08699
tgctacataatgtggaaaggatattttaatagagcaatatgattttaaatactcattaatattattaaataaatatgaatcacatttaaaaaattctgttagtactatgcctaaatctaggatctttcacactgaattaaatgactagcaatcattaatgccagccagctatgctaacactgaaaatcatgcaaacttactaaagattttgactaataagaaaggaaattttattacagaatattaaaagcagctgcaaatgtctacttttaaattggaatatatcctgttaaattaacyatcaataacataaaaagtaccctggaatccagaaataaaaccttgtatttacggtttaataaagttttttttttttttaaggaacttatttttctgaaaagtaaagatttacaaaaatatttcaaaagaaagttttgtcatcaaaggagacagcaattaaacttcagtatacttattagggaattatcatttcagtaataaatcacataaactgcatcatgccaatagataaataatgaagatgccactgtcaatgaaaagatgaaatattaaataaggtccaaaatatacctgggggtg

SEQ ID NO: 21042 - DNA, 600 bp, Bovine  MMBT00613; identical to SEQ ID NO: 4552

SEQ ID NO: 21043 - DNA, 600 bp, Bovine  MMBT01016
cacctgggaacccattccaggtgcaaaattactcaaatgtgtgtatgtatctctctctacatattatgttgttgtaatatatatgcatgtacctttctctttccattataatacatatattcaaatcaaactaaacagtgacatacataataatgaaaaatttactttactaatactattttaatgaaaatatgtgaatgattatcatagctgatgaaagtcaggctcgacccaagaaagtcctggaaggatggtaagtgtgaagaattggttatacacctggctggatggtgaggtgtytawgtatctagaatgaggtgttagttgaaactttgtgctcttctcttgtgttcagtcactcattcatgtccaactctttgtggctccatgaattgtagcctgctaggytcctctctccatgggatttcccaggcaagaatacaggagagggttgccatttcctcctccaggggatcttcctgactctgggatcaaaccagtgtctcctgcattggcaggtggattcctcaccactagcaccagctgrgaagcmcagatgagtctgtatctgatgcttactgctcastcatgctatcactt

SEQ ID NO: 21044 - DNA, 598 bp, Bovine  MMBT09049
  misc_feature (1)..(77): n is any nucleotide
nnnnnnnnnnnnnnnnnnnnnnnnnnnnnnnnnnnnnnnnnnnnnnnnnnnnnnnnnnnnnnnnnnnnnnnnnnnnntatcttattaattaaaaaactgaatatgtctttcagggattttttacctctgcatgtatgattaattcataccaaagtcatcaaaatacagccaagtgagggccatttgatgtcctggtgccctttaatgagagatttcaatctttttccctttaattgagaaattaaaaaaaaatctagtcataaatagaactcagcctctaaaaggaccttggctttgcaytgaaacataaatgcttatgaaatcagggagatttcgagtacgttcttttctatcagtaattctgattagtctcatagatataattcagtgttgttaagattataaaattggttcattcatcttgagggtaagagaattaatgagatgatacctggtgaagcaatttcaattcagaggtagactctaaaagtgtgattcatatttgtcattattgctggttgctgtatttacttttataggtgtgatgaatatggttttaatttattatggttgcattgactgtatagccatactgaat

SEQ ID NO: 21045 - DNA, 600 bp, Bovine  MMBT16630
gggcccgagacggtgaccattgccgggtcagttctgctcgtgtgagacactgcgctccagcggtccattcatccaggcaaaggtctttctgagagtggggagaaatcccatacctcttccttaccgctgacaagagtgcattttccagccaaaattgagtctcacttcggacatgaaagatgctagtcggagctattttacaaatatgattttctagctgtctgcctgataaagcagcttattccagatcctgtgattccttgcttacaaaataacccagacatttctccttctcagttrtggggggaagagcactagcatccagactgctgaattcgaacagcttttgtttctagtcagtgggtytcacataccacacaactggatggaccggatggcttttattttcttagagcgtgatttccatatctgatcaacagtgactgcctgtgagtttattagatatgctttttcctaattactttctttgtagaaaaatatatcggtagccagaggggaggatgtcaagagaaacagtaacagagaaaataccacagttacttggatcaattttctgtgaattaacctatttaacatctg

SEQ ID NO: 21046 - DNA, 598 bp, Bovine  MMBT05387
  misc_feature (1)..(86): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnncttatagcatgttctaagtacaatctggaaaaaattaagtcactttattcactaggctgaaagccatgcttttctctcgtcctagtctactgctgcacggagtctacaaaaccacagcgatatgctcagacctcctggggtaaatgccgccatatagcctatagcaagaaaaaaactccaattgggaaattcaacatgggggactaaagcaaaytgtgaatttgtaacatagtactttacatatagaactgcgaaaaaacaataaaccaaaaaaagactctcctgtaaatgtcttagactactatctctgaatcaagcatccaagagtcatagttttcataatgcttggatagagtattwytaaaaactttcagcttcatctaatataaaattaacaattacagttccccaatcgctgattctacaaatattcttaaatctatattatcctactcagcttgctatttgctaagtacatcacagtataataataatatattttataaaagcag

SEQ ID NO: 21047 - DNA, 556 bp, Bovine  MMBT18066
tgaaaccagatcaactctgctcggaattgctattaaatcttcttttgagaatcttgtttttctttttcctgttaggggtggccccttggtagaaggacgtttacacagaataaaggagaaaaaaaaattgtttgctgaaggcatcagctctgagaaatatttaacagtttgcaaataggcaggcagctcccagaccaaaagagtagggaggaaggctgttctgctcttatgaaaaggagatgtattaaaatgcagtcattaactggtggaatgttctagaattgctgacgacctactggraatttgggctaagtttctcgaggctataacacaactgtacatcctcctgggaagccggaaaggaggaggacttggagcagcagggcgtggatcttagcagagtggagcggagatgggagaggaaatgtcttcccatcattgttctgatggaagatggggaaggttgcccgtggctcagcaggtagacgtcattaacagggagagaagtccccaccagagctcgccaacggccaagtgttactcattcacccggcaa

SEQ ID NO: 21048 - DNA, 600 bp, Bovine  MMBT10315
attcatttcctctggcagccagttcagaacaagcaagggaacactatattccaaactgcatttttaaaatgtgaatattctgcctgttactttatgttttatgcattgtttgcaaataggaaacacgggtcacttcatattttatgaattttctttgaaaaatgatttgaaagaaagttcaatatcaggagcatagaccttggctctgactttgccraatgtctgatttttcccatgctatctattttcttaaaaaaaggataatttaaagcaataccttgccctttggcctcattactrtaatctgatgagaaccagccttaaaatgtatatatttaataaatatgtacttacccaataagctgtaaaaagcactgcatgggccttgaagtcaagagtacaacatgtttttcaaaatatatcaaggtcaaatttgcttacctgataacatgtaaaaggaattcttggtataagttatatactgtcatatacttgcagatttaggaccaagttgaccaaaaattctaccagaaatgtcattaaggtaaaagggaatcttttggctatgggatatattttatktccaaatgcagttttcct

SEQ ID NO: 21049 - DNA, 598 bp, Bovine  MMBT02241
  misc_feature (1)..(133): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctgcctatcaatctctttgtaatatacactattccccagccgacgtcttcagtgacagccattcatgtgtcctgagctgatcaaacgcaggcaatagtgatggttcagcacgacttgcctttaactgaatgaacagaaactgttccccaaccatgcgtctggtrcacaaactctactgttcttttaggcttttaatgggctgtcctccaaatggcacatcagagaaaacatttcatctgaagaacaggtatagaatgcaactacttgttcagccacaaccctggccttttgggttatgtgmagtcttagttctgaataaccgaggataagggggggtagggaagcttttccctcaattctaaacaccctttagtctcctttgagtcaacgccgctaattatgccaggcaggctgtatgatgagtagcggttttgtgatcccaactattgttcagaagggctg

SEQ ID NO: 21050 - DNA, 600 bp, Bovine  MMBT22842
attataaaatccttragaataatttagcacaatctattaaaatcataaatagccttatctaccttatgcgacatagtaacccaagtttatttttatatttaagaaaaagagaaggtgaaaatgataaaaatctaagggtctgttggttgcttacaattttattttttttatgaaaataggaatttataaatttagtaaatatttattttgataaagatgaggattgaytataattcaaataaacatttcattctatgatttgaaaaaatggattttagcttcctttaaaataatgcacayaaaattttaatcagcaaatttcagcctgtgtttatattgaaaaccatgggttattgctccctaaactcaaaatacatttaaaaccataatcttattaagctataagcatccctgctccactgctcaaagatacttgtctttcagccaaatgacatatccagatgacaagcactgacaaagtcagggagaaagctgatatttttaaactcatgaaagaagttgatttcagtgcttcttacctgtaatctctctgcctcactcccacgtgactgttccctgaaagcaatgctgactttggct

SEQ ID NO: 21051 - DNA, 600 bp, Bovine  MMBT20628
catcatttaattattccaaactagattccagagaaagctacaggcttgaagtacagctgcaggacagaggacagagttcagaatccagaattcaagttctagaatcttcatgtcctggtttgagacccagttctatacatccagctgcataatacacggcaatttactgaatctctctcagccctagttttctgctctataaaacagacttaacaatgatcaggatcatgatgtaataagagcaaatgactcctagggttgtggtgacgattgtacaaaaagaggtacatgaacagtcaytatagcaatcagacattggagagttttgtggcaacatccccgccagttctagcacctaataaatggtcatcacaagcttactgatggatggcctggtaaacaaacatgacaaaagttgctcttctcacttccttaaacccagcagaagattagggacaagagacaaatataattcatgaacggaaggraacaaaagggtttggagggacatggagtgacaaatttctaacttccctccaacatgtttaaacgatgtgtccctaacggagtgacattgcccctgattctgctstttctatt

SEQ ID NO: 21052 - DNA, 600 bp, Bovine  MMBT09054
gtaggatatatgaaatcattccatgttctttttgaattatgtaaatcatgctgaaagtggatagtaatttcaaagagcatttttatgccctacaaattagtttattactcagaagcacacgaatgatgacttttaaaaatagagttatgtattcaagaagcagaaaatgctggtgtgtggagaatgcgtggaccaacagtgagtggctagtcataaagccgattgctagaattatcctcaggtggatccaattagctgcatctgacaggacgtcagacactgctgggatgcccatgttcrtgtgtcttatgtcccctttggaagccagaagatgtctcagtgaggctccacccacagcagccatgacagtgtgccctacccctctcccaattcacaccagcatgaactaactgaactgtgattgaactttcctgctcaggcaagtacatttttaacacaatctaccctgtttaagcctaatttgcatttcattttacaatcttgccattcaacacaagcccttaaagatagattttagggcagcagctaatctgaaacgtacatgactctcattctgctaaccaaagatatgctttctgt

SEQ ID NO: 21053 - DNA, 598 bp, Bovine  MMBT18786
  misc_feature (1)..(229): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgcttctgtttgagaaaaggacctgaggatcagcaacaatgacctccggagtttctctacttattttygctcttaatttcaagttccaagtctcttattagcaactgtctcttaattataagtttctgtgggattccacagctgggtatggaaatcaagtgggtaytcaggtgtcagatttaattaatctgggtaagaaaactgtaattcagggttttcttgataatcaaaagatgtattacccaacctttcactacttctctttgctcttttcagtagagaagtacaaattgtcatttttgaactagaatctcacctaataatagctactgaaccctgacagtggctggggggtagacagtatgt

SEQ ID NO: 21054 - DNA, 600 bp, Bovine  MMBT21269
cagaataaagcaaagccagccaatcactgacacatctgggaaggagaccttgtcttttactgaccattctccctctatccattaaaaagctatccctaacattttcagtgggtatcctgccttcctgcaaaaactctgcccttgtttatacacatccttaaatcacgggcaatactgactcagcatatcaacagctcataaccacgtgcccttgaatagtcttcactgggtaccttaactcagagcctgaccatgcttcaaccaattgaacacgtctcagcagctgaaccgtcctcagaytttaagaggctctcatgctcacaaatttccacttggaaaaaggcaaagatatgaatctttctgaaagctggmtatgagcagagtccaaaccctaagaagtaatacctgaacatttacagggacttgaaaacatcaagccctgctagcgtgactgctttcccggttttgaaactgacaagtgcgcawgcgagaaagcgcgagcctctgactcaccggttccgggggtcttgagcgtgcctgtcggggcagccggcttcgtccttggcatggtgatgccgacctgagccgtcatgcctcgcc

SEQ ID NO: 21055 - DNA, 600 bp, Bovine  MMBT01053
actggaaaagcggtctgcatatttgaaattgtagtcgagatttcttctttttttcctcatttatggtttggctccagagccaaagttacgtcttgaaaccttccttgctgtcactgctgactgcctgactctgctgtgctctataaacctgcctcttctctgcgcctgccgggtaactccctactgcacaccccagacactgtcttacatctctgctgggtcctggggtgacgtggaagcaatgtctacatggcgcagtggagggaaagagggcagtgcgcttactgactgccagacagyggacagcagcccagagcagtgcttcttactctccgtgaaaaagtaaactatgaggagctgatgaagaggcaggaaaactgctgcattttaagtctgtataccctayggtcagggacagattaatacatgctgatgccgttactatcttcatggctgcattcatttagataatattttagtgcaggagtttatagtgcattttgatattggatgggcttcgctggtggctcagagggtaaagcatctgcctgcaatgcgggagacccgggttcgatccctgggtcaggaagagcccctgga

SEQ ID NO: 21056 - DNA, 600 bp, Bovine  MMBT04443
tgatagagcaacttttcatgagctggtagaattagcgaagacatcctctgcatttaagcgaggcacaaatttcaggatgtaaaatggatgctttacaggagactccattggtttactcttttcttcctcagtattagtaacttaacaaccattttcttttaaaagaacatcttaaaataattttttaatcaccagactgtgacaagtggagactctgaaaagatgtgccccaaacaggtggtctagacaactttctcaaggtgactctctgctggacttgtacgttacaacataagaaayggtgtgtgtcagggtgacttawttaggtgacttaattaaagtccttctgatgtctatttgggagaactaatgagtttcttttatcaaatttattccaagcacttcctgagatgcaaaatctgaattaactaacttctctataaatctgatgaggaaaccaagttctaaaaataacatgtgcagtgctggaaggatctggatgaaagcatagaagccagctgagtggatgtcaagaaagaatgtctgatcttgatgttttcaagcttggctcaattgaaacacttctgcaacttagagtag

SEQ ID NO: 21057 - DNA, 600 bp, Bovine  MMBT04431
cattatttagaattttgactttggaggaaatgaacctaggcctccatttttattttttgtttatcatactgcaatttttgccagtatacctaaatccacacctgtgaccttagtgtagagctccacaatgagaaaattctgcccttgagttgtcttcaccttggacattactttagggtttattagcttggagattgagccaatcttccttgttttaatcaaggtatttcctgcccttcccagcacttcaggctgctgctgagatgcttccagtgtaaattctcttctgtagtctccatycacactgggagtcttcctccttcctgggggtcttcatacgacttgttttagtcagtacagaggggactgctgggcataattggttccttccatgctcagacatccatgaatacctggagccacaaagctgtgggtcatgttctctctctctctttttctctgtctctatctctccatctctcaaatatgtgttgactgcatctctttggtatagctcctgcagtacagcctttagagtttgtcctgctgggtcatgttccattcagtttcccaaggactagatacagtgttcaccaggat

SEQ ID NO: 21058 - DNA, 600 bp, Bovine  MMBT16939
ttaagaagtcaagagtttagcatcaagtctataacaaaaaagaaaagtgaaaatatttgaggatgtagggaaggtacattaaaaaattagccttacgtaagtaatcaataaatttctgaaaacagtaaattatgactacaaaagagtgtgacatctttactaaaaatgtggagtagcacatgctaaatgagacacttggtagttgtttttccccctgtgatgtaattccagattagagttacatttttttcccccatagagcagtaaaaagcttcaaaggaaggaaagagtgggatgtgrtagaatgagaattagacagcacagtcagctggtacataaaatgatgaaagagactagaataatatcaacatcttgtataatcaatcactgcaaatgtgtcaccaagtatgaggccatctccaactgtcaatacgaccgtgtagacaatccgggtaagggaggaagtacagcatagtcaaacacgcctatcaacacttctttttttgtctccgaagaacaaaattctgagacgagacaagttcttggagcaaatggaaatttatccaaatgaaaatcaaacgataaatgccaagagaatat

SEQ ID NO: 21059 - DNA, 600 bp, Bovine  MMBT06697
tgtatttttatataatctattccaccttcgagtctagaataaaccacgtgagccaagacatgaggaagtggactgactgactacccgggagagtcataggcccactccaggaaccacataagactcagtagtcaccagaacttgccagttggagacctgatcagagattcttaagtctagaataggacagaaaaagcacaaagacagcccaagagcatacttgctttgggctaccttcctgcgctccttagcaattaaacttgattatagccgacagctcccattacaattatctgaagmcgatagcaagagcctcctgtcaggaagctattaataacccgaaagccttgtcttctttctccctgtagtcactctttactttctgggggagattacagaccctgcagatccaatgaagcacagagtccgggcatgcctatggagagttgggacagagggtgggtgactcaggagaggtgctgcccagacaagaaaccctgatataaaggaaccatgtatgtgcctctgcccacccactcagggccagcctaacacatgctgacccaagcaggggcagtcagttcagcaacctgtccagaa

SEQ ID NO: 21060 - DNA, 600 bp, Bovine  MMBT11210
ataatatattgcccaaactgcagaacgtctgaaagtcagagcaattaataagtaagccaggaaagcaagcataagccagaactctccgcatcaaactgggaatatgtggtcacccaggctacaagcaaagaagtcataatggcagagatgggaattatggacgtatttgtcatcatgggctgtcccttacccaacactgcagagcatccaagctgccaacatcagaaacaaacaaaatgcttctgacacaggatcacacctgaagggaccaggcagccatttagaaggaattaaatacastgcacctgtttcaraatagaagggatcagtgatttgtctgcaccagaggactttcctttcttttccaagtttctgccaacactgtcattcattgacttactgaatgacttattgtctcagtttccatacgatactgcttctgctatggaattcacattacagaggaaatgaggcagttgactgatactctttaagatttacagatcctaatgtgaacattgaccttataaaaagtggaatgtctcatgttgaagactcagttgctatatgagcaggaagaaaagagcttgtgagtttggc

SEQ ID NO: 21061 - DNA, 600 bp, Bovine  MMBT11050
gatcgccgtcttgagtccatagaaaacaattaatgcagctgtagcataaaaaatcaagctcttgagaaacctcttttggactttgacataaagggctctggcacccactgtaatgaggaggcaaaagcccatactaggaatatacaatactcgctctgcaattacaaagccgacatagaaaaacaggttcgtggcaggaacaaagggtattattaataaagataaagacagaacaactatgttctccgtagaaggaagctgtgttctctgcgatgcattgtttctaatgccattttctastttggatgcaaagctgggtttaatctctgagttcccgtactccacctctgaatggcagctatgtccatttgcattctgcttgccatttgttacaaatttcccgttgcattctctttctatgcttgggctcttcaaaccaaagtaggcaaggaggaggagtccagtatagaaggccacagtgtgtaagtttctccaatcagaaattgttttgagcagaggcacggcgtccattgaccaatcaaaactgagggtatctgggcatagcaacagccaaaggttcttggttggcaagtagaagaa

SEQ ID NO: 21062 - DNA, 600 bp, Bovine  MMBT17397
aaaaggaaaagaatcactgagaggttgtgaatttaccaatttaccaaatatcttttacatgtgaaatatctgagattctttttatacctaggctcttttaatactgaacagatgtcatctggtaattcagttctgggccaggtctcatgcacagaacaatgcatatattaacagaagctgtttgttcttcaacaccttttaactgattgtctgtacatataaaaggagcaaaagtgaatgccttccatgtaatgtcaatttcacaagtatgttacttaaaaataaatgtttacactgtakgttatttgaaaccagtggctaaatatatttgtatgacatcatattctaattccattgatttactggaatgtactgagagtatatgtctataaacccctataatataaatctacaaatttattattttaggaaataaatctatattattttcagcaaactatatatcaaaaaatttcatacatgttttaatagtaacaggtattttattttaactcctcatttaacttactttctccaattaagagtagttctatatttctgaaaaataagcaaaagaaagaatcattttccacaagttct

SEQ ID NO: 21063 - DNA, 600 bp, Bovine  MMBT07405
caatacttcgagcagtggtcgtaggttatattcctgctaaaaacataaattatgattaaagctaagcaagaaactggcagccacatcctgacagttggggtgtaataacggcccagaacgaagaaccaggcgacatgcagactaagggccacccctccaggaagacatctcacccagcacaatgcyccttcactccttttttttttttaccccccacacccattcaaacttctacaaaacaaagagatttctcataactagagacatctctcataactattcagcttcagtttttcattytggaaaaccagtaaaattctcttaatcaggataattttattcttcacttcccatcaccattaccccaggaacacaaaagaatatattttaatgcattataagccaactgagttccttaaaaaaaaaaatctagaatgatagttaataaaaaataaatttaaaaatacaagtagaaagatagttacgaaacgaaaggtgctttgacaaacgtataactctcggcacctaagtgtaatctatttcagctcttacatgggtgcctttatattttatgcttgaaaatatacgttagcctctttg

SEQ ID NO: 21064 - DNA, 598 bp, Bovine  MMBT10872
  misc_feature (1)..(82): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnaaattcaaggccaaggtgaatagaatcagccagcagatcagaagcataaaactctgagtactaacccctcttttttgctcctttaagcataaagtgattgtaatgaaattgagagagataagtcaagccatccatgtttatatttactggggcagtgatgttgaccctacttgcctgcagtagagattcaaaatcagatttttctggagttcaaaatrgagctcatcaacctggcttctctacagccactcatttgctctggcagtggcagaggaaaaggaggggtgaaaacaggtgggtgggtgggattcaaaggatgactcatggcttgcagcctttgtcccaagtgcagcctgtggaaatcacaaatgctgccaggtggatcactagttctggagctgactgtaaccatagagacagcacttctatatttcaatcaaagacccagaggcttccagtccctagaatatatggtggtaatgatggacacactgcagtggaggaccccaggaaagt

SEQ ID NO: 21065 - DNA, 600 bp, Bovine  MMBT05804
aaatcagctgagatttcaggcattgctacctgaaatcatacaagagcaagtgttctattatgaagtttgagcattgctgaggcattctagaagaatctttcttttttttttttacatcttgtttagtttttggcaaccagttaaaactccttgggacaacatatgcaggaaactggtatttacgatgaaagcacaggaggaaaagcatagcatcgtgaaggaggatctgaggtccctgaatctacattgtttacatgataaaagaagcataagacttccgcagctactgtcattaaggakaggatctgtacgcataggacctggaagaaagttcaagagcattagaggactgacccccgaagttactgaaataaacaaatagttcccaaattttgcttgagacccaatcagaattacctgacaagttttattttgttttaatgtagactcttgggacccatgccctgagattctgattctgtaggactgatgtgagcctcaaagacagtgttcttcgttgtttttttttgttttttttttttaatgttccccaagtcagtctgacgactggcctgctttaaaaaaccattataacaatga

SEQ ID NO: 21066 - DNA, 544 bp, Bovine  MMBT21517
cccagagcctgtaagtccgggcttgcctctggtctctcaatttcaattccattcttactccctccacttccttcctggagaactgggagggcatccttgccaccagcagtgtctggggtgtcatttaatactgccagtaatcaccacctcctgtttactggctgtctttccctcatggctagtcttgttatctctgggtctctctctccatctttcacacgcacacacacatgaatgggaaaaaggcttctctccatcccagttcctgccccatcctactgctctccctaaaactgatcygaatcaactggaaagcaggaaacaagaagtaaggatgtatagagctggagataccaacatctcttctgaactacaagagcggggggggacagcaagctcagaacaagagaatacttggagggcaataggagggaggtggactaaattagaaagtatcaaaggataaagatccctcttccacatcaaaaagagccgtcacagtcagcgaggactggaacacctgaaattactggtgggttcaata

SEQ ID NO: 21067 - DNA, 600 bp, Bovine  MMBT19675
tagtggattttgccagcttctccatcaacgtcctttttctgacccgggatccagtccaggagcatttagtcggaggtctccaagggctcctacaacctgggacagcttctcagacttttttcatgacttggacagtttgaagggtttcacgcagatattctgtagaatgtgcctctatctgagttgtttgaggttgtgtcctgattagtctggggttgtaggttctagagaggaagagtctaccgtagcatcacatatcaggggcctgcgacatccacgcgataccagaggggatgcctrcctggacctgtgggctcgggtgcctcctctgtagaggtgctgggcttccccctcaagaytcctggtctggaaaggaggcacaaattcctgctcaatctccagggggagccatggcaggggaagggttaggtccacttcctggagggggatatttatgtacatgatttggaattcctctgtaaagacatgcccctcctttttctttcattgtaaaatatattcttagatctagtctccttatttaatagatcagtaaaataaacatcttctacacatgctcttaagaaaaattgtttcctt

SEQ ID NO: 21068 - DNA, 600 bp, Bovine  MMBT07413
aaatttctaatcttttaggatatggtgccaagatatttctaaaagagtattggaaagatgggacttgaaacagtaattgttacaccgtgaagaatacatagtgtaaaatacttaatttggaataggccaactctaaattaatgaaaaatataagttataaattatcttttctgggtgtgttttgaagtatgacacattgaaaacttgctgtaatggatgatgtgaaataaaatggagcaaattaatgaaagattacaaattaagtcagtgttacattctgtgtcaccagaactcattaaygtgtcaggtacagtggaagtcatccattttgaaacgtcctattgcacagttcagttacttggcttaggttaatgtagcttaatgattaggattttaattaatcttcacttaacttacacawggacttggaragtatatgagataacattaatatcatctctttttatctcaaaaactgagtaaaagatggattatgaagctggctgatgccttacaatgaatttctaaatttaaaaactgatttttttattcattccatgaaaaatgtgtaaagaatccacctgcaatgcggaagacctg

SEQ ID NO: 21069 - DNA, 600 bp, Bovine  MMBT10938
tttgtcatcagccaactcactctaaaaaaaaaaaaaaaagaggctgaagaaaatttcctaaatagaaaggaaacaataaaagaaagawctttaaaatatcaagaaaagtgaaagaacacaagcaaaaatatgattaaaaacagcagactgtcctcgtcattatgtttgatgattcaagcaaaaataacaacatcatttaatatgattctaaatatacatggagttctgtgtttggttctacatatgaggagctgggaagtcaccactctatcctaaaagtcagtaattcttcttggatckatkagacagtggatgacacaagacaaaacactgctccaaagacggaagagactaacggattaatacagggagatatggctttctggagcagagacttacaagcagaaactgckatgggaaccagtactggctttgttaagctggaattataattgacaaattgctggacactcagtgcagacaactctgagtattacaaackctaaggggacccagtctaggagttatgcartattatgcaatttacctccaggagttaatgctaagtatcagagaaaaatccccttggscctctggaag

SEQ ID NO: 21070 - DNA, 600 bp, Bovine  MMBT22367
agtcacaacattcgaactcgtagctgtggcatgtgggatctagtttcctgaccagggaacgaacccaggtcccctgaactgggagcgtgtactcttagccactggaccaccagggaagtccctgagcacgttattccttcaggctctttcctgttctctctggacctggactgccactggccatgtgtggccgcagagcgtggaaagcctggcttgtcacactgctgtgtgctgagtgcactggctttttgagattaagtatggagaacaaaatcacttgtttcggtgtggcttctagcraatttacgaytccctatgtgttagcgttgctctgggccgcgctgttttcctttccgcaaggacttgcgccckgccgcttgcagcctccgtgtggcctgcctcttctccgggaggtgttggtggtacctggagggtgccagggactgcggttgagagtccagggtgtgcgcatggcagggccggggcgggggggcctgctttctgtagacgtgttctttgtggttttcagtgtgggcgagtccttgcaggcccctcaggtcgtgggctttgctcctacattgaggtctggctgtccacaga

SEQ ID NO: 21071 - DNA, 600 bp, Bovine  MMBT13785
ccagtttgtcattaggtgatttggaattccaacaataaacaactggttttgttgattgctttggctgaattgattaaatgcctctgagatatagtagaaacacttcagtttgtatgacagcattgcatttctgctttccagtaattatagtctccgttgagccaatatttccaaaggaaatgctgtgaaatgttctgaattggtgtttcatttacaatgtattattatctttattatatttacctgaaatagggaattagcaaaaacaaagccacaggtaaagcagaatagatgagctgyttgtacccaaccaaagttcatctagagaagttgaatataaacacagtatttctatatctgtgaggcacttagaaagtgatagtcattaaaagcccacaaatgcctcttggcacatctgtttatagtgatgaacttaaagaaaacatcaaggtcactcattctgtgtttaaagacttagggaactattccttcttaatgactgtgcatcttctaagtgcatcttaatgactggtggtggccagtggccaccraacttgtgctgctcagatatctgctgtgatgagcatagttgactattgc

SEQ ID NO: 21072 - DNA, 600 bp, Bovine  MMBT07750
ctgctgggtctgacgtcctctgagtttctaggacttgttcattttcctttcgtcttgacgaattaacgggaggaaaatcttactgagaaaaacgcatgtgcttctaccgttctgtcgatagtctgggatttctcagttgtgagaaaccccagggccacgtgtctagtggasgcccccgcccttggggtcctgtgggggtggcyggcccccggcaggcgctcctgctgtgcaggcaggcccgcccctccgcttcgttcacacacactttgggggagggaattagtgtaagactgatttctytttcttttattaccaccgcttaaggataatctaaatgtaattaccatgatggaggcataatgccattccaaataattacagcccaccgtgtttaaaactaacagaactctccccgctgatttacgggttcttttggctcaacacgcgtttcaaacactacctctgggagcagcacttcagataatgcgagaccatttttaaaaagcagatttgtgtagtcgattggggccgaggcggttttttttcctcaagcccgtagtgagaaattggttgttgccatagatcacggggcccgctccg

SEQ ID NO: 21073 - DNA, 600 bp, Bovine  MMBT07692
gggaatagcccctacctcttggaataggattaaacccatgtaaacatttggcatagcataaggcatatygtaagcacttaataaatgtgagctattccttgaagtaatttgagttggcaagccctactttggcagtattaaaagttttggttttgttttctgttttatttttttaatgaagtatagttgatttacagtgtttcaggtatacagtaaagcrattcagttatatattcgtgcatgctcagtcatgtctgactctttgcaaccccatggactgtaatccgccaggttcctctstccrtgggattttccaggcaagaatactggagtgggtagccacttcctactccatcagttacatgtaattctctcaaatcctcagcttctggggttagtttccagtgatgggcttcagtgtgatttctataagtcacccacttcctccttcacttactctttgagaagcaaacactggaggagggaacaagcagccagcttttgcccactgaagtcttctaaacacccagggcttcttgtagcagcagttttccaggacagacccygggttcacaaggtggtttccgtttcagaatatgt

SEQ ID NO: 21074 - DNA, 600 bp, Bovine  MMBT20732
ttaccagtggcacgggcaggagtggttcctcgaagatcccaagacttaagggaatgcctctgggaccagggttgaggtggactgaggccagggctcacggccactcccaggtccacagtccggcccacaggtgagaggcctattacctggggcatgaatggggttagcctgggcaggcccctgctggacccctggactggcacaactacctctggactgtcatagaacggggccagagctgggtcgtggggctgcccacagtcaagtctgcagtcgacacacctgttgctagaggtgccrgctggcatggctcacccagggcccctgggtgatcaggactgcgggagagcaaagcggaagggcctgctcgcaggcgttcagttagctctccagtctgtgggtcattccagcagcgtgacaagtgtgacactctctagttcccctgctgagaaccatatcatgaccatagataagcaggcttggagccgagtccacaggggtagagggctcttccaggcctgccgctgtggccaaggtccatggcccggccactgggatgcaggatctgccttctcaaagaggccctcctcagtcttgggc

SEQ ID NO: 21075 - DNA, 600 bp, Bovine  MMBT18692
agttttgggcttcccaggagaggaggaattttgcaagaagtagctcaaacggctcttccaatcttttaatctacagaagaaaaaaaaaagatactcacttagcggcaacacttgaaactgccattgcagctgaaggcatttttaccaaataaagtcgcccccartagctacagacaagccaaataagacaaaacaacttctccagtcagtcttactcctttaatccagcacctaagtactcaacacaccagtttcatccactcatctgaacataattattagttttrtaagtaaggatargacgrcctacaattatagggtattttaatgaatttagtttgcatagttcaaaggtagatgctatttatggcccacaaaaggcagccagtttttctgcaacggttaattacaattctgagacatttcacacttgaggaagcccacagtggacctgccctgagccagcccatgctcggtctcccttctactctcagagcaggaggctcgggaccacccgagaagctgtgcacaatgaggtgtgtgtgcgcgagattgaccgccccctctcccaactccagcactcattttaagaaggtgatg

SEQ ID NO: 21076 - DNA, 600 bp, Bovine  MMBT01188
tgaaatatcttacatctctatcttttcacttgctgctttcctttgccacttatgcttcttggcttcacagcgagtgtttcctgattcacagtttagtaaattgctgctcacaaaaatgaaactgtcaaagtaaaaaatgcttttcacgaaagaatctaaaactgtggtggaatagcagcagacaaaatggttcaacaaatactgctataatctttctttcattttaccttttactttaaaaatggtttgcagaacctcgctttccttgattcattcgtatttactcttagtacctatgtktccagttacccatttagtaaattactagaaattaactaatattagaaaatgtttattctttttctgctctttgttcccccttcatctttgtaatttgattattaataggcatagtacattttgaggagatattggtaatatataacaaatacttcagaagaaagcatatgtatatattaataatctgatttcttaaaatatgttctaagaaaataatcaagcaaatttcagcttattcattagtaagcggtttataattagctccttccacctccacctcctccatcatgaagaaaacaa

SEQ ID NO: 21077 - DNA, 600 bp, Bovine  MMBT03421
gtttgttgggatcttcacttgccttgtcttgaaagacgctgatttgcatccaacttgagcataaaggagagagaaagttaatcatctcttagcctcttgaacagatccgcacagggtttcattgttgcctgatccgaatctgggtgaaagtccctgttcaccagggtcttggtgagaatatccctgagccccggtccagaaagcttagctctttgaaagctctttaatttatactttaggcaaatctttctatatttgcagttaacctaagctccattcatagatctttactcattaagyagcatcatagtaatgaatgcccagtgagcactaagtcgatggtactcagccttgtagctgtgagcagcaartcagggtagagctttcttccttctgagccggtgaggttacgcaggagaagtccttttcccataggaccgggaggccagcggtgttccagcccttggtgaggtctctgcgcctgtcaggagtaccagctcccacccccggaatctccctttggtgatgctcggaccccacggccagcagcagccgcctgctcctggcttctgtgagtctgagaagagtgcttatcttctc

SEQ ID NO: 21078 - DNA, 600 bp, Bovine  MMBT09535
tgagcaactgaacagtcctcaaagagccttatatatggacaagaatcatatctacttaaagaggtgttatgagggtaaatgagaaagtactcaaaaaggcattataaacagatattacactttgaggtcttaccattactaaaaaaggaccacaatctctagtctaagctcttggtgtcaaacagttcagaattcaaaacttagagtttagaaatataatattgagcccatattccatattatatagcactgacatgaatagttcaatatttttttaatattaagacatagttttaaaayagtgcagttgatttacatcctctcagttcatgtcctgccacacagtgagtaggtcagatyagatttcacactaacaagttacaataatgtattattgaaagacttgggattttagaatggaagtttactatgtatattataggagatggtatatattaaatgcctagcaaacatctggctgtctccttggtgcatattaaatgcttatcccttcttgagctttctcttttgtgtcccctaatccacagcccgtctctcgtttccccagtgacacggctgggcttccatccctcagcctcc

SEQ ID NO: 21079 - DNA, 600 bp, Bovine  MMBT13784
tacactaaaaagagtatctgtaattacaccagatatctccaggggaaaraaaaaaaaaaagatgctgcctgagaacaggtgtcaatcgagtatagaactaatttattccagtggatgtcataactatgataggtccaataactttccaatacagctatatgaccatgtttattttgtaagtcactgttactttcactgtagaattacattttgttttctgtgtctctaatgacttcactgttatcaaaaactgggtattagtaacatcaagatgtcagccactaatgcaataatcaaaayaacatgtatattctcagtctctctgcaaaactgcctttgtttctcctttagaactcaattcaagaaacattaattgaatgctagcaatttcaggattcttgcaaagtactataaggaatgtgatgttgaacaaatcgtgtgccttatcctccaatagccatctcttaaaagggtttgcaaagtgcataaagagctataaagtttaaggcggtcaggaatttaatacacatgagatattttgaactgtattctgatttagccattgttattaatacttagcattttctagctcttggagat

SEQ ID NO: 21080 - DNA, 600 bp, Bovine  MMBT08778
tatctctttgaaattgtttaactgtctagctaatctagctaattgtttaaaggtctagctgacctttgtatgcctctgtttgctcatgtttaaatggtgtgtttaaccatatctattccatgtgtttattatgagatttaaatacaataatgtattgaggttgagtagcacatggcctgccatgtaaacaaagaatcaatatatattagttgccatcatagtcaaagtcrtcctcacttataattagttacatgctctttgctcagcaccagtgtttgtgttgtagaggaggtaagaaayttattaaattctctcttttcttagaaggaatttctaactgtctgagaagacaaaaaataaaaaaaacaaawcaaacacatacaagaacaacataccaaggaaatgcagaacaaccctcaaaaggcacagaatttcattgttgggcctgctcaggtgtgtrggtatggggaactctgcgttagtgggagagaatctaggtcgtagaggctaagtcattgcagcagagagtcctgaatgacatggagaacrggggtgtgcctggaactgggtgggcccargaggatattaaggaggccagcc

SEQ ID NO: 21081 - DNA, 505 bp, Bovine  MMBT07126
ttgcaaagaatgctcagcaaagctgctctcagctactgtacacaaacgtggtccaacccagtagagacatccacagcatatatacaaaatctgggtaatggtaaccttcacagtctctctatccacaatggcaattagataattaatagcaaatagaactcattgatttaaaggtatattaccacaatggggtatctgcaggtttgccagtgaaatattcttgctgttttcatccagacagtacaaatcctgagtttctggactaggtttagtctcttgaagagtcttgatccacataaygtcacaggagcatgtaaatgggttgcccaccaggattctacatggaacaaaaatgaaattcaatcagccttctctttctcagttttagctataaaagtgtctaacaaagcactaataacattatgaattccttccatctggcaatctggtggaagacacacycatctttatagtataactacttattattcaatcattaattgaa

SEQ ID NO: 21082 - DNA, 600 bp, Bovine  MMBT13987
cttaggcaagtcgatctgtgcaaaaacaaagagtcagaagctaggtctccaacaggtcagtctggtttccttctctgagaagcatcaagggctactttttcatctcaaccatgttcccgtcttgcataatctataataatgtgattctgaatgcattttagaaaatgcaagatggaatgggaytctctcagctcctaccaaacacgtggtctgagagacctacaaggagctgcactggagggttcactaaaagaaaaaaggacagccacaccatcctctgccgggggaatgtgcttccammttgacggctcatggtcattttttgttgctgttcctgaraaagagatggcaatcgtggagttggaggttcaccttttgctcttgtgtttaattgctgcaaaagccatttattaccttgtgttcttccccagagggaacattatcctccacagcagccaggcctggctatgtctggctcatctgactgcccagaagtgaacccatcacctccacatgattctggcgcagctctgtctccacgtctgtcagcctccagctcaggaaggccttgtaaaagaaagaacggtagaaactgggatt

SEQ ID NO: 21083 - DNA, 477 bp, Bovine  MMBT18560
atttgtgctctcttaagtgttgccaggcactaaaaasttcaggttagaatgacaagagataacttgagagtgatcttagaagtaagagaccattttggatattctagtccaagacatagctgactgcagctttaccatgaggagcagaagaaccttgtaactgagctcaatccacctgcagaaccatcaggaatgacatcgttcttacgttaaggcatgatatattcaggtgatatgttatatggcaatagataactgaaacagattttacattaaagatctccattcatttttttctcrtatcttaccctccttttgaagttatagcaactggtagttatcacctgtattcctatgcctcttgcagaagtgactcaataacaataacacaaaaagccaagatatgaattgggaggaaggggtagaatttttcaaggagctcagattgattccctctgctattagggtttttttttt

SEQ ID NO: 21084 - DNA, 600 bp, Bovine  MMBT07091
caggcctgagctgaatttctcaaatcatagttctcatgcttcaatattcctgtgatgcttattgctatgcaggataacaggctaagagaaacttcaacactggtggacttaagggaggtagtaatagctcccaaatgaccattaaaatagaaaatgatttgaggtgcaggaggaatttaacttaaattctgcagatatgcacaagtcagaggattctgcacaggttgtttcaggagaaaagtcccagaaaaaaataataatattagaacattcgcatgagaatgatggctggcaaatttyatccagtaaatactatgaagttgaaatccaaagtgactggtaaaaatcttcctcttttttgattaaaacagcagcctccaacaaacattacacagaatcttcaagtcactggtcactattcataattaatgttatttattttaattcttttaattcacttgtgatcattatattttgacttttcctctatcattgccacttttctgggcttcaaaagccaatgccgctttccctcattattccaggtagtgttacttaatgtcagtttcaaaaatggaagcacagaaggatagaaaattt

SEQ ID NO: 21085 - DNA, 600 bp, Bovine  MMBT17174
caatgaaccgctctgaaaaggggccagatctagataaagcctctaatcttaacaaggtttagtgtagaaatctgagtctactgtctggccaagtgagtctacaggcatcgtggaagagaagcctgcttccagcaccacccctgcagctgcccagtgacagcatctcagcacgcacctctgcgccgccggagaggaccactttctaccacttctctgggcaagactcagacctactgattgtgtttataattaaggaataacgagaaatacgactcaggggtacagataagcaggtacacrggaaacatccattttccttaaccttagtagatttcactgctcacttgcatgagtgcagaaggtataaatctctaaggaccctttactaaaatcgggaggggtggggtttcttctcgcatcgctgacagcaagtgaccccgaagtcacagaaaacaagttaggggacgtcaaatgtcaaggtcacacggggagcctgttaaataccagatgctggatgagcaggggcggtcattctgactctcaccaaaatgtgagaacacagtaaggtcaagttcagagaatgaaaagttcacagaagac

SEQ ID NO: 21086 - DNA, 505 bp, Bovine  MMBT11784
aaactatggaaagcctttcaaatgagttaaatcagacatatttagcatagggacacaaaaattgttagcatacatatgagggaagtaaacatatctgtcttttgtctagttttggatttaaaggcttatcacaatttctgtcactttccagtgaagcacaattcctgtgcttttcagtaaatactgaatggataagagagcctcaaagaagaagaaatcaaggactaagtgatttcgaatgagggagaaatgatttcttacatataaggtattgaggtcaggcacttgagacacagattstaaggttgggatttgtgtgcagaaatattattagagatggtttcaggattaacatgtacagtattcaaggaaasgaagcaggattgggcagagaggggaattgggctgtgtgatatattcaaaagactcataaatccactgggatctcagagactggagcaggtttttggagttttcctgagcaccctcactttgagcggatatg

SEQ ID NO: 21087 - DNA, 600 bp, Bovine  MMBT04633
tcccctacttttaatttccaacaattaccaacacagagaatcgggagatagcaggatgcaactgttcatactccatttgctggcccgtatctgaatgggctttaagtgattaacatttcgctaaaagggtctttctatgtgtatgttttgcctaaaataaaccttggggcttccttaattgtttaattatgagtttctttaggttctagtaaaaattagtgattgctcagtatcactccaactactactgtgtttctgctgaaaaaaatgtgaaaagcaaaatttcacaggatattttcrcaataaggaaatgtaaagagattcccttagtaaaaacacaaaaacaagttttattctgccttgcattctgaaaatacagtatgttaaatggaccagtgatcactcttgcaaaacaattttggcattcctcatttttcacaactagaaacctaaaccaaagagcctctgtggcacgaactttgattgttatggtcctggaaaagaaaaacagatgaagaaaaggcatctctgtaacagaacaagggaaaaacacataaacccataatagctgaagaaggaaaaatacagcaaacccaggag

SEQ ID NO: 21088 - DNA, 600 bp, Bovine  MMBT19188
attctctgataacaagtgagatgtgcctcgcaaataaagctttcctcacagtcaatacattcatgaggcttctctccagtgtggacccaggggtgccgagcgagacccaagttccacatgaagcctttcttaaagcccttacattcataaagtttctccctagtgtgaatgtgattggtagttgtaaccaggactgtgcttcttcacacccagggggaggaacrgggcaggccttccttaggctctaaccatggtgagtcacagtccacgtgttgctctactcascatctkaagtcttaygccggctctaaattggtcccatagccagggagaagctgtgcactgactgacttggcctggattgctggtctctgaacactctctcatgtagtgacttagatgggagaacttacttggcttatctcagtgggggcctatgctagtagctggagttgggattactcccacccaaagggcctggctactccctagtcggggagggggaggagaatggatgtagggagggaaccacagtgtcctctagattctctcaggatctcaggacctactctcgctaccactccagggaatttcccatct

SEQ ID NO: 21089 - DNA, 598 bp, Bovine  MMBT06920
  misc_feature (1)..(6): n is any nucleotide
nnnnnntttcagcttcagcatcattccttccaaagaaatcccagggctgatctccttcagaatggactggttggatctccttgcaatccaagtgactctcaagagtcttatccaacaccacagttcaaaagcatctattctttggctctcagccttcttcacagtccaactctcacatccatacaatgccactggctttagggatggattaatccatgagttcaaagagtggaattcagagattgtatcttcattattaggcaagctctttccaaattgatggcagatgaagccacagargctctgggaataaaattcttcttacaataaaaattcagaggagcagaaaaagagtggtttgttttcatagtgccatcaaaatttccagagygtctttctaaggtctgtggccaggaaaaaaaaaatcattttcttactgatttcgattatgtgtccaccctgagcatgaggttgaggagtcaatcaattagttgaaagtcttgttgttggaggggaagagttggtgcaatacccctaaggaaaaaaaatctgagattattataagcccctggttttaaaaacaaagaaacaaagaaaa

SEQ ID NO: 21090 - DNA, 600 bp, Bovine  MMBT06803
agaggaatgtgctatgatacctagcacagaagcttatggggaatatcaaaaggatcaatgcatcttgaaaaaaaaaaaaaaaacctatatatagcactctgcacaaagtatatgctcaatagatgatattattgttccactgaaagagtaggatcaccatttctttcttccaggttgccactttgggtcagattcacagctctcagagtggagacaaggcactactggaggtttgtagaagctctttggttcaacttgattagatattagggtacttcggaagccgttagcaagaggccycagggttgggaagagttaatgtaccagaacaatggcaactgttgtcaccgggaaatcagctctttggtttccaaaaggaaagcagaaaagtccctcttacccaacaaacccaactcaacactgaaaattctgactgcagtcaaatatgcctcttttaaaatgaaacactacacctgcaagcatgaactgattgcctggcttttcaagggccagaaagtgaaataaagaaacgaactctcaatagggagccccccgcccccccttccccgttactgaggagaactgagtcagaacaatgac

SEQ ID NO: 21091 - DNA, 600 bp, Bovine  MMBT10088
aaaaaataatttcatacaaccccataattttttgctttttatgctaaacgtacatcatcgttactgatagttatccctacttaaaacaagtcttattttggccttactctctgaggtaacaaattggtcagcaggccaaatctgactccagagagaccttacctttgttcatggtgtgtttagaagggaggtcacgagtgaccacattttctatcacctattctgtttctcaccactgtctattgtcttatccctgatctcatccacacattaacttactacctggggccctacaccackgggttttgtgacactttagttacccactgccagtgttagctgctcagtcactctgcctctttgcgactccatggactctgcccatgggattctccaggaaagagtactggagtgggttgccatttccttctccaggggatcttcctgacccagggatcgaacccgggtctcccacattgcaggcagattctttaccatttgagccactagggaagccccrtggttgctaattaaggggcagctttcctctacaggccaaagggtyctgcactacatgaattcaatgaggccataatgatt

SEQ ID NO: 21092 - DNA, 600 bp, Bovine  MMBT01106
ctgcagcagaaagagaagttgggaatgagtccgggggtggtcagcacccgccagagctggatgacagctttatagaggaaacggctgggacggtccatcctcacggtcctgggactgggtggctggagaatttcaatcaattatagtttttacttgggagctagctcactttgagggagaatttgttacttgaaacaaactacactgtaggcaaaatacattttgtgatgcaaactgggagccacctgggtgtcccgctgtggtttcccatgcttttcttgtccgtttctgccatctacyggccacaatgcaaattactcccgggtttcttgagattctacctgagaggaagggcgttttattcctgtaccttctggatctgaaatgcaatttcccagatagttcaccaagacacaaaatgtatctctccataagtcatagttctgaggggactgaattatctgtttattcattcgctttattagcttagttttgtcagagaggcagtgtttgaattctgcccacctgtgtttaaatcaggccacttccctggtggctcagacagtaaagaatctgcctgcaatgtgggagacctaggtt

SEQ ID NO: 21093 - DNA, 600 bp, Bovine  MMBT10548
taatctatagcttccttatgaactttttgctgattttgctaaatcactttctccaaaaggtttattatttttgttgttgttgtttagtttttaaatttttgtttatttatttggctataccaggtcttagttgggacacatgggttctttgtctccatagtcaagatctaattccctgaccaggaattgaacctgggccccctgttttgggagttcagagtctaagtcactgaactgccaggcaagtgcctccaaaaggtttttgattttttgttttgttttttttcaaaaaaggttctwgcatagtaaacktgtgagacctaatatgcccaaaaagaaatgtatttttcaatcacatttcaataatagcttagttgattgtgaaagtacaaaagtgaagttcttttctttcaaaataatatctgttgttttcttacattccagttactgttagaaaatctgatgttacctttatacttacttctttataggtgatctgtggtttgtcccaacaatattttagattttttccttacttaatttttaatattttattatgagatgtttaggtatagttttttttcttatttacactatttt

SEQ ID NO: 21094 - DNA, 598 bp, Bovine  MMBT21124
  misc_feature (1)..(28): n is any nucleotide
nnnnnnnnnnnnnnnnnnnnnnnnnnnnggacactttagatggatctcctaccacttttggaaaaacaaattagaccacctgtcctaatgttatgcatcatacatcatcacagtggcagagagtcagcgttattaatattatgggaggtggtgtgtagaaaagtcatgcagtatgaaatccaattatctaaatttagagactagcattgccatttattagctgcctggccctgggagataacaattacaaatattcactgagcacatactatttgcctgtactttgtttacataatgacyaacttcatacaatcctaagaggtatataacttcattacttccacttcacaggcaaagatactgaggctctggggaaattcaggtaactcaccctaggttacactgttgggaagtggaagaaccaggaataaaaccctagcaatatgactctaaaacacatgttcttaatttctcagtctttgattcctctagaataaaacagagataataacagctgcccaacctaactaatcagaattatattagcaagtacaagggcatttttaataaactgtaaagtaatagaggtcaatgtatg

SEQ ID NO: 21095 - DNA, 600 bp, Bovine  MMBT08079
caatagaattcatatccccccgtcctgcagaagactatgtcatttacataacacattcaacccagttggcactgttgtcacctgtcattcaattaggtatttaggctatgtcctactctagtcataatgaaatcactatgaaaattaatagagaaatgcattctacttgggcagacattgtcttttaagttataacatctccattgttattattaattgtttttgtgtgaaaatatcatgtgattggaccaaattatgaatcagtcctctgtcaaattaaattcttaaaatcaccatcaytattgggttatgctaatgtgaaacagaagcaatcaaacctagcaaacattagaacatgcctaaccagtagagaaacagaatgatttttttwaatttaaatttatttattttaattagaggctaattactttacaatattgtattggttttgccatacatcaacatgaatccgccacgagtgtacacgtgttcccaatcctgaacccacctcccacctccctccccataccatccctctgggtcatcccagttcaccagccccaagcatcctgtatcctgcatcaaaccaccactccttta

SEQ ID NO: 21096 - DNA, 600 bp, Bovine  MMBT04924
aggcccccacggacacctgtgagaggctagttttcggtgtagtgtggtggggaagcatgatttcaagtctggcctgatttcagggtcaaatcacaactcttccactattaactgtgtggctttagttacttcacatctctaagcctcttagcttccgtctcctcacaagtcaagtgggctcttgtcaaactcaagtaagggaatatgcatgcagcctcgagcatagggctgggtctgtgggaagatgtcggatccatgtgggcccctccccttcatctttggtctgtcctgtatgtgatrgaaaactaccctaaaatctcagctgacattgtggttattctcctcattagaaaacatgatggcttccaccggcccctgctagtgcaaggagacactagtttggaaaggctgcccagcacacgcctccttaaactcctccccgcccctcgcattgcattttctattgaaagtcaagttttcaccatgtaaccctcctgattaccaaaacagctgatgatactggggacagacgcctgataggggaaccagtccattgactggccactagctaatggaaacgtgtccaagaatcaagaggct

SEQ ID NO: 21097 - DNA, 600 bp, Bovine  MMBT01236
tgtgaactgtgatcatattttgtagtagagttcttaaatgggtatcatcagctaaattcaatttgactgtatataagaaatgaagcaacaaaatacagtaaaaaaaaaaaaaaaaagactcacaaagattgtctgaagactgaaataaggtctttccagtgtaaaaacatctggtttatgataattctttgtcaagtgaaaactgctatgtaacrcaagtgtgrttatagttcactgtaggactaaagtgaaaataaaaataagcaaaggacaggcaccatcttggagaattgctttgcycatcttcccttgctctcacaccatcagaggcaggtctgtgattccacctgcccaggactatgtgggccaagggcatctgcttgatccaagataggcagtctgtaaatgcttggagatcagtgtcctgagagcagtcatcattgacagatgagtaagggtggctggtggtcagtatggcggccacatcaatcctggggtaggagagctctcagagatggtccacactgtcctacaggctccggagcaggactgagtcctcccgcccacagccatgacctgctccattgacttcgttccctt

SEQ ID NO: 21098 - DNA, 600 bp, Bovine  MMBT05296
tcccagagacacagcatgcccatctgggtaatgggggcaaaggttccacgagcttcacacactgagacatgcgcatgcctgggagtttaaaacctctgctccatggtaccctggggaggtctaacctcccgtacagtgctagcgttagaagcaattgcccttacatcacagctctgccttctccttgatgatacaaagacgatatgtacagctctagtggtgagaaaaagatggaaattggaatgctttgtatgccagaggaggctgcagctatgagtttctaaaccagtttcttaagaygsattgaaggaaatggatgtgaatcttacagctatatctcaacttaawttcagccatcaagggcctgatttctaaaagcttatttgcacttttccaacagaatactacttgcaaaggcagaggggtggagcgaatctatttcctatgaggtgaaacctcctattcggggttttaagtgggctcatgtattatcccaatggctgaccattctcctggagctgagggcacagtaagtccaataaaatcaccccagcagtttgatatatcatttcatccgtttctgacttggagaagtcataa

SEQ ID NO: 21099 - DNA, 600 bp, Bovine  MMBT22872
tgtttcttaggctagccagaatcagttctgttgtttgcaaccaaaacattctgactgactgactccaaattttgtaaacggaaaacggtagtagcatcaagaggtcagtgacttgttcaagcccacgttcttagaactttgggcacaagtataaggccacgctctccaggaagaaattatcctagatcaatatttacaacaggagaacacacacatctaggacagaactcacctttgttctgtgcatatgagggagacacaggaagagaaatgtgaataatggctgggaaatagggagcrcgtatcccagatcttcacaactttcaattcactcaggcagggttttgcagagacccagaaccattctctctggaccctaaggcttgaggaggaatttctgaaaaggtggaagaatcttaggatctcaactgaagaggaacttgggcagataaatatctaaccagggatatgattcaacagaagcaaaactgagggtctgtgggaacagaccacatatgctaacaatagtagtggtagtgttagtcgctcagtcgtgtccgactctttgtgaccccatggactgtggcttgccacgctcct

SEQ ID NO: 21100 - DNA, 600 bp, Bovine  MMBT01486
gtgaatggaccagggttcagccaaacccaggtcatgctcagggctggtcagcttttctgtgccctgctttcaccactcagagaagcttccttccactctgccgagccacactcccactgagggcctgggctggagaggaagggttggaacgggcttcagatgatgctgccgagaggcctgtggagggttgaagtggtggttctggaatgaaagatgtgatgaaaggagcatttctctcagcagccatacatcatggaacttctccaggcagaaaaaagtgagaaacagatggcaatgaasaggcaaatgcaccacagggacaaagctggagtgggagggtgtgaggaggcagcagcccatcggcagcagcagaaagaggggaaaagcccaccctgtggtaytaacataaggcaagtcagagttggagacaggagacaggaccatgtgaccagagactagtgctcaygacacttggagccaaggatagggccagctstttcccaggcagataggagaactcttcctcagaggtcccattgaagactcatttctgcacctgggaaaataagctgctctaaaacaattagggcagtagattty

SEQ ID NO: 21101 - DNA, 598 bp, Bovine  MMBT18369
  misc_feature (1)..(73): n is any nucleotide
nnnnnnnnnnnnnnnnnnnnnnnnnnnnnnnnnnnnnnnnnnnnnnnnnnnnnnnnnnnnnnnnnnnnnnnnnacctgggaagtctcctcacctatgaatttagaacagacactactggctggcctataagcgcatgttcaatgattcacatattttgtatgtgagtagttgttcagagtttggattctagagacggaatctctggctagattccaatcttagctcttccattgattaacagtgaccttgggcaagtggcttcatctgtctttgcctcaacatctgtaactcaggaatamtactactcacccatcaggctttcagtgatccccacctacaggtattcacagtgttgtgtaggmccctcctccatcgtgccagagtcagctgtgtgactgagtacagcagaagtgatggtatattgctcccatgttataaaatacactgtggcttcaacgatactgttccctgtatttcttctctgtctgtactgtctctctctctctctgtgcctctccttcttttaggctaggggaagccagatgtcgcgaaacaaggacactcaggctcactgttgaaagtctcatgaagggagaa

SEQ ID NO: 21102 - DNA, 602 bp, Bovine  MMBT21153
  misc_feature (1)..(2): n is any nucleotide
nntttctatattgaggagaaataatgttcactccctcctactgactttccccaaattaggcacatgggaacatccctacccaaagaagaagagttctttatcattctgcaggaaggaaaaaaaaaaaaacacaacaacaacaacaaaaatcaatgcctactacaatgtgtctagtaactgggaatttttatgtagaagttggatgggtaactagacataatactgtgcattgtgttgctgtatcaagagaacagttagaagatagtttcctacaagcccctggtctaatttgaggcatctaygagataagggaatttttgagttatgctggtgtgactgctgagtcgtgagataaagcaacrcaccrtgtgtgccctttccctggaagcttcacgttgctttataagggaatccatttctaccccctygagttcaaagctggtcttaattaaatactgtaggtttggcctattaccgctaggggtcattcttttacatgtgtcattcaagaccatctaagaggaggtactgattctragacaactttagaggtttgttctttccaaatattttaactacagagacaaattgcatttggtaaa

SEQ ID NO: 21103 - DNA, 600 bp, Bovine  MMBT01632
catctcattctaccatcctgacagcttctcaggtgcctaccatgtgctcagcctcacactcagaggatctgaaggcactgctcagtccattcaatgttcatgagttattttcataaagttagttgtcagttaggagataaccagctttatgtactgtttctccaccttatacacctatactacagacatcttattgcacatatgacaagatgaactgacttctgtggattgtgcagattttggcctccccccaatcctctgtgaaaatattgaaattgttagtctaattttccctgcctmtttccctccactacctctgcctttcaaaggactcttgttctttagcacctgttgtgtgactttgatcccccaggcttataggatggagaggttcaccaagagtgttcagacaggaagttaacactgctgaaaaggtccatgctcccagcacagagacaggaaatggaagaacacccagaaagcaaggcgccctggctgtggacaccaaggagatgacttttacattttatgtgggagtgagtttggtgagtggaatggcactggagacagtaaggtataacaaatgaagaatttttaaaa

SEQ ID NO: 21104 - DNA, 600 bp, Bovine  MMBT09785
cgtgattatcttctcaaccttaactatgatttattggactagctccctgtaggagtggggcctggtgtgacagggggtggggcccagcagtcttgtctgttatcacatgacaagagtctgaccagagcccattggtcccagcagaagcacccgaggcaatctagccagtcggtttttcttttctttcatatttaaaatttggaatctagagactcagagcataggagctgttatagccaagtaaataacggtggcctagaaacagcaacttctggctgctgctcttgcaattctctgaaygatccacggatccctacttcccacacctggggttgtccaattcctccttctacctcagaaaacccattgtctgtaaaaaaaaaaagagagatttattttttcttggcttaaaccaagtcagaattgatgygcttataacaaaccttaactaactcatttaytaataggatatttttaaacctcttacccaactgatagctgccctccattatctgaagaagagcaatatggaaaagagactaaatttattctctgtagctctraaggacccataggtggaagttagatgaagttagattt

SEQ ID NO: 21105 - DNA, 600 bp, Bovine  MMBT04907
tcactttctgccattagagagggattatctgcatatctgaggttgttgatattctccaggcaaacctgattccagttagtgattcatccaacccagcacttcacatgatgtactctgtatagaagtttaataagctgggtgacaatatacaagcttgtcacactcctttcccaattttgaaccagtcagttgttccatatctagttgtaactgtcactttttgacctgcatacatgtgtgaagcatgccaatattttctaatttttttccctgaaaaatgctagtcaggacccacaaaaytgatttgatgacccaccaataagttgattgaattttgaataaggtgtgatttaccactaataaatcattagactaaacaacaacccctaagaagattcttctttttaaaagtatcctgtggctaatactaggattttcctaatcttttcaattatcaggaacgataaagtagtatttactcggtatgcatagtgtaataatttgatggaatgtgtaattaaaagactaacgttaaatgtctggtaaggcttctagatagatccagtgccaacagcttttaagagtaagyttactaattgc

SEQ ID NO: 21106 - DNA, 600 bp, Bovine  MMBT13562
ttttgttgttgttcaggaagcaaattctataaaaaaggagaaaagttagaggaagccatagacagcattagaattacactacaaatcatttctttttgaagaaaaatcagtacgtgacttttcagaaagtttataattcagtgtttaaaattttaaaagtttaaaattcatgtgtttccatgaaattaaatttactcattagccttgttttaactcagtaaaaaaggtagcaatgtcttataaatttatcaacttttaaattagtctttaagtttcaacttctgtccccaagcagattayagcttgagatgaaccaaaaaagttaagtaaccaacaagataaaatagaggcaacaagataaaatagtggatacactaaaatatccaaacatatgagaatatcaaaagatattccaggaaggcaagttttcaggtcaaatttaaaggatctggaatcaagatttagtcaaattaagctctacattctttaggcaagttgattctccagaactgtttgcaacatctaaaaaatcagatcattgatttttcttgatttccttaatttcatttgatcacttgaagatcaagtaaaacacacaca

SEQ ID NO: 21107 - DNA, 600 bp, Bovine  MMBT21151
agagtatgaaacttacatggtctgtctagcagtagccatcccaccaccttctcagaggaactgcctcatctctatgtacaccagaggaatggtcatctctgcatcacaatactccactagccaggtctcagctgacggggctagagttggayaatcattcaaaatctgcacaaagacagtacctggctggttcaaaaaaacaaactgcaataacaagattccctctatctgaaacttccttctaagactcttagcttgcaggagctagaaactttcttctaggacccttacagttggagragcatgcactggaaaagcaagtgaaaatagagagggctaagagcaggcagaggaaatcagagatgcaagatgatagagattaagaccctmttttcayggtccccaaataattctcagagtgggaaaaagaagagagaaacttgtgttaagggttcattgcaaatgggagaaaacaattataaacagcagctaaagtcasagtttgggggtagagcatttctgccataatcgaagggcagcctgattttctgtcagcaaagcaagggcagcttggactcccatggatgaccactgggtgct

SEQ ID NO: 21108 - DNA, 600 bp, Bovine  MMBT21150
ggtcatctctgcatcacaatactccactagccaggtctcagctgacggggctagagttggayaatcattcaaaatctgcacaaagacagtacctggctggttcaaaaaaacaaactgcaataacaagattccctctatctgaaacttccttctaagactcttagcttgcaggagctagaaactttcttctaggacccttacagttggagragcatgcactggaaaagcaagtgaaaatagagagggctaagagcaggcagaggaaatcagagatgcaagatgatagagattaagaccctmttttcayggtccccaaataattctcagagtgggaaaaagaagagagaaacttgtgttaagggttcattgcaaatgggagaaaacaattataaacagcagctaaagtcasagtttgggggtagagcatttctgccataatcgaagggcagcctgattttctgtcagcaaagcaagggcagcttggactcccatggatgaccactgggtgcttgcagcttacctctttctaatcattggttcatcactataggcggtgtacatattttagcctacttaaaaggctctttttttttttacttt

SEQ ID NO: 21109 - DNA, 600 bp, Bovine  MMBT21154
tctgcatcacaatactccactagccaggtctcagctgacggggctagagttggayaatcattcaaaatctgcacaaagacagtacctggctggttcaaaaaaacaaactgcaataacaagattccctctatctgaaacttccttctaagactcttagcttgcaggagctagaaactttcttctaggacccttacagttggagragcatgcactggaaaagcaagtgaaaatagagagggctaagagcaggcagaggaaatcagagatgcaagatgatagagattaagaccctmttttcayggtccccaaataattctcagagtgggaaaaagaagagagaaacttgtgttaagggttcattgcaaatgggagaaaacaattataaacagcagctaaagtcasagtttgggggtagagcatttctgccataatcgaagggcagcctgattttctgtcagcaaagcaagggcagcttggactcccatggatgaccactgggtgcttgcagcttacctctttctaatcattggttcatcactataggcggtgtacatattttagcctacttaaaaggctctttttttttttactttacaatat

SEQ ID NO: 21110 - DNA, 600 bp, Bovine  MMBT01330
ttacatgttaacagttttgtttgtttcatttgtcaccttggttttagaaattcctatattcttttttttaaaaaaatatttatttttggctgtgctgggtcttcgttgctgcgtggactttctagttgcagctaggggctactctgtagttgtggtgtgtgggcttctcgttgcgatggcttttcttgttgtagttcatggactttagggtgtgtgggtgtctgtagttgtggtacatgatctcagtagttgtgattcccaaactttaggttacagattcaatagttttgacgcatggamttagtttctccatggcatggtgggatcttccttgattagggattgaaccagtgcctcttgctttaccactgaacccatcgaggaagcctggaaattcctgtatgcttgttcttagttgtaggataaaatcctgagagtaatccagccttccagttagttagttaaatagatctgtagattgtgtgactaaatatttaaatgtctgttttgtacaggtacttttgttgttgttgttattgaagtgtagttggtttacaatgtgttaagtttcagcggtacagcagagtgaatcagttatac

SEQ ID NO: 21111 - DNA, 600 bp, Bovine  MMBT22526
aataattcattatctctttcccaagcttgggggggcagtgctggcctagaagtggcatttaccttccacaactttaagtgatgcttttttagctgtcatcttcagatcactttcagccccggccctgtacttctcatccccacggacaacatcgacgtgtctgacacagacttggaggggtggtcctctcctcacctccacttcccctctcctcccctccccgccccagcactgcaacccatctgtattctgatgctgtttgcaccggagcctytctctattgtgaagyaagacagccgygagctgcagggagawagagccgttctgytggagccgagataagtgctgctgggagggaacccagtggagggttggagggggccacatgtgtcagcttaacgggaggatctgaaaaagttatttcaatcccgtctctatgtgggaaactggcagatgcccttctgtggagtgaaagtttttctcttcctctccatcctctctgccaaggaagggagcttgattatcaaggggcgtgaggatgctttttcactrgggaaaaaaaagtccttttcccaaatccagtctctgctctaatgccag

SEQ ID NO: 21112 - DNA, 600 bp, Bovine  MMBT06106
accttcctgcaatgatgtgtgaaacacaatatgtattgctaactagggaaactcaatcaagccttggtgtccagactggatctttacccactccctctggatctagtatagatacagcatgacccaaagaacccaacaaaaatgattctattagactacccagtgtagctcaaagcctcatggtacacaaagatattcttatcttttatccagcacagacataagaagcaatacattccaaaagccaacagatcacgttttagcaaagggaaaaggccatatctcttcaaataaggctamttctgcacayagtcacaagaaaaactatatttttacaattttgaattgataactcagttggtaaagaccacctgccatgcaggagaccccagttcaattcctgggtcaggaagatcccctggagaagggataggctacccactcctaaaaacttgggcttcctttgtggctcagttggtaaagaatccacccacaattcgggagacctgggttcgatccctaagttgggaagaagccaaaggctaccaactgcagtattctggcctagagaatggggtctcaaagagttggacacaactg

SEQ ID NO: 21113 - DNA, 600 bp, Bovine  MMBT06351
cattagtactagtttaacatctttaagcttttaatcagagtgagttcacaattgcattttatataattgaattgaagttttaaaaattggtaaatttgatagaccttattttaatattgttttctgatttagttgtctgtattttaaaaaatataaaccttttatggtataaagaatcaggttattttatatcataaatayctaaatgtataatctttaatgtcrcaactatttaaatttataatcttttagagcctggtttttagataagtccctcatcttaaattattatatcctaaytcctgaaacaaaaatatgttacctgcacattaaayaaggatctattattcttgatatacaaaatgaaaatataaaatcaaaggagaatgggtttaatgtacatttggccaaaaatatgggagaaacctattttgttttctgcaataaccaaagtaatgctgtcattaacacaatcatgttttcaatctgtgtagataaaatttgtttcaaaaagatatactttagttatttggaattgccgagttggaaagagagcaaaattaccttgtgggggaacaatgaaaaggaagacttaagggc

SEQ ID NO: 21114 - DNA, 598 bp, Bovine  MMBT16396
  misc_feature (1)..(64): n is any nucleotide
nnnnnnnnnnnnnnnnnnnnnnnnnnnnnnnnnnnnnnnnnnnnnnnnnnnnnnnnnnnnnnnnaagcatcattgaagagatattttaggtaagtgagatctaatcttcagagtgacgactggggtgggagagtgataccagagcacagcagaaactagctttactaatacagacattttctcttaccacctaacttctcacagagcttaccacctaacttctcacaaaaattccatattctacatacaaaggacacaatgaacattgctgtaaatcagaataagaggaagaggctaaayggcattcaactgtggggtgttttttttttgggggggggtgttttgagctttgtctataggaagcaaatttggggccctaaaacactttcttctactcaacttacaacaaacctcagaatgaaacacatgtattatacttgctatattgattaaatggttggaagcaagaattaagcaattttcaaacttctaccataagcaggactagcacagtagcacaatagagagaaaataatgctgaactagaaattaraagaccctcaactttgtcaatatgctgtgcaaacataggaaaatc

SEQ ID NO: 21115 - DNA, 600 bp, Bovine  MMBT16534
tcaaacatacagagtagatagaaggaaactgttatttctcactatgactgtggtaaccatgttaagacacacctttgtgatttgaaaatcagaatgtttatttttagaatagatatctgaaaagtttgttttcctctaataaaagtatttccattctaaaagccccatttacttaaaaacattctgtattttctcctttaacgttgccagatttttttacaacatgaaaaaatctcattcccatgagaaaaaaggcagctgtgtgcctaatatagaactgaagcataactgctttaaaartgggccttgacaaatccattcaaacttttcccatcttcagttgttagacagtcagtggaaaggcaatgatgggttatggaaaatgtaaggaactttaaaaataaaattttctcttaagctcactatttwaaaaaatatcaaaacagtgagaagttattttcacttgatcatttttattttycctatctttttttctgatttatattcctactaaagaatcttaaaccatctgagattttcatcctgattcagtcttgaataggaccatcttaagtgagaatgcttggaacactgaatttc

SEQ ID NO: 21116 - DNA, 600 bp, Bovine  MMBT12746
tctcttaaggtatagtctaattaaaactgtcattcctacattctaagaacatttagattttaatcatgcaattgtatagggacttatttttaatactgtacttcctagataactgtgtttccctcatattgctatcctggttaaaatatacacacacctgttggattttaattatgaatcttaggatattccaaaaggaatatttttaaaatatcatctgtagcgcaatattctaggattctttttattctttgtttttaattaaattctcacaagataagtgtattgagagggatattyagtgtttattcttacttcattttacactgttccctgttttgtgggcccagaatcctgggaaataaactcccctaattcttttgttggtatgattccagtttttatcaatgaaagtcacttgataaaatttgaaagttgtaaggaaagtagagaatattgttcttctgctaatagtaataaatagatatgtgtgcttcagtaaatatgacttttgagaaaactttcagttgagatataacatatatcctrtaaggtgcattaatattaagtttatggcttgatgaatatttacttatatgt

SEQ ID NO: 21117 - DNA, 600 bp, Bovine  MMBT05572
ataaggtggtgatgaggtgactgttgagcagacagacctggggaggtgagctctttgggtgagtgtctgggaagagcattgaatagggcagataaaacagcaagtgctcaggatgggagcatggactatttgggggagagcagagaggtcagagggccatcactgagtgggcaaatatgatctggcacagaacagaggaggcactttcctgcaggacctggtgagttctgggaggaagttgtgctcactctgtctgcagtggggctgtctgtgtgagagacgattccaggattttgagaytgatcgctcacactggctgtgtggaggggacagcaaatatttggcagctctacaagcactctggggagagaagacgggggtcctagccctggggtggtaagaagcaatgagatcaaatgtagagccgaaaggtgatgaggtgaatgactcagacatgctctcgatttagtctagaaatggacagaagatgtaaaaccagggtcagtctctctcagctcaacttgctagtccaaaatcaacagccagcatcatgagtggggccagtggtgatgctctagaaaggcacaatgacgtgatgtc

SEQ ID NO: 21118 - DNA, 508 bp, Bovine  MMBT22632
gtaagaaaaggaaacaactcaatagtcttcmgtttagttcttactttgtataacttgaatttcttagacttagtagggaacaggaagatagtgaatgtattgaaatatactctttcccccatcttcctcattgtcttctctttcccatctctaratttccccarttaatttttattaatgtgtagtaactttctgttagaattgctttgtgaaaataataaaaggccagactcttgggcattttattaccctttggttgtctgtgagccaaccttttaataattgtgggtgttacttggkctccatttttcagctccatttttcagcttgtcatattttaagagttttatggctaggatgcatatccacctggggttttggatgtgactactaagttgtagtgtttgatttatatttgagttcatgtctttagataaaagcgtccatctccactgtcttcattttagcagctctgcttgttgcctttggaatgtgctttagtttctgt

SEQ ID NO: 21119 - DNA, 600 bp, Bovine  MMBT20666
ctagagggaaagtggattactggaacacagccatgtttcactgtcccaatttttccctcatccatcaaatggaaaataactgccttccacgcctcccttgtatgatggtttttgagggatttattgtgttagttcccttggcaggaatgacaaaatggtggtcagattctagtgtcttcccctagaagggaccaggaagtttatctacctgaaccacctcattaaacagaggaagaaactgaagtcaaacatattataaaattgtctcaatattatcaagcaaatagggcagaaccaggrcaagtgctaaggtctgactctgcacgctttcttcctctgtcactcaacatgtacaaacaaaaaggaaatgatccttttgttcagaattaagttctgaaattaagttcactggagaaggctcactgggatgctgttgtaagagcatcactgaacctggaattagcaagggtgagaacaactcattgctgtggacctaatgtgtgcccagtgctctactacaggtcctatacagagcctgtattccccacaagactgtagtctctacaaatacaagaccttcatccaccctttctgaccttt

SEQ ID NO: 21120 - DNA, 600 bp, Bovine  MMBT00726
gtgtgtgaatcataagaaatgaaaagtcccttggtaaccatgtggacaaatggttctaaaatatctgtaactgaacagtgcaggtccatgacaaagtttcaccagccctcagttcacagagggaaagtaacaggtttctatcatacaaccaaaattttaatacaaccaaacttgtccaatttgaaaactatcctttattctgagattatttctttcttatatttctaccgccttatttgtatgggaattcccctcttttatactttgtcaactctatgttctgtcattaccttttctttkgtttttaaactctttaaggattatagactttggtcacsagtaattagataaaaatgtgtaacagaaggttttgcctaaagtctggtaatcatagtactaatgcagcctctcccctaaagcaagaatcctttctaaaacattatcaagaaatgctcatgttttgatgagttctatcttaggaaaatggaacaatatccatgaaaagttgataatgtacatgatccatgattttaaagttaaattttgtgaaagatattatgttactaacaacctaacaatatcaagaaatacatgaaatat

SEQ ID NO: 21121 - DNA, 600 bp, Bovine  MMBT08426
atgcatgtgtgttatagttacagagctgtgccaaaatagttcaaccagtagcacgaacattaattacagccatgtgtggcctttcaggtaaaataattattttcttcactgagtgattatagttgctctactaagagatgtttgaaaatacttgtgagtgaactataacatatttcttagcaagcattcactttctcgttctgaatattcacatcattaagtcattgtgagccaataatgactaatgtttataatgaagcaataaatgaaattagttattaaatttgctgtcagttcttrtctgtgatgactcttgcacttagttttcaaatattaatcttgtattaacattgaatacattcactctcaagaatatctgctcacaaactgattcatgaacgctatggtgctatgctgtaaccatcaaatctgtcagccttagatctaactcatcagaagtgagatctaaagaactgctcggctctactactgtgatagcatggtccttcaggttagcattttaataagactctagttagaatatgactgtttcctctaggcatcctattattatttaatactattaaggaataaatatcc

SEQ ID NO: 21122 - DNA, 600 bp, Bovine  MMBT02892
aacttaaaactgtgtatcatatgaaagtgataggtgaaggtcactcagtcgtgtccgactctttgtgaccccatggactatacagtccatggaattctccaggtcagaatactggagtgggtagcctctcccttctccaggggatcttcacaacccagggatcaaacccaggtctcccgcatagcaggcggattctttaccagctgagtcacaagtatatcatatagtgcttgggaattgacttcctgatactgtttgtctctgggcctctttctgacttgaactttcacaagaaacctrtgtaacagcccatcttaaaagtaatgtgacttgtgccacagtaggaggtatggagtaaataattraagctgctttcataaaaagcattccacagcaggaaaggaatgaagaatcttctttgtgaagaaaagcactaaatcacacagtgagaaattaggaaaacaaaaaccaacagagagcaagccatcataaatagtgccttgaggaagtgaacaatgttttaaaaacaggactcaagcttaggaagctgaaaacatttcagtggatttttgggttgccagcaattttaggatcaactcc

SEQ ID NO: 21123 - DNA, 601 bp, Bovine  MMBT03727
  misc_feature (1)..(1): n is any nucleotide
nccatgtagtagcacaagagttctaggagatctgggttttcaccaaaccaaagcatcatatcatttcatcataaccaaagcatcaccaaccctgaawtatatatgaataggaaaactaggtatgacatgtcttcagttatattcatggtcaatatcctataaaatgattaagataagtaagatggaaggacattaaaacagaatggacatggagatattcactsagtatgtccagaaggtcttaaacactgactgtgttaccagttggatagacaacagtcaggataattaaagtgagcawtggtaagatttttaaattttcttaaagttttattatatttgacaaagttcaatttgcctgcagtttactgggcaaacacaaatatgtgttataggtattacactggcttttttattttctgctgagattttcattatacattagcttctcagtcatttcaaaattcctcgaatttctttctgattctgtcatttcatttagcaactggatagaagcagctgaaagtatttcttggtcttaaattagagttggccatgacaaatgttcctgcaaaaatataggatgaatcccacacattta

SEQ ID NO: 21124 - DNA, 600 bp, Bovine  MMBT19142
ctcaatgtagcttgcagatgggtgattagaaactcattacaaactgtgaatggatgcaaaaatcttagctcctttctggaatgcctagatgttatgaaactgcccagtcaccataaatctctttctgaagtgcatattttctttaatataagtatattttggaatagatttggamtttatattatttaataatttaacaatttttttstattcttatttaatttgtattttcattgtgtagagcagacagaaagatgctgagtcaaacaactattgaagagaaatacaaagaaaatatcraggaaaaaatgactggcaaaagcactgctgataatttctataccttcacatttccaaaggcaagatcaagcaaatgggctgtgagaaatggtaagaatgaaaggataagatgagaagttgatgctgttttggttgtcagcatgagaattgctaagacttagatgccaatgtctgagggaagaaaaatacagaaatatgctgagtatccaaggcaaatgatgtgcattcaggtccaggtaccttcttggactttcctgatggaaagcatgcatatttggaaaatatcagcagaggaaagag

SEQ ID NO: 21125 - DNA, 600 bp, Bovine  MMBT14153
gacatttataaagagaatttagcagttgacaatttattgttaatttcaaaattatgtaacaattaacttccaattaatgtagcaattaattgttggcctcaccatagaaaaactccacaaggatgataacatggtaggctcattgaaagaaaatcctgcagagatcacataattacctgagagagatccttgggggaaatgatgaagactgaaagtacttgcttgcagacgtgatgattgttaagattatgcagcaaaaacaaccatgaagagaaggacgcagatgacgaaactgaggcycagagattcagataactcayscaaagtctagtgtaggatgcagctaagatgagttgaaggcattatcctcctcgttccataacytataacaggatttgcctagagcctccaaaggttttatcatctgcaaaatggggataataacagtccagtccttccaaggaggctgtgagttttaaccgagataatgtgtgtccacgctcagcacaaggtcaagcccaggagagacagatgagtgytgtgactcttactatttacagcatcacgatttgacatgaagwrgctgcataaatgattcag

SEQ ID NO: 21126 - DNA, 600 bp, Bovine  MMBT01510
gttctagatttttttttttctagattattttgatatatatgtgtgctgtaggagagaaagaatactttgttcataagcactgcaattctaaccttaaatgtttttttcatttatattgaagtatagttgaattacaatgttgcgttattctactatacagaaaagtgattcagtttatatatatacacccattctttttcatattctttttcattgtggtttatcataggatattaaatatagttccctgtgctacacagaaggaccttggtatttatcagttctgtatttaccagtttrtatctgctaatcccagactcccagttcagctgtctcccacccatctctgccttggcaaccaccagtctctctgtgtctctgattctgtttccacagacaggttcatttgtgtcatatagagatcccacatataagtgattagaaatgcaagcttattttgcaaattcattgtcttcttctaggtttgatgatctgatggccaacattccactgcctgagtacacaaggagagacggcaaactaaacttggcctcacggctgccaaactactttgttaggccagatctgggtcccaagatg

SEQ ID NO: 21127 - DNA, 598 bp, Bovine  MMBT20693
  misc_feature (1)..(216): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaatcctgtttaatatattagggtgttagttatcttccatttatagcaagatggattcagtttttattgactagtatgacakaactccttgaagaatatgggaatggatcctggttccactcctgacagaggggaatgctactatacttgcattttgggccaagaaaaaaattwwaaaaaacatgtttttcyacacacactttcgctttttgccttcttatttagaagttatttcaaaatttaaagaagacttcagttcacagggagaagccttgagtggtgatcataatgagttcactcaattttccacattgttagtctctaaatgacaggagtgggctgttgatccaactactcttaggcattagagaaaatttaga

SEQ ID NO: 21128 - DNA, 600 bp, Bovine  MMBT07556
atttgagcatctacatcatgttagtattcaaatatcccagcacccttcagcttagttcaataaacaagtacgtttgcactgaaataaccagagttcccttgtttctcattttaaagtcattttaatatgttctagacacaagataatggatcacatttaaacatgagaaaattaagtcccatcagcaagtaataatacccaatcatattcaatcatgttgaacaacaacctctactaaaatcatcttctcctaggtgaggttaagaaaataacaacaacaattaaaaaaaaagctattaygttactttcagaaagatccaactttaaaatacttctgtgttatttcccataaggcaatacagtttcttgtgttcatgcctcccagacctctgcatactgtgaccagatgtcctctctcttgatgcttagtgaattccctcatttttcaaatttcaacttatcaagtctatctagatacccctttctctgctctccaaccccctgaacttccctggttctagtcctaaacgactttattcctctagaggattacaagcttcatgagagcaggaactgataggtttcttagatgctaaaccc

SEQ ID NO: 21129 - DNA, 598 bp, Bovine  MMBT18084
  misc_feature (1)..(164): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagtgtattcagaaacctttagacacatttgctgtctatgaaatgaggatacaaacatttgtacctctcctctttgagacatgaggatggatggcaaaaatcacttgtacaatactttaagtgtcttggaaaargaacctatygaaatggaaattattatcatcagaagagtcataacagtcttccaactgtcattgttatagtggaaaatggtgattcattctactccccatctcctttgtcccggtggatagaaatcagcttattagtttcttagtgtaactgacagtgtctcctttataaaacccattcccaattcacatttccactgaaattttaatccartgaattatattttgtcctctgtattgccaattcaaaatcgttctttggtaactgtactctctgccttctagttctccttcaggaagt

SEQ ID NO: 21130 - DNA, 600 bp, Bovine  MMBT01748
tccaaaagctagtgggttttcacagacaccccatggaattagggtgaattgcagcggaggtagtgccccaggacccccactctcatgcctcttttaatactttgcatttggattatgagagagtggtgggttggagttcttctgcctcctttcccaaattctcctataatttagttatactgctttaatgttagattaaaaaacaagaaaaatcagaactttggaatcagatagtcctgtatgtgcccctgacctcttctctccactgaggcaatatttccactttttaaaacgttcctyctttttctagtgtgacctctgtgactccctttttaaaatttaattggtttggtttaataacttggaaagcactcaaactaaaaaacctacttccctgttttgcatgtcaattaattaatatctgtggctcattaaattaaaacttttttttaatttacttaaaaaacattatctactctcggtatttccctgaatagccttttaaaaatatgtcacgttgttttagataatgctttcttttagttttagtttttctattttgcattagtttattcatagaggtttctattttcttctttt

SEQ ID NO: 21131 - DNA, 600 bp, Bovine  MMBT22656
taaatctcggtaggagtaggtgccttcataatataccacatctcactaatcagagaagtatctagaggggactgttatagacaattttaatgaaaagaaaccacaatgtgggaaacctgggcttggaaaaatgtcaggtttttattcactcctgtttkaaaatgaataagaattaagggcagagtttctgattagaaacagaagactaagcttaggtcaatttcaccaacctcgtaacttgctaggagtttcagaagcagactttggacttaccttacttacatgctcaaaaggcatacrctgtcttgctaccacttctgatttctgaggttccacccatgtttgtttttaatgagcataatcacacataacttttaataactaaaataattccagcatctctctcccacctttatctacagagcaaaatatactctatggattccgaagaaagaacattttgctcttcccttgaggtacccatctaatgcagacgctgcactggatcctccccttgtcttttatcatttagccatggccttggtatctggggactcttagctccagctgttttcaatggccttccagaaaacagtatgt

SEQ ID NO: 21132 - DNA, 594 bp, Bovine  MMBT18799
ccaaggttttccccttagcagatggagggatgaaattgccatctaggcgatggaagggctgtgggtggagctgggtccccctcccccacccactgcactggttcccttcctgggaaggaagaggagtggagagaatgtggaagaccacccatcccggtgagatgacagtcgccccttctgttttgaaccttcaataatctttttttcttcaccaattcaaatgctgcctgttcagtaccctcttcaagattcatcccctcctttatgacatctagcttgattaattttacctggctgaartctcccagttcactccatattcatacagagatatgttttacttaacaggggagtttttaaaaagagaggtgtaagtcacctttaaaaaaaaacattaaagcctggcttatgttcaccaggggaatgacttagagtgctctattattaatgcttttgtaaggtgaagaatccttttgttggatgactatggatctccagtaattttcagttttgaaagatcaggttgaagacatataatactgattgcacacttagatgatatgtctccgtacatgaggcacctgctaggcatct

SEQ ID NO: 21133 - DNA, 600 bp, Bovine  MMBT13240
ctgtacgtaagtagcttcctcttccatctgacagtgctggccctcacttccaggccaccactggagagaatcataagatgtcccactaagtcatctccaaggtaattcataaaatgtcctattaaaggtgagctacaactatgactataatcttcacacagccatagatgtcctagtttgttatacttttcggttcaacagctaagaaaaaaaaatccacctgccaatgcaggagacacaggagatgcaggttcgatccctgggtcaggaagatccctgggaggagaaaatgacaagcckctccagtgggacacaacttatcgactgaacagcaacaacaacaaagttagactgaggcctgaggaagtccccaggggtctccctgatggccgggggtcaggcggggctaccctctcctcgtctagcacaactgactgcttggagggaaactctggccctcacatggacccctgctgcacttcatctcgctggatgccgaatgttcggctcatcattccagccaactgagatcatttagaagtttgattttgccatcaatcatttcttctctccctcccagctgtgtgtcagctatagctg

SEQ ID NO: 21134 - DNA, 600 bp, Bovine  MMBT17970
gacagaggaatcttagactttacagcatgtgcgttttgttagaaagatagttcctctgtcatggggcttaacaacttttcccaattcaattaattggaatctcacagaaaagcaaatgccgtaaaataaaagactcaaacatctgggaccccaagcagcatccagtggaaaacactaatatgatgcagtttcacagcttgcggatgggaatattaagagccttcatttctaagaaccactgctcagagagtgtgcggcttcttttaacagctagttcacaaggcaggtttagatggtggkttttctcagaatgcaatttagtgaggcatctccaatgcatgcatgcaatcaaagtatactaagtgaatgtctctttggggctagccatggtgttagggtataatggaacacacacaaagaagacacaagtcatttctggcctcacagagcgtggggtctaactgcctttcaaaaactcctggcctagaaggagagagtcagggagaaaaggtaaccccgacaagacatgtgactgctggtcaagagacgcaagcagactgaggcccctgcaccctttgttccctcttagggctttccacg

SEQ ID NO: 21135 - DNA, 600 bp, Bovine  MMBT19042
atgataggccaatatcactgatgagtgtagatatgaaaatcctcactaaatgttaacaaattgaatttaacaatatgttgaaaggatcatacatcatgatcaggtgttaattatgcaagggattcaaggatagttcaatgtctataaatcaatcaatgtgacacatcatgttaacaaaataaagaataaaaaattatatggtaacctcaataaacaaagataaagctgactctggttgcctaaaaactgtatcgatgaaataaatgcactagagataagattttcaaaaccttatacctygacatgacatgcggttcttttggagataatatcccactgtacacatgcaagttcttgtagtttctgatgttggtaaacaaagctgagaacatccaccattatttagttggcaggaattgctgcctgaaaagtagaaaaacaaacaaaagaaacataaaaatcaagaaaagtttataaacatgattttactgatttataaatgctgctgcttcatattggttagtatcatgttttattccctcaaataatttgaagtagcagattatggttgaagtctgtctttccataaaaagcacagta

SEQ ID NO: 21136 - DNA, 452 bp, Bovine  MMBT22366; identical to SEQ ID NO: 4689

SEQ ID NO: 21137 - DNA, 600 bp, Bovine  MMBT01633
tacccactgcatcttatcagtctgcatgaaggcccyttaggcacctgctatcctcttcccgaccctgtgcaggagcagttccaggtgaggtcccccacccagctggccccaacatggtgaatgatctggacctagagaggctcttgcctacacactcacccttgccggtccacaagaccaggccygactcaaggcagtacctaaggaaacattgaaatggagacccaccagctcttgactgaatgctgccaattatttttatgaatacttcagaagtcaaaatctggcagaaaggaaaarcatacagagatatttaccccataaataaataaatcaacctttcttccttgtgaatagcataaaaatgtctttgctttagtggaaactttgtaagtgtgatcttggctttttgccatcagcagatgtctataataagctaaggtctcagacagagatgaattgatttttttttttttttttttttacctcaaagcctcacaaaagacagtgtgcctgagagttcactagaaaaacaggatttgttgttgtttctagttttattatttaatggcaaacagtttaaagcttcaagtaattggt

SEQ ID NO: 21138 - DNA, 600 bp, Bovine  MMBT05886
gaccacagagaccgagtgggtagactctcagcttaagccgaatcaccactaggccactgcatggggtaggcagtactgacaagacattctaggtaaactacaacaaatgggccattctaacaggcaaacaaaatgtcttccctgctcaggactggagtgggcagtcttccgggattcacattcaggaatatacttgtttttttcagcagctttctgaattgtgtcaaatttatgaaaagaaacactgctccatcccatgtgtttttcttgtgaaatggaaaggtagaatgacaaagagasagaccacgtggcagagtcaggagccggaagatgtgtttgagaatgaggcccgccactgactggctgtgttgatcttgggcacgttgtcccctagttcttctgagtcttggatcctcgagcacctcacagaattagttagacaaatttaaaaaatgccccatgtaatgtaaagcgatagtcaattatgaggtgttattcataaatgcgaactgggacgtgacatggagcataatttctactagaattcgcrttaagaaaataagcgtgcatagaacatacagtagatcaatatattgatcc

SEQ ID NO: 21139 - DNA, 601 bp, Bovine  MMBT03804
  misc_feature (1)..(1): n is any nucleotide
ncctctacttgccttagacagggaaatatatagtactttacaagaacatttgaatatttaccattttatagatcctccttgactgcacagaagaggaaaaaaagccaattgcactttagaacaatccttcattggggagacgtttttagtgagtaatatttcaaagactgttcaagggtgaaaaaatgktttataaacaataaatattttagtgactccatggtgaaaatttcatagtatgggttttttatacagggttcttccattccactatctgtagtcacttctaaaaatacaaacrgtcaagagtttcctaccaagctaaactcatctgtaaatttccacatcaattgcactttctctagaatcagatargtttctatgtatttgtaaatgtatccacagtatttaaaaaatacttatcaagacaattgacttaaataggtaagtctatgaaaattatctactgttgtatagtaacaagagattaacgttatagaataaatgtaccatagattcaaaagtagattattgaagttagtaaaaccaactacaaggcacatgtctgtatcctcgaaagcttattttcaacactggatgc

SEQ ID NO: 21140 - DNA, 576 bp, Bovine  MMBT12023
gcgtggtgaagccatcatcccaagcagggaggacaggaattgaaagtgtctgctcctttsatcccggctcacctcacccctctggtttttgcttgatttttatttcagttttcctttaataaaacagtgaactagagtaagacattatagttattttggtgtttaatcgtattctagggagttttcatcagctcattttaaattttagatggatgctggtggtggaagttctgggtttgaagtgtggacacagcatcagttattgttcctgcaagccctccggtgcggctccatcctccygcttggcgataaaccttcaccaagggctttgctttttccctcgggacatcttattgaatacttgcatcttcagtaattcatctgggcccagtgctttgtctgttttaatacttctaattacctaattaggtgccataatgcagtgacaaagccctttgtcatttcactcttgtcttaacccttttcttgcttaggaaacactctttgtgtctctttgttgtctgaggaactctccatcatggatattccttggatatttgcctcactccctttttg

SEQ ID NO: 21141 - DNA, 600 bp, Bovine  MMBT13878
atygacttagcagcaggcaatgaattgccattcttttctcaatttaccagcagttacaaagtgacaagaataacactttgctatacagtaggtcagcaaactttttataaaggaccaaatttgaagcattttaggctttgcaagacacacaatctaagaactatccacctctgctcttatagcacagaagtgtgatacaaaaccatacaaaaacaaacgtggctgtgttccaataaacctttatctacaaaaacaaggagtaggctggatttggtgcagggaaccatagtttgcaaaccmttgctccaaagcacattattcttgggaattccctgacggtccaatgattaggatttggcactgtcatcacaatggcccaggctggggaactaagatcctgcaagccacaagacacagccaaaaacaaagtcttaataaaaaaaaaaaaagtaaatgataaagcatactattcttttaaaagaacaaacaaaaaccaaattcattttttcagttagcatttatacttaagaactatagattacttaacagaagactagtatacatttatactgtgttgacttttcaaatatctgatatgaa

SEQ ID NO: 21142 - DNA, 601 bp, Bovine  MMBT01202
  misc_feature (1)..(1): n is any nucleotide
nactcttaagggaatgatgtttaaatattccagccctgtctccttttgccttttctacaagaagggttttgatcaatagcagaagtacagaggcccagccagctaggaggcttggctccagttcagctccatgtcccagagagatggacggctgctttactttcagctctgccttggtgttataacatttaaaggaatatttccactaccttcaaaatgtttaggtccacaagccagttacgaaaatgtaatctggacttaatacagagttgtcaccttaccctggagatgatattgctgrgggacttcacagtgccaaccacacaatgaatttcccaggcacctggctagggtatgcagtgaacagtccttggcagggaactttgtacaaatttgcaaactctttgtacagggttaaaaacaagccctgactggaaaagatatgaccttcctgaatagctagggatctccatttcgtgttctctgtagggaaagtgatgataatgatcttgactctctctcattgtgggtgagtgtttttactggcttgagtatcattttctacctacgtgttcattcatcaaaaattttctgtgttcct

SEQ ID NO: 21143 - DNA, 600 bp, Bovine  MMBT10847
ttatttcattctttgtaatgggtatagactatatttatttgattttcataggcaaacatgtaagtaagcatcactttctcctacttcctgttttacaatgaggaaactgatgctccgcattctgcatgtggttccatagcctgggagataccaaagctcatgtttttcttgcatcaagctgcctgcaataagccaagacaccatatttacaggagaacactgtttagaaaaaattcttattggtagagacagtcctctcaatcttagaacataatcaccatcagtttgataggtcctctytgaaaatgaagacaatatgtcctctcaagcttgatttggagggtcactcactatttctgattacttgcaaaattctttactatcatctgattacttcatatagagaaaaatgattcctaatagaagagataattttagtaatttaagtaaattagctctttaaaaagtatgcaatttatgggtgggtctcaagtacacttgtattgagtctagagaaggtaagtatcctgttcttcccagtgcagaaaggacccctactttatataaccgcaggatctcaggctcataggtttttttttc

SEQ ID NO: 21144 - DNA, 425 bp, Bovine  MMBT18626
agagtctctgtgaggaaggtataagaacagcctgttccttctctcctttcagaaaccgtggttggttccatcgtcactgactcactttagctctgctttactgttagaactgttataaatttcacttcatacctgcagcataatttacatttctatgataagtatgatgaggaatctraagaaataaaatattatcaagatccttcatctcattatcattatgcatataattaataatcttatttctgttagtttaggggccataataggtctttgtcctgccattcattgtttctctgmtttattaggcactgtttttttagggactttacatattttgtgtctaataacagccctgaaaatgtgttatcttttccgttttcaggaaaaccaaggctcaaagaggttgttactgcacaaactca

SEQ ID NO: 21145 - DNA, 600 bp, Bovine  MMBT17017
cccgacacagtgactgcgttagtcacggctctccagataagcagaaccaataggatacatacatttagacacaaattctgagatgtataatgaagagagagtttaagaataaaattggccacataatggacggattttggaagtggagggtgatattttatgtgagagctgagtgaagttagcaaggcaaatagggcagggccactactgtgaagggcatttgagagggttccaaagtggggaaaattttgtactttgatgataattcttgtaaaatccagtgtgattggggttgggaayaaaatagtctcgagggtgcacagaggaatcctcagaactttgtagaatcaatctgaaatgaagaggggccccagaaagtcttatactggggagttacatgctccaatgtgcatttcaaaatatcacttttctttgtcagctagagagctggtgagcaaatctcccatccttggtttctataaatctatgagtatttctcctagagacacagttccagttgttacacattccttatggagtttactttacctactttctttgatttaaaagactcgaatgtctctgagtacaaggactaac

SEQ ID NO: 21146 - DNA, 600 bp, Bovine  MMBT00598
aatgctcaacagatgtttactctgaggagctggcaagcacggggcagatgtgggctcacccgtccctcacacctagtgtctgctttgaggacacttcctcctccatctatcctgccccgccccctcttccatcagacggggtggcctctgtgggctggaaaccccagtcagggaaccttttaagtggggaggggaaccccattctcyrcagccctactgagggttgggtggtttctgtttgttattgcctgtgaggtrtgggctgtggggttggtccaggagctgcctgttgctgagggkcccgggcggaggccaggtgggctagccctggtgagggtcyggaaggagaggctttgcttgtctgccaggggctggtttgtctggaagacagcagccggctaagattgtgcaaacaggtcattgtgcaaacacacccccgtgtgtgacctcgattgtgcaaacaggtgtttactggagggtgcccagcttgggctgcccgcttacaaaaagcgccggagctgttgactcagaaggaaccggaatctggacactcattctttcttgaacacaccctgaactttctgcctcccagccttggct

SEQ ID NO: 21147 - DNA, 600 bp, Bovine  MMBT17103
accaaaacttcaacagtggtgagtaataatttaagactccaagctttactgaggattgacagttttaaaagctaaattttaccagattcactagattttactatgtctgtaaggaatagtcttggttttaagttgcagagaagaaattattgaaaggattccgggtaagtcatagatgattcagaaagacggaaacatcagacttggaaagtgagcaggaatgaacaatgttagggatcaaggcccaagtcactccaggatcactcttcaaggacagttttctgaagagaccactactgytgctgctacacacagaaccccacgtctcgctctgctgccggcagaaatggatgttgaccgtgtcatggccactgccactgactcaggtgactgacagctaccactactgctgatgccacgtcacaagactccccatcacccctgcactcgtcccgggctccctgattagttttgagtaggtgcatccgtgrcccagctgaggctgggtcaccacagagtgagcaggcctggcctttgtgtttttataatgggaaatgggccctgcctccctccccaaggagggggattcccacaaggcca

SEQ ID NO: 21148 - DNA, 600 bp, Bovine  MMBT13336
gaggtggaagagagaagcaatatttaatctatacaacatttcctaacattttctttggatatatttctataaaaccttgagttttgccaagaaaatagccagcattttcctggcttcatcttgagtgtaaaagtgtgtacacattctgatagtactagggaaggctctgcccccagcctctctcctagtttctggtggcctcagaaattccttgacttgcagatagccattttctccctgtattttcatatcattttctctctctgggtgtttgtctttgtttccagatttcccactttraaaggacactggccatactgaattaaggcccatyctgatkacctcattataaacttgattgactctgtatggacctgatttctaaatgaggtcacattctgaagcactgggcattagaacatcaacatatctttattaggggacccaggccattccataacagtgtgggtagagggarttgcttgagagggtataygtgaaaatgacaagacagcaaacataggaaagttaacaaaaacactctatcaaacacagttttggagtcattcctatgtaagaaggccttactttaatttgtag

SEQ ID NO: 21149 - DNA, 600 bp, Bovine  MMBT21012
aacatttcctaacattttctttggatatatttctataaaaccttgagttttgccaagaaaatagccagcattttcctggcttcatcttgagtgtaaaagtgtgtacacattctgatagtactagggaaggctctgcccccagcctctctcctagtttctggtggcctcagaaattccttgacttgcagatagccattttctccctgtattttcatatcattttctctctctgggtgtttgtctttgtttccagatttcccactttraaaggacactggccatactgaattaaggcccatyctgatkacctcattataaacttgattgactctgtatggacctgatttctaaatgaggtcacattctgaagcactgggcattagaacatcaacatatctttattaggggacccaggccattccataacagtgtgggtagagggarttgcttgagagggtataygtgaaaatgacaagacagcaaacataggaaagttaacaaaaacactctatcaaacacagttttggagtcattcctatgtaagaaggccttactttaatttgtaggaaaatggaaagcacagggttcttgacagaagac

SEQ ID NO: 21150 - DNA, 600 bp, Bovine  MMBT22456
ggaactaggatcaccatgccaggcccaaggccttcccaagtacctgtcaccaacacttcaaatacactggtcaagtcccaagtgcctggagagagcgaagaggaaaaaaacatgaaataaaggagatatgtaaaactgaatattagaactattatccctcacatggtgaggctacttgttttcactccacaggaaaatgcagccatttttccaagaagccctttgagaggacagcatgttgggagtcagaagactgagtcctgccctgcctccattgttgactgggctgggtgatttagkctgagccagtagacacaccttggcttgaattgccttcattgggaataatacctgttctgtttgcatcatggggttgttggaaaatctgataatggatataacctgtctgcaaaaaccgtaaagcactcttcaagtggaagrtgatactactactattccaaagactaggagcccttcagaggtttggcccatgggtagaaactcctagagacttggttcttcagccctcactctgcatacccctcttccaagaggcagagtgggagaagggatggaacaaatgtccaagaaggcaaagtt

SEQ ID NO: 21151 - DNA, 600 bp, Bovine  MMBT09447
gtgatcattctagatatttaaaatgaaatgagatgttgcccacatcttaaaatcagatatctattcctttaaaaaaaaaaaaccaaacttttttattttgtattggggtatagccaattaacaatgctgtgatgatttcaggtgacagcaaagggactcagacacgtataaacatgtatacatggttttgattgaatagtactcggaagtagagttaaggaactgcaaattagaaatgcttcctaagtgttttaaaggggctgtcaggaaatactatttgatgaaataattttctataasttaaagtgacctatcttctctactgaacactgtagtagattggaaattgtagaatctcggggatgactcatgttcctttttttaataaacaggtcttgctgtctctaagctgaacctcgtcaccttttttgagcaaagaaaggagccctgggatgtgaagaaaaggagacaacagtcatgcacccaggtgggtagggatgaataacgcagattgcgcagggatggtgtctgaggcgaaggagaaactgaggccttaaaatgtggtttgggcggctctgcttcacgggggattccttcgag

SEQ ID NO: 21152 - DNA, 600 bp, Bovine  MMBT07377
tgccctttgtataagagaagagggaagtgatttcatagaccatttctggtcttgagttctccaatatttacttctctaggtatgactttcttcaatgtaactattgataatttgaagatacatttgatatcacagaacctagagatcccaagaagtcatatatgtttctggagacaggacaagtatatcatccacaattattcccattttacctgtgataaaactgattgcttggtgagatgtaatagctagacatatgacatatccattgttgaaaataacaccagtaggataaagacrattttttttaaagtaggtcgtgactctgatatgtgtgtgtgtgtgtgtgtgtgcgcacgcgcgcgctaagtcattcccattgtgtctgactctttgagaccccatgaaccatagcctgctagactctgtccacagaattctccaggcaagaatactggagtgggttgccatggcctcctccaggggatcttcccgactcaggaatcaaactggggtctcttgcattgcaggcatgtatacattttggtgtgctggcacagctgttcaaccacacttgatcatctaatccgatcatttttc

SEQ ID NO: 21153 - DNA, 600 bp, Bovine  MMBT20243
aagacatcagcactttttttttcagttaagttagactctctcctcctgccacaaatgttctttactgtgtcatgacagcagcacattcattttaacgtggcsctgttcttaagacagggcctgcccaagtgtttgcttatctctgagggaaaattgattctacatgaggggataaatagcagcccccatctccctccaatatgaggatgtagtggaggtgattgagtagtggaagttggaggctgtggttattgggtaccagcaaartcgctgcagcaaagactcaaaacagtgcctcckacaagtccatcacttctctgtcattaaactgtctagagggaggcacttccagtccccttttggagccatctgggaccctggttcctgtgctgtttcctgcttctgttttccaaggacatttagagtagaggaagaaagacatcagcwtttttttttttttttcaattaagttagactctctcctcctgccacaagtgttcttctttggggagaagtgatcttctctctctgttctcccctggagtgtggctccctgtgtgtctgctctttagctgttcctgccttgggattatttcttta

SEQ ID NO: 21154 - DNA, 600 bp, Bovine  MMBT13386
tttcctttagtctggcctgatttcctcttttcccaaagaaaagagccctcagctctgcattatataaaagtgagacggggctttagtgtaacatggtatcaaacttgatgtttcagaacaagactttgagtcttgttttcaaaagcacaaaatgagacatacattcatatggtctcccttccttctcaccctactcccaagttgaagggcctgggtattcatgaggtgagagttcagatatagtctccaagccagttaaaaaaacaacatcgcctatgctctgctttcccttttttggcrtttgcatcagtgtagcccttctgtgagcctcttgctggcagggccagctagccagctgtggtgtgattgtgtgttcagtgttcctaaaagctattccattggccaaatgaggcaccagagcaagcctttgcctaacagacagcttctcagtattccaccagtggctctttcctcagccagatggataggactcaattagtctatcagttttccctttgacatatttattctcctttgtgaggccagctgtgggaatccatccttttacttaaaccactttgataaatggctttcattttc

SEQ ID NO: 21155 - DNA, 600 bp, Bovine  MMBT07205
agatctgtcttgtgtgatgtttcaaatactttaggtttggcagaagccaagacacattctgtcaagttctttttccccttcgtttttttaagcccgtgtggattcgagagaaatgtggccatctgattctcattcgtttttgcctaactcaacaacaaaaattgtctcagaagaactagaaaatgtccaagtggcaaatataacctctttcacagaagccttcttaggatctctgtcggtccaccccgaccgattgacattctccaaacaggccaagcattttcacttctttgtgccagytgcacttgctccctgagcctggaatgttcttccctttcaccctctcctctgctcatcgactcctgctccccaagtcccatgcaaagacgacctccttcgtgaaggttttccccaccgtccaacttgtagaygctcccacggtcccctgaagtcctgcaggacttcacttggagccctaacgaccctctgttctgtgctgctttgtgttatagtggttgttgaaccmcatgaatcaagccctcactsatgttgtcctggatgtgaagctctcaaccttaattaaaggccttcacgagaaag

SEQ ID NO: 21156 - DNA, 589 bp, Bovine  MMBT09225
tgtcggggattaatttctaacaaytcaattattatatgtatcttccagggctcatttccttcacagattgtttaatcaaagagacaacagtattttctaaagcttgcaattccctacaccaggaacctttcttacccctctgttaacatcatctgcactgagattaaactcataacatcacatgctacacaaaagaaaacaagtaaaatatatagcccctaaagtcacttgtaactaagcaattgttatgatatgaaaataatgttcatttaattaaaattcataccacatagggtctcratttagagtgttagtttttaaacacctaaaccaggcttctgtggctcaaagctatagtaratatgaaattgtatatatcaacattttttttggtttaaagctaattttataagtaatctctctgtaaagactcaacattcacttatacatagtttataaagtacaattatttgtaagttaatgaaacactaggttcttgtaatatgctttacttgaaggccattaaatacaaatacccaatagcaaagaactacatttctcaaagctaaagccgcatagcctcatgttc

SEQ ID NO: 21157 - DNA, 600 bp, Bovine  MMBT10232
ctagaatagtttgccatgccctcctccaggggatctttctgacccagggatcaaacccacatctcttccacctacactggcaggtgggttcttcattagcaccacccgggaagcccacagtactgtastacacatttattattttttaacccgtgtatamatggacccatgcggtttaaactcatgttgttcaagggtcaaccgtataaacaactgaactgtaatcttacaacttctgtaaaaagtcagccattatttttcccaaattcatttatgccagttctttccccttcaagaaastaaaagacagccatttcagtcaatcaaaactaggttcagtgctttgctagttctgactatagatgcacactgcattgtttcagagtagacagtgagaaaatagtaaagattgatgggaaacataaaaattcatgaaggactctgcacacagattgctttacaagtatctttagattcttgttctactttaaataaattgaaactggaacttatagcctatgcactatacatgtgattaaatcaagaaaaaattggcccagcactgaaacaaggacaaactaaacatcaaaagacatatac

SEQ ID NO: 21158 - DNA, 600 bp, Bovine  MMBT07730
gaagaaaatatttgttcctatgaaaatggcgatcgtggtttccagtggatggtcttggagagagtgggagtcaaaagcagccctttcaggccttgggtggggcccaccctcaggacactcctgtccctgcagtgctgcagcgatccaggccccggcccctgtttctgtgccattcatctgggtggggcgggtggacctatttcctcgaactgtgccaagccagggcttggcacctgttgagtctcttggcaggaacattgggcttttagcagatggcatcaagttttgacctttgcaaarcatttacaatctgaaaatgatgggaaatgatacaaaagtaatgaaggtggtgcaggattacataattacggagttgacagaaccacggatgtctaggccagaatgcctcctggtccggctggtctcattcccctgcccatttctgtgtgacacttcctggcacggaatagggggttggagggcacagtgggacagaacgaggattttatgcctgatgggtctcggattgcttgctaggtctgggagcttgtcgtctcttgggaagaagagctttgttagttgttcagtcatgtctgactc

SEQ ID NO: 21159 - DNA, 598 bp, Bovine  MMBT03788
  misc_feature (1)..(127): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacacacacacacactcacacacacacaaaacctttaaagctaccaaatctttttctctaccacataacaattatgagataactttaaataaatcaatcatatttcgctttgttttgttatccttagactaacttgagtacttataattataataaaagttgagcaatcaayagaacttattcatatttacaaaaatacatgtcatctggctctgtctggagggaatctataccctagttcaatcttaattccttataacatatccataaatctccaaacagctaatcatgaaaatattaatgaaatgagyacatgctttatttataagtcttggcttactaggcccttattacattgccagagagaaggaatattaaaataaatgatatctgtgttcagcactgaaaataaatcaaaagagtcacaatgtcacttataatagattccagtcaagtgtcactttgttgcc

SEQ ID NO: 21160 - DNA, 600 bp, Bovine  MMBT18842
cctcactctataaatgaaatgtacactcagtctgtatactgaatcaatctgtatactgaaatggaataaaacagaattaattatgctgacttggaacctctcaggaagctgcttgggttgggagactcccaagggaattacgcaagggacaacagtatttcactcacctgcctttagagtcgggtgggatgtggtcagctgtagagctcttcttctgctgagcagaggtacaagtttgggtcagaattaaatggctcaagccmatagaggagagacagattctatcctctttcacttgcrgttgtgaagctgtctttaaataaatattaagcacatatttttctatatgtgtttgaagcaatacaaagttgtcccattaaggcatctgtctgtcttggcccagccttgtttatcagtgtcattttacttatcaaagggaatggaccactccttgaacagtcacagaaaccacagtggaactcaggaaacttaaccagtcttgcatcctatcattcacatcccattgctaaataacaattcattccatttgtttattaatgacaattatctgcattgctcaaatgacttcctcatccaaat

SEQ ID NO: 21161 - DNA, 532 bp, Bovine  MMBT11716
cataccaatmggagctcagggctggcccagtgaaagcagtgagactgctcagtgggcgggcagcctccgcccccagtccatgtgactggccccgcaggatgagaaggtgtcccccatactcacagctcgcgccaccagcgtcatcagcattccggtgagaaaggtcaggtaatagcccgggtacaccccgtgccagatggcagagaggaagaaggtctgggtggtgggactcaaggaggcacgttcataacacaccctggaaaccacgacacacgtgagttgtaagaagcctgtcacccycacaaccatcattctttcagtcccagtcaggatttaggaaaacaaccacaccttagcttggccattagcctcagggaggttatggctcctatgaggtttataaaaagattttttacttctgtcttcttactggtatcaccaaaatggtcatttctagtgtgtggggagtctgtactatgtacagaaaaactttaataaatataaaagttattcttatcttacattattttat

SEQ ID NO: 21162 - DNA, 600 bp, Bovine  MMBT03509
taaaaaagtccattctacaccagtaagaccacaacccccaccattcccctggcaatgctgagatgtacggggatttaaacagatggagtgtgttatgggaatgcccttatttatgacctaaaggcatccttctttcccttgggatcaaaggtgaagttattttccatgctaactctgtcctgaggcagagtctatcaactctgccacatttctgctgaattatatgatggttttgaaatgtgagttgatgttcccttgagatggtgctttaatcaggttcattacaataaaaaaatgaawcctagactaacaaaataaagtgacagtattttataggccataggagggaagatgcactgaataatacttaacagatccttaagataaatttacagtgaatgcaattagcctcatccctcctcaaaataggctgttgccactctcttaagagaattggacgtagtgtgcttcacatgcttcagtgctttgtgtacttcacgtttaataatatattagtcatgctgagcttcagtgttttagatattttgatcctttggcatctctgcaatcataaggcatcagcaatcacatgaataacag

SEQ ID NO: 21163 - DNA, 600 bp, Bovine  MMBT11396
cacacatatgtgtacatatttttgccttatttgcctaaaatattgttttgagatcaacacgcttactttttctcaatttctaaatttttctaaattcttcataaaactttaaaaaataaactgtttaaccctgtttcagttttccctaacatgttgtttctctgcaagccatagaatatttcaattaaacttctgttccactgatacatactctattgtaattgatatttctttaaaagtgccttacattttttcctctaacatgttctaagcatctaaaggcactgtactttattttcytagctttgtacatatccttaacatctctggagatatttgccactaaagcaagtgagtgtttatatactgtttgtttattcatgacaactcctaaatgtttggaaagtaataaaaaatgtcaatagtcctatggtcattgaaatgctcccctaatttcaacttcagttttatttatattctcaacattttatgaacactcacagcaactgaaacatcatctcctttaaaaataacctgggaacactgttgtcacaaccactgttctttaaacagcaggtatatcagtgagacagtggtcct

SEQ ID NO: 21164 - DNA, 600 bp, Bovine  MMBT07467
agaatgcagtgtgggatggtgaatgatgtcctggggaaatagtatcagtttttacatagggcagcctctcaggctagatacatagcgtcatgcatcaaagcggtttagtaacagtgactgcctgtgcactccaggtgcccaactcctggcttagctggcttggtgtaaatatagatttcacaatactgggaagaatgacataactaatgatctttcaagaaattatccctatcacatgtcaacaaattgaagactatcctctccaacagctacaggatgggcagctgctctcagctgctkattaaatgcagaccccataaactttggcaagaagttgagcagaggaagtgttggcctcctcccgggaaaactgagatgcccgacaatgagtcaggcctcggctcttgcttgggggagggtgtgcatgtgtctgtctgtgttccatagtcctctgtagaaaattagtttgaatccactagaaaatgcaaactttaatgaaagatcaaggccctaacatacataaaccttattaaatggacacaatagttttagtcttgaaaatattcagagctagcaaactctgttaatcaaataatcaat

SEQ ID NO: 21165 - DNA, 600 bp, Bovine  MMBT08894
aacatagctaggttagtaggtagataggcacttttcactttcttcatgcattggagaaggaaatggcaacccactccagtgttcttgcctggagaaccccagggacaggggagcctggtgggctgccgtctatggggtcacacasagttggacacgactgaagagacttggcagcagcagcaggcagttatggagaaatcactaggaactagaactcagtgaccaaagtgggtacacataaaaataactggattcagaacagacagtgcaagctgaaattacagtactttgttttgtccyatattttacgtaaagtctgctatgtttaaatatagaaccagggactttcctggtagtccagtggttaagactccatgctcccactgtagggggtatgggttcaatccctggtcaaggaactaaaatcccgcatgcagtgcagcatggcyaaaaaacttataaataacaaaaagactatgttcggtcaaattttaaatagtcctattttctgtatgtctgagtagcatgtttttctttgaattctttcatccaaagtaaaaaattaaacaaacaaacaaaaaacataaatcaaacatttcg

SEQ ID NO: 21166 - DNA, 600 bp, Bovine  MMBT16249
catagcttaagaaaaacatttccataagaaaatcccattggttagctcaaggtttgagaaaagttaagttcaggtggaaacaagtgtcctcatggtaacayagaattttaagagaaatctaattttgcatagcgaaggaaaaaatctctgacacttgtttgtttcctcctgccacttaagagagagagaaaaaaaagtctgacacttgaagcctatttcctctgtttgaagaccccttgccttcctgtctgttaccctctcaattctttaccaactgagctccaagggaagccctgctargtagattttgacatctgcttatttctctatttttcagttgcatagttaatttatttaactgcctcctcattasgagttcttaagaaataatatcaccatttaattgggtaggtttcatagacttggcaaaatccatcwatttctattcattattatttggtcttcataatacttttggtaaaattgggctcacattattttaccaacaaagaacctaaaactcagagaaatatatgacttatttcaagtgtgtactgcctttttaaaagctgtaactaaatagaattttcctatttctcg

SEQ ID NO: 21167 - DNA, 600 bp, Bovine  MMBT09371
tctttgcattgatcactgaagaaggctttcttatctcttcttgctattctttggaactctgcattcagatgtttatatctttccttttctcctttgcttttcgcttctcttcttttcacagctaaactcagtaaatataggctgttctgattattgttatcattattacagttagtytgaatacttaagcatgaaatttctgcagcttctcccatagattttatgagatgaatatttggtgcagactcaraaaacatggagtgaaactatagaaactgaagctcaaaatttcccrtctayttgcaaatgtacttttaagccatacaagaagctagtgtsctatgaaatggtctgtgctttatggattagctctttagtcrtggctttcctgcaaacactggagcaagttgttatcagctgatatactcctctaagttacagtgagtaaagtcaccaaataaaattgtttaatttttgatcattaggaaaacattctttttagatgactccagaaaggcacaatttgtggaactagtttctgaaccataaaactgttgagccaggattttacaaaataaaataattttatggtcatacaaa

SEQ ID NO: 21168 - DNA, 600 bp, Bovine  MMBT02719
caagaaatgcctgctaagtacaccaggtattctgttagcagaagactgctaagactgctaattacccctgacatatgtcagattgaatggtcttaggttaaaaaaaaaaaagtgctgagtggagacactatttcaaaaatagtctcctctttttatttataaagtgcttttaaacatttagctttaagaagttgaaaaaacaagttttcagcagacagtagttgcagatattgtgcaaattctcctgtgtactcagtcaatgataaataactgctgccatttcaggtttttgtctgttaygaacttgtagagaaaaaaaaaaatctttatacccaatttctaattatctagactcccaaaagtatcaaactggagaatcccctggcttacgttgyatccaagtcttaacacctaaaatctctttaactccctccactctttctccttttttataaataagaaagacaaacaacattttacatgaggataagaaaaactcttgaagttaacagatttttgaacttctgttgtgggatttcagtgaagttccttattgctgattgacaaataattcatggaaaaaggtaatgcagggcaagg

SEQ ID NO: 21169 - DNA, 600 bp, Bovine  MMBT03843
tgaactccccccccaccttgatttttcatttcattgtaggcatcatgttatagatgttaccaactgggagtagtcacgtggatgaaggtgggctttttatttttcacctttaaaaatgtagtaatgmttgaaatcttgcctgatgctatgaatttttcatactagccaggtagctattcagcccagcgatctaaatctgtacacctcagctgcagtccaagcagaatgaaayggaaatatgtgacggtatttcactaaactctatcatgcatgggcatgccacttcctttattttttacrcatattattcattcacgcagtaaagcaaatcggtttacacacacagacttaaatttgcttttcatttataagtggtaaaatcctttcttaatttattgttctgcatttttatatactaactactgtattttatactttgaattcctcattcaatatggttgagagtatcatgcaattatacaatctgtatactttcaattttaaaaagcaacacaatgacccaactttattacatgtatctgtatatttatatgggcttctctgatagctcagttggtaacgaatacatatacatattca

SEQ ID NO: 21170 - DNA, 600 bp, Bovine  MMBT10851
atttgtgtgatatggaggcagagactggagggatgcagccacaagccaagggatgccagcagccaagagaatctgaaagaagcaagagattgggtctcccctagagcctctggatrggttatgaccctgccaacactttgatttcagctcactgaaactgatttcaaaaactatgttgttttgagccacaagtgtatggtgatttgttatagcagccacagaaagctgatacaggaagtgttcataggagatgggtttttgtttcttctgctaagtgcagacttacaatggtttgactcrtgattttttgacactacaatggtgcaaaggcaatatgcattcagtagaaaccatacttcgaatttttatcttttcctgaactagcaattctagactcttttgctgctgggcagtacagcaagccacagctcctactcagccatgcagtcatgaaggtaaacaaccaatacacttagaatcattctgtacccatacaatcattctgtttttcactttcagtactatatttaataagttacatgagacattcaacattttattataaaataggtcttgtgttatttgattttacctaactat

SEQ ID NO: 21171 - DNA, 601 bp, Bovine  MMBT05561
  misc_feature (1)..(1): n is any nucleotide
nagccccccgtaaagtcagaggtgtaggtgagagcacaagtagtaaagtaggcaggctctggttatgggggtagatgctcaaggatttccagggggactcctgaggctcgatcccgcctttgcrtatgtygagcctccttcctcagagtgccgcactctgccccaacattaacccacccagcaacttagtttaaccccatcagttttactgctacttagtaaattaaaacaacataagagggaaatcaaatagtgttgcttttaacccccagtttagcctggataaataacaactctaaaygaaaagaaatcaaacagggtatttgaattaaayacctaaggagcttcttaaaactacctaagctatacagacaaatgaaacatttaccataacaatttcagcgactacagttttcaagtctccacagctaaccattttaaatttaattttggctatctgtccaatctagacagtagggtacatctagggagggaagacccatgacttgctgcagcacttaaacctctaatcccacagaaatttttcttaaaatagctgaagtgaccagcatgggcactcttcttgagttgatattaacag

SEQ ID NO: 21172 - DNA, 601 bp, Bovine  MMBT09920
  misc_feature (1)..(1): n is any nucleotide
ncacatgccttggagtaaataaccccatgtaccacagctactgagcctgtgctctagagccagcaagccaccaactaccgaaccccgtgcaccctagagcccaagctcagaaacaaaagagaagccaccaggatgagaagcccacccacctcaatgaagagtagcccccgcctgctgcaactagagaaagcccacacaacgcaacgaagacccagtgcagccaaaaataaaagtaaattaatttaaaaaaaaagactttgtaagaggctgaaactcaatatcactttttgaaaccatcacratttaggaactaaatctaacatagcagagtccatctagctgattcatctcttaaaaggtagacttgtaaactcagggtgctattcagtgctccctattgaaacaaaagaaaaagttagtaactcattactaaaaagataagatgcastgataacctatctacttcaagaaaaggaatccaaatggaggatcacagaycttcctcacttattcgcaggcagggaccacgcacagaggaaggctgtctggaggtcactagattaaatactatggcagcaccaagccagggtccatgaatgca

SEQ ID NO: 21173 - DNA, 600 bp, Bovine  MMBT22801
cttaattcatatgttggaagggagatgaaaggtgtcatcacatgatctgacatcctatccaggaggctgactcttccctaatgtggaagagtcataacccctgactgagaggagctaaagtcaagtcttcaaggaacagtcccatttggactttgttttactgtgcactcactttagaagacagcaaaactgcagaagcaaagtaggcggtgtgaggggatttgagaagcccttcactatggctcattcatgttaagaatctaccagattttttacacttcataccagacatggggaaaraagactcttaagaccatttttaccctattgccagtcatagccatgaggcttgggtttctcctctggcaccaaaaagtgtgagatcttagaaccaagttctttaattttaagaaactgatcctaagatactgatatatccagaatgatcatcaracctactctttttycttctagaactcattgatacttamcagtaccaacaggcccccagaccttctctgttctttccaggctgggaaaagacttcttatgagttccatgggtcatacagttagagagaaagcaaaagaacataagaaa

SEQ ID NO: 21174 - DNA, 600 bp, Bovine  MMBT10261
cctatgtgtgtagtgtctgtggaaaaggcttcactatgaagggtgatcttgtacatcagtgcactcatactactgagaaaccatttacatgcagtgattgtgggaaaggctttactgtgaagagccaactgattgtacatgagtgaactcatacaggggagaaatcctacgtatgcagtgaatgcagaaatgcttctccagccaargcccacctcatcagacatcaatgaactcacactggagaggaaccctatatatgcagtgattgtggaaaaggctttgttcagaaaggcagtctcmttgtgcaygaacgaactcactgtagagaaacccaatatatgcagtaaatgtgtggcaaaggcttattctcaaaaaggaagcttaatgcacacctgcgaactcayactggagagaaaccatatatatgtaatgaacatggcaagggcttagatttccctggtggctcaggaagtaaagcgtctgcctacaacgcaggagacccgggttcaattcctgggttgggaagatctcctggagaaggaaatggcaaccmactccaatattcttgcctggacaatcccatggacggaggagcctggt

SEQ ID NO: 21175 - DNA, 471 bp, Bovine  MMBT09455
atgcctggccatgttctaggtaatgtaatatcatggtaatatcgtggcaacacagtaaggcccttccctcctggagcttgcatacatcttcctattacccagccatacagaagtgtgtcccactgggatgaaaaatgccttgaaacttcaccccactaggttawtgcttcagtgtatagtcttccagatctttcccccaggcatctgcatgcatccatacatctactaacattcttgtttatttatttattacaaaaatgggctatattttatacataacttcccctctccctgcttaawactgtatctcaaacattctttcagtttgtatatacttggacatttgggttgctcccagttttttttttaatactaaagacaatgtgtaatgaaacttttttgttatagtttttgtacgtgagtgttttatctgcctcaggcatatgcatgataatgttaatagatattgcc

SEQ ID NO: 21176 - DNA, 600 bp, Bovine  MMBT12639
cagggattcacactacccccttagttgttacaatttgctggaatggctcagagaactcaggaaaatattatatttctgattacaaaaggatataattcagagcaaatcaaggggagagatacaggggatgaggtctaggggccccaaatgttaaacttccgtggtctctccccatattgtcaagaatgctttaccctcccagcacgacaacatgcaacagcacagagtatcgccagccaggaagccccctagagtttcagtgtgmagagttcttattgaggtttcattgcataggcatgrctgaccracttgactgaatcatcggtcatgtgactgaactcagtgtccagcttccttctccttgtggggctcaaagttacaactttcctaatcccatggctggtctttctrgcaccatcagcctccrttttgagtcacctcattagcataaactatcaggtgtggtctaaggtgccgccatgaataacaaatacagtcctatccctccagaatttttgaggatatagaggttactgaggatagaggttatataggacatagaggtccccagaaacaagggaccgagggtcagccgagtct

SEQ ID NO: 21177 - DNA, 600 bp, Bovine  MMBT19616
gcagacgtgcagaggtgaccaggggcctcctggaggaagatgggtgaatgctcctcaagtgcttgggtgtgtttaggtagcataatgggtaggttcttgtaccctcacatcctggagcttggtaaggattctagctcctgaatcaggtcagagaggcaactggtggtcatggctttcctagacagggtggggagagagagagagtgtgagtgtgtgtgtgtgtgtctgcgcttgtgtgcagtggggtaggggatgcttgctgagcaggcggagagggcagggtggccatcagcctcctcycttccttcccttttcagctcaggggtgtgattggcatgtgtgatgtgtcgtgagtggaggtttccttctaggacagaacccacccaccttgccttggtattagaaagcatctgttagtgctccacctcagtgacgtttctctgggtgactgcaacactgctgacggtcagatgataactgtggccctgacgggctggggagagaccagtccaagcccctcactgtaggcctggagagcatataagagggaaccagggtctggagtgcacagaaaggctgtttttcgtggcatataggatg

SEQ ID NO: 21178 - DNA, 600 bp, Bovine  MMBT16343
cttatagagtctaactctttatctacagcattaagggtctgagaggaggagaatatgttattagtgaaccatctattactcttcttgagatttcttcaaatggcagagagaactaaaactatgagaaaactactggagaggtctaattataataataaagcatccaattttggttagacaacgtaattaacaggctggggaaaggagctaaaataaaaggactagttatgtttcatttcctgaattgttatttccaaaaacagagacattttgttcacttctcattttgtggagctattrcaaaaatgttctgccactatacatcttagagatagtgactcttacttaaaagttgtatgtggaaagtctacggccaaagtagacttgtttcatgtgaaagatycaggaacatatctttcctataagatgatgttaggaaccagccttggtgacaagctaaatctttcaaagataaaaaagtaacttcatcttaactatctctggttagtatgtcaggctaattaaggttaggctagctcggtgatacactgaccataactaaccactgcacatgtctgcatggaaagataacacagataa

SEQ ID NO: 21179 - DNA, 598 bp, Bovine  MMBT13518
  misc_feature (1)..(8): n is any nucleotide
nnnnnnnnactcagggattgaacctgggtcttttaggtctactgcattggcaggtgagttctttaccactagcgccacaggatatattaatgaaagtgggggtgggtagtgagccttagtcgctcagttgtgtcctactctttctgaccccatggactccaaggcatcttcccagtccagggactgaacctgattctcctgcattgcaggtagactctttaccatctgagccaccagggaagccccatattaatcaagagactcccccaaactgtggtktgtacaagagagtcatttatwtctgcatagtagcccagaggcaggaaggtggtccagagtgaactggtgggttttgttccatgaggtcatctaccaggatccatctattttgactctctgctctctcctgggatgtggttgactaggctccctgacactgtatcaggcttctgttttagggaaaagggaaagagagaakagagaggacagcacttgaagaaaaaagatgcaaagtttgcacattttgctactgggcacttgatcagctgtggcacgttttacgaccagtgctcatagtcccttagtgagaactaggtca

SEQ ID NO: 21180 - DNA, 553 bp, Bovine  MMBT16850
tttttttttttcaaatagaaagttataatagctactgaataaataatcagtatttggaaaaatattttaactaatcttttcccctcctttctcaaaagctaaattgtttgctatttctgagactaataccattgtacttgttggataatttacagtaaacacacatcctcttaatcacatcacagaaacttaaatagatttgtaaaaccattaaaaaatcaatacttagcttttaggtgatgaattaattaatggagtgtgaatgcttgaagtctgcattacccagcatgcactatggcytttcataatatcactgtcaatgggaacagtatgcaaagtaatataatgtaactagtggggaagtgctgataaaaatatatcaatctctgctacccaatgagaatattccagtaaaaacttccttttggtaagaaatgcaattcaatatttttctgttatgtataatgatggaagaaagaagcattgttgacaaatgaaatccagagaaaaaatagtcagaaatgtcccaactctttttattatcaggcaatag

SEQ ID NO: 21181 - DNA, 600 bp, Bovine  MMBT23144
cctccactttttaatgtatgtcttgtcactaggtggtcagtgaatatttttcttcccctcatacacacagggtattttgtttttaagcattggagagcaacaatagaagcagtgtgtctgaatgcaggaacagtctgggaattcaggkgctgtgaattttatgatgtctttgctatttccctaaagcacgattctagaccatttaatttctttattccagtgtttcttcatctggataacagaaatgatgagaaggccagaattgaaagtattataactatcttaaccctatcagtctaytagccatagtacatgaatcctcataatcctcataatcattctcataattttctttgaggaatggtctgtataaaatattttttgctccttctcactaagaaaaccagttcatgccctaggctcaggaggcttcagcctgcctatagcttcatctcatctcccatgtacatcacaatttgcttttataaattccattcccttagcctagaatgctttcctgccattactcaaatccccttgttcctggtgacaaatcagtatcaagactgagcgcttctcctcatggtcttcatcaactgc

SEQ ID NO: 21182 - DNA, 600 bp, Bovine  MMBT07584
tatttatcagagctcagttgtatgacatgagcagtgcaaatttcaggtttcactcattctgagttgaagtgccctttagaattcaaatggtcttacagcaaatgcaaaaatcaaagcagattcacatatggtaatttaccagctaagccttcttactgcatatttcctgtttgctctcccctcaacccattctttctggcaaatgaggttccttggaatggaacctataatggtaatatattcaacatcattatcaatcatttgtattattgtaatcattgcagttgttgtttatttcaragattagtactgccaggaggtcactgtaaataataaccagtccaagcggcatgtggaaatgctatgaatgtgaagtgtgcaagtttgaggcatttcttctacagactgggtcttagcattgtcagcttaaccataaagatacatctaaaaatcttaagatatctgaaggcagagtacaatttgcagtgggcctataaagacctggattcttatcccagctcagcaataaaatttgtatgttctgtgagtcatcatcttcttctgcaggaggatagatgttatatggaggccttaaatttg

SEQ ID NO: 21183 - DNA, 600 bp, Bovine  MMBT14954
cttattctttcaaagttaatagtgtaaagtccaatattcatttgagtctgtaagcttgatatggttataaaaataatccgtcatattataatcatatctaatacatttcactaattgtgtctttaaggcttaatagagttatttcttttccccccaaaagcattcaacttagacaacattaatgagatcagacttaatttgtaatagattcagtgaaatgaaaaattaggttagcttgatataatacagttggccaaaaggccaaactaaatccttttttaggcaaattcactgtctctmtcctggcctcttgagacatgatacacttgtagtttgtttcaacaattgagtttttaattattatagttttgcaggcatctctgatgacattaactagttatgaccttggaccagctgtctcacttctctgtgcctcagtttcttgttttgtacaatggaaataatatttacttttgcattacttttgagaggattaaaataagtgatgccatcatgttgtttagcaaagtacctcctgtgacaaacacttaaataatattgacatatcattatgatcagttttatatttaattatttgct

SEQ ID NO: 21184 - DNA, 600 bp, Bovine  MMBT10317
ctttgtaccctcctgmatactaaaccactgctcgcatgacctggatacccaaacaaatgtctaggaggccrtttttcctttacacatctggttttgaggttccctcgtggctcagatgtgaagaatctgcctgcaatgcaggagacccaggttcgatccctgggtcgggaagatgccttacacatctcaactccaaggaagctcctatttttgtataccttctatgttgttgagggagaggctgagaagaatggatagaaaaaacaaatagcttagtgatgcgcctggaaaatcagaccrcgttcaagaatcaaatgtcctctgctgtaatgtgtggagatgggtccaccaacacagatttatttgccttctttttggatttccctccttcgttaaaggaccttgtggattatttacggactcactcccatagcgctgcttatggcacatccatgagccccccggtagcagagcaaatcatcagagtaatgaaactcatcatgggactagatgggaccacagaaggtaagagggtctgcagcaagcccagctccctttcattccttcctagacccctctctgcctcccttctgccccatc

SEQ ID NO: 21185 - DNA, 600 bp, Bovine  MMBT12289
atgcttttcagaacatgcttcaatccatatcttttggggrraaaaaatgacctgcctgaaattccaaataaggtgattgaaaacatacacctttctcattattggaacatattttgagatagactctatcaaaaaggcacggaaacatacggctgtaagtaaggaatagttgtgttgaaattagcatcrtgctgatcctgctgcccgcttcattggttactaagtggatgttcagcatcctggccacgtcttaaaaagacaggttcccagtctccacaatagttaagtcctgcttgcccrttccatgtctgaatttgacctttcctttggtggcacaagtctccttgtttaagtgtaaagctgaactctgtgtttcaaaagcctattaagtaagttcaagcaacgacaagttcttcagtgaagtttcattttcacaagttccactttgggtcacggaggaattttggaaagacttcaaaaaaaggaagaatagccttcagggctggctcagctctgctttggactgtcccatgtgggtagggccctgaattctcatctaggtgacactcttattcatcatatccccttagcaccgttgta

SEQ ID NO: 21186 - DNA, 600 bp, Bovine  MMBT16798
ataaatattattttaaaacatccaagcattactaaaatatttaatgtaagaagtaaaagcacccaatagtctcattctcaatagataataacaactatgaacagttttgggtccatttctctagacttttttcccatgtgagaacaatgaaacatttaaaaaaataaaaatgggatcctacaatatatatactgtttgcttcttgctttcccccctattgaatcttttttcctcagtatttttgacttttttgcatggamtgaggtcatctgcctttggcacttactgactgtgagactrtagatgaatcactcttcggctcagggtttcagtttcctcatcggtaaaaggaaacagccccttcccacttcgctgtgatgtaagctttaagggagagagcatgtgaaagtgtaggcaccctgcggtggcctccagtgaaccctcctctgtcctgttctcctgtttgactgggtttggagcactgaccatgacctgaaattctgatttcccgggttgtttctttgtttgtaccacctctagaagttaagctgtgtgagagcaaagaccgcatctcttctgctcatcaccgaatctgtcccc

SEQ ID NO: 21187 - DNA, 600 bp, Bovine  MMBT11454
ccttcaacaacccaatccaatctgtctgcctcaacttccaaatagctagtaatggggccagctggggcctgtgggatcctcagagctctgggtcaatatcttatgcctcgttatctgccagaatgtctgagataaaatgcaggacagcccggacttctacacgcgggtcagaatgctgaggagctcaaggagtgggggatgggaaaggctctgatttgaggtgcccttcgccccccggaccctgcaccctgctagactcacactgtaacagcgtcaccagatgtcaccacccacaccccyctcctgcactcattcaacagatgtcacttagcccatactaggggcttggcggtgcagtggtaaagactcagcctgtcaatgcaggagacacaagagacaagggttcaatcctcagctggggaaatcccctggaggaggaaatggcaactcgctccagtatgcttgcctggaaagttccatgggcagaggagcctggcgagctacagtccacggggtcagaaagagtcggatacgactgagcactggcttcaaaggtgccagaccctgtgctagaagctggagaacaataaagatacgttc

SEQ ID NO: 21188 - DNA, 600 bp, Bovine  MMBT22082
ggtatgttgtttcactccatgtatatcttaagttcaggaattagaataaatgaagtcatattatgacattaacacatgataaatattgatctacgctgacaaataacattgaataatgacatttatagcactctgaaaccttcccacatttgttcttcttttttatattctcataactactctgcaaggtaatcaaccaagggatatttaatgagtttctagtgttgttcaggaacagtgctgggtatacagggaaatgattattggtcccacattacacattaggatatggattgtgartrattaagtttccagggtcagttgatggacgagtcaggacctgcaatgacagcctggctcagcacatcctaggctttgctgcctaaaaacttgccagttcacctattgctgctgtgattactctggggagtctcctaaatatcagtgaaagttccatatattcatctttcttacccttttgttctctttctattgtattcaagcttccaattatatttgaaaaaaaatattcttttttcttttccagccagctgccagatcgtctcattttccttctattcttttagaacagatgatctg

SEQ ID NO: 21189 - DNA, 598 bp, Bovine  MMBT19532
  misc_feature (1)..(2): n is any nucleotide
nntatgtctgagtgtacagttttgtgagggctggggtccttggtgcagcccacctctccccgcacaatggaaacccctgtggtcaccagtgcttctcagcaagacctccctgtttagtctcaggacaggtgtttggcaataaatgaaaccttgccccagatcaacgaggcctggagattcatcagcaacagaccaaccagtggggagcccttttaattattttgtgttgaccatgcatttaatgataccttattatggatccaattaatttcattcatgttgcagaaacaaccaagagtrgtcatgttgctgaaatactgtattctgaccctattcttatttttccatccctaggaagcctgctatagcatattcttggtcttgaagtatcataagtacagcatttttgctagatagtgatataaaatgctcatgttttcatgtgtgccatattcatttctgaagcttgtatactattatacgagactgtgtttctaccagaagctacctgatggcacaatcattggggttctgagactgctatgaaaaagagaaacacttctaaggtttgcttctgcttttcctttatacacactat

SEQ ID NO: 21190 - DNA, 600 bp, Bovine  MMBT08270
taaaatgaataatataccctcacattcaatcgttgtctatactttcagctgtacctcattttttatgtcaaagggaatttaaagatttgtataggtatgatctaaaaggttactatttttctatcttatactctgaaagcttatttcatacagtacaccttaaaatcaaatttattgctgtttttcacttcatattttaacagtcttcttgatcctctttcttattctcctggactcacttacatgagaataatcttgaaagaacttactgataggttaacaatcatggacttcggtaargcaaatctattgaccgtttccatttcaacagtggggtcattaagaagatactatagacataacaatgcttagattaagtactataattcctgtttcagggaaaagacataaatatgttctaacttaaaattaaaatttattttaattttgcacttaattggtttggcccagcaattaatttagtactcttctttgttctttgtcataacatttttgtttaagacaaagcaaaacttctaaatcagagtacagtaagtataaatattttagttrgagtcagtatctaaaaatgcctattct

SEQ ID NO: 21191 - DNA, 598 bp, Bovine  MMBT02202
  misc_feature (1)..(4): n is any nucleotide
nnnnttgtctctttgcatcaggtggccaaaatcttggagcttaagcttcagcatcagtctttccaatgaatattcaggattgatttcctttaggatggactggtttgatatccttgctgtctaaggaactctcaagagtcttctccagcatcacaattcaaaagcatcaattctttggcactcagccttctttatggtttaactcttacatctgtacatgactactggaaaaaaccatagctttcactatagggaactttgttggcaaagtgatgagatccattaccttttaaccaactytccataacttaaagctaactttgatcacaccttgtcatccacatttggcttcttcctatacatggttctccagtgaaaacgaaatttatttgttcctctctgttctcacacaaaattccaaatgctcaccaactctatttccatttgaaatgacacccaaagtaattgttctttgcacaatgtttaagatcaggaaagccagcttccacttataatagaattctctaaacttctgagcacaggatgtcaactctgtctctagatagtaatcaccgagagctctgtggtcctcattcct

SEQ ID NO: 21192 - DNA, 598 bp, Bovine  MMBT01950
  misc_feature (1)..(64): n is any nucleotide
nnnnnnnnnnnnnnnnnnnnnnnnnnnnnnnnnnnnnnnnnnnnnnnnnnnnnnnnnnnnnnnncatctgctgggcatcctgagggcacacggggccactggagctggtgctgcaaagctagggggagtgcggggctgtgtggcatgtctgccttctttctagcgcagaaatgctgattccagccctgggcagactggccacgggcaaaaccagctacaggacatttggcagcatggtgttggagtgtgttgaaacattttctgtagagaagtgaatgttcgtagtcctctgggtgtggmcacrgggactctgtgtccttcagggcctagaatcccagcagtcagcgtcctgcggcccactgccccccagaccagcagctggggcagctgggacccagagcttgctgttggcagctccactctggggcttggttttaagggacagtgtgctctgaagaaacgggaaaaagtgggatgtggtttccgacgggatgacttgatgtcccccttgtcacaaataataactttacrtcagacttggctacacgtgtaaaacacaccgcatagactgtatttatttcagtttgagtttctaaaa

SEQ ID NO: 21193 - DNA, 598 bp, Bovine  MMBT22061
  misc_feature (1)..(152): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggtggcctgtgtgatgagtagggtctccgggtaaatctctgaacctctacaagcctcaggctcctgctgtgttcaaaccaacccagggctgttttgaagtggattcaatgctcaaacacccccgaacacagggaaacactatatayggacatcaccatgctatcacttctccccagcayrtagaaacccagatttccatgcacccatccagagaactgtgctccctggcacctcatttggctatgcaactcattatactaattattctttaaatctkcggatgttccttgaaaagctgctttatttataaacaagttgcctgacagcaaaccttggagcagaagtattagcttcaaaagccgccaattcaaacatcagcaattcagaggaaaaaccataaatggcctagcacctaatcccagtgctgaataawaaatccatcat

SEQ ID NO: 21194 - DNA, 598 bp, Bovine  MMBT17179
  misc_feature (1)..(9): n is any nucleotide
nnnnnnnnnaaaaaaaaaaaagtcctggtttcaatgtggattggaattatcaatagaaacaaaactgcaaagagggaactcaagagatggaattatatcttatgctctgtctccataggaaactaagctaaaagactataattcctggaatcttgaaattctgggtgtaccaattgcactgaaatcgaaatgggtatgataattaaatgacagttgggtttgatcaattagatttcaatttgggggttgagaaaagaggttttgggggacccacgtataatatacaaaattaattctggycaatagtttgccctttcttccattatctgctactttataagcaaactttgttttaggcttctgctatctacctgaccaaggccacagtctagtgagacaagcccaggaaagacgagggggcacaaatagacgctgagacaagaatgctggctgcattccttggcctgagcccttgtggagggtgggctgagctgaaacacgcactagatcgggcccacacacagagagctattmctttgcaaacctgaagggaactaaaatccactgcttttctctttttttgcttttgaatttatcc

SEQ ID NO: 21195 - DNA, 600 bp, Bovine  MMBT14326
gagtgttccatttccccttggtttccgagaaggtttgaggctcctactaatatgctgaccgtctcaatcaatacatttggctcgaggcatttgtgtagtcaattctccatgcctactcttcagcatcctctctatataaaatggctggctgtgttcagttagaaccttcctttcctcatcaatatatcaacgttatacaacagcttgcaaggcatggttagatgaaactattatgttaatcctagtggcttgagatttcacaaataattcccaaatcctataacatttaaaatgtctctytatttctatagagctactacaggaaaataattttttaggaaaactttgtctgggctataaacgtcttcttagacaagcaaaatctgtcattatagtcaagattgattgacctgtctatgtatcaaatagactagtgtaggtaaaggtttataaattaatgactagcatggattttcccctcacgtctacctctttatttcagtgtctgaaatcttgactggctttgactgtgtggatcataacaaactgtgggaaattcttaaagagatgggaataccagaccaccttacctgcctcctg

SEQ ID NO: 21196 - DNA, 600 bp, Bovine  MMBT19308
aaccctaggggtctgtgctctgtctccggagctggtctcggtaagtctccggtcctttgaccacctgcagccagttctagtggatcgatggtgtcctggccctggacagaggggttcacaaggaaggagaggagtgtaaaactgtgtcctcaggcgctgggcagctaggcagtcagctccgacccttgtgttgaaggagctcagggcaaaaaagagctgggggcagctgtgtttaaaagaacaacaacatttgagcagagggagtctgtgaaggatgagtgggatcaaatatttgggtaycaaagagggaaggagatgtttccagatgaggcaagacaaagttccttcctcagacagggcctggtataggaaggatgggcaataaggatccagggaaagaggagccagactgatcgggaacactgtttactttccagaggggtctccccacccagaccaccaggacccccatttccagaagaatggcccagatatctcaagtgcaggaactcttccacgaggcagcccagcaggtaggcctgggtgggttggggggtctgtgagaaaaggtcaccaggcaagatgctgaatggaaatctt

SEQ ID NO: 21197 - DNA, 600 bp, Bovine  MMBT17700
cagcacgaattgtttttctttgtctttgagagcacacttcagaggcctgccctctctggaaaatgacttgatctgtaaatgtcaatgattcaaaaatatttctaagggggattctagccacatacaagtcagaggctcagttagaatttcctgatacttgaggcaaacactcctgtccagtcccacattaggactttccctctgaccttatatttcaaggagggcttcccaatggtgagccgaaacctcctgcggagtcctcatttgcccctcagtcagtataaaggacactctgattakagcctgcaaatggcaaacattttagtagctacgtttacatttattcttactattgttcatagaacggattcaaacgtgattccatttacagtcagctcataaatagttggttctaagtttagccttaatccctttgggaatgagttccttttatggttcacaatgtgacttcctagtttgaaaaagtaaaaaaaaaataagcaaatcctctaacacttagaggaaagcacattctatttcatgagctttcttaaaaattctgggggcgtgcttaagctacttgcttgccagcgtgaagcc

SEQ ID NO: 21198 - DNA, 600 bp, Bovine  MMBT11795
gatcccagcgagcttaagtccatggggtcgcaagagttggacatgacttagcggctgaacaataacaacattcacccctcacattcaactgagcagtacaaaacaactcaagattttctcatatattatgcagttctatacatatctatccagtcctggcatataataacaagttaaagcacttactatggattagtcattgttgtacgcagttatacacaacacatttaattgtcacaagcaacctgtgaagtaggaaatattaggaccacttarcagagaaaacagagayacaagatrtttctagtaaatggaagaagtaggagttgagtctggrgtctgggtctagagtccactcttgtaagccactgtgctccactactttaacatacgggtctctgtacccagcatgtccttcaccctcaactcccttctggactcacacatctttccagaacaracctaaacrtctccttccttaactgtaaagcctttcctcagcagaatgttcaccctctaccatcctcccccatgctgtacaytattccaccatgtggcagggggtctgttgaccggggtctctcctcaccaggctggtga

SEQ ID NO: 21199 - DNA, 600 bp, Bovine  MMBT18867
atataataacaagttaaagcacttactatggattagtcattgttgtacgcagttatacacaacacatttaattgtcacaagcaacctgtgaagtaggaaatattaggaccacttarcagagaaaacagagayacaagatrtttctagtaaatggaagaagtaggagttgagtctggrgtctgggtctagagtccactcttgtaagccactgtgctccactactttaacatacgggtctctgtacccagcatgtccttcaccctcaactcccttctggactcacacatctttccagaacaracctaaacrtctccttccttaactgtaaagcctttcctcagcagaatgttcaccctctaccatcctcccccatgctgtacaytattccaccatgtggcagggggtctgttgaccggggtctctcctcaccaggctggtgaggtcctggaggaccggagctacctcattcaccattacccctctcagtcacaatgcctgccacagcaagcattcagtatacatttactgaactgaacgaatttcaataaaggtaaacgcctatttttattcaaaaccatttcaagttgtccacacagcttg

SEQ ID NO: 21200 - DNA, 513 bp, Bovine  MMBT20141
  misc_feature (1)..(66): n is any nucleotide
nnnnnnnnnnnnnnnnnnnnnnnnnnnnnnnnnnnnnnnnnnnnnnnnnnnnnnnnnnnnnnnnnngaaggcgctggccaaggcctcagcctgtctctgaaagcctcgcgagaaggtaaacacaaaagggccgccaaagccaggaagatggaggtggggttcaaggccagaggccagcccaagtcgacccactcccccttcgcctcggaagtgagcagttactcctacagtaagtagtgggccgcgccgcctcagggctgttcttcctccctttccttcctttcttcctcttttggcctygaaagctccatggcctctggtgatggtctctttttccgctttggcgccggtaccaggccggaaacggaggtggttgtgatgaatgggcactgttgtttgggcggccacctgtgattggtgggtactcgtgattggcgggcgggtgggagcggaagtccgccagccctcccgtacccgccttaccgttggtccgcgctaaggccatcggtggga

SEQ ID NO: 21201 - DNA, 600 bp, Bovine  MMBT13592
atgccatagaggacaaagggacctttttcatgtttacacactagcagtccaccagaatctccctgaaacaccaaagaaaacgtgttctaaaattgctttaatcagaactcctggctttcaattttggaacatgaataattaatttattaaaaacatatttctttaattttttaaaaagatttattccttgtcatttggtataccttagaacacttagacataaataaatgaaatggcaaaaggaaggaaagaggagacactacagctggtattccagaaatacaaaggattataagagaycactatgaacacttataaaccaaaaattgggyaatttataagaaataaattcccagaaacatgcaacctactaacaacaaagtaagaggaaaaagaaaatcacaatagactaatatgagaaaggagaatgaatcaataatgaagaatatcataaaaaagaaaagtccaggaccagaaggctttactagtgaatttcattaaacatttaaataaagaatccttgtcaaattcctcacaaaaactaaagaggggggaatactccaaaaatcattttatgaagtcagcattatcctcatacca

SEQ ID NO: 21202 - DNA, 600 bp, Bovine  MMBT21582
tttacacactagcagtccaccagaatctccctgaaacaccaaagaaaacgtgttctaaaattgctttaatcagaactcctggctttcaattttggaacatgaataattaatttattaaaaacatatttctttaattttttaaaaagatttattccttgtcatttggtataccttagaacacttagacataaataaatgaaatggcaaaaggaaggaaagaggagacactacagctggtattccagaaatacaaaggattataagagaycactatgaacacttataaaccaaaaattgggyaatttataagaaataaattcccagaaacatgcaacctactaacaacaaagtaagaggaaaaagaaaatcacaatagactaatatgagaaaggagaatgaatcaataatgaagaatatcataaaaaagaaaagtccaggaccagaaggctttactagtgaatttcattaaacatttaaataaagaatccttgtcaaattcctcacaaaaactaaagaggggggaatactccaaaaatcattttatgaagtcagcattatcctcataccaaagctagataagaacactacaggaaaagataa

SEQ ID NO: 21203 - DNA, 600 bp, Bovine  MMBT10499
ccaggaccagaaggctttactagtgaatttcattaaacatttaaataaagaatccttgtcaaattcctcacaaaaactaaagaggggggaatactccaaaaatcattttatgaagtcagcattatcctcataccaaagctagataagaacactacaggaaaagataattacaggccaatatccccaatgaatatagatgtaaaaatccccagcaaaatactaacrtactgaattctgcagtatattaaatatactatcaatcaccataatcaaatgggatttattccagrgatgtaagartttttcaatatatgcaaatcaacaaatgtgaaagttaaaagttgtgtcgtctcaatagtacaaacaaaacatttgaaaaatgcaacattctttcacgattaaaaactctcaagaacttggatataaagaaaacataactcaacataataaaagtaatatataacaaaccccacacttaacatcctactcaacagtgaaaggttgaaagctgttcctctaaaagcaggaacaaaagtactcatcctcaccatgcctattcaatayagtctgaaaatcctagtcagagcaatctggcaagaa

SEQ ID NO: 21204 - DNA, 600 bp, Bovine  MMBT14022
aaacctctcccagtatttaccgggaggactccaaggatcatccttctagcctccttcaaatgccattttcctaggaacctctgacctccttcgacgctagaagcagagacgaacctcccacccgtggggcctcttccacaggactgggaatccctgtagcctcgctcgtgtgcggtggaggagcctggraaaaagtggcaaatcaataaatgggttttttagtcagtgaagtccatcaagtgatggacagagcaacggaggtccagagagaagaggcaactggtccaaagttattcaggktgtcggtgttgagactagaacccggggtctagtcacgatataatcagagcaggttaatagatttgtttgagtttggtccctgagtgggtaaaatcccctggaggagggcatggcaacccactccagtattcttgcctggagaatcccatggacagaggagccaggcgggatacagtgcgtggggtcgcaaagtcggacacgactgagcgaccaaaccacaggggcatgtgcggtaacgacagcggacatgtatggaaaggtcactgtgcgcaggtgccaagccctccggacacatgacga

SEQ ID NO: 21205 - DNA, 600 bp, Bovine  MMBT11291
cacagacacaagcgctttgtaaattatgtaaatttctatttatctatataattggcaataactgggaattgtaacgcctgacagttcgcaatctctttcagctgcgctctagtggctacgctgagattactgagcagctgaagaagacggtgtttttcaaccgcagggatgggggagaggccgccccatcccctctcccttcccctgccaaggtgctaatgcaatggtggatgctggggtgttagccttggccaaatgctaaattctcaatgagtagtataaggtacgaatgtgaatatycatcatacggaaatggaaaggactgatgtgccagcgagatggtatacagtttcgagaagcgattatttattgtgaaactggtctctacatcaactcctttcggtggatgtgttcgcagcagaatctctgtacatagagatgttaaattctgttctgaatccyrgcttgtgttccttagggcttgaattatgtttttgttaaacgcctaagcaccgtttggctctgtggcaggatggtatctcggaaacgcattcattgtgctaacactcagaaaatactgtcaaatgcaaaataaaaaaa

SEQ ID NO: 21206 - DNA, 600 bp, Bovine  MMBT21675
cttaacccctgcttcctccacttcctcggctgtgaaatggggtcaccacttcctagtcagcatcacaggactttacaaagagaaaattctgatgacaagcagttttgcaacaggaagagctaaagcttcaacgctcaattgtaccagttcccacgagctgaccgtaggctctgctggcctctccctgcctcagtttcctcattgaaaatcaggataataataggactcatctcaaagctgctttgaggattaaatgagataatattgtacttgaagtacagtatctaatagccttagtamatgttatttgtttcccctgatctgcagctcattttaccatttagtatgtgtaccagagcactggaatagataagagaatcctacaatgaaagagaaaaactctctcactttacagacaagaaaaaaaagagagagagaaagatgcagtgagattgggtaacttgcccagggcttctgattcattagtgagagtgaagtttagggcttctaattgttgggtcaagcaagcctccgttttcactcctttgaaggttgtgctggtatttctatccccagataaccctttcgaagtctgatatt

SEQ ID NO: 21207 - DNA, 600 bp, Bovine  MMBT08930
aaatccagattctgcttcttctaaattgtgtgcattgggcaagagacttctctcagagggaatgtctaaaccagtaaaatggaagcgtctggcacaagtaggtgcagaaaagatgttctttctgtttcttttctcacagatgtttgaatatgtactgaagaactactttgaggggggaaaggcccatgatctcctctgtttgtatgttaatagtgataggttttgccagactcagaaaacaagcaggaaaatgggtcctgagggtagctaccgaggcactggagtagtgggattacagcrattacaacaaacacctcatccacttggtgtttccctctagttgtttgtgtccttttaaaatcactcttacatgtgaactttgaacacatcatcccaatgactccttctacatttccattcttttgcctacatttaagatcaaactgtaagagtagcttttcctagtgaatgaaatggataatggggaatatattgtgacactgtacattgtctaactagaaactgtcattcagaacaaagtcagaaagagaaaaacaaatatatattaatgtgtatatgtagaatctagaaaaatgatat

SEQ ID NO: 21208 - DNA, 598 bp, Bovine  MMBT21772
  misc_feature (1)..(45): n is any nucleotide
nnnnnnnnnnnnnnnnnnnnnnnnnnnnnnnnnnnnnnnnnnnnncataacagaagactctacacatggacatcaccagatggccaatactgaaatcaatagataagaaggtgtcaaaaataaatgggcactgattttactttatgaagcttggaaaatagcactcttttaggagaggtaataatgagcagtttgctccccttttctcaatgattccatcctattctgaaccaccagctctggtctatgttgctaagcctaggaaatcttcacatgtttgtagtctgctcttttccaaaytccaaaagaacaacttaataatgcagctgagaccaaatcatcaattagcaattcatcacaggatatctagttcacaggaccttagatagaagcccatctcttagtgtaggagacaytaacagttacatctgcaggcgtagcctcctagtacatagcctggaaagaaattcaattaaatcaacattctgagctctggctgtaacatttatgttactgctgtacatctggtgtccattcaagagctsaaacaraaaaggaagtcacagctgacattattggtattggatcaagcaaatag

SEQ ID NO: 21209 - DNA, 600 bp, Bovine  MMBT18335
actcaatgaacatgaatctgagcaaacttccagagaggcagtaaagggcaggggagcctggggtctcaagagttggacatgacttagcgattgaacaacaaccagcctggagatgaagaatgaggagatgtgatgaccatggtaagaatctcaagggagtgacaggtttgcttctgtttttcagaagaaataagtgaaagcaatgtagaggatgaattattgtacagagtagagactggaagcaaggtgatgttttttggaggtggaggtattattacaatccagcaaacctgagaggcrcctgaatgaaagctctgacagtgacagatggaaagagagtgaagcacccaaagggggtgtaattgacaaaacctgatgactgttgtgaaaaggagatggaggacaatttttttwwatttgttttttgctgactttctagatttaagattttttaacttagatgactgaagagatgtcaattctatgactgagatagtaagttaataggatttataggtttgggggaacatgaaagaaatacctgcttatttattgggttggttttttgttttgtttttagtcatgtccgactcttgcaac

SEQ ID NO: 21210 - DNA, 598 bp, Bovine  MMBT15415
  misc_feature (1)..(85): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnaccccgcctcccctgccagagcagagggagtggaaagcagctgaaaaagaagctttagagaagatccagggggctttgctgatggttcagattctctaatctgcctgccaatgtaggagacacggggttcaatccctgatccaggaagatcccacatgctgtggaacaacttagcccatccaccacaactatcgagcctgggagatgcaactacsgaagcccaccccccttaagcccgcgctccacaagagragtccccacagcgagaagcctgcccaccgcagctagagagtgccccactcaccgcaacagagaaaagccccgcacagcagcaaagagccagcacggccacaaataaatacatttttttttttttaaagaagtaaaagtaaaaagaagtgctggaatttcaggatagtaattaacaaagaaaaaaaaataagatccagagttgcatatgtaatatgagaatgtccaagtttcaaacgaaaaccactcactttgccaaggacc

SEQ ID NO: 21211 - DNA, 600 bp, Bovine  MMBT10914
agttccattgggagaggaatctctaatggtgagatttaatatattgtggcacctaaaaggggggatgtgtagaaatactggggtgtcttctctgtgccttaaatctcaacattccctacactacattagtctatgataattataactttttagggtgtctaactaatggagattttgttgttgtagttcagagttcagaggtaataatccttttacacagtttatatgcattatttccataatgaagtagttttaagaataaaatttwaaaaaaaatcaaaatcaggtcaagaaaacacrgaaaggttgacatagctgctacagttaagtatcacgtttgtctctgtgcttcctagcagccaaggggaaaaatattaaatgatttttattgtatactgaacacatattgtgtgccaggaactttgatagctgtattgactttatatctatcttcactacagccatggaaggtaggtgttataatcctcatcttgcggggaaagttcctgaagttggaacattatcttgccaagtgtcacaaaactaaatccttaagtggagcaaagattcaaatccaaggactctctgacttcatagtct

SEQ ID NO: 21212 - DNA, 600 bp, Bovine  MMBT18792
tcctaacacaaggcacattaatgagcagggcaaataggtagggtggagaggaaaagcacgaaagctgtgaatctagagcagggagttaattccagataaataaccaggacagttcttgctttcttttaggaacgacccaggcccatacttcccctggagagaacacattggaagagcagctgtggccagaggtaagggctttgtcttcatgggagaggtagtgacttcccttctgaagggtgagtcctagtcttgatacaagttgacaggcccttccctgaggccttgggggtatagackaagtgagctgcttcccctgggacaggcaggttacctggcagagtggaggcagcataactgtagctcctggaatttggggctcaaaatctcttcagactgagcaggtagttcccagaagtgcccagaaagacttataaacagcctggttatctctgtgaaccttgaagcagatgctgtgagttatccgaagtcatttgggtgaggttttcccagaacatctacaagataagagttgagagtaaatgctttatctcttactgaaatcagtaattcatgagaaattaacttgtgtctcctggt

SEQ ID NO: 21213 - DNA, 598 bp, Bovine  MMBT17386
  misc_feature (1)..(147): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccacattgctccactttctagcatttatgcatgcttttcctatttctatattttactgatggaaatttggaaacaggttagcattgtgtacaaatgtagccatcttatccagaagtgtattgcatcaagtacaaaagctaaacatttttmttgcctctagaacatgattatgggctcgttctctgaactgagacattctttctttcatccaggctaagagctcataccttaagtagtctaaagtatgtgcatttaccaaattatcaggcccaggagaagctagaaggtagaggaggttgggtccttcaaaatgcccccaggttgagcttttctgttcaccccacayggacccattcaaagaccactgtttgcaaggctctttttagggtcatggttttcatggcaaagcctgtgggtccctggggagtaagaaggagggtgagtgtga

SEQ ID NO: 21214 - DNA, 600 bp, Bovine  MMBT00195
caagtctcgcttagatgaggccatgacttctaccacaccctcttggtctggacctctgtttccccacacaccccagaaggacctcagaagatggccctcaagtccaggaaagcacatctgaaacggactgcccacagccaatacccagcagactgcaccctggcccagcctccagcctacatatgacccataaattctcccagctgaacaaacacattttatggggcctggggacgcttcctggcctcactgttcccaccttcccgtgtcctgctctggcctggccagctccccaacacygcacctctctgggacccccaagccccatccttaagtctccctccacctcctacccgtctcccccagctcccgccacaaggagggtggaaagtttcttctcttatcagccgttttactgccccctcctccctggttacacagtaattgggaacagaactcctggcaagaacgggttgatcctatcagtttgcagtcaacagtttactagacagagggaaagggtcccctcagtgaggacccaggaggcaggtaagaggtgtgcaaacaagagggggacagaaaggacccccaaaggaaggg

SEQ ID NO: 21215 - DNA, 600 bp, Bovine  MMBT19140
cagtcaagttttatatcaattgtcatggtgaattattaaatcactacctttcatcctcaaagtctcctgatttgatgacaaattgtgtggtcatcttactcaacatatgctactgacatccatttggtcaggacactatgttccttctaatcagtcacagtcctcaaatggcagtatgattctttactatctgagccaccagtgaagccccaaagccagctgagtgaaaagaaggatgggagagctcctaaaaatgagtttactttgtgcaagccataaaattaaagacttatacttgaygaactacttaaaaaaaatctcacttgagagagtgtcttctttaggctagaagaaccaacatcacgtgtactttgattatctagttcagaatctgctcctgaaaagctaaacagattaatatttcattaaagcatttatcaatattctgaatacagaataaaacagaaaacaragttaactgaattaaccaatgtttaaaatttaataaatttcaaactagatgaatacrtaacttacatatgtgactcttctttcatcagctgcaaagagagagaagggaagaaaaagcttttaaagtgt

SEQ ID NO: 21216 - DNA, 600 bp, Bovine  MMBT01197
gtttgtacttctctaataattagtgatgtgcagcatcttttaatgtgcctaatggccatctgtgttatttctttggagaaatgtctatgtaggtctcctgtccattttttgattgagttgttttgtttctcgttattgagttgtatgagctgtttaacaactgactcttgtgaaacatcacaagtcagctttataatcacagcttgagtttccagtaagcaagatgacctggagccaaatatagggaaaagatgtgcctcttgctttctgcattcatctttttgtggatctctcaatatrmctagaagaagctgccatcaacccttcagctgaggctttttaagatctcatgtaggaacccaccatactaaaccacacgcctagtcatccaggattctgatgacaggttttgaaagcagagaccagtgtggttcccacatatcaaagtatgcaacctttgtaaaacatcatggaataaacatataaattatttacactacagacatatctctttggattatcaagatttcacacatctgtttctcaaccactcctcagttgctgttgttggatgtgttcttaggttctgaatatagcttt

SEQ ID NO: 21217 - DNA, 600 bp, Bovine  MMBT18908
tgctttttgtattctgtctttagatttgtagcatctttttctttttgctgtaaaccaatcagtagatatttaagggaatacatgttagataaaatatctcctttgaaattcatacttgagcaaatagaatgctgccttatttaataggttccttgaatcttgacagcagagaaaagcagaacttgattatgacttgtagggactggtttagtttcaacacaataaataatcacatagcagaaagtggtgaaaactttatctcatgtgaacatagtatcgggaactacatttccaggcaayagctcccagtaatgccttgtattaaatccattcttgttttctttcaggtccattctttccaaggatggggttttatatgttaagctcagagcaggtcagctctcctacaaagaagatccaatggggtggcaaagtttattggcccagactgtagctaacaggaactctgaagctcgagctttcaaggtaatgtgattggtaaaaactgaaggatattctcatcagaaggaaaaagaaaattgtaactaagtgtgatgctggatgttagctagacttgtggttgtcatttgtcagtatata

SEQ ID NO: 21218 - DNA, 600 bp, Bovine  MMBT05966
agtggttaagactccgagcttccactgcagggggtgcagtttgatccctggtcagaactaaggttctgtatgccatgtgacacagccaaaaaaaagtttaaaaaaaaggaaaaggaatttgaagtccataaatacatcawaacatggcttgggatttgagtgtctagctcataatagttgctcagaaatagttgttgaatgtcaaatatattcattatcctatggctcttgagcctaacaagcgcatctgataaaggatgaggaagtcatcataaaattactaccctttccattagacgstggcatagataaatctgatactgacagagaagttcatcracagtgacagagagggaaacagtcctcagaatagaatgcttcatggctgcaaaatcacttcaagttgtagccacctaagatctgaaatgaacagtgaataatcatcccttggctgaaagactgacaatacaagctaacatctcctggctgtaaattagaaatgtagattagttcatggaaagttacacatattatgatttctaaaacttctctggaataataaacatcactccctttggggcttatgttactctgatttta

SEQ ID NO: 21219 - DNA, 600 bp, Bovine  MMBT08433
cagactttttttaaatggaaaatacatatgtaaattttttaacattacattcagttctaatcactttctctccctactgtggcttccttgaatcagaaatgctttcagattaaattrattttacatgtttccataaataacwgtaataatcatcaytcaccattcaagcataccaaagtatatttcaatattcatatcaattcaccaaattgaaagaaatatcaatttaactcwaaatcataaggagaaatgtggcagttttcaaaagaagttactcaaaatatttagattatttaggamaaaaaggccttcatsagttagaattatttgcataattaatttctatttccatttcaccttaattccatttctcctaatatagatgtgccttgagtgaatatagactaggcaactttctgttaattgtattaatatctttcatttaaaaataatatattgtgatttttttcctatgattaaaatgtaaatttattaaatcttaccttttaaacttttacacatatttatgaaaagtaaattactctgaagataattttggagagtattttctttactttggggataagacagtgtatattt

SEQ ID NO: 21220 - DNA, 598 bp, Bovine  MMBT21312
  misc_feature (1)..(59): n is any nucleotide
nnnnnnnnnnnnnnnnnnnnnnnnnnnnnnnnnnnnnnnnnnnnnnnnnnnnnnnnnnntaatattagtaaattacctgcaatttacttgaacacataaccaacgatttgaaataagttgataattaatattttaagttgtactttgataaataccctcccaatgttttgatcttttctgacaattcctaatgctcttcagctgttgtaagtatagaatatatgatgcaattacactgagtttatgtttcttgagttaataaattggtctcaattgctaatggattctttatactgattraatttgcatgttgaattggtttaaattgcctgaccatatttcaaggttaaatacaaawgtatgtggagctattaattttgtgttgctgttgttggtttgaatgatttaggtacttgaagctagagcaggaattaaattaatttgtgccttcaccttagcccagcctttctctttgtataatgtatctgtgacatttgtcttcattccgagagaaratgaggaaaactcatcagaacaaatgaccagttctcattaaactgatgattttgagggggatttcctttgattccatgtaatg

SEQ ID NO: 21221 - DNA, 600 bp, Bovine  MMBT21641
gtttaagattttttttttttaattcattttctcaccccaacccctcacctcaagccaacatcatacctctgtgaggtagctagttgctggcatgggagtggtctatttccaactcagtcaaatagaagctgaactcacaaacatggcaccattttcacagagtctaacatgatttgaccccaaagatgatgagggctggtatcagtgccttacagatttattttggaaaatagtttccttgactactgattcaataagattttctattttargatttatttttaattgraggataattgsttaacaatattgtattggtttctgctgtataacaatgtaaatcagctataagtttacataaatcccctccctcttgrgcttcccttccactgcaaaaggattttcagttaaagagcaatttagtaaatcagaaatatcatgtaaatataaaayggtaaacttaaacctgcttaaaaaaaaatgaatggatgtttaaacatctaggaagttaaggtacttttaagttttctcataagtatactatcttctaataggaaagtttacacaaactcacttatacatacgtgcatgactactaat

SEQ ID NO: 21222 - DNA, 600 bp, Bovine  MMBT18797
catctcctctcttgctcatttatccagcaagaaccacttcagtgtatcctcccaacacacacacacacacacacacacacacacacacacacactgtggttcttgggtatgctaggtatggaaggaccgaaatttctaaccctttcaagttgggtgacacaccccacccctcctccaggaagcctcccctgctgcagcctggtcctctctgcacatctcagcggtgctcaggcgccctagttaggtggcgtatgatcatgtacattcctgtcactattgcagacccctgtttcatctgaygtcacaagcaagtcttctagcttcttgagcacaaaaaggaagctgtaaagtcaggaagcttctgtgttagctgctgggttcacctctggcatgatccacttcagcaaactctcccttgagtatatctggttggcaggacttaaaatcacaaggatgtgacttgaaggatgtgaacctggttgccagggagtctgggaattgtagttcttctctttccaacctgtgcactctctgtctaactcaaggcagacaaacacttggtcaatcctcagtgtctatataatcacagaaagaagacag

SEQ ID NO: 21223 - DNA, 600 bp, Bovine  MMBT10732
tcccagaggtatagtttgataaagacctgtgaccttcacatgtgaagaatcaaaaacaaagggtgagtgggctatgctctgatcttggtgacacgatagaggttgaactctccattagccaaaccacggattaacaacccctgctgcaagttagcgttagcaaacctcatctggcttctagaagggaatctccttttgctatggactgggtcctgggaactaagtcagctctgcaggaatataaaacatagaggcaactcccttgtctctgtatttgaaatatttgtagagatggagcayttaaaatatgaatataaggagcaagatgttgtggaatacataaataggtctggtggcacagctgaaaaaatagtggctggatcttgtggtcacgctgatgaagcttgttgcttaaaggatcctagtgccaaaggctcggtaaagtcagtaaggtaagacactagtctgtttcacagggtggtcttgtgaaatatcaccccatccctggcaggagttacccatcaacaggtgcctttctttcattttctactggactgttgaaccaaggcttggttcacaaatctgtggattctctttgat

SEQ ID NO: 21224 - DNA, 600 bp, Bovine  MMBT11112
tccatggatacaagagtcagacatgacttagcaactaaatcaccatcatttccacatatgtacaatgagaatctaagaagagacaaaaaagtgaaaggggcataaaggaataatgactagaaacttcccagttttgatgaaaaaaattaatctgcagttctaagaagttcaataaaagcaagtaggacaaagttaaagagatccacacctcgacagaccatagtcacactgcccaaagacaagacagaaagagaaccttaaaaataataagagataggtgactcatcaggttccagtgaycctcaagaagattagcagcttatcaaaaagctagtatctagaatgcaattgaagagataataaaaatgctgaaagaagactaagattatcaacaaaaatttttatattcagcaaaactatcctttgaaaaacaaaggataaattaagacatcatcagaattcatcattgggagacctgtccagcaataaagagtaaagggtgatctttgggatgaaactaaagcacgctagactgtaactcaaatccacatgaagaaataaagagcaccagcaaaggtaactatatttataaaaataaaa

SEQ ID NO: 21225 - DNA, 600 bp, Bovine  MMBT19521
gtcagtgaggtggggaaggcatctcccacactcaactctcctggcaatactcagctgtcagggggcagagagcccacagcaccagccctgtgttctgcagcaggcaaggatttaatacctgcarcatttacaatgccagccaatcagcacatccacccagttgtcccaggcaaccagccccatgccagcccccagtcagggcctgaagataccctggtgaaatcacagagaactgcagatggagggcaacctgagaagtcaagttgtccggtggtggtcatctgtggcaaagatcaaatrccctgtgattttccttctcaagaaayaatgcagggaatrgtgcaaactgaagatacagcagccaggtcgttcagtcctacttccgctactgtaggtggacccgaagcagaaaggcagcaagctgtttgcacttcccagacaaggtcctgtggctctccaacaggagaagatggatgttcggggaacaaaccaccctctgccgccacctcagacacccaggccatgacttcggtgattcctcaaccatcccacctccctagcaacggatccatgtttcctccagatccagagaaggtgccg

SEQ ID NO: 21226 - DNA, 600 bp, Bovine  MMBT05268
attcattttccatcaggcataaggtttctcaagagacgtccccctgactctttcctcccatggcttctaaaacaccatgggcccacagcggcccttccccagctccactcccaactgcgtggctctctaaggacccaccagtgttgtgctcctcagcttctgtccccatgtgagtctgagaaatacagttcctagacaagcatcctgggaacctgtgatacgaacctaagctacctcaaaacactctggacattagaacatcactgttcagccctactgaaggtgaaaagggggttggaragggattcactccttagcttttatgtccgtgcrtaattcttattttctttcccacatttatcctagggagaaaatccattacattcggactgagggtaatcatgggcttgaaaagttgtcctgtgatgcagatctagtcattttgctgaggtaaggggctgagcctgaaacagttctggaaaagcaactggagaaactgctctgggtggttctccacgacagcctggactaaaacacccactgtttgttctagaggagtctagtggctgtgactgaagtggggcacccgccttacacctg

SEQ ID NO: 21227 - DNA, 598 bp, Bovine  MMBT10603
  misc_feature (1)..(137): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgggcattcagttttggtctgtagtaaaaggtcctacagagtgcctcattcgcaaagcaggaaagcgacaggaagactcatcatcccagagatcatgtaacaatgtacctgcagggctcaatgaacctggcttaataaatgttcactgcttcagtagttyctattaccaaagttgctgtgaagattaaatgatactgtttctattccctttggggcagtggctctgcaggtggccaggactctgcactaagagccaggtctgacagggcttctatcctgatgcgtccactgaccagctgtgtaactgtgcacaaagattcacatctttgagacttagattctcctttgataaactgtggtaataactggggttgcatgaggaataaatattcagtgtctgcacacagcactagctcaactagtctgtcctctcctctcttccctctaccactatttca

SEQ ID NO: 21228 - DNA, 600 bp, Bovine  MMBT14307
gataaacaaccttgcaatattgttagaaaatttctataaaactcaaggcacagagtaggaactcaatagatggtgattattgtcatgattatccctgtgagtagctgtaaggaatgaaaacggctgaggtctaaaattaaaaaattaaagatgagcctaaaggagttgaatctagggaactaaagaaaaaaaaaaaaagggtcaacattggggtcaaaatcaagattcagacccgctggtgagaaacaggagacctgtcagaaacagaagcacagaacagagagaagataagaggccccrccttcagaagatacaaacttgagatcaagtcatgcctcagcccttgcattcttgtacttttccttctggggcagaagtctacccatcagctcagttcccctgtgatctgaggctggcccaatggccagagggagcaggtgtctggaacatagatggaagattctggtgttctttctgggatgttgaagttattgacctattcacactgagcccctactacctaccagtgactctgggtgtagcctgtatgctctatttaccttctctacttcttctctcatccctaagaaatggattggg

SEQ ID NO: 21229 - DNA, 598 bp, Bovine  MMBT20175
  misc_feature (1)..(132): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagaatactgaggctcagaaattcaaaataatttgccccgggttatccaacgccttggtggtgggaccagcatttactctccttcttattagaataatgcaacagtactgccccaaagcccacattcttcagattgcaccaagggctgcctctgtcctctccaaaygccctttggaaaatggcccataagtttccccaaaacaacagttgaagacaaactccagagactcagggttttctggaagggctgtctctcaaaaagcttctgccctgaactggaatcttatttgcatttgtccttccatggtagtttccaattcccaagcagaacacacatttaactgtaaaattcgccttaactaggcagctgtctgctgcagtcaggcacaaggctcaggtgcagctcccagtagggtctcctgaatcagcgtgccagcctccgtaaagcaatgtaagtcacctcc

SEQ ID NO: 21230 - DNA, 598 bp, Bovine  MMBT11372
  misc_feature (1)..(120): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctgcattgcaggcagattttttaccagctgagctaccggcgaagccccacatcctcctcgcagcccttgaatttccacgaaggcatgagtatgtatgtcctgttgtgttaccatacctaacagtatcataataattgcttgtttaaagaattaaaaagtagatgactgagtaagcwwwagctttgaaccatgattgaaaattctatataatttcattagacttttcagttaccatgcaagcagccatagtccttactacaatcataagtaggatatataattcccaaagtactcataaaaagggaagccatgtagatctgaatgggaagatggtataattcttctattacacctagtcccataataaaaaaacaaaacaagcaaaaggtcaatggtggggatggattatatcatcaggaacagtagacgttgcttgaaattcaatgtgaatgggctaataagaaattagctaat

SEQ ID NO: 21231 - DNA, 600 bp, Bovine  MMBT19040
tctcttaggtgcttagcccaatgttttatttcctctccattcccactaaaactccttagctcaggactccattacttctcattctcctgatgacctttgctgaggaaacactagagtgatctttccaaaatgcgaatctaagcatgtcacttcaccacttaaaattctacagtggcttgcattcccctgccaaaccacttagcatggcacaaacgccatttgtgatttgatgcctacttaactttccatcactagatctattactgcccactgtgtaccatgtttagaaatattgaactkcagtcaactttcaatttcccaaggatagattaactacattatgagggaaaatgggtgaaaatgggccaaagacagcttacttgtaaagaaaaagaactaaaagtgtagtggattagagaaatatctacatatcagaatgagtctattatttataattatataggaaccattccatttttacattgtacctattgcaaataaggaacgccccttccacctgggcagtcaaaactggctatgtgcatatgcaatctgttagctgcttttgggtgcaggaacagttttctgcagtttgcctga

SEQ ID NO: 21232 - DNA, 600 bp, Bovine  MMBT16633
ggggggttggcttgtattttaatgtggctcaatctcagtgtctcaggtttgacagtgttttggttttttgttttttctctcctttccactgaagtcattgaaatatattcaccctttcattcacatcagaggtgtaaatggattttctaaaggtttttcagagacaaagtcagtcgctttgtgacttgacttcttcaggtgttgcaaaaagaaagcttagcacaccactaagcacaccatctcaattgcaaggatgctaaaactatgtttgaccttgactctgcaaagagatgggcacartcttttgctagaagtggcccattcaccacctctttgctttatccatctgtataggatttacttgggaaagagaaaagagaaggaatcagatatattcgagagaaaagagcatgtttatttgattttccagcttctaatgatggttacattcacagtttaaactttttagtttacccttttcaccattgatatttgcaaaatccaaacttaaaaatatatatatcagccatgtcacacaaaggcttatatctcgatttgtttcatgtcattaaaaagacatactgagtttgaagctccttt

SEQ ID NO: 21233 - DNA, 600 bp, Bovine  MMBT21383
  misc_feature (1)..(2): n is any nucleotide
nnatgtggagatgacttatgtcaagacttgatttcaaaggctggtttgtattcaaagaaaacgttcatagcaagaattcagaattcttgctttagttataaaacaaattacactagttgttgagaaaatggtagatcatttcaaggaacctcatctgtagaattagataaattatttaaggttgcttcctaattaggcctaataacatcaataattaacaattccccaaactcacagcamaagtgctttattcttttcaaagggttttttttttttttttccttattagatactcacatcarttctctgaggtaactgagaaaatgttaccctcatttattgggtgagaaaactgaatattggagatgtctgcagatagtttatcatatgagtacagtcatcacagrttacaatggaattggtgttgtattgtaggctcagtgcctatttcatagtctgtgaaacatcrtaacattttattatagtcaccctgcttctttctgagtccatacagcctataataacttgtgaaatcaagcttacaaatgtaccatgattaaatttaaacaacaacaaaaaaagaaataagaaaacagcaaa

SEQ ID NO: 21234 - DNA, 600 bp, Bovine  MMBT21245
acatagcttgtgttctcaaatcttgtttttatatcagctgttttgacaacagactatatttccctttagaagcaaktctatatcagtttgatgtaaggaattgttaggtgatacagactaacttggcccagtgcattcattcattaaaccacgatatgctgtgaatctatgttctagggacgactatggcactagagatgaaacacggctatagtttggtccctcctatctgagggcctctgctttgggtcttctatctgtatcccctttactaagcatgcgcttggccaataatgctcrgaaatcaggtaattgaatattgcaagagtgttgaatgctcaaggaaaacaatgctatctctgtgtagcaagccggcttgcctgttaatagagagactacgctgagcaaaatccaatgaggtttaaaaatgcagtgtgtcctgggtatgtggcaggaaaaatagctagaaaagtgacttggggtcggataaggaagccataaatcaagcagagatgagattgttcttattaatgttttatttggtcatttattatttcaatggtgaattgaaatctttcatcatattgacccatctagaac

SEQ ID NO: 21235 - DNA, 600 bp, Bovine  MMBT01156
acaatgggtaagacagaactcaggggaatggctcttctggagaaacttttattcacagaagtcctgaatatggtgagactgacttgcctctgccctgctgcaggtgacctggaggaagcttcattgtgaatattctggaaaattagtgccaaagccacttgagtgactgttcattcattctgactccccttagatccatgaatcagcattgcgagccaagagcagaaggcaggtggagaagaggaggctggcggctcagaggcagcgggctcactctgctgatgtggagaaaaataggcrggtcaagcctgcctcctcagagaacccatggatgacagagtatatgagatgctactctgccagagcttgagggaaggaacagttgcttggacaacctctttttaaaagtgtaaatgaaagaaaagaayaagacaaaaactatcaaaagcaattggacacaggtttaagaaaccaactgattatgcaagatttttcttggggaatttccaaaagattgtctcttttgatgaatcctggtcacctacctcagcagtagggtgacaactgaagccatagaaatttggttatttatgaggagaa

SEQ ID NO: 21236 - DNA, 600 bp, Bovine  MMBT17404
cactcacagtttaattagcttagagtttattttgtaaggcagcratggagagaactgttgctcaatttgtctgtatccaggtggcaccgaaaggctttttgtttgtttttaattttcttttaatgtggtgatgattgaaaagaaatgtcagtgatgtttttaatttcataatttacatctgcccatagacagaaattatctgggtggttttttcatctattcctattacactccggggcccacccactttccttacacagacattattggatagaccaaatttcttaactctttaatggwaactgtgaaaacaaagccttcttaaggttaaaatggattagagatactagtttatgggcagttgcaaactccggttttgtaaaaaagcagtgttgatggatgggataatcttgcacacgcatctgctccagatcagaccagcctccatgggtgccaggtgtgtgtcccgagtgagcgggttaacaccctccggggcatctcaggccacttgggatcagatgaggccattcggtactgagtagcagagctgggatatttagccagacagatgtagctcataattcaaaaaagttttccata

SEQ ID NO: 21237 - DNA, 600 bp, Bovine  MMBT17685
tgtgtgcctgtctttctgtctctatggcatcagaggcaaggaagtttgtagttgtgtgcccacctgaacggagactggtcttcctttcacaccctggtggctgtgcgtgttaaggatttattcgtcacattacttatgtgcagcatttaggcgggagggttagggttttctgccccattgaagagagaagttgcaaaaggatggtagcaatccccttcttcattcatattcttcgtgctccgggggaaaatagtacaaagcttcagaatcttccatagacattgatcactcatcaccgtyatctaaaggatgttgagaaaggccgacgggatggaggacattaagctctgtcctgggaaacacattttatgtttctctccttggctgaactggtgtatgtttgggggcatattccttaacctcatarttttcacttcctctgtaagaaactgaatttctaccaagtttagcagttttcaccagttagcaaatgctgtcacacagagcagagttctatcaattagaggctaagaatccacagaatggggagcagcccacagacctactggtgcctaaagattgataatgttaactcctatt

SEQ ID NO: 21238 - DNA, 600 bp, Bovine  MMBT09740
gacaagtgtaaaaacaaacaaatacataattcaaacaataaatgcaaggatttgggctcaagccctacgtctgctgcttaactgcagggagtgaccatgggtcactggttcaaacgctgccctcacctttgccttggctgtgtggccctgggtggtttgagtgagtctctatttctttctgttgttatgagtggagatagcctgtgctcagcactaggacaagtggcgccgggattccagcgccagagtgcttgggctcaaagcccagcctggtcactcggtatccacgcgaacttggcmaagttacttaacctttcaatgcctcagtttttccatctgtggcatggagatgctgtaatgatacctaccgcatcaygctgttgtgaggattaaatgagataatgcctggggacattyagaactgtgcccagcacttaataagagcacagtaagcctcggttgctgtaacttctgaggcttgcttggggattaatggagactgtgaaagtactttgtaaatttccaagctctggacccgcacgcagtatcgattgttctccttctgccttggacctgggccatttgtgtctggcctcgttc

SEQ ID NO: 21239 - DNA, 598 bp, Bovine  MMBT10986
  misc_feature (1)..(102): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttggagcagtctctcagtagtctatctagggtgctctatccgggctatagtcctcattttgcccccaaataaaacctgactcataactcacgttgtcctttgttgttttttttaaagctgacagcactgtgctagttctcaggagcttgcttgcacctccatataccaggaacctacactggcatatttggacacsccccaccattgtaaccttaaacaaacacatccagctaatgcaccccaaaactgcaaaacagaaccaaggctaggtctggaacaatgataactgcaatcgtttgcacttgctctgaccttccagactgccttccagccatctcatgggtaaggtgacctgggtttcttacgagtcattgtaagaattatctgcaacgatcattctgaatcacaagatacttccatctggttctgaccggcgactgagatagggggaaagtgtagcgcctccattgattaatacgatcacctctgctctt

SEQ ID NO: 21240 - DNA, 601 bp, Bovine  MMBT22420
  misc_feature (1)..(1): n is any nucleotide
naacactagcaggatctgttccttttctcaggaaagcaaacattttcccagaagcctgcctagcaaacctctgcttatgtgttactgtccagaactgtatggcatgtggcctccctgaaggcaagaaaggctttttttttttttaagtgtcttttctatcccagttaataacgatagagataaaggataaaaggattgggagggtgtgttaggttagccagccattgactgttcccaacctgttttaattatgtacatcatcctggcaccagaggtggtgctcagaagacatcatttgatyggccaagccctctgctcatttttgcagttgggagactgaaattaagccccactgaatcacttgatctgagagtgagaaagggagttgggtcctttaaggtcaggaaataacggacagacaagaacactggtattttctatgtattgkctcttttctacagctcattacatgagtttgagtaggctctgggagttggtgatggacagggaaggctggcatgctgcagtccatggggtcgcaaagagtcagatgtgactgaacgacaactcaagatcttggatgaagggaatcttagctgcc

SEQ ID NO: 21241 - DNA, 598 bp, Bovine  MMBT19088
  misc_feature (1)..(114): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacccccaaccccacaaatcgcttagagctattggatggagctcgacgcggctgtkatttggggagtgatttagcaccagacttccccaactcggtccgcctgggctcttttatttattatttacgagctcctaatccctccagggcgtgggcagctcccctcatggcgcctacagaccccaaggkacttcatcttcgattcccaggcaagagtgaggggctttccttaaaccatccatccaacacccgtatcaccaacgcaaaatcaactcagctccaagtaatggctggagcgggttactgacacaattgcccaaggctttgtgtgtcagatgggctatgtgtgtgcctatgggagtgtgcttaagtgtacagtgtatgtgactgagtgtacaaaagaatatgtgtgaatgtgcatatgagcctatgtgatcgttaatatctgtgtaatttgtcagtgtgaatgtgtaagttttgtgagggg

SEQ ID NO: 21242 - DNA, 600 bp, Bovine  MMBT01879
gtttaactacttatcatcccagtcctttcatgagggctggatgagtcttctaatgttctgataactggattttccaaaagatcttgaagaatcaaataaagttatttgtattttcattttcctgtacaagagaattctgggatagtcaagtcatgttattgtacacagttggctgaaagaatccagatgatttctggtctcacttgcagagatccgaagaaatcagtttccagacgttagaatttgaaagtgtgtctgagagttactacgtttattccctctgaaacttttattccctcygaaacttttggataagctcaggaaagggcttaaatttaacctggtacaaagcaaaacaaaacaaacataatatcaagagggaaggaaaagaaaccactaagctatgaaaactcttcaaaggcttgcatcatttgttcacagagcactcaaggctatatggcattattcgttcctgactctgcagacaaggaaaatataacaagatgtgttctgaggaagcagcttgttccaaggtaagactgagtttaataaccaacattgttcatggcccaaatgtcaaaagctttgtgttcctcttca

SEQ ID NO: 21243 - DNA, 600 bp, Bovine  MMBT06628
tttttttcatctccttcatttcaaactatggagattcccgccccccccgcaaaaagcactaactcaaatttcccctctctgattataacccttaatcacctcaacttgttaccctcgattccctagacttcttaaatctcaaaagacttcagtgtatggagtcctcttgttttctttccatcagccttgtcttttcattactcttctttttaataaattggtttattgtatcaataatatatttgctgttagtttatagtatagtagatttagcttgatgtattaaaagtaaaaacaacmccatagatgtctatttctaactagtaaaaaaaaaaaaaaaaaagacagctgtgagttacttaaaaaaagaaamctgtcaacatggaatttgttgaataagtacagaactaatatatatatagtcacatttcctaaagccccacacacctcctcacatagaatgtataaactccagctttgagaataagagcaaagcagaaattaaatctatctccctaatttattgcagtgtaacaaactctatcccagcaatactcagggctgtaacaccttcatacttacaactccagtcccaagaaa

SEQ ID NO: 21244 - DNA, 601 bp, Bovine  MMBT21179
  misc_feature (1)..(1): n is any nucleotide
ncaatggcaataatattcttaacgttgtttcacatgttttctgctactgcagaatctctagcagaatcacatgatgagagagaattaccatgaaggtggctgcatgaattaataaagttataagcragcagcagcatcacacagtyaggctgctgatgtacaaagcagcaaatgtacaaaggctggtaatgactttttacccttgacacccactcagtcaggttaataagcacatgtgactgaaataccacacaagagtcacaagtcagcrtgaataaaaccacactccttctcctgtcaytgggatattatattctaatagcattttcttttcaataaaacccttacacactttaaacaggatagaattatagagctggaagggtcttcaaagataagctactccaatggttcacaaatatcactgcatgcaagaattttctctagaacttttgaaaaatacagagactggggcaccggctcagacctctaaatgagattctttgggggggtgaggcccagtattacttcaaagttccccagatcaggaccaacattcaggaaacagggatcttctccagacttttaatttttaaggggc

SEQ ID NO: 21245 - DNA, 600 bp, Bovine  MMBT19483
actgaccataaaatgtttgaaatgtttctcttagtgaaaatacgacagttctgtgagtcataaacccaagaactgtaggtcaaatacatcaaatagtatctattgacatgttttatttgtctctcatggtgttttaaaagaactgcgtctatttccaaaatgtcagtttatggagatttcaaaagaaaatctgaatttctaaactgccttaaagagttggaaggtttggaaacactggcmgcatattcctatggccactgtcatttgggtgttttcagaagttctgctcattaggtgggmcctgtacatgtcagtttcttgttgtctccacaatgctgttttcttagacacttcttttgtttatatagactttgtcagttcagttcagtcactcagtcgtgtcckactctttgcgaccccgtgaatcacagcacgccaggcctccttgtccatcaccatctcctgaagtttactcagactcacrtccatcgagtcagtgatgccatccagccatctcatcctctgtcgtccccttctcctcctgcccccaatccctcccagcatcagagtcttttccaatgggtcaactctttgcatgag

SEQ ID NO: 21246 - DNA, 439 bp, Bovine  MMBT20952
gctctttgatgtatattgatcacttttatgaaacacgtgtttgcagttaattgttatagcaatgtattaacttatttggaagttgataacttttcttgggaagaaaaaaggataaatttagatgtaagattagtttaaattgttaatccataatttatccttgagtgtattattttacaattctatgatactttacaaactggaaaaagaaaaaccccaaagctttattatatagataccatctttaagttgtttcattttctgtactttctacattttaccaattttaattgtagccyyattatgatgtgttatggtaaaaccgggcagaatgtaattttgtctgatatttaaaaatgaaaagtatgtaggattttaagcttctaaatatttcaaggacaacattacacatataggagttcatttattcctttttagt

SEQ ID NO: 21247 - DNA, 598 bp, Bovine  MMBT19769
  misc_feature (1)..(66): n is any nucleotide
nnnnnnnnnnnnnnnnnnnnnnnnnnnnnnnnnnnnnnnnnnnnnnnnnnnnnnnnnnnnnnnnnnaattggactacatttgatcaaccctcatataacaaacagtatattcattgtatgaatgctgaaaagagaagacagctaaggttttcatgtctaatttctgctgatctacatcatgtagagtcggactgagacacacaggcctacgtagaagcttacattttwaaaaaatgcatctggggcacatttrctgtcatccttctgtctaaataaaataatgccttttttattatgaakaaggcagaacatagttttaaggaacaacttttggtaatctgcaatagcataaaatgctctcatctttcagagtggtacttatataatgagattacatctatttatttttgtatatatgaaagattcatagagcttttggcttttttcacataccttgctttggtgtataaatggcatcctgaagtacagtgatgaatttaaaaaaaatttttttttcaaaaatggcattatgtttatagtatatgcaccagagagagcaaactacttatttttgaaaaactaatattaaaaactcttg

SEQ ID NO: 21248 - DNA, 600 bp, Bovine  MMBT11808
atcaggaggaagcgaggttcccttgatgtctgatagtcattattttgagagtgtttgtttaagggctcctgttgagaatgaggtgaaacaaaaggtggattctttggagagttataaaagcaatgaagaagatctggggaaaggattatctcagtgttttgaagtaaaggagaatagaaatactttagtgttttcagaggtgcatcccagatcttcagaaatacaatatattgagaatgttgtagttcctgataattctgtagaagtttcagaagcacatatactctcccgggggcttgrtacctctacgatggagatttctggtggtcctcttcagactattaaattcaactcaaatgagacatcagaacaactgtattttcaagaagaaagaaaccaagaggcaacttctgtttttgatggggaaaatgttggtgctatgaaaaatgtagcttttcgggcagttattgcctctattgaaccttccaagaaggagagtacagtaaatgaaatccaaactgacatcaacaaatctttaacaaatgacagccaagaaagtgaaccaaaaagtccagatccttccctgttaaattatgatga

SEQ ID NO: 21249 - DNA, 600 bp, Bovine  MMBT09337
gttccttaaatcctgttatttccatggatattcatgaaagatggcctcttcataatccattttcgacagagacatctaaatcagtttagtttccccctgcctccctatctccacttcccagtggagaaatagagttaaaaattctgcaagggtcttaaatcctaaagcctgtcatttttgcataaccttggcttatcaaaatctcttgttgaaacacaactttcttaaataggaaagagactaataacacaggtctcatagtgtagtgattataataaccttcaacatatgtaacatatrtaaagctcccagcagagaatcttacaacagcrttgargttaattccctctggtcaactcttatctcttctcatcttcctctctcttaggaatatttccactaaatgagacccaaatagcccattctgttctccagtcacaaatttagctgagtgtaaattcataatccattcataggaagcattatttaaaattaaaaaaaaaaaaaaaaactaagatggccattatgagaaagacagactcagaactggcttgggtatgagccctgacctggattttaatcaacacagccagtgttttc

SEQ ID NO: 21250 - DNA, 598 bp, Bovine  MMBT19070
  misc_feature (1)..(80): n is any nucleotide
nnnnnnnnnnnnnnnnnnnnnnnnnnnnnnnnnnnnnnnnnnnnnnnnnnnnnnnnnnnnnnnnnnnnnnnnnnnnnnnngatgttctttttgatttctcttgaatgcatcccaaagtactactgtttctcctttatagtctttttttttttcctttatagtctttagtttcctttctaggcttcgtttatttgatgacatgtcatccagtcaccttgtcttatataagcatgagtatcatttgaaaattagttgtgtttggagaattttttgacatcccctgtgattttatttttttartattacctggatattgtgaaaacaaaggctggaaatagctctgcttagatactaacttctgagcaataggatatgctgctctatgggcctctgctccttcgaactctttcttagatgttctgaaaatctcatatgtatttttttcatgctttatatttaaggtttttaagctttgattactgccatcttcagccagccaaaaacaactacatagaactttcagagcttattagttctggctaggttagcttgggttgagtaggaggttgaatagacgacttctgaagtccctttcaac

SEQ ID NO: 21251 - DNA, 598 bp, Bovine  MMBT21562
  misc_feature (1)..(153): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatttgcctgttgagaggtcaatgcaattgcacagtttcacaaaaaacaaatcattgacaaggggaagatacttggaatttaacagaggatgcttgcaagtagctcatgctgcctgtgtatagcagagacagttctctcatgatgyagaggttactataaagaagtaattattttgatttgaaaaatacatttgggagatgtcagtgcttatggtcccctagacagaaaccatggtcttagctcatcctctttgttgagggacaggggctgtgctctgaaagtgggtggacaggaagctttttcctaaggggtaaaaacagaaccagatttactttgcctacaccagtcttgtggtacatgattttgatgtcaataagcctcatatctcaatctcaaaaactctctatagtcctttcttcaatagtttaaaggagaaaaaaaat

SEQ ID NO: 21252 - DNA, 600 bp, Bovine  MMBT09437
acccaaggccctgctggataaaaaaatacatatctgtaataattctcgaaacaggccccaataacaaagtccacacgtccctttgagacgtgctggcgaatggactctaagaaatccattacccttccttttaggatcaacacccttgtgttaatcccttcctctgaaatgtgagtggggccacaacagcccacaggctacagtagaggtgtcacaatgtcacatctctgttgtcacattagatggcaacacccatcttgctagaagactctctcgctgttgtggggaaacaggcggccrtgggagggagccccaaatgacaagaaaccgaagccttctcgccaaaaccaggaaaacacggaggcccttagtccaacrggctgcaaggatgtgagttcatcaacagccacatgaatgtggaagcaagtcccccgctgggtgctgtggcctgaatgtttgcagccccccaaaattcacgcactgaagccctaaccccttgtgtgatggtgaggcctttgggaggtgactgggggtcgattaggtcacgagggtgggaccctcatggtagaatcaacgtcttaccaggcgctctatctgata

SEQ ID NO: 21253 - DNA, 553 bp, Bovine  MMBT18278
gcaaacaatgcatatgaaacccacaaagcamtactgtgtgtgtcttatagggaaatcataagagaaaatgaatcgaatgactcacaataggatatgtttggaaggagataaaccttttatatctatgagcataaagacgcataaagtattaaataattttaccttagtagtacttatttttgcatatgttaacatttaaactaccagaaacagctcctgaaattggttatgctaatgcctattgctactcattttaaaaggcaattccacttaaaaccaaacctcaggcctcaaaacaayagttaaggtcaaacgaagcataccaaagtcgatatacacaagatatgaaaagctccaaattatatttcaatgacttgtttaatttgtaaatcaacccaatcaacaaagcatatgtttaaaattctaaagacatttttggggtgggtatttctttaaaccaaatgtaacttcaatcccccaataataaatatctccccaaatgcaaagctgaatgtttcattagcctcctaaggggcatattagcatataaaag

SEQ ID NO: 21254 - DNA, 600 bp, Bovine  MMBT19871
tctggggtcaggcctgcgattctgcatttctaacaagctgtcagggaacactgatgctgctggtccagggaccacactttgaacagcgaaggatcaaaccagtatttacccaagtatgatatgtacatgtctgacggcacatacagagattttaggtgagtcataaacattctattttaagatctacacagattttcacttaccttcgtgatgtgaagcttcccttaaatgcatttcaggattaaaaagttaacttgaagaaaacagtaataaataacaagagaggaggcatgcataagyggtaaaaattaggcagggggcctgcaattactgaagtcttgaggaatgcttgtaggaagcatctgagggtgcttgaacttgtaggaagagaaagaaattccagtttagaatcaacagtggcaatgcaagagggagaagcattgcttgatggagcaaggtgactaacagcgaaggtgactgagcccatgagcccagcactgacctggagcatgccatatactctgcacaacagcccagtgaggtcactgtcagggttatccctggtgtccagatgaggacaccgtgactcagggaggctgt

SEQ ID NO: 21255 - DNA, 405 bp, Bovine  MMBT12221
ctctttgtgagcccacaaactgtaacccgccagcctctgtccatggaattcttcaagcaagaatactgaaataggttgccataccctcccccaggggatcttcccaacccagggatcgaacccgggtctcctacattacaggcagattcttcactctctgaaccactggggatatgccctacagcccctctgattccacctctccctcctcagatcccagagccagcccagctgccaagaggagacctcagatggctcaggtgctccaggcttgagacctcaactcagaccacaatgtgygacccttcmcaatgctgattagggttgtccaactgctctaacctcacttcagctcttggtgggtttggggttcatcatcactggctcccctcgcttccatctaga

SEQ ID NO: 21256 - DNA, 600 bp, Bovine  MMBT13314
ctggtcaaggcagtcttgttctcacaaggccacgcacccagcaaaagcaaagccaaggttggtcaggatggaaacaaaaatgcagcccgccaagctggcccctttggcccattgcccacttcctggcacaggcgcccccattccaaactctttcccttaatttctagactctccttggtgtgaacccctcagaggaccccctgtgccactgttaaccctgaggacagagccccaggcccctcctgctgggctggccaagtgtcctgtgcagtcccggctctgttctgcccctgggccagygctgaggcttagggcagacgtcctggctgcttttgctccatatctgtgcccaacaattggggaacaaagatcagggtggatacaaacatagaaaatgagaatttctcaggctttgccttggtcacmtgggaggaaaacccaaggtgcccctcacccaatgtcctacaagatcacccccctgcagtccccatmtgcagagaactaggacatcagaggccccaggagtcaggaaagtggctgaaaatgtccaagagtcagactggaaacttggactgaacttggcgttgctttccctgagcg

SEQ ID NO: 21257 - DNA, 600 bp, Bovine  MMBT18815
atttcaaatgcccgttccacatccctgaccctgatccagtgttggggtgggggtgtagggagtgttcccagccattgctgggttctgctctttacctgatggatgagtgggggaatgaggagccactctcgatcagccctgggctctttctcctctgctttccctctgccactgggctagagtttgctgttagccaacctctataggaagctgggagcggttctggtagcagccaggctccatacgagatcacgctgtggagctgaagagggatcgcagagagccacggactagggctgycttcacatcactgcagatggtttctttcaagatgaatgggctgtccctgccgcgttttcttttcaaaatgtcatgctgtatttttgagagcacatgaagaaataaataaagtgttaacagtaaaaaataaatagaagtgggacttcccttgtattttgctgattgatctggaggagtgggactcagggtggggaacttcactgctgtgacatgtgggctgctaggtccagcgtatggagattctccaatacgtagtgacattgaggacaagaacagcctcttgtagcccctgctaacagt

SEQ ID NO: 21258 - DNA, 600 bp, Bovine  MMBT06010
ggccagagccggaaagggcctcttggggaggctgcacagagcttgcgcgctcctgagccgaccccctggcaccgcgggaagctgcgtgggggcagaggtggagaaggcgctgactgaggagccgaggatctggggccgggccgggagctccggatggaatctatttctagaacccgtggattcccaggagaagtcgagggctattgaaaaaggagggcaagccactaacaagtgatgacacgtggggttttgatgaatgtgctgtatgttgcctgatagaagtaatcggttttcctaacytcggtgtgcttaactgcagaccaagttatataccagaaacttcgttcctgaaaacccagtttcccttgttctttgaactgttacctgggagataaattaaacttgtaaacagtaaaactgccctagagtyggaacattccagtgcagggaaggaagatggaaggactgtgcagataaggtaatcagtgttcggaatggatatgttgagttcgtcctgtcttttttgctctggttgacctctgggtggagatgataatgggagatttgggggtgaaagaatcaaagacttagaaaattaaa

SEQ ID NO: 21259 - DNA, 598 bp, Bovine  MMBT00899
  misc_feature (1)..(94): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgaattttgatggactttgcaccaatcaccaccaccaccaccagaagtgaggagaagaagttggtggtgttgcaaaactaaaaaacgggataattttgtatctgtatcccaaaacaatgacagaaagtgattagatgttgaaatgttggctttgttttaaaaaatgaaactaaatgaaatgtaaatggttgattccaaatagcraataaggaaagatgtgattagatgtttggggtcctggtgattgatctttgtgcctcattgttgacctgctttaggcccttaatttctgccwtgtacactctttagagatggatttgtgactgtgtggtgcaggctgctgtcctccagattctttgccttcttctccctggtgaaggtaaaatgcagaataaagctgaytgtaaaacattcctgacttgatgtgtgctcattcctgctgttcttgtgatgatcattttctccttttttgacaagtctcaaataggaataaaaaacagcm

SEQ ID NO: 21260 - DNA, 600 bp, Bovine  MMBT02090
tcaagttaaaattaaggtctttttgaactattaagcataggaatagttggagtcttaaaaaaatttaagtatttgatagtaaaaatatctaaaaatatgtcttatactttaattcagaagacaaaaygctgtattatagaagaaagtattaattaacatttagttgtaaaattatataactgagtattaatgttgcaacatttagttaatagtttatttttatttttcaggcgttcatttgaatttttagatttattattacaggagtggcagactcactcattggaaaggtatgcatcractcttcctcttccaccactctcccctcccctttgtcatcagttctttagaaattgatggtattggatttgcattatttcccattttcctttaaaagttatttgtactgattttcctttaaagctgaggtgctcctcttactcatcgtagctgtgattttcttctttgtggggtgaatgagggtctcttaggtgaatgggcaagaaattccaggttaaattgggcaagarattccaggttttataagaaattccaggttaaattgggcaggtagtttaaaatgtatttctagtcatgtaa

SEQ ID NO: 21261 - DNA, 499 bp, Bovine  MMBT09974
  misc_feature (1)..(1): n is any nucleotide
ntcactaagcaattctgagtacaaggacatattaaaatatcccagtgtttctcctaagaattaggtggtcttctttgattttttcttctctgcttcttctttttccttttctatttcatttacttgtaattcaatttctttggcactaaacatctgaaaagaaaaaattttwaaaagcaaatttcaattayagcaacaatttcttaactataatgccgatgaayccaattatattttataattttattttttatagctttatatcttataacttcaagtacatgatgaaatatttcagaaktagcttaattataacaattatggacaaaatcagaactctacaacatttccactatcattgtgctaaaataaaaagccaggaaatacaatattgggttccatatcttatatatggatataattctgaacacatttgaatgcaaagcttattctattcatgaaaaaataactgattactgaattcccaccccatcccaat

SEQ ID NO: 21262 - DNA, 600 bp, Bovine  MMBT01953
ttkcaggctatagtccatgggcttgcaaagagtcggacacaactgagcatgcaataaaacacaaacaaaaatccaagctgctctggttaaggtggaaatcacgaaatataagcttccctcttccccacctctacaagagaatttgggcactgctggggaacacggtgtaaaatccatggatcccactcgagtcagacccagagctgtcagcatctgcactgcgtttttaatgttcactgatcaagagcgctaccttctgcttacgtttcatcatgaacaattacccagtgactctttatkgattttattttgatgaaagataaatgataacatcttcatgtcagttagttgaactagttcatttattgaaacaataacgcacccccgacaataatggtgaagtagtcaaaggtgccgtggtattttgtatttttcaaagataattgcagcaaggtattctgacccctgctctctcacagcttgacttggtcactcctaagacaggccacgtctgtgttctaccagtcacatacctgtaaaaagtcttgcttatttatgacmcatggggacagcaacatcrtgttccagcttagccacaga

SEQ ID NO: 21263 - DNA, 600 bp, Bovine  MMBT10906
cttctctttcaagtatggatgaacctatgagaaacaaagcatccagtacaatttatatatagaaatatgtttcctactatttacacaggtaggaaaacctcaggcaaggtagattgcattcatgtttcttacccatgtgtataccaactcttccacatggtaaaggctttttatgttgttcattctaactcaaaaagtcgttttgtaaggattgactccaaggaaaaacaaatacccaagaacatttttccatttgttttcctacaaaggtttctgagccctctgccacactctgggatkcccaagtccagctgaactaaacacatctcccactacaagtcctggatggaacaatctgatctcatttgtaggacaaagtccggctagctaccagggtccctctttcctaggccagaggctacaagggaggagagtaaagtaaagtactttgcacctgggagcaaagtaaaacatagaggaaagtatacttgacaagtcttggggttcaggccatacctagaacctctactgaagggactatatctgaacctgtgggctgctacaccaatatagctgactggaccactgatgaacacctaa

SEQ ID NO: 21264 - DNA, 600 bp, Bovine  MMBT09033
cagagcatggtgcaaagcgtcaagttcccgggacacaacagggagaagcagaaaaagaactgagactattagaaagatgccagcaatgagttgtcacctggggtgccaaacccacagggaagaagaggtcccaggtcgcacgcctgggataggaccacagacaggtggaagggaaggctgtggagaagggaacttcttccctcactcctgacattttcttccagagaaggaagcttaactagtggaacttctggaactctctctgccccactgctccagtgacttgctgttaactttggmaagagtacttgggcccccttgactccgcccacatcttgtttctcttgggtaactgttctccccaccttcttgcttttactcttttttttttttttaaggagtaggcrttttacttatgtatttcagaacaataaagacttttattacacraactgaggtaggaggcaagagggtttatttttgcttttttatttattctgtttttttgttttttttgagacttgcaggatctcagttccccaaccagggactgggcctgtggcccctgcattgggagtgccaagtcttaaccactggacc

SEQ ID NO: 21265 - DNA, 600 bp, Bovine  MMBT19352
aagtataaatttcctgatggctgcattatttagatgtaggtttgggatagtttcagtttaaacaagggaaatgctgtataagttaatttcataatatgaaaactggaaatcactttttggtcaaatttcaaaatgccaaagagtaggaaacctcaaaagaggaactgatttatggtggcatttctagagttacagaagtatcttctcttaaatgtaggtttcaaaatgtttgaccataggaaatatccaacagactcctttatgtctctgtgcttcatacatgttagccagtggtctctyagtttacagcagygctggtgcccactggggtagggtcctctgccttgatgatgcacctgagaggctgtgatgggacaggagcagtgctcgcgagccagagtgtctgggttcatttccttatattccagcttacttttcttgtgaccttggtcaagttacttatgctctctatgaaaccattgccccctcataacaatgaaaataaataatagcatttgcttcattgggttgttaagggtataaaaatgtttgaatgtttgccaggtgctttgaataatgcttgtcaagtggttcatgtta

SEQ ID NO: 21266 - DNA, 600 bp, Bovine  MMBT09409
aacagattcctagggaaagtggtcttttgtaatggtcagctaaagctctctatcatgagtttgagtaagctccgggagttggtgagggacagggaggcctggcatgctgcagtccatggggtygcaaagagtcggacacgactgagtgactgaactgaattgaaagctctctgtgtcataggttaagtttcaggagaagccactggcttagcctatataacaccaaacagccacacagtatcaattattcattcaacagggtcaggctggaccaaaggaatgaacttctaaccaagactyccccagtcttgactccatccactctaaccgtcactcagctgccaatgtcatcaattaaaacactcttttactttataataataataactaatgtgcctaactaatgtgcctagcccaaataagtccaagcagtgatactaagcatgttacatatatgaacacatttaataagaaactttaacagcagggtatcatttttattctgattttactgaagaagaaactaaaagctcagaaaaggtgaagtagcttgtgtggcaaagcctagattcaaacccgtgtaatctgggtttcaactat

SEQ ID NO: 21267 - DNA, 598 bp, Bovine  MMBT05911
  misc_feature (1)..(73): n is any nucleotide
nnnnnnnnnnnnnnnnnnnnnnnnnnnnnnnnnnnnnnnnnnnnnnnnnnnnnnnnnnnnnnnnnnnnnnnnnctgtcccccatccatgaaacctgtggccataagggcatctttgcaattcatatgcttaagagttttagtttagtattcattttaaaaatgagattctgcttagatttgggccagttttatacttggttacacaaaggccaacttttgtactgtagcaaaaaaagagatcaggtgggatttgcactaagaaaatccaggaggacctagttttcaaccttttcttttayccatacacatctcaccattccattaatttaaattctccattctggttgaagtaaaggtgaaaatataagtttagctaacggggaactgtatttcgtttggtacagattcacttacaaggtatgttaaatatgaaaataaaatgaatacaatgataataatcactttgttattgtaaattttatatgcaactcagggacaagcttcaaagagaaggattctcaaggcaatttctattgaaaacctgcaacaataatctttatcctatagttgcaggttaaaaaatgagtttcaacaaaa

SEQ ID NO: 21268 - DNA, 600 bp, Bovine  MMBT03857
gaaataaaaagctttccaatctaaataagatacattaacatctaactgtatacagatgttcagagaagccacagaaagataattgcactttgttaccaatttagcaatctttcctgctctaattaaaggaggaaataaattatcttgtgaagaaattgctcataacattaacagtacaaatgctaatttaaattatttagatatatgatttattctgtaccacattaaagatttgtcacaagtttagaaatagtctaaatatgtttaagaaagtcacacacaaaaggtaaatattttgtmctattgatattaaagggaaaataaaacaagaaagaagcaaattatataaaaattttaagctatctcctattcctaatctaaagaatgagaaaaagaatgaaacacagaacagggacacaatttgtcaaatgtttcatcaacaagaatagaaagtgatacaaggacattcttgagataatcaatgaaatgtcagccatgggaggagcgtggctagtctcactgctacagtgtacaattgattgctcaggactctgtggggaattgctcagcataagaggaatacaaattagatctctccac

SEQ ID NO: 21269 - DNA, 600 bp, Bovine  MMBT22696
gatgaaccrtcagacagggactcggacagctagagaaagcagcagaatgaccagaaattgcccatccagatgagaaaccgtggaaggggcggccgtggtggctgcgcaccctgaaaccgccacctgcccggcccctcgggaatgaaacagagcgtggccaaccaggcctgaagcgctccgtcagccgagagcgctacgtggagaccttggtggtggctgacaagatgatggtggcctaccacggacgccgggatgtggaacagtacgtgctggccatcatgaacattgtaagtgcctccscctccctggacatggacccccaaaaatgtggagcccacctccagagtcaggaaaagggctgtcaccatcccccccatcactgatcaaatgccagtgaaacagaatgggaaggggacrgggtgcctcagaaagaaagcctgttagtgaaagtagcctagcacagtggttaggagcatgaactcaggagctagccaacctggccttaaatctcagctttgccaatctttgactgtgtgcccttgggcaagctactttgcctctctgccttggattacccacctgtaaaatgggtttaatcat

SEQ ID NO: 21270 - DNA, 600 bp, Bovine  MMBT03618
aaacatttttggccagagacttgaagaccaaacaggagagctttaaaatgggatttaaaggggataaagtggaatgttcaaatgaaactctaaaatcgcagcccatggaggggcagcaggtgtgagctagaaataagaggcctggcagagggggtgccgagcagttctctgaggaactggagcagggtcacatccacactggggacacgctcaccagctgcatcgtgaggggcccagcgaatgggggaggcaagcacgacctcggagacaacagaggcgaggtggctaggacacacagcyaggacgccatgctaggtcagggtgacaaggtcacgtggttgtaggcactgaaatgggtgttaggagggtacacagaagtagaagtcataaacatgagagtggaagcaaagccaagagcatatggatgagattttcaaaagggcaaaatagaaaggattttgctggcggtgtgtgcactacagtcttctcaggcagagacaggctctggctggtgctttcctatttaagacttttttcctaagtagcataggaagaagatggaataaagatgggaagagggtatttattcaagcatctgcc

SEQ ID NO: 21271 - DNA, 600 bp, Bovine  MMBT06331
ctaggagagatactataattatcatcctttataccaaatagccaagggaaattaaattttattcatattaccttgattcttgagattttgagagcatgttgtaggaatttgtacaatctttattatagtacttttatccctaccaggtagggtggaaacaatggacatatcataggccctacataactttcaaatctcacccagcacctgagcctaataatcaccagtggtgctcagaaatcgttttaggcaaaactaagtagacagcttcagcctttctgcctcccgtgcctatccttytagcattttttctttcwtttcttcggaacccactgttcataaatggttccatcctgaagtcagctaaacatwagagatttgataggctatctcattcaaaaattaattgcatttacacttgttttgatggggaaaaaacttattttgtgggataaataatgaaaattcagtcactctgtatcatagaaagggaatattcttggtaaaggggtctccttagcrttactgtaaagaaaaaaaaattagaacctctttcttcatccttgagacattgcttaaaggggtgtctgtggggggaag

SEQ ID NO: 21272 - DNA, 601 bp, Bovine  MMBT06791
  misc_feature (1)..(1): n is any nucleotide
nactgcctcatcttcaccatcrccctgatcctgaccatggaaatggtctcctgaatgttctctctgcttctctgagacgctgccaagtctacctcaacctctcacaattttaaaattaaaaataaaaagcttagatcacacaaaactacttaattacaagggaaaagaagatacctaaaacrgagatattacaaataagatgtctcactcatattctagtactcactagggtcacaagcttcagagccagtaactcaaaggctgaagtttwaaatcctgttatcaaagaaccttcttccarccattccctccacactgcctcctagaccctctggttcatagaggcagattactgtggtcaaggggctgttttgtgaggttatgttcaatcgacatgaatctgaagtgcccaggactggcagagatcttcagagccggcctggctgtgtctgtgctcagtcctgtctgactctttgggaccscayggactatagcccaccaggctcctctgtccatgagattttcccaggcaagaatgctagagtgacaagttttcgctgctsttagccgattaaaagaggttttaacaattcaatttgca

SEQ ID NO: 21273 - DNA, 600 bp, Bovine  MMBT07117
ctgaaattcggcaaggatgtaactagagttggacatggagctgagaaaagaactttttcttttttttaaaagtagaagatagttgagctaatggactgaggctggaagagaagttgaaggaaaaagagagatggagaataatggatgtcactaagtctgtgagaagtcagaggggtggaattggaagatggggagaaagggttcagaaagagtaggctactgcttctgttctgataggagagaaggcaggatatatactcaacacctgctgtgaggaaacaacaaggagcatgatccccrtcctcgagaagcgacagtccagttggagtggcaagacattgcaacagaaaagaataatactctgtgataagctggcaggcaatgagtgctggggcgtttgagaggagagcgagatgagctcctgatgctgtgatcaaggaagacttcaggagaagtggcatttgattttgaacttgaaaagcagagtaggattgtactagctggagatataaatggtaagagaaaataaaggagaaaaaagtgcatttcatgtagaggactggcatgaacaaaggattgaagtactgaacttcaattagt

SEQ ID NO: 21274 - DNA, 600 bp, Bovine  MMBT19592
agagcttctccatctttggctgcaaagaatataatcaatctgactttggtattgaccatctggtgatgtccatgtgtagagtattctcttgtgttgttagaagagggtttttgctatactaaaaaactaaacttatagagaaaaatactcatagaattgaatttggtaggcaaataagttataataacttcatccaatgaaatacaatagcctgtcatttgaagtagaaactgtatgtcaaaatttataaacattaaagtaactgtactataaaawttttttgacgaagcttatcttaaygtataaaatgcatttgcaaagctgtatwtgctttctctcttgctgtatagtttcaatcagattttagaaatatttcagcttttaagaaaactacttttcaaattaacctcctagtcctatattggcattgtatgctttctttaataaatctcattttttagaaatggtgggaaatcttttatcaaaatatccagtgatttggaagcaagaaaacttcagattttgcaataactacaaagggaaatttatccctacaaaagctgggagatgaacaaattaaataatgagaactcaaacagt

SEQ ID NO: 21275 - DNA, 453 bp, Bovine  MMBT14175
gggaagggaaggggatgtaatctaacagcaaagctgagcaggggtctactgctcaactctcaggagtcgcccaggacggccacagcaactgtcctaggcctgcggtctccatcctgcgtcggaccctttggctcagaagaaggagaaggggcggggcagrgaagctaattatacactttgaaactccctcaccttgtcacccacaaaggaaggaaccaagggagaggaagacaattttacctcagaccaaagagaatagaaaaataggtcaagtggccatgtatttctcctccccgcccmcaacttaaagcttccagagagaaaggagaacgcaaatgggcttccaaaggggaaagggggaggggagggataaattaaggctttgggattgagataaacagaccactatataaaaaataggcaaacagcaaggacctgctgtacagcccaggg

SEQ ID NO: 21276 - DNA, 544 bp, Bovine  MMBT19071
ctttttcttcttcttcttcttcccccagcagcttggctccgaatctttgctgggagactcttttccgagtaagtcatctaattcgttcagccccagcagccgggcctgaggcacctccagctccagccgatacgacaggttcctcagggtgcacacgcagttctccacggtctgaaacccaacacggcgcagggttaaaaycatcgtagcgtgttagtgcaaaatgcttctgtaccmagcaccagtggcactaaataaatgtagaatatgaaagaactgtttttcactgatgggaacctrcaaactgaaagttagaactctgattccagactcaagttggtgggaccccaagctcacagagtgtgcagagccacccaaagtagagctgaggatctgatttcacactgagtgaaatgtgtggggctctgggaggggagaatgcccaaggtttctgcttcagggctgctgcagtggcagagcccccatattaccagaaccccaccccttctcccagctgggaactctcatcatgacagcaggtgtg

SEQ ID NO: 21277 - DNA, 600 bp, Bovine  MMBT11368
tgttcttaaatattttctaagtggtgacatctcccccaccagcaccccacctgctacaggtgatgtataaaaattctcagagtataagactccactatgcattctgaaatatgagtacaaattgaattactggagaaaagtattttccaagcagaggaaacatgttggatgcccctgaggcccagagaagcacgggcataccaaagaactcaaagaacacctctgagcttggagttgagacagtgtgggaagtgctgcaaagaaggctggtgatayatgcagggacycatgactttactrggtcttcattagtgtaaaatacctgcagtggtttaataagggaatggcatgttgagatttttgttttaaagtcattttattatataattttcatttacaataagttcattttaaggtaatactcactgtttgcactaacttgaacacctttctaattcacaggacttttttcttttgtgtatatatatgactttttgtttatttgttgaagggattttcttttgcacaaagaataagagcattttatataaaatgaaaacaaagcatcttttaattacccatgccttcattcctcattga

SEQ ID NO: 21278 - DNA, 600 bp, Bovine  MMBT03456
agggaactactctgagtgttcaccattagatgtgatctcggacgagccaggtgggctccttgacctcttgagtaaagcaggtttactaatgccgagattgtagggttattttgaaaactaaatgaatttatgtaactcagtggttagtacatgagaaagttctcttccccccagggaggggattaatgcaggacttttgtactcatgtaggtgaagcacttgggcaaggaaaaattgcccaaatttactggtgtctcagcctgtccaagtcttgtcccatgtagatccctttagaaaccrtgttctcagactgttggcgaagtttgggtaaacatgactataccagaatgatcctgagatttcctgaggaaggattaacatgcttcgcatggaattttgcaataaaggaaacactatagtttaattcatagtgatttaaggagatggaagattttttagaggggaaatctaattatagtgaaaataaaatttcatttgcccatcatttccttcattattcattattttttattgggaagataagtatgtacaaagaataggaaagaaaaacatattagagtgtactaggaaaaataagga

SEQ ID NO: 21279 - DNA, 600 bp, Bovine  MMBT12485
attccactattcccccatttaagctgattttcttaaatattgcataagccagaggtaatttgatttcatgtttttatttaaattatatacattagtaccactgaaattaatctcaatacaacatttaaaaataattagaagcagattgggagtaacttaaactaaaacacatactgaaattatatggcttcctaagaaagaatagtgtttataaataattacatttatgaagaaaaaagactaatttgtatcctttctaaattgtgggctataggttaccatactacatacaagaagatyccctgaagaagggcatggccactcactccggcattcttgcctggagattcctgtggacagagaagcctggcaagctacagtccatagggttgcaaatcagacactattggagcaacttagcgtgcatgcatatatatatctatatcaatatctatatatatatatakagagagagakatatatatatcaccttagttcctttattttaactttgaatttaatttttattactttttttgcttatctttaatacttttggagaatatagatttttatatcctgaaactacgtaaatagcta

SEQ ID NO: 21280 - DNA, 600 bp, Bovine  MMBT09648
gcgagaatttaaaagttatgtaattcacatagtcaagaggatgttaagtgagaaactacccagataaattattaacagagaatagtgtatcattttgatttttttttttaaagaaaagcatattaagtatctttcaaagactgtctttaatcatttttttcaatcacacacttgacaatgaaaattggaattattctttgcaagaagcaactgtcatgtgcagcattgtgaaaactccctttagtcccagattaaatttcaaatcatcactcaaaagcctgccgcacacaatcagcacgygtccttgggtggcagccttacccattcctgggctcccattctgttgctggggcctgctggttggtggactggctgctgagacaggaggaggaactactggctgctgtccgtgtcctgatgatcaaaagggaaagaccattttagtgccaataatttggattaagagatttaaacttaagcagaagaaatattctgagaaagtgtaaatttgtgatttttgtcaaagactctcctgggtcagaattcatgctggggcactttactgcatgcagcgaaagtgctgggggttcacttttgttt

SEQ ID NO: 21281 - DNA, 600 bp, Bovine  MMBT03839
ggcagtttcagcaatggaaatatacctgcatttcacttaattagggttggaagataatgtggctgtgaactctcagatattgagcaatgagttttttctccaaaggttatattattctgcttcaaactagaagtatcattggcaccaagactccttgggtacactttttaacaaataaatctgctgcagaatgacatcagcatcattagaagttcagctggccagtagtagaatgtgctggcatacaacctttccatcaaaactaataataagcttccaaatgatcataaagttcaggcmgtggtgcaaggtatgtgtgatgatcacaatccattgcaaagttgaggggacagtcaagggggatcaaatttcagacaggtatacggtcagtcctcctagagacaagagtgaaaggcagccaacaagggtacttctgaatttatacaatgaaaaataatcaacgatggatcagcaggaaaccgaaggtggtgcctcagtaaaaagtcacggttccttacccagttcctggacctgcgccagtcctcagacctggaactggtcactgagggagaaacaagattctcgggagaatagaccctg

SEQ ID NO: 21282 - DNA, 598 bp, Bovine  MMBT05610
  misc_feature (1)..(22): n is any nucleotide
nnnnnnnnnnnnnnnnnnnnnntattttcctttatttaacaacatgtatatatttactacctgtctacaatgtcctaatcacctttaaaactttattattaactcattaatactcataatgatgcttttgaaataggagcagtgtaatctccatattacacattgggaaactgaggcacagagaggttaaataacttacctgagatcacatggctgggaaaaggaggaccgaaaaagccaggccaggcagtctggctcccaaattcacacatttgacctccctgtccacattcttcaccwctctttattctaaaccctgtggcatcacttcaataagaccctgagactcattttgtcacatttcacacccctattgtggatgggaattcagcctttttggaatatacttagggacatataggtgatttaaaagagaacatgatcgggactttgctggtggtccaatgattagaactgtgctcgccaacgcaaggggcacgagttcaatctctggtcagggaactaagatcccacgtactatgtggtggggccaaaaggaaaaaaataagacaaaacgtgtttgctgratcagtctgac

SEQ ID NO: 21283 - DNA, 598 bp, Bovine  MMBT10426
  misc_feature (1)..(33): n is any nucleotide
nnnnnnnnnnnnnnnnnnnnnnnnnnnnnnnnnctgcctctgtgttttaccccccccccaaagtggagtgtttatgatttggggggatattagcagtgcatgaagcttgacacttacttatgtgaaactcagagtagcatgtgcgatgctgtcctttcaacatttgtgtcgggaggcattgctgggagccgagaaaagccttagctgatccragtggagtggattgaattaatgacaactctgagagcaccagttttagggtaattgctttattgttttggagccagggtgcttataatmtggttcctgtacaaacatgtttaacgtgtgttaatgcatttgcaaaccagagcctctcagcacaaccctgcttttcattaattgatgtcggtagcatggtacagtatttcaaagagctggccaagtataaactgtgtttccaatttccttcctttcctgtgtttggaatgccaatgttaatttgttcccatgcaggagcaggggctgccaactgcggctttctataaagggcttcacggtgaaggcttccagccctcactgatgcttggggctgcctggccaagtttcctgacacttt

SEQ ID NO: 21284 - DNA, 600 bp, Bovine  MMBT02139
agtgggttcagtgtcagggagtttcagcctgggctccacctcccagcaacaggatgcaagtgggcttagctcaggctttctcttctcctctcctagtctgcatattggggtctgggcttacatttttgtttggaggcaaagggttgtgctttatttacgaaacagagaatgcctctgagccttgcataggtgagagacattgggcaggaacctggtccattttgttccttctccttgcgcaggctaggcagaagatgggctgcctctagttccctgagctgtgtgtcttggctgaagagyctgtctggacgaggactagtgtcctcttatggccagggtgactttcttctatccctggctttcctaaataaaaggactgtggtagagtgtcatggtggagaaccatgctcttcacttgaaggactttctgagtacatccaccctagaattatttaactgctagcaaccatggggcttctgtgtgtgaaaaggtggtggcaagagtccaggttcagtgtctggagcagtgacctcctcatcccctgcatcgttctctaggcttaaaccgctgccaccgcctcccctgactcagagtaggac

SEQ ID NO: 21285 - DNA, 600 bp, Bovine  MMBT21683
gtcttggttccaatctctaggttctagtagagcaagggtamtccctcttcyacgtgataggtattccaagaaagctatcctgttgactggtcctcctcaaggtacacatccccttccctccaaccattcttcacggatcttgctgttgaagccctttgccaacttggcagtcaccttccttctgacgctttccattgtgtggtggggtccttcctaaaacatgatgaattgcaactggctgtcaccttgacgtcagagataaaggcctgtggagaaggagacacaaactctgtgtttcayrtttataaacrgtaacatgtactcatagaagaatattgaaaaaacagaaaaagtataaggaagaaaaacgtaaatccctgtagtatgatcttctcaagattattagcttaaactttggtttaatttcttttacttttttcttctctgtatatttgttaatattttttgatgggtaacatataggtctcttcttttcatatttagctttttcatgtcattaaaacttctcaccacccttattttatttacctatttcctgagataataaattgtttccagttttccacttttataaataaa

SEQ ID NO: 21286 - DNA, 600 bp, Bovine  MMBT21684
tcttggttccaatctctaggttctagtagagcaagggtamtccctcttcyacgtgataggtattccaagaaagctatcctgttgactggtcctcctcaaggtacacatccccttccctccaaccattcttcacggatcttgctgttgaagccctttgccaacttggcagtcaccttccttctgacgctttccattgtgtggtggggtccttcctaaaacatgatgaattgcaactggctgtcaccttgacgtcagagataaaggcctgtggagaaggagacacaaactctgtgtttcayrtttataaacrgtaacatgtactcatagaagaatattgaaaaaacagaaaaagtataaggaagaaaaacgtaaatccctgtagtatgatcttctcaagattattagcttaaactttggtttaatttcttttacttttttcttctctgtatatttgttaatattttttgatgggtaacatataggtctcttcttttcatatttagctttttcatgtcattaaaacttctcaccacccttattttatttacctatttcctgagataataaattgtttccagttttccacttttataaataaaa

SEQ ID NO: 21287 - DNA, 600 bp, Bovine  MMBT17551
ttcacagtaaaaatgtagatagatgagacaggacaaaggtaacgtcgtgtccattttcgcgagtgattctttttcaagaacacatagttgcacacggcttcatagctgttgcttcaaaaaaaatgtccatattgtaaggtatggataccattgtcaagcataatccaagcgatatatgtttactttccatttgaaagtcagtatgatatttgaaaaaagcaacataaagtagaaaatttacaagtaatgattaactcatatatcagatctactttcagtaacttgaatgcactcagggayttttggggccatcttatgtgacactttgctagactctgatccctatttcttcacttgtttttatagtccagtcctataaactcacactgtgctgttaaaagagcagacttattcacagatttccatgccatcacgatagccatatatcaatgcactggaaggaatagagaaatagaaaaagattaaattattactgcaaaaaattagaatagtattttttaattgaagttcagttaatttacaatgttgtgttagcttcaggtatatagcaaaatatatacatacagttatatgtatgta

SEQ ID NO: 21288 - DNA, 600 bp, Bovine  MMBT18150
tgagcagggtagatcagacagtttcctggaagagtgaagatcttttcatgaactgaatggtacaaggtctyagcacagcctggggaaggaaaagtcagaggtcagtggaacaacaggttgagagaagctcccaaactgcttcccttcaggaagaagacaggaggataaaaatcactgtagctaaaccttctccctcattttctgtcagtagccaaccctttgtgtagaggagagcgaagggaattctaggtaagtggaacaacacacgcaaagacttggggaatggtaagaattcagcaygactgtaaaaaaggttgggataggaccctgaagcaccaagtcccgtcactctgggggtgctaagaaaggattctgggcagggaaagtggactagaaggtaagaaattgaagacatgaggcaaaggaggatagagccatagttttggcaagaagctccgagtcctaaactgggacaggagcaaacctctcagaatgttctgccatcttttctttgatctcatgactgtgttggggatgaataaatggaagattaggagcttcagagagaaaaagacagagaccaagatggaaagataagga

SEQ ID NO: 21289 - DNA, 600 bp, Bovine  MMBT04393
aaaaacaaaattymtgccttaattgagtccacattctagttggaggatattaacaataaattaataagcaagtaaatttataccatgttatatggtaataaatgctatggagaaaaataaakcaagataggggactacagagtattagggtagagatttgctcttttaagtattgtggtcagagactcaccattgaaaaggtagtatttgaacagagacataagaagtagatagaccaagctgtgtgattcattggaaaaaaaaagaacattccaggtagagggactagctggagccatwcccaaggsaggaaggcttgggctcctggtgtgaagtgaggaggagtagtgagttaggagataagtgagagaatsaagatgccagatcatataaagcattttaggcaagtataagtgaattttaaggctgttgaatggtttagaaggatgatgtgatatggcttatgttttgaaagaatcatcctagctgctgtgttgagaacagactatgataaggcaaagaattagggaaattatagttaggagaatactgccctaactgggcaagaaatattggactatggaccagagtggcaagaga

SEQ ID NO: 21290 - DNA, 598 bp, Bovine  MMBT13010
  misc_feature (1)..(100): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagccttcagggactagctggtgctccgtctccctgaccggtgctccgggtgctctccatcacctgcagacactcaccctctggacacctctgtgccctgttgtgcttcctctcagacttcctcacctccttcctcctctcggggttcctgctgcagctcagtgcgtgtcagactcggagctgagcgctggtctgtcrgcgctttgagcacaggagccctgtcgcttcatctctgctccccacaagcccatgttcctgactgttagggtgtctggtcttactgtcgaccaaggcagttgttataaggtacgcttcaactcagaggtgaagccacagccattacgtgtaatagaacagagtgaaaatggatatgaattgcacacaccatctggtgtctgagactgtcacaattatgcatttatgcagaatgatataaaatgcacaaatgaaccctaatttgcaaatttcwtttttttttagattatgcaatatctga

SEQ ID NO: 21291 - DNA, 600 bp, Bovine  MMBT05396
tcactctgccctgcctgcagcaagaatcctgttaaggtggtttagctggatggaattcctcctcacctcagaggttttctcttaggaaatttatacccactgacccttgccctgctccttgtctgtaaatccccacttgtctatgctgtatttggaataaagcccagttctattcagaagtcttttcccccttagtgcaccagttcctgaataaaacttttgtttatttttttacaactttcactactgtccaactactctgattttctgggaataactcagtacatatttgtcaaacamtgttcattatgtccttaatccatggaattaagtaktattagtaaaccagtcccactcctgctgttgtcacgttgcacttacagggctgtatttgcctttgatgatgatcatgaccatgtgttaggtgtaagagaaggaagggacatgaaaatgagaaagaaggtcatcttcttattataataaatgccatttggaaatgggtaaataaaccaattggtattgcataaatcagcagatgtcaatgcagaatakttggggatgtgttctctgtccacctgcttctgtccgctgggcttgact

SEQ ID NO: 21292 - DNA, 600 bp, Bovine  MMBT09143; identical to SEQ ID NO: 4797

SEQ ID NO: 21293 - DNA, 600 bp, Bovine  MMBT14769
aggagcaacaacctgcccaaggcccggccacgtcccaggatcagggcagtgacatttcaggtgctaacttcacttcactctgtaattctcccctgtaatttcccccctttccctcacttctgtaatgctggctcactacctctagcgctctgaagtaagttcacagatgcacagacatgctgtcccagcaaatgtgaatggagaggcagctgggttgactttgaattgtgtatataccctcatgctttcattcagagcctataaatgttttctacttctccctgaagggatgaaatgtcrtctaactctgagtctcacacagctggctcagaattgaagcatcagcgcaccactgtygagatctaaatatttatgccacctccttacctcctgtacatttaacaaacaaaagctcttacattttagacagtaaytttctgagagagggactatattttaccaaaatttaaaggcagacgatccaaaccctccccaaacaacaactgccggccacgatgaaaggagctgggaaacattaaggactttgtgcaaacagggaccaaagcgtattcgtccctgtgaccccggctccacgcccgc

SEQ ID NO: 21294 - DNA, 600 bp, Bovine  MMBT19936
cgatcttttgggcacttccaataacttcctgcttcctggcacttcctgccaggatccttctgcacttgtctcaaccttgtatttcaagaaaagtgcaggtttcaattgataagcactattagagccatgctaatactactctggatatgtgttagctgtcatcctttatgttataaacattacaattttgttcaattctttaatatctccatatgcaaaccttctattaaaccaaacctttgatctccccctactctgaatgtcttcctatgacctgttgccatggagatgatcacataygcctcatgtaattatgtaaacagcagatagttcgtccatcttatctcacatataggctgtttcatttttccttttctgctggtaagttttcatcttagcttaggtgaatttacagcaccatgcttaaggactcaggtgttttaagtcaacaacaaaattaaatttctcttgatgaattaactagactcctcctaattcaatattcaattaatttgaaagtggaagagaccatctttaacaagctggaacccaaattcacaaagagatcagagtttctattttcagttcaattatctgaaa

SEQ ID NO: 21295 - DNA, 601 bp, Bovine  MMBT01258
  misc_feature (1)..(1): n is any nucleotide
nccagaatttsctgtttataatagcaacatatttattgagtgtcttataaackctagacactgtgctgagcatkttatagttttttcatttaatcctcatgatgacyatatgaagttggtgaacaccgttttgcagagaaaagaaaattcaagcctagcacggtggactcaacaggctggtcaagcctccagattggtgtttgatagcctgtgttattttgctttgggggaagattattgagaaatttgwtcytktggctggatagtggttttgaagcgcgcccttccgtgtctcaccccytggcaggtagagtgtctccccgcggtctgacaatccagggcgagcccttcggtgtctcaccccctggcaggtagagtgtcaccccgaggtctgacaatccagggcgagccctttggtgtctcaccccctggcaggtggagtgtcaccccgaggtctgaaactccagggcccttgtgcccagcactgggccttgtgctgcctcggtgcttttcatatgcagatgatcgagaacctgctggctgccgccttctccatggcagtgggttcctgtttgtttaggaagtttaggggagtgtctct

SEQ ID NO: 21296 - DNA, 600 bp, Bovine  MMBT02687
gccaatacagtatgtcctcaacacacaaacaggttctgctccgagagcacattcctaagtccacatctttcattaagtccaacaaagttcacctactaacaaaatctgccatttggtactgtactataataggtttataatattgtacttttcatacaaataatatataaaagcaaacagaaaaaagaaaacattaaactatagtaccttgaaagtacagtagtaccagttacatcaccactgcttttatgcttgtttctggacatcctgggcttgaaatagagatgctgtactctatayagtacagtatacaaaagcacaaccatttataaaggatgcatgcatctgacactttactctggacacctgaattaacttacgtgattagacatgtgaactcatgctcatatctttgaacgtctgcaccttgaagagtcatatgtaggggacttactgaatagtctggagagtggactgaccacaataaagtgagcaaaagaaagttagggaactctattatctttcttaactaatttctagaaaatgatctgttttattcctcaggcatatagcatgaacatgacttttcgtttttcataa

SEQ ID NO: 21297 - DNA, 600 bp, Bovine  MMBT12972
tccacactgagtatacaacataaaaatataacttaagtcttttctgtgactaatgtggttctggtatataactttatgtaaagataagtctgagtatcccagcagaacactcattatttaataactctggtgagaacctggaatacttgtattttgtgttgtcatctcattgaaaacatacctattaaactttgggtagtggtttatcatgtggcaagactgacacattgttgccacatggagaagtctgacctgcattcttgcccagctaaggagctacttaccaggcaggtagctgcraaggtgtggtcacaggcagatttcagagagaaccttgactcataccaaatttgaattaacctctgactgaaacttccatttctacatcatagccaagctgagttcattttaacctggacagttaccaggcgtagctgttgtcatccactttgacaatagaacttaagtggaatattgggttttgggtgacagagttcccagtggatctgtaaaataaaaattwtaggatgtggttttagttattagattgaattaacttactagatagagtttagtgttagccatccgaacagtgaaaaa

SEQ ID NO: 21298 - DNA, 600 bp, Bovine  MMBT03513
gtcagacaatttttgttttgtaacygaatattgattgagagagaaatggaaaagattacaggaatcgtcattcatttttgcaaaataagttgtagtttccacatkccatatcaaataacaaatcatatagcaccatctaaaattttggggcattgctcttttccaaacttgctattttataaagaattttagttttgtgttcactgaacaccaagcagagcatgagtctctcttagcttggttgctgaacatgtgatttaaataggttttatatattagratgccctttttttattctcmtggaccaaattaatctgagctcaattgtagaactctaaaaagtactgcggtggaggtgtcagcaacactagcatcaagatcagcaaaggcactgttaaatgtgacattttgcaattaattctagcaaaggtgttcagtcacatcatcccttcagtataatttgtatttgacccttgataatacatactttcttacatttcaagttcattgtttttaagaaatgattttcttcagaacctcctagacttctggtcttaacttggagtgctttttgcttttgcagttgtcttttctttgtac

SEQ ID NO: 21299 - DNA, 598 bp, Bovine  MMBT13769
  misc_feature (1)..(89): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagagagccctaggaaggccaggctgcagccttggcagggccccggggcactgcagccctggatgggcaaccatgcctgtgaacccagcaggccccagaccctggctctgtccctgctcttcaagagggtcagcccgagctccctgcagaggtgacaggctcaggaggatcctggggaccaagggctaaggaaactggagagcagaaggrgacatccaagggcagagatgtaggagcagaggggcttggaggggaaagtcctggcrtccagggctttacaggggcaggrgactgggagggctatgcaagaatgtcttttcctgcagtttctcctctcttcccatcccccagctgaggagagygcccccaaccatggctgccagagccccagcccagcctcccaagatggagaggaggaaaaggagggggctgtcttcccagagaggacggtttcyaccaggaatgctaaggtgagagccagcaaggctgtggggagggacctttgatg

SEQ ID NO: 21300 - DNA, 600 bp, Bovine  MMBT07036
tgttcctcatttaaaaataaactcatttaaacaatgagaactaattaccacattaatttattgtcaacacagctaagtacaggcaggcatatataataacgtgtaaactaccaagtgagcagaataaaagggaaatgtagtggggttcacctccatgatactgttcatgtaactcactaaagctgtatttgaggttctgttttgtagtttaattaatatcattatgcaaaaatcggcgcccatacatttcccataatactttatctgcatctctttatcctattagttgatgttgatttytccgtgtgtataagggaccaactccagggtgcccacccttgatcctcatcagctagtgtttatgtccytgcaaactccccttctgttgactgtgaataagacttatgatttgagtcaaattgacagratatgtcatgtctcttccacaattatataagcctggatcttgtagcggattgcctctaatctgcagtagtccttgctgcttgacaagtatgcagttctattagggaagcccacatggtaagaaactgtggacagtgtttaggaaataagaaacagacttcaggagccgaaggc

SEQ ID NO: 21301 - DNA, 600 bp, Bovine  MMBT18895
agtggataagaatccaccttccaatgcaggggacacaggttcaatccctgatccaggaaaatcccacatacctcagggcagctaagcccacgtggcacagctgggaagccatcgctctatggcctgtgcgctgcccctacggaagcccscacacctagagcccgtgctctgcagcaagagaagcctgtgcactgtaacgaagagtagcccccgygtgcagcagytagagaaagccatcgcacagcaaggaagacccggcacaaccaaaaattaatcagttatttattttaaaaaagaatyrggattggaagggggaccagggagaatccatctcatagatggcagtgtgctctaccacaagacctcagtaccccatccacagctgacacaccaggagtgagtatctgatgcccagaacaacaatttctaggctggcctgcagtctagttggygcaaaagcttatgcatcaggagtagtggtagggaactagatcagtaagagcctctctctgatctacattcacatactagaatcacagggatgagaacctgcttgttaggggacaatgagacaactcagatctagaagaacctgtagtc

SEQ ID NO: 21302 - DNA, 600 bp, Bovine  MMBT22515
aactctggataactgtcctgacaagctaagaaaaatgacattgggtgtggttgaaggttggtagctagctgcttcgaggataaatgtttccagtgacttccgaggactcaggaataaaggaataaaaatcaccctgaatatctgaacgcataaaagctattttcaggaaatgcaatgctaccttgaaacatatgtctcttcccagtttgttttattcttaccgttttgggttgttgttgttttttaatcctctctttctcttccttcagaatgaggtaggtaattgatttctttatcaasatgccgggtgatacatttttcacggctttcagggagcacagaaaatctaaaaccattgtctggcagatgcagctttcagctgcaatcatctttatcatcaggtaagcctgctggcatatgtttttcaaattttattcagaagcgttgtcttttactggtcaagtaacattctttgtgattgcgttatccaaaaataaaaaagaatttttagcaatgatcgaaataaagcttgttagatcattttaatggtaatgaattggttcctgaagatttgattaaagagaaaactaggtcaattta

SEQ ID NO: 21303 - DNA, 600 bp, Bovine  MMBT21408
cagggacgtggggaaatgggggctgtcgcaggaaccctaacgcattgttggattacagagcagctgggcagctttctacatcttcatcctctgttctaagccacccgccatcagcaaataagacttgtcgtccaaccacaccatcccacttgtgaccttagttttcacttgagtagtctattttagcgtctgtatttcttgattgggagcccacttggtgtttttggtagatgtgaattttctgtgatgcttagaaaattttcttggtgatcagtgtaagtactggctgggatatactcratgaaaattttccccatggagacccatcatttctcatagaatctctcacctctttctgtaccgccttggaagcagagtatggtggatgctgacagatgagactaagagagagggaaaatggccagctccwgcagctagctgtcatccatttgatcaaagaaacatggtagcaattacacggatttttaaaattaacttctagagacatttttatacaatagttggttagtaacagggtaccgcgtctccttggggaattttatctgtttttcccacttttcaaaccagcttagaagcaaa

SEQ ID NO: 21304 - DNA, 600 bp, Bovine  MMBT11130
tattttaccagttatataagtctaatagaggagaaaaagtcctcttaccacctctctttgggaacagtttcttagaattttcctgactaatacgggatcacgtcagtttgctcatttctcatcttctgtagctcatgccacacaaccaatccaaacccactccctttctaaagccaacccaagactcttcaaagtgaactgtatttgtatctgctctgtggtggagaggaaacgcttgggcaagggtcaacagagaattgctcatcaaattctagaatggttgggcagtgagacactctktgaagttggaaggaagcatctgagggtaaataagagagaacggcatcrkgtattgaatagtactcatttggaattggtcactcctcatggaaacctggaaccccaatgccaaacccatacacgtttgttgaatgaatgaatggaataaatagggtgaaacagagtttggataaactcacagatgattgatatgtaactgattagaaaaggagattctatttcttttaggctatggaccctctacttctttctcctttccccttcctctgttaattatgtgaatgacaaagaaagagatac

SEQ ID NO: 21305 - DNA, 600 bp, Bovine  MMBT07985
tcattaacctattcattcttcatggtggcaagggatctggttacatctagtagattgaaacctgagtcagtgtttattgggctgggcctcttctcagatgaacatttacatgttaaataagaggcattgtaccttccaagtttgcactttacagtgtggtatagakcgagatttgtttccatgccatttgatatactggttacagagtgatccacctccaattctttttacttgaatgtgccctattatcatttcatgattagtaggatatccagaaggttcaggcctcaggagattagrgactgagtttatacacacaactttccattagggttatgyagatcatctatcattttgtcacaggttgttggattcgatgtgayttactcactcttctctgaaatcaccccttttgttaaaacatataaaaatgcatacaataatttttaaatacgacatgtatttaagtgaaatcaccatgtccctaattataagcctaattaaatacttatcatggtttagtatactcgccctacttaaattttcacactctaaattttattttaaagtttatatacttaattacaatctcatgttttt

SEQ ID NO: 21306 - DNA, 600 bp, Bovine  MMBT20251
cacagtcttcaccgttaggtcttcaaaggaataattcacatcctgattctcacacctaggaaaagcacagaaggctgctcttcttaggagacaaacaggacggccaagaccctcaactcccaccgaaggttccaagcccagagttcagactactctcctattcctcctggtgcaagcaagcaggattcctccccctcrgycccctcacatcagtgyccagactgatccgtggggcccaggcctccttacccctctgcttggcctgtatctttacaatctactcaaccrcccataagcagraaagagctcatacctggtcaacacctctgctggattctgtgaagagaagaaagaaagaagttatgtaccctcgccgtgagatctgttactcaacttggtgagcagctacttttctgtcagttgcttttgtgagcatcacacatgatctccygctgccaagcccaacagggttaacacagggcagtcttttttcgtgtgagccctctgccgtatttaacaacgttgacccatcctttcctygaaaccctcctcttcctcctttggcactatgacatgagctgtctcctggctctccgtcta

SEQ ID NO: 21307 - DNA, 600 bp, Bovine  MMBT20252
actctcctattcctcctggtgcaagcaagcaggattcctccccctcrgycccctcacatcagtgyccagactgatccgtggggcccaggcctccttacccctctgcttggcctgtatctttacaatctactcaaccrcccataagcagraaagagctcatacctggtcaacacctctgctggattctgtgaagagaagaaagaaagaagttatgtaccctcgccgtgagatctgttactcaacttggtgagcagctacttttctgtcagttgcttttgtgagcatcacacatgatctccygctgccaagcccaacagggttaacacagggcagtcttttttcgtgtgagccctctgccgtatttaacaacgttgacccatcctttcctygaaaccctcctcttcctcctttggcactatgacatgagctgtctcctggctctccgtctacttctccatctacactctttcaatcacagacaagtgttaatgaggatgtggtgggaatataaaatggttcagccactttggaaaaaggcagtttcttaaaaagttaaatataaatataccatcagttcagttcagttcagtcgctcagtcg

SEQ ID NO: 21308 - DNA, 600 bp, Bovine  MMBT20649
tcctttgtcccttgttgagaaaatatgaggagagcataagaatatgggttcacacggtcttgaacaagtggcacatttgaatcaattaaggattatatttacacaaatatgttccacttctgcacagaggttaacctgagttctgaaatgcttgagtgcatcaaaaatgataaagctatgaactagtcacatacccaacaaacctagttaacttggagccatctctctgtgagccagtgggagttaagaaggtgggctcaccaactccaaggattctgtttctttattttctccaaattktgctagaaagcatcttgaatgagactccaggtggctagacaggttcgggcaaagtcttgtctttgacactatcgattcagctttcccaaactctccgaaaagggaagcacctcgaatgtccggtcccacccccaccctccacccctcagcgccttcctctctgagctcaaccttggaatgacagaggtctgtaaaaggatgtctcagccagagctctcatggatcttaaacgtttctggcgagctccccaaggcccgcgcgctcaaagccactacttgaagtagttgagtccygccacca

SEQ ID NO: 21309 - DNA, 415 bp, Bovine  MMBT13873
ttaactaaaaaatatagagaaacctcactggccatcttataggttgctaggcaaatgttaagtcaataaatatattcctttgactaacaatccttggtttgatcagttgtaaccagattcttaaagtcacattccaaaaaacttggctacttttgcatagcaatctgccttggcagcttttcccagaagggacctgtaggtctggcaattgctcagaatttcatgagtagtccagtcacaaatagaagatgctcccaaaggtaattatgagactttcatcagtacagtaattttaagcayggctttactaaagtagcatcaaattctaattggatccactaggcttaatttaaggagccatagaggactaattctaatgtactgttacatccagtatatcagcacaatattatat

SEQ ID NO: 21310 - DNA, 600 bp, Bovine  MMBT20168
tgcttcaaaagatgatctgtctctggggaatagggatgtgctacagactctgcaactgttggtgccgctctcattacagagtctaaccaaatgggatttcaagagcagcttcccaaagaatcattataaggacatttaggtctaaccagatgcatcaagatgtcagattctcatggcctttgcattaattcaaataaagtaagcccttctctgaggttttgaaatgttcagtttcttttttactaaaatactgactcttggagtggaaagcgattgaagtaaagttatgtcttatttacrttattgtgcaaaaggaataagtaaaatgaaaaatctcatttgaaagtattttgtggtttgctaaataaaagcaatatattggtaaaaaacagcaagaaaaagaatattgtgtcttaggaattaagaaatttatcaaactattcagttacaaataccttttgtatgttttgttatatgtcagactctgtgctaggctccaggcaagcccaagaagtaaataccctttctgttgttaaggcacttctagtctaatggtatttcccctgagaactagaagaactgctgtacaatagggtctca

SEQ ID NO: 21311 - DNA, 600 bp, Bovine  MMBT13147
ctgcttccctcgtagggtcgctgccaagccccaatgagatgagtgtgtgacaatgctttgtggattgtgtggttgcagacctgtaagctattattatttccccagctaccgtcgttaagggctcagcggtgccctgcaaccaaatcttctaaggaaatctaagttctcactgagaagcaaacaaaacaagttcattccatcttggcaacaatcagaaaatcagacggaataaaatccttgggagagaaaaatgtcttttgccagaactgcagcccactcaggaactttaagttccaagcytccaactcrgctgaaacctcttccatttctagctcttcttgtcattggaaaaggcaacacagtgagtgagggaaatgtcccttactaggagactttctggaccttttttgcacttgcaaaatagtatcttgaatgacccccaagtgattcagaaatgaggagacttcacyggcttatyaacaccatcaatgcttcatgcaacatgtagcatggatttttcctcctctttaaggagacatcttcctgtctttcctgccttggaataaaatgcattttatggatttcagggtgtcttcttct

SEQ ID NO: 21312 - DNA, 600 bp, Bovine  MMBT20672; identical to SEQ ID NO: 4822

SEQ ID NO: 21313 - DNA, 600 bp, Bovine  MMBT15759
aaaacattggcataagtcctccatgtaggtagggaatagtgtggatagccagaagcatagcaagtagaagaaagcagtggtcccagaaagagatgcatatgagcacagtgatacagagtaaggagcaaaacacattccaaagatacccccacactcaaagtcaaccattatccctccaaaggtgaaattctaggatgctttccagtgtgggaataattgtatttctcacgaactgttcttcctctgttatactgtaatttcctttagtgactccaaccttttaataaaattggttatacytatgaaggcttgcatagcggtgctttggacaacaaggaaaaagagaagtaaaggttggtgtgatttttctgatgtgcaagcatactctggaaggggttgtatgtgggagatccaagtggtgttcatcagagtgagatatagagcacacaaccttaagaagctgcaattccatgaataatccatgactcaaaaagaatacgaaactaaccctcactaactgaatacaagaggaggtgcagaaatagaatgaacagcagaaatatatatatacacacacatacgtacacaatatctgtaaat

SEQ ID NO: 21314 - DNA, 600 bp, Bovine  MMBT22568
ggcagccagcagtggtaactactaggaactcagttcagttcagttgctcagtcgtgtccaactctttgcgaccccacagactgcagcacgcaggcagctggactgactgaaaaagttatagatcctataatccatgtttttggttgcttcttactagcatttttacctctgttccttcttggatggttttctgtccccaccagccatgcacttttttatgtcattraatatcttatcrggaagaagtgtgttttctactaacgggaattttaaatagtattaaagcagatcttgtacttytgaagaatttgacactgatcacaggtacagtagggatactgacaaaaaacgagccctgctgttgccatatgtgcacagaaagaaaccagttactgaagcaagctggtcaatactgttttaggtgcaaaatttccaatcaagtggacagctcctgaggctgcactgtatggtcgatttacaatcaagtctgatgtatggtcatttggaattctacagacagaactggtaacaaagggcagagtgccatatccaggtgagcttgcattcatgtacctggagtttatgggggagaggcctttt

SEQ ID NO: 21315 - DNA, 600 bp, Bovine  MMBT20747
ttcttttgtttccattttttcctaacacatcatatgcataaaacttcctctaagatttagacataacctgtatataaccagacattatttacagagggcatctctttatctactattatttttatgggaaaaggaaataccttgcagaagaagtgagacagaagttaggaaatcatagcaatagtaaattacttttatcaatttttttaattgttatgttctgaaatttatagaaactatataagatctagttttcaaaaccatgccaagcatacaaactaaagtgagacctgctctacrcccttagagttactctggmtcgaatgtcctgtgacaattatgataagaatccatttactggacacagataggaaggatgacaactttatcaatccaccaggaatcaatggaacaacagcagtttctggggtattttgtcaaataaataacactgaggttaaagctgaactactggaagggaaaagctgtcatgctgagatgtgtttgttgaagaaaaggatttcaaaaatgataaatatgaagtaaaaatggaatgtctgggaaaactgaagatgaactaggatatgaagaactttattg

SEQ ID NO: 21316 - DNA, 600 bp, Bovine  MMBT06544
tgagccccagtcctgcctgaaaccgaaagacttccgtgacctctctgcctgattcattaaggctgacatctgcacacagcttacaatgatacaatgaacttgcactgttctttcctttgagcctttgtgacaccttccctgcccaccsccaccccmccccccagcccaggagagaggaattgttatgaataagttcacagggctttcgagatgttaaaaaatctgcctaaggccacacagctgataggtgtcaaagtcagatgcaaaccctgtgagcactttccggggctcctttgacaygaacagaaggtattggctgtgtcatcagacctaaggtacagtcccctgatccttccccctgcccccaggctgcctcccatcccctttcttgtgtcatgttctcctctgggtggccaagatcctaggggtgtatctgtgtaacccagttctaatcagcaccaattctgatcaaccgccwgaatgttggatgactttggaacyttggatgaatccaacttccctcacctggctggctgaragctcttggagtgaattayataattaggaagaggatggagccactacagatccactgcgcag

SEQ ID NO: 21317 - DNA, 600 bp, Bovine  MMBT09656
cctgtgcatcccgtccacgtgtcctggttcctccagggggtggcctgtcctagtctagactggggttccagcctgttgggttcaagtgtactgcgatgaggggggtctttgggtacttcgatacactggccttgctgatgggctttccctgtgctgggcttgagctgaaggactcgtagcccagtgggacatcttaactctccctgagctggttctgatttgcagagaatgtgagaaagagggggaagcaagtcaggccaaggagtcaggaccttgggttctagtctcggctctgctgtygtcttgctgcgtgactctagatacatcgcccacctttctctgggcctcacacagtttgctctttgtccaatggccagccagttccctggatcaaagtcctctggaaataaacatcggtttaacctaaggaagatgtttctgacttggctcccacagttcagggtttgaagatcccagttctgtggcccattcaactttgtgatctggagaaacttgctttacttctctgagcctcagtttcctcatcttcaatagggggataacacttctctgtttgaaggactattgtgagaaaaaact

SEQ ID NO: 21318 - DNA, 579 bp, Bovine  MMBT14868
tcactaatctctgtcagcaatattcacacatgcaagaaaatgaaattatatttcatatctaatctaatgttctggtccagagtaactaactaggattattgatatattccccagaattataaatcttctgaatgttataaatactttaactgaaattactttaaattataattactttctccttcaatctaaaaatgagaattttgaatatatgtagatgggtctaaatgtatttacttctcaattcaagctaaatttataaatgttaagtttatataatttgctgaaaaatattaaccrttttagatttctttagagggataccagagacttttcttgcatataacagtgatgactggctagtcagcagcctgttactagtagcttttaatttcaaagtagactaataagagttgactggtgggtgtctgtgcacgttcttgagtgataatcagtatagaattaatcgtcagtagaggcttatgtcataagctgactgtctaaatgatgaatatataatgaaattaaacagaattgagacagatggttctaacttttgataaatgtgcatatcttcat

SEQ ID NO: 21319 - DNA, 600 bp, Bovine  MMBT21503
ggacacgacttagtgagtaaacaacattcagagcagaataaaaggtgctgcagaagcgacattaacccaggattcctcatacacaggtcacctgttagattattatcttgaagtcctcaagttcaagaaaccataccctggccatccagcttgttttccatctggcccacccagacctggctctgccccttcccctccccctgtcascagatatgctaagggcacaacagtcccactgggtcctgagtccccaaaacttcacaacaaaacctgtcttctcccaaatgaaatkcaagggtycttaccttcacagaggcgagattttgtttctttgttgctttcaacatcgggaaggatgtcaaactgcctttccttggctttttagcatccatttcagtcctgcagaaggagatgaaaaggtaaactggcattagaagtaaaacacagcaagtcccctacacaggaaccttcaagttgcgaattttcaaagatgcaagcgtgtgttcacacgtccagtcacggaagtgagttcacrtgtctggcgtccatcgtcacgtgcatgcgtcctctagagctgggtgtgcttctgtggactttacc

SEQ ID NO: 21320 - DNA, 498 bp, Bovine  MMBT21504
ctgggtcctgagtccccaaaacttcacaacaaaacctgtcttctcccaaatgaaatkcaagggtycttaccttcacagaggcgagattttgtttctttgttgctttcaacatcgggaaggatgtcaaactgcctttccttggctttttagcatccatttcagtcctgcagaaggagatgaaaaggtaaactggcattagaagtaaaacacagcaagtcccctacacaggaaccttcaagttgcgaattttcaaagatgcaagcgtgtgttcacacgtccagtcacggaagtgagttcacrtgtctggcgtccatcgtcacgtgcatgcgtcctctagagctgggtgtgcttctgtggactttaccttataggactattgctgtacaacatgagaaccttactaatgaagacctgatggaattggaggcccagagaaaggacaaatgtagacaagaggaagatgaacaaactgaagaagagacacacgacgcagaagag

SEQ ID NO: 21321 - DNA, 600 bp, Bovine  MMBT09863
ccttggaggcatgagaatgcaacagtctcatcagaggcccacaggactgcaaawtaagaagccgattcagagatagggctattctcttcatccatgcttccttctaacccagttccttcaagggaactgcacccgttgkgggagtcataaatcaagagctgctgtgagacactctgctctttcctgctgccaaaagggaaaagagaggtttttctttgaaatggcatttacttggcatcgctcggagtttcggtagtgccaacgactgttataaacaagcccttttaaaaaataccttcyacagtatactaattggtgaatgaagtttcaattaatacaagctacaagtgagcaaatgtgaatctgtggaaaaattatttctgcataatgtaacaatgtcagggatacaagttaaaagctgtgagaattctattccagaaaccatcaggtcttctactgtggtttattatcctgatcattcatttcaacttgtccagagaaaagtgttcagattctgcttaaatgtgtacagtttattcatctatccttcaatttccccaccacgtaaatgatgcatttcctaaaaggcagtttctttta

SEQ ID NO: 21322 - DNA, 598 bp, Bovine  MMBT13092
  misc_feature (1)..(54): n is any nucleotide
nnnnnnnnnnnnnnnnnnnnnnnnnnnnnnnnnnnnnnnnnnnnnnnnnnnnnnattggttgatgagactacgtccagtttttgtgccagttgtagtcagcttcatttcctggttctcacacagccgcctgacactgttgtgtttggattcccaacacggctgggggatgtttatgtccccacccagacagctgtgctcattgaaacagaaggatcgttgatgctgtttacttccagaatggtaaaacgccgaaactcctcgtctctaaaaaatggttactattttatttaaaggtgaaytaaagctgtttatctcaactcagcactatcttataatggttttcccaagttagcgtcaattgaaaatgctcttatgttatttttaaagtgtcaaaaaatggtaggtcttggaaattctgcagatttttatttctggcataattggaagatttggaatatggttaagagagtgtttccatctatttattctaaattggccaagtctggaaaattacagagatggctggtccttttgtcatgagttcccaaaatcagaattgcttggctgatggccggactctgactttcttgaaaagtt

SEQ ID NO: 21323 - DNA, 600 bp, Bovine  MMBT05317; identical to SEQ ID NO: 4528

SEQ ID NO: 21324 - DNA, 600 bp, Bovine  MMBT00535
cttgtaaagcagcaggtcggctttgcaatgccttctaaaggtgaggacgccaaaggggggaaggggcttgtccgtggctgacccagccgtggcctccccagcccttctgactcccagccttgggggtgagtggccctgtcacctggtgaggagctgcccgaggcttcgaggagccagctgtctcgccctcctggctcacggccccgtttctcggcctgcaggaggccggccgccgtgagcaatggggacgctgtggacgcagctttctccgaggtccagcgctccggctggaggcggaasagttcccgtcgcagtaagtccccctccctaccctgccccccaggtctcagccccaggaggctggtgccaggagagccccccttctctaggccaagggagctgattcgggctcatgctccctgaggggctgtcctcgctacatgggcttagtggcagctctgaggcagacgggccactgcccacccatgagactygccccctttgccaccctggagccatggtcccggagtagatcacacatccagctgttcatctgtccccttccccctcaagctcctacaggtcgatctgggtggtggg

SEQ ID NO: 21325 - DNA, 600 bp, Bovine  MMBT18491
ctcacggccccgtttctcggcctgcaggaggccggccgccgtgagcaatggggacgctgtggacgcagctttctccgaggtccagcgctccggctggaggcggaasagttcccgtcgcagtaagtccccctccctaccctgccccccaggtctcagccccaggaggctggtgccaggagagccccccttctctaggccaagggagctgattcgggctcatgctccctgaggggctgtcctcgctacatgggcttagtggcagctctgaggcagacgggccactgcccacccatgagactygccccctttgccaccctggagccatggtcccggagtagatcacacatccagctgttcatctgtccccttccccctcaagctcctacaggtcgatctgggtggtgggtgttccccagtgcccaagatgagggggtccctctgacagcagtaccagacacatgggtgggctcttacggtgcagagagcaggtgccaggaggagggtgggagctgagagagcccacgaggaccgaggcagagtgcagagaagcaggcgtcagggccagagtgttcagattgagggcgaggggacccctggcac

SEQ ID NO: 21326 - DNA, 600 bp, Bovine  MMBT06991
cctcrgcataaccttcttgctgtttgggagaagtacaaaccttgctattcaaagtaggatttttagaccaccacctggaaacttctagaaatacagaatattgtcatccccycctccacccaggaacagaatctgcattttaacaaaatccactgttatgcatagtgatgtttgagagtaaataaagaatgaaggtgagaagaaggagaggagggtggtggtaccctggtttataaaggaattttgacattaaaattttattgttttctgtctttagaaataactacaaagattactcgytggagtcaagactacacttcagaattcaggcagctcttcacctctggaaaaaatcgtcttcagattgatcagaacatgaaggatggacttttctctcaattcataccggcgtatactatagattaggccttgtattaaagtggaaaaatgatcttgtgaatgagagacaaaaaactaattttactgtcaatattttctataatttgtgtggtttattcttggtctacttaagtgtttttttttttttttctctatggaatgatgatcagtaatatcttgaaaacttatattttgcatctt

SEQ ID NO: 21327 - DNA, 600 bp, Bovine  MMBT08280
atctctaattttcttgaagagatgtctagtctttcccattctatttttacagttttagataaatcacctaaccctttcagtcctggtgtcttcatttatgcaacaaagagacaagtctaggtattttctaatcttatgcttgttactaatattacacacatttctaattattattctcaaccatgcaaaggataaagcttgtaactgagcctgtttcttaaccttgtgccccctcaagatttgggcacactaatatttagacaaagaagcacacaactttcatttttttctgatcaattmaaaaagaaacaactgatgttttacaagagggaaagaatattgattttatttatttttatttttgaactgaagaatgacggcaaataataataaaattgcagggtaataaactatgctggcataaacatttaggaccagtaaaggaaatcatcagattctatgtcatttatacataaaatttagagagcaaacagttatcctttcaaagattttaatttatattccaaaatgaacaattaaagattgcataattatataacattgctattgttagatatgtgaatatatgtatattttcct

SEQ ID NO: 21328 - DNA, 600 bp, Bovine  MMBT11809
cctagagtgttttagagaggaagaggcctccatatgaatgatttcttctttactccgccatggcaatgcagacttggaggaaatgttaaattacctttttgtatgctccttgaatttttaacagrtcatctttgaattatcttaaaaaataaaagcaacatggttttcctgattgtaaaattaaaccttgttcatgaagaacatagacacaaaaatgcaaatcacccacgactccaccatgcaaaagtaacacctgttaacatttgaatttctctttttatgactatttcattacattaytgargtaagattctaggtaatttggtaggttatttttttccattgatattaatggaaaacatgaataatattttctcatgttattaacactcttcagtaacataatggtagtggcttcctcttaatattattccattayatgaatrtgctattactactttaaccatctccctactgttgagaatctgctaattctgtatgataattttattttgttttcttgattgtttccttagggtagattcccagaaataaaattactgggccaaatgaaatgagattttaaagaatgcttcttcc

SEQ ID NO: 21329 - DNA, 564 bp, Bovine  MMBT20065
ttctagatattataagttattatattatattatatctatataatatcttatatagatattataagtttctagatattataagttaatttgtacacataaccaagcagtactccttcccctcacttccttatgtaggctcaagttccatgctacaaacagcaagttttctacctgttgtacacaccagaccttcaaccatttgtgaaaacaatcatgttttccctagtattttcttataaggtcaaacactcccattacctttctaaaccttttgctcagcttttagagccatcaacatcycagtcattcctctttgaatgaactctaatttgtcaactactctcttaaacggtgatgtcaagaatgtgctctgactggctatggtcacagctggatcattgcttcctttaatctgtatgtttggtatcttcttaatacagagagtacattgtttgccaatatatcagagcatattgaaaatgtgtttgtggcttataaaatatgtatttgtgggcactggagattgcactattatcctagcatatagaagctaatgagaagtaa

SEQ ID NO: 21330 - DNA, 598 bp, Bovine  MMBT13995
  misc_feature (1)..(42): n is any nucleotide
nnnnnnnnnnnnnnnnnnnnnnnnnnnnnnnnnnnnnnnnnnttttgtccccagatgggttgcctatatcccggtcttgtggagagctcaggctgagaagtcggctggtgaatagctcatgctcttgggtcacacttgagggttcaaatttggctccagaacctcctaaccatgtgactctgggctgcagacttcacctctctaaggaaagggcaggacacacacccgcctgccagcgcgtagtgaagagtgaatgacgggacacagcccggagcccggcacagacaagcgccctgttayagcagcggccgctgggatgttgctcatggtgtgctgttattatcaccagtgtggtgattggtccacgtggctgtggggggcggcgcaagggcagtgggctcagcctcgcggtcagcttagagcccaccacccccttcccacaccatgggggagagcttcccgtggtgatgggcatgccctctgtctgccctgtacctggtggtggccactggcttcatggcactggtgagcacttgaaatgtagttagcataactcaggaactgaacctttattgccttgaaaaattactttcttggg

SEQ ID NO: 21331 - DNA, 600 bp, Bovine  MMBT04380; identical to SEQ ID NO: 4713

SEQ ID NO: 21332 - DNA, 598 bp, Bovine  MMBT20119
  misc_feature (1)..(103): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttatagtcgaagccatactggttcaaaaactgaacactggaagcctggaaagagaactctgagtccaaaaccccaaatgtcgtagggaagaggaagaagttacatgaatgagctacatacctagcaacaaaaacaaacagaaggagaaaaagacagaaaacacttaaaattctggctcatggagcaggcttcckagtgggctcctccttccccttgagaagtccagctgacccctgaacaacatgggggttaggggcaccagctgttcttacagccagacatctgagtatactttagagcctgccctgggtccagmcacaggccctctgcacccacagaccccactgtggggcgtacagtaccacagtgtgtatttagtgagtgtaagtgggctcaggcagttcaaaccctgyrttattcaagggttcgctgtatttgaatgccagctgtgtttcaagtactatgactggtgctgggggccagtgaacaaag

SEQ ID NO: 21333 - DNA, 600 bp, Bovine  MMBT09247
tccctacctgtttgtctcctgttcacctccaaggccaagtttagagcctacctggactccattcaactcagcttctgccctgagtccctgtggaatgaatactgttcaccggccagtctcctggccaccatgtggctgcctaaaggtaataactttgtcttcacatctgtattctctacatgcttcaaaggtggggctttgcttctcaaaatgtttatggtccagcagaatcagcattacctggagcttgtgagaagagtcacaggctccacccagacctgctaaatcagaatcttccaytgaacaagatacctgggtaatactaatacacggccatgttcaagtttaagacgctggatggaatagggtggggaacacttaatcagtgatcctggaatttacttgaggcaatcaattattcctgatgacgttctctctcttccaagaggacaccaccaacagttaagggaatgcaaaccctccagcccttctcctagccctgcagtggctccctgccgtgaactctgcagagcttggtggccagtttccacgtacctaccacctacaccttctactttcaaagaaaccacaacctggacc

SEQ ID NO: 21334 - DNA, 602 bp, Bovine  MMBT21183
  misc_feature (1)..(2): n is any nucleotide
nnacattagtccagaacagccccagcattgattggacttcagcttaactgtgtgagtttattttgtgtataaattctgaaggcttcattctgaggcttgtttttttttttttgggtgcaccctgcagcatgtaggatcttagtttcttgaccatggatcaaacctgggccccctttgttgggagcagagtcttaactcctggactaccaggggagtcccatgtctttctcttcctctcttagtcacctggcaaaaaccwtaatcctaggagacccagttgtctcttactctgaacctcaccygagttgcagcacatggccagagaaaagtcaggcaattgtgttaaccatactcgcttcaaatctatgaccaaaacatccagtgggcagtaaagcctgcagtatggttctgccacacttgtgctggtaaattcccttccccacaccctgaggtgactcttattttgctcctctctctcctcacgtttcccacagcccttgaccatgaccctactctcacacactttggagagaagccagagaaccccgctctgaccaccgccaactttacccactcttctcacctttgtatctttgtgattt

SEQ ID NO: 21335 - DNA, 600 bp, Bovine  MMBT22627
cttatgctattcttgcttcctggaacatctcacaagtgccagcatggagaactcctacttgttctttaaagagctaaagtgaaaagtgaaagtgctagtcactcagtcgtgtctgactctttgctaycccatggactatatagcctctgttcacagaattctccagggaagaatactggagtgggttgccattcctttctccaggggatccttctgagccagggattgarcctgggtatcctacaytgcaggcagacttatattgtctgagacaccagggaaggtaaagtttcatctaamcctagcaaggcttgtttcactccttcaagaatcattcttcattcgtgaatgaatttatgtccctttttttcttgaataaaaatgaataaatgaatgaatgagcttatgccccgtcatgcatttttttgtaaaagcattcagattgtgccatggtgttaaactgccttgtttctggctcctacatttaggcattcagtttctgttgagggtcagaattttgatgatacttattcatcttaaaatctccaactttgtatataccatctgttgggtagaaagttttttctcatttcataggtt

SEQ ID NO: 21336 - DNA, 600 bp, Bovine  MMBT18850
ttaaaaataaaactaaacaaaatcatctcagcaaagtgaagatgatccttcctttcaggccttcaccatatgtttgaatgtttgaccaaagtttatatttgaactgtatgaaaaaaattgaggaaggcaaataatttaacatttttctcacaaggctgatcaccacagccaggtgaactctcaaagggcaggtttctttgtccattgtttatacatagtaggcatttaaaaggtactcaaaaaatacttgttgaattgracagaatcaacatgtctgtggctgcccttattaggtaaggygaaatccgactagaaataaaagttgtttccctttcacttattttgtgccagagcccctagcccctccccccccccaatgttaatgaaataccaaagaaaacaatggcagtactgagaaatgcctgtttaaattctttcagtgttattctgaaattgtgactcttaactgtttcctttatcacagataacagtatttgaataaatcttcatttgatggatgagtcacctgccgtaccccagtctactcccccttactttaaaaatttttccttcagaaagggaagccagacatatctttag

SEQ ID NO: 21337 - DNA, 509 bp, Bovine  MMBT05807
ctaccctgtctcaccaccctgtccacctccctcctgcacacagtcatgtccttttatagtccagccctcttgttagcccctctttatcctccaatctcaccccagccactaagatgtcattgcagtaggcctgtttgcccattcaactgtgaaggcttgtatcattaactcatcatgaaccatacccactgagcccagtcaacttcagaatactcctggaggcacccccagtagcttatctccaatgaccagagcaggcactggaggtgaagcctctccctggttgacctgttgttcagmctgtgtacctcccttccatctttccaagactgcttcttgtctcttccactcaaggttaaatgatcgaaatagctcttgcctgtttccttgcctaagacacacctggcagctttgtacaacagcccaagttccatgtaattctttgcaaggatgctctgctagaaaggcaggagattgggatcccttggtaacatcacagtatcttaggg

SEQ ID NO: 21338 - DNA, 600 bp, Bovine  MMBT07356
tgccattctcataagatacgtgttaagcatgttagtgttcacctgaatgagctcgtgggtatcggcaccaggttgcttcagctgcaggaaaacccrgacccagtgtgtgttaatggcagtccatagacagccaggttgcagagcagacggaggtcgacctgtggtagagattcgtgtcactctgtaggacagaggcatcgaactcttgttcctctctgagttattcccaaatctccactaggcttaggagtgactttgagaggaataaactccggatacctctgtgggtgagaaagatayctgagaaaacatacacttgtgattctgtcattcggggagaaagtatcttggtatgctttgacttgttaactaccaccgttccttctagggcagtaacagacattacacaaacttgagccaaaaaggtatgtatggtttttgtcctttatagaaaattactttttgactgacagcctctcccctgcacctgccacactctgctttgggatcaggctctgcagaccacatttctcctctgcgactggctttgtgttaggttctaccgatcatgggccacgtgggagacaggagcccctagga

SEQ ID NO: 21339 - DNA, 600 bp, Bovine  MMBT03943
caaaagctctggggtgctcaactgggctccawctcaagtgctaaaratcttctactggcttattttgaaaaattatttatacaaagtcatgcttgtaacattctgggctctcgtggttattagatttcacaccgaagagggctgagggctaagagtatcaytacaaggagaaacatgagggaggcagatactcaaagagtctgaattcacacctccactggagatactgagagaaaatataggcctgagagctccctggaaggcgagataagagaaattatagatgagggagctctttgyggcatcatagaacgatatctgctcatactcgtagtccaggaaaactccaactctgtgcacttgctctctcaaggagacccttttgaaaggggggaaagtccagaaggtgtgatcggttcccatgagagatcctgtgagcaagaccttatttccggagctgtttctgacggtggagctcctgtacacgcccagctgccactgcgccgccctgcccacgtccacctcccagtagtgccgccctgaggtgaagctctgcgcacccagcacggtggcactgaaatcaaatctctcagggtgacc

SEQ ID NO: 21340 - DNA, 600 bp, Bovine  MMBT02598
tggaagtatcactcttccagataaatatgaaatgtcagtgcttaaaagtcttgatagggtacataaaatctcttgggagacagtgaccccagaaggaaatctgcttgattatcatgtaatgtaccatacaaggttacagcaagatattttgtataaccatatcagtaaaatactggctaccacacagagacacagattaaacatttttcaattggtattaatatcaactctttggcctgaacttttattcatgaagaaaacatgtgaaaaagtcttaaagtttataagagatttcatttkatgtgagaaatctcacattttattctccttttcacacaaaaagcctaataatcatagactactgtagcagacagatgatggtctgttgtatgttaatttttcaagtttgataacaaaaatcattcagacgtcttgaggctgagtcaccacaaaattcaaatggtttttatgcattataaattcacgacttaagaccaaacacatttaacacattgaagaacctgtacctactagaagcagatggtgaagcagtgacttaaaccacctatacaagctgattctccaactgcaggcaggtgt

SEQ ID NO: 21341 - DNA, 600 bp, Bovine  MMBT03919
aaggtcttctgcttccctggtggctcagagagtgaagaatctgggtgccatgcaggggacctgggtttgatctctgggtcgggaagatcccctggagaaggaaatagcaaccccttcagtattcttgcctggaaaatcccatagacagaggagcttggcatgttacaatccagggggtagaaaagagtctgacacgactgagcgactaacactactacttctagacaaaaggtcttctgattactagtctagtggtctttgcacaatattacattacttttcacattgtgtcccaaaccmcctattatgttcacagagtcacatgaagacacagaaatagaaacagcactctgaatgaagtygattacattttatggcaatcaactgggtctagaaactttaaaataacacacacattttaatgccatatgtgtctgtgaaagaataataaagaataatgctggttcttgtttcatggggtttacagtggggcccctttttgtcccataatttccctaattagtctcaattgcgttctccctctaagttcgcaggccaagatagtatctgctttattgccatgggaggaaaacttgctct

SEQ ID NO: 21342 - DNA, 600 bp, Bovine  MMBT01041
ataggctgccaggcttctctgtacatgggattttccaggcaagaatactggggtgagttaccattattagtagtttatgtgtgatttggtgaaaatatttccataaaatggctgggaaacatagggtctaactatgctgtccatggtggacccttgtctatttatcacactcttttccagcttgcaaattgctaatgggtagatcatctccaatctcccaagtcttttcatctctaaaatactttgaatatgaaatatcagagaactgatctttacagatacttgggaagagtctattawgaaaaacaaaatgtcatttaacatgattcagatacaatatttgaattaacgtattgaatattttagcaaaactgaagaagcccttggtgtagagatgggtcattgaattctacctctacctttttcctgaattttcatacatgtattgcatttcagcttattcctctctgtcagtactctatttgaaaattatcttaaaaatggcaatttttatgaaatatttcttaatgttagaattcttcatttagcacaaaaatgaaaggaaaatcatgagtgtttttattgcttacaagagaaaag

SEQ ID NO: 21343 - DNA, 600 bp, Bovine  MMBT06934
actcagggcaggggtggctttgcaaggccacrtggtgggtaggactgagccaaacctccatttccaacttgatcagtaatgtaggtgctattttcatcctgaccgatttctacccttgaatgtgcttaaacccagaccccaccccagagaccctcaggaggccactgtccatattttccaccacatccacaatttctggtctgtctgcaaactggctgatttgggcatayggaccacaggcccgccstgaagtctccaggtgtgatcatcacttttgacattccttccctgacctgcccyaagctcagcagcccttggtgccctcagacagcamcctcgcagtcctcagcaggtactgctgctaactcatccacgggcccgcagaacgcatccccctttggagcaagggctgtgcttcactcctgctcgtgtcccgttgccaggcccagcacagcggcggaaggatgcccccgtgactgcacgtggagtaacctgaacgctaccccaagtcstgtacccagcaagccagtcaactctgggtgtccaaaatatgcctggcattgggtttcaaaggatgaaaaagattaaaaaaaacctttc

SEQ ID NO: 21344 - DNA, 600 bp, Bovine  MMBT20646
tggctgatttgggcatayggaccacaggcccgccstgaagtctccaggtgtgatcatcacttttgacattccttccctgacctgcccyaagctcagcagcccttggtgccctcagacagcamcctcgcagtcctcagcaggtactgctgctaactcatccacgggcccgcagaacgcatccccctttggagcaagggctgtgcttcactcctgctcgtgtcccgttgccaggcccagcacagcggcggaaggatgcccccgtgactgcacgtggagtaacctgaacgctaccccaagtcstgtacccagcaagccagtcaactctgggtgtccaaaatatgcctggcattgggtttcaaaggatgaaaaagattaaaaaaaacctttccaaaagaagatattttgaacaccagcagctgacactgcagaaaacacatgggactttggggccccrcaccctgaagtagaaatctgttatcatagtgtcattaatttgactactcccattgacaaaaatctgagttaagcttgatcaagaagatgacattaatgtartcrttcgtggcacttcacagtaagatcttcaatccagcacaggct

SEQ ID NO: 21345 - DNA, 514 bp, Bovine  MMBT21662
  misc_feature (1)..(26): n is any nucleotide
nnnnnnnnnnnnnnnnnnnnnnnnnnaaaagtgagaaagctattcgtaggctcctactaatcttttgtgaagcctcatccgctgtctccattagagactaaaaataacacgggctgatacatgaatatgcaatgaaattttaaagcagttctcccaacttggggggaagattctcactgttacaattgggaaattacsaaaattaatgtgaatttatgaaatcctgcaggaattgaatcccaggtgcttgtcagctcttgagattgagtgatagacaggcatgaaaactaaaggaaaaartggaggcgcctcaagcgttgctttctggactgtacctgcagcatgatgatgggagaattattccagtgctcctggagcagctgctgctatgacctccttattattcccactgttatgctcaatgacttttaaaaacctattttgggcacagttcctgggctctatccaatatatatttttttattcttcactggtatattgccactcaaatagg

SEQ ID NO: 21346 - DNA, 600 bp, Bovine  MMBT07114
agsgtgcaactgaaataagtaaagaatacaataaattaaaattctcaaaaaatagcttaaagcaatattaaaacagcatgacaagaatcattaaaatagtgaatatccattatatcttgctgcatygctgcatgtggcaatctgcgaaaattcttttgcatgattttatataaggtcaacatatggagaatttatcaatttctagtaggcactcagtaagtgcatatttgggttagtgaataaatatgtaaataaatgcttaagcattcagggacaataatggaaaggaaaaagttttawagactgattagatgtcttatggaacctgaaaacctagttttcaaagagactgaagtattgatttgtatcaatggatatttaatttccattaaattttataaattagaaatacatgctaatcttgttactgattggaacatataaatttttttaagtatacttgatttacaatgttgttttattttaaatttttagctatactctgcagcatgtgggatctttgttccacaaccagggattgaacccgcacccctggcattggaaggtaaagtcctaaccactggacaaccagggaaggcc

SEQ ID NO: 21347 - DNA, 600 bp, Bovine  MMBT08435
gatgcatgtataattccaaaatcyataataactagtgtcatcataccatggtagctagaattttcatgcttatattcccacgaagcccacatagtttccctaatagtgcagttggttttaacattacaatgcctagactgaaatagactgaaattattctctgccatgattgctattaagtgacaccagagcattaaaatgaataaccatgagagagaaaggccaacttcctaatgtcttgtggaatacagtgctttttgttttaaaatacagagacaagaatcaacctcaattttcttyatataatccatgtaactgagtgactcattttctccagtttacacaaaaatcaactgttattccattttttccaatatttctctcaagtacatgttgaatattctttttaccatttaacagagtttacttttttttttaataatgcctatataaatattttccaggaagcttgtgttttctttaaaaagattttctttctacattatgcacaaattatattgggtttactccatgagcttttatctaattttcatgtaatgagtttatatatagtctacttgattgtatctgctactaaaa

SEQ ID NO: 21348 - DNA, 598 bp, Bovine  MMBT11681
  misc_feature (1)..(75): n is any nucleotide
nnnnnnnnnnnnnnnnnnnnnnnnnnnnnnnnnnnnnnnnnnnnnnnnnnnnnnnnnnnnnnnnnnnnnnnnnnncctcacacctcagactggaatttatactttataatgctttgaaattatataacatttctagatggttcaaaatactctcaaatatcctgtctcataggaacttcacctgtctcagacgcaagtcaaatagggttttaaattyccactgttcttaaataaaagcagagaaatggaggcacgttgctcggggattttttaaacaagtggcaacaccaacaatgggcyggaacttctcgagctgggcccacggggaggcgcctaaagttcaggtagaagcagcaggcaaatgcagggggcctggccccacctgcactgggctccaggacttggcgcccatctcaagatcaaagcctcaagatgagctgactcggggggaagacctctgtaaatacagagcatcaccggctttaaaagaggctgagtcaaggaaaccagtcctccccactgagagcccggggtgccccccacctggccccagaccagcaggggaggatcrgggaggaaagattagaaaraggccctg

SEQ ID NO: 21349 - DNA, 600 bp, Bovine  MMBT12844
atgtttgactcggcaaccccatggactgtagcccaccagattcctctgaccatgggattctccaggcaagaatactggagtgagtagccatttcattctcccaagggatcttcttcagccatgcatcaaacccaggtctcccgtgttgcaggcagattcttttcggtctgagccaccggggaagctattatcatatgcagtaaacaagcttgcttaacctttgtctataaaagagagattattttcattatatcasactgtaagtaaacctgccctctgctctggagggagatatgtctytacaatgcaaggctgtacrttgttgaaagaggacagttcttctgcttacaaaatgtgcagatgatcaagagacccatggagaactatctcccaggaagcatttccattaatgcttcatattatgatgcaaatttgacatttctggttctaatgtaagaattakttactatgaatttaattgagtgcttcaaatctggtggtttatgtcttgactaggaataggaaaaagtggtcaggaagcattactattaatattgtattatttagagaaacaagatgatcaggacatgtttatattat

SEQ ID NO: 21350 - DNA, 495 bp, Bovine  MMBT13979
cttagcaacagcagcagcagcagcagcagcacatgcctaaactttccatgtctctcaactgttgaaaacagaggaaaggaatagctcttcctccttttttctcttactccatttccttccactctggtctgcatcaccagactctgcttcccaacgaagagcagctaggttctaacatggccattttgatgagttatttctacatttttgacagattttcgcagactatgatctacctctgaagtgcaataacatcccagatggcatcttcaatgaggtatctgaatggccgttaattcygaatcaatatgattactcagagcgagctgtgtgtgtgtgtacagagcgcatctgtgggtgttcccagcagcaggcatgcgtgacttaagagcagagagctggggattctttgaggaagcagctgcagggtggggaaacagttagcaggatgggcagggtagaatgatggacatttagttatcttgtattctacag

SEQ ID NO: 21351 - DNA, 600 bp, Bovine  MMBT10627
cccggtggggaagatcccctggaagaaggaaagggcaacccactccagtgttcttgcctggagagtcccacgaacagaggaggctggcgggtcacagagtcggacgtgactgacatgcacacacagcagggcaaagcagctatacttgagtacatttttaaaaactttattgctgcttctttggatattaaaaataagggcaaagtttttttaaccaaatgaaaaaaggagggccctcgtcaatcattctcaaccacaaaatctcagttccaggttaccagggcccctgcactggactcytttccttttgttaaacagacacagacctatgagaccaaagtcataggaacagagttggagccaccagaataatrtcaacaatcatggatgttcctaaaggaaacggatgactacaggaaccacggatcccgcgtcggctctaggatgcttacctgccctttgtattccactggcttcagtcctgcatagatgggcaggaagctgctggccagcaggacctagtggacaaaataaagacacagctcgtgaaatgagacagcaacacgtcctaccatctatttcacacgtcacctactagga

SEQ ID NO: 21352 - DNA, 600 bp, Bovine  MMBT17283
tgccttattgagcaaattgcctccttagcagtagaatgttggattaaaaatagttgtgtctatgaccagactcactgcctaaagaggaaatggatcttgcttcctcactcttcaaagccattgctatatcatgcgagggacattcttagaaaaacttctcagtttccagtttttctccagcaggagcatgtcaggaagtggaaactaaactttcagcctggatacatattttcaggaatggcttcaggtctattcatggccagggacaaaggtgtgaatcagaaagccgtggaaagcaawgaacatgatttcccacacaccctgtgtaattgtcattaaccttcagtggctgggtacaaagcacagttgtttactttgcacttctgatccaaacaggttcttgaaacaaagacattcagaaccaactaagggaaccccctgaaggaatgactcacacaacggagagacatgccacccaagtgaagtctagctagggagatgatatttaaaaatataaaaatgagaatagcacaagacagtgtatcattagcacatgccgtaaatgctacctggaggcaaaaagagaagtctctgtgggct

SEQ ID NO: 21353 - DNA, 600 bp, Bovine  MMBT04239
atttcccctcccttgcctagaccgtgtattgtgagtgaatcacgtaagtagtttatgtagttcagggatctttttttaatatatataaactattggtttgctcatgtccactactagcaaaaaaggttttacgggcaaaattgtaattccctttgaccttctctgattgtgcttggcacatgacagtattgttgtccggtatctcatttacaaataatataatcaagtgcatcatgggtcttctaaaacgctgatgatgtatctgtactgtgagctgctctaataatggataagcttcgytattctacgctccaaacacactcatcacaggaagattctgcagtatgtcttgtgtatgtgtacttgcattttgcatctgaacatgtatataagaatttatgagctttgattgacagttgggcccaaattaggcctttaattatactgactcttttttaaaaaaatcagggacctaccaggatagggaaaagtaattgtgatgctgaggatgcccacgcatcctcagaatgaagaaaagaaataggatttgggaaacccctctttaacyactctgttaagttgaaatgtatttagtttcta

SEQ ID NO: 21354 - DNA, 600 bp, Bovine  MMBT09140
gagatcctcagataatttaattctagaagaaaaaaaaaattaatcttgatgttagaatccaagccttaccactcaaggggaactctgtattgcttaccttctcaagttcccacaatgaaaagatctaacttgaatgaaatttcagagtatactgccctctgtgatatactcctgagactctgccaagatgggctcttacggtcttaaaaggaacaagctttggtgatatttttcaggagctagcatttgctatatgtaatgtaatcagttattttaaaatgtatattttctcagagtcaycagcaatttttattgaacacataatgtgccagatgttattatctcttttaattttggtaatggctggcacatctacttccactcactacagagacaaccaggaaaccacggtgaatgggaattggaatccaggaaatctattccggcactcatttccttaatgagtatgcaattgtacctactaatatattctatttccatgattgcaggggcccttattatcttgctcacagctatttctccactgcctagaagagaaactttctcatactacatgatccataaatatgtttagggtga

SEQ ID NO: 21355 - DNA, 600 bp, Bovine  MMBT22210
agtcacaaagtgcaccggtgttgacagtagagacctatatggaatttattgtttacagagtgcgtcctcagacattacctcactcggtactcatgacagttctgtgagttattactaatgccagggaggaggaggctgaggcctggagaccccccctgggccaggcctgggaagggctctaggaatacagagaaacaagccacctgtctgtcttagagagctttcacagagctggatggatcctgatccctttggctccactgacagcagctctgcacatcctctcccatcaaagagggscttccggaaatatgcattcccctcacaggctctttggtggcaaagtcaagatttctctcgcaattttagggtaacatccagctatgtagaggcaataaatagagtgatgggtgacattaatgacagaccaagtgaaagggactgagttttctaaattgggaaaaaagtatgcttgactatcatctccttggcactttccatcatcttactatttagaagggcacattttttaatgtcattgacaagagtgagcgagcactttatttacatgatcagaatagaaacgggaattgcagcttg

SEQ ID NO: 21356 - DNA, 600 bp, Bovine  MMBT01679
ggcagttcttaatataatctagccaggagatcttcaaatttcatttctgtatccaaactctaaacaaacaattaggtttatttcatgtagaaaaatgatggtgctcattactggagggacagagaaaggatcccctcctcatcccagtaaaatgtaagttttgataatttatttatattcccttaaaatatttgtgactaaggatgtggttaaaagccatggaacaaaacacagctaaatgacctcctcagagagtaagcttatgtctttggtcttaacttgtatagaatcacactaagkgaacaattttttcctgtctgcattctgaaaattgaagtgattgtccattgtcaagcaagggcttcattctttgctctaaactactgatgaattttataaattcttaatcaaaatctttgagggaaattatataatgcaaaatatttttatttcattatcttcctcgagatcaatgagtttaacctttcagtcttactaccttctgaaytgcgacagatggtgtaggtggcaaatattacacatttggtaagaaaacatcatggatataaatacccttgtctttttccctcagatcagtgg

SEQ ID NO: 21357 - DNA, 598 bp, Bovine  MMBT21817
  misc_feature (1)..(106): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaaatacttagcagtctctatttacttcagcagattcttgtgaattacttgttaaatattattctgtaaaaagaagaatctattctgttggaaatacttagcagtctctatttacttcactcttacyacctatgaatcagcactaccaacacactcaatgctgcccaggagtcagttaagaagaatcatgtrtaaggctgcattacttcttcacattataaagtgtattttattgttaacttatgatctggcatggctattgaaataaatttagtcaatggtaatatttgaaataaataaacagcaaataggttaaaaattgtatcawattaaacrtattttgaaattaatgataatgtgaaaattctaagrtcatttcactcttttggggcactcttagtgaaataaggatctcatgtgaaggataactaaatgtggctcttttctgtaattggtattggatgtcaaaacagttaaatatgtctcagca

SEQ ID NO: 21358 - DNA, 600 bp, Bovine  MMBT06018
tccagtttctttccatttgagatcataactcttagtagaacactgtgcaattaataactgcttagaagtacctgtttatttgatctgagaatgttactggcatatgttgccttctctcttttatgacaagaatagttttacaataaaacacatagcctaaaatcagtacactgaaagccacagggaccattatttaaggcaagtccatggggtcacagagttggacatgactgagcacatatgcgcaccatttcttagcctaacaaacttgaaggtgtccctttgagcagcaagtattamagtgggaagaaatagcttcatactgtaactttcctctagaaataagaactgtccttttagtgaagcaggctgctctgtctcacgggatawaatttgggcctttgagaaggaatgtaaggctgctggtctggtttgaaatggttgtgtgtggttgtccaaatccctgaagaaacttttaagtttcttgccaaggccactgctattgaaaacagtaaatatattttcagaaagttagagcaatggagaatgaaataattcacctgtcgtcttttcaaaatgttagtttcctactgggagcag

SEQ ID NO: 21359 - DNA, 598 bp, Bovine  MMBT13589
  misc_feature (1)..(144): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaagactattccaagtgaacaaaactgtcaaataaaaaaaaattgtgcaaaaacagttacttctctctcttttgatattttacttaattttatttagtctaattggaagattaggcaattaatttgggaacacggttccccccacattccwtttgcctagggagagactatcggatccttgtcttggctccttgacaacatctttcaaatagcctcaggaacatgactgttgctattctccttgcagccctttgatgaccacctgggacctaggatatacaagccaagttccctctctaacctgatcagcatacttccccggccgaacctccaagttacttcctgcttcacacctcttattttaataatacagaactgctgtggggctccctggcctgtgtcttgctgtttcttgcttctctgggtaaaagattatgtctataaataaa

SEQ ID NO: 21360 - DNA, 600 bp, Bovine  MMBT01155
aggcttgcttaatacagcccctcygtaatcataataaatacaaagggcttagattagtgtccagcacagagtgaaaactcagtaagtgttattgtttatgatgacgatgactagacccatccagcaccttaacttgagaacttcctggcatctgactcaacagcccaacacctgggcatcaccacccctgcctgacccagatggatgaggttagcaggggagggagtatgctgagaggcaggcccctggaaatagctggtttgatacagtcttctattggctcagttagtaaagaatctrcctgcaatgctgaagaccctggttcaatkcctgggtcaggaagatgccctggagaaggaaaaggctacccactccagtattctggtctggggaattccatggactgtatagcccatagggttgcaaagagtcagacaygactttcacttttcatcattaaaaaggatgaccaagtgctccgtattctttaaagcaaatgtacataaattaccttaggttagaggaaagatcatttcctagcgttgttacagatatttcctgagttggggaatcttctcagtgagttgagacctgtcccca

SEQ ID NO: 21361 - DNA, 598 bp, Bovine  MMBT05963
  misc_feature (1)..(83): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnntactttgtattactatgtgtatatcaccttatatttgaagttattaatttactgttatacataagcaaaaaatacctgtattgtagttgaaattggctagctcttaaaacaggcaaggcccttcctcattttacatgattataatataattaaagctatggttagtacctctgaaagtgagagtttggaaacattaaactttggtcatttttcttaygtagatggaaaaaagcacggcaggaaggaggctatcgttctgaaatagcatattgccggaagaactttcttaatagaacatcactgttaaccctagaggtaagtcttaatgcagctgtcttaatttagggtcatatggtggaccagtgggattatgttgggaaaagaaatgcctaggatagtgcttgacacatagtgtttaataaacatttgctaaattaataaatttgtgatttttttgttttgtttaccacaacaggtaacctgtattacatggttattcaaaatagtatttaaca

SEQ ID NO: 21362 - DNA, 600 bp, Bovine  MMBT10188
tgaaggaaggaaggaacattttgcgtctcagtgaatctttctgaccattcaaagcaccgtctccatacaacacgtgcttgccttccgggttagctgattcataacagcctcttcgaacttcacagctccttgaattgtcagcaactgatagcaattcaaaaccactgttacctgctccttccggctcatccagccgaggtcccattgacaagcctcctcccctgtggaaaaaccaattggcctccattcggacatgtatttactcgaatagtctgaatagtctgatatgtccttaagagkgcctgtttttctggactcttgaacctcgtggaacatctgcctggttcccataggagttcaatagaaaaaaaaaaatcttaatacgtgtcctttatttgtcagtgagagccatgattacacccgcttttgaaaattatcttttaaactttctatgtggaatctcaaaagggcgagggctgggactctctgggctctgggtgccatctggcgcgtccctcagccacaagggggcgcctcagaccctgggccaagcccatgaggcagggcaggtggaggactcttgtaaactggctccctttg

SEQ ID NO: 21363 - DNA, 600 bp, Bovine  MMBT10257
acctcagtggcccagggattgacccccagctgctgggccagcgtcagaaaggcgggcagctgctgacggtccaggagcaggtagacgggcacccagcggcatgtggcagcctccaccaggtccgaaagcaggtctgggtcagtgaagacgtccatgaccacggccaccagctgaggggtggggagaggggctgtgggtggagcctggggcttggggggcacattctgggggtgaggttctccagggcgtttaatggtccaggctccgtgggacattcagggaagctgagggggatacccygagacacatactacagttcattcagcgcctatgtgtgaactgactcaagggacaggagtttgagcaaaccccaggagacagtggaggacaaaggagcctggcgtgccttagtccacggggtcgcagagttggacacaaccgagagactgaataacaacgatgtgtgaatgagaagcaaacaggctttctggagcccctccacctctaactgctagaaaactgtcattataaagcacacgtctgcagcagtaccccatgggctttgacactacgtggctgccaggctccagggcttggtgg

SEQ ID NO: 21364 - DNA, 600 bp, Bovine  MMBT02488
taaacagtactctggaatcatttatatacttcactgcattgtgtagatttttcatgttgtgtgcctttaagatatccttgaattggtatgtccatggtaaccagaaccatgtagagtctaagaaaatgttactgattctctctttgaatttcaagaagcacttctctgtgatgcttaaagcctaaattactagattttccttctttgaaagtctcttttaaagggacttttctaatatggaaattttttcttataaaacagcaaaaattacacaatggagatcttacatttatagtggawaatctattagctgcaatcccaagcttcatatcttatttgttaaaaaatacctctcctagacttagcaaaattaccacatttaattacattgtattgtaaaaacaaatatgaagggaccttgatttaaaaaagggctatgggattcttttcacagcctatcatatagtctttcaagctcaaatatgccagccagagcagcaaagcctgaaagaataaaggtatgatttggaaggctctataaataaaaagttgagcatagtaaaactgagacattcattctttttactgattttacagagg

SEQ ID NO: 21365 - DNA, 600 bp, Bovine  MMBT11734
cccccactggctctgtgccatctgtccctgggcacacctgggtactgcagggggatgtcaatcttgggcccgatgacgtagtggccctcctccagggtgtgggctgtcaccgtggtccactggcggcaggaatgaatgagcaggatgtctcgctcactgacgccctcagcatactcccctgggagggggcaggcggacagaggagggaggagagaaaagagaacatcaggaggggcagagagacagggtgacctcctcaccgagacaccgcccgaggacagctctccaygatccctgtcygggccagcaatgctccagggatgggggctgccagctgtgagcttggggctgaatcaggccccgtctctcagggctcaggcttccgatggggcctcagaaaccaacgctgcctccatcctgcatttatccttcgactggactgcctgctgtcccagtccgtgtgctggagccaggggctcctccctccaggagccctgaggcccagggggcaggaggtggggagagatgtgaacagaggatgcgggcccagtttgaggcactgaatggaggcagtctgagctctcacagaaggggcagcaa

SEQ ID NO: 21366 - DNA, 600 bp, Bovine  MMBT10794
cttagagcaacttgataaattatacctttattatccaaatggaagcatttagctttttatttttacctgatccctctggaattcagaaactctcagtgagtattcttattttttggcactatagttatttcaaaagttcaataagaatctgttctccttataacaggacagaattggaaaccctggttacattatcagtgctttgactagaatgtcataaatgaaattcagataaacatgtagactcagatatgaccagacagttggaaggaacttttgacttttagagccaatgaagcyccttggaaaatcagcctggtaccttacttatggtattcacagcagccttacaaggtgagtaaggaaggtcactttctggcaggtacaggaacctcaggatattttgaggacctcaagaagacagaaattcaccaaatccataggtattacaggtgagcctggtgataagttttcagtgtggtttccaggccttgagagaagttcagtctggagatttactatgaaaaattccagcagagtaggtttaaaagtgcctctatggccaaccactattcttgctggacttatacagataatcag

SEQ ID NO: 21367 - DNA, 600 bp, Bovine  MMBT08428
gatcttagttccctgaccagggactgaacccatgcccactgcagtcgaaaggtggagacctaaccatcagactgccagggaagtccctctcttttcctttttagcgcttataatcaggcttctatcatcaccattctcctgaaaacacactcctgtgtgccaccgatgtgtgcacatttggcaaatccagtgatcctctttcattcttcatgttcatggcctctttgtgccaaaatgtgctattaattatctcatcttgaaattctcatgtccttaattcttcataaccattctcctcakagkctacaaggtgtggtgttctttagtactcactcttttcctacatattctcatatacttatttatatccatacwcatctttatttacctatgttctccaaccttaagcactacccttcttgtttaatccttccytccaaatccccratcccctcctttgtatctcttcctttgacttttttttttgtctcctgtatcttcaatttctccctctccttctcaaytggctttttggtaacatattcaagtctattccttacaagtacagtgatggtaagtacaataacaacaaaaggcttc

SEQ ID NO: 21368 - DNA, 598 bp, Bovine  MMBT12292
  misc_feature (1)..(46): n is any nucleotide
nnnnnnnnnnnnnnnnnnnnnnnnnnnnnnnnnnnnnnnnnnnnnntccttctaatgctgaaagcccctttctatccccctttccctttcaacctgcccccagaattaaataatttgtacctaggttttctcgtgaatggtgcccactctgatgcaggcaaggtgctgtttgagaaagaaaatgattgaagctcagaagtcaaggaagccaagaactgccaagaaggagacaatttccctctgtactctccttcctcaccccacactttcctcacatatcacactcccaggctgattttycctttcagaggaaatgaagcaaaacacataaatggagtgaaatggtttattcctcagagtcgtaaaaccacagttccttgtaaaaggtgaagaaaatgagctcctcttatagataagtgaggcttttaggtaaaatgtcaatatcccaggccctygataacttcctaacatatgactttctatagagacagmtttttgtcaaccaccatggaaactgtttgacttgaagcagaaaaatgacttcaaattatgaaaatctgaccttcaagtatggagatgcttcctctgaatgatytta

SEQ ID NO: 21369 - DNA, 600 bp, Bovine  MMBT11477
gagagcgccgtatattaggcaatgtatccaagttactttagttttgctacatgcaaaaatttctttgctgagttgcgatatgatactctccctcggtttttatagagggtggatatgacaaacagccgctgaagaatgkgtcggtgttactggtgagcatgctattcaccaagttgcacaatttcctttatctcaagattcccatgctttattttgcccagagccaaactctagragagattgtgtctcttgggactaatacacatgctgccttgggacagctccatacctccttggaartgaaaagttkagaaatgagatgaaatgtgatgttcacatggtaagcccaaattctaggtacaatgagacttctttttttcctgttggttgctctatttttttttttttaacagagtttttaaacrtcrttttgttcaaaatagaaattgttttataggttgtttctgatcttaaatatgtgtatcttgactgtaaacaaaaaacagtcaactttttgatgtgtccccttgcagatttacatacatatatgggtgtgtaaaattttacttgtatctgtgtgctttggaaatgaaagtttag

SEQ ID NO: 21370 - DNA, 598 bp, Bovine  MMBT03189
  misc_feature (1)..(138): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgaagtccttaattagatataaccaggatttcagttgctttctaacaacttttacatccttcttcaaacactgcatatataattccagtagcatttgaaaacaacagattacatgtccctcaagtgaaacaaagcaattcagggaagaatatttttccscaaatggcaaatttctctatataaattctccatgccccaatcacctccatatttgtgatggacactctgaaagcagggaggcctttgcatgcccattcatttggctacttggtggttcactcaggacttttgtttattttaaatctgtatgtcatcaagggaaagaaactaaactacagatctgaagtttttcagctctgtctcaggtaaaactcatgagtctggatcactggaatctgagaaataattttagtataaaccagctcagcaaagatccaggctgtccacaaacacgcca

SEQ ID NO: 21371 - DNA, 600 bp, Bovine  MMBT11251
cagtggttagggtttggcgcttgcactgcaagggcctatgtttgatctctggtcaggtaactaagattctgcaaaccatgaagctcaccaaaaacaaacaaacaaaaaggtgttctatccttaaaatctggtagtattcagctgtgctctataatacatacgtattataaatcttatatctcattaaatatatttatcaaataatgatgcacctggattataaggttttgtagactggtaaaatatagacaaatttgacagatattttttaaatatctggaggactgtagttgaaaactrggtcattaacgtgcattagaactttatctctgaattaccagggagccaagagtaatttgaataatcaggggtccctgatggactagagtctgtaacaaaccatactgctgccttttcctagcatgaacagggctcagttatgatgtttgagcacctcatcaattctaacggactccaagatgtcatgaaatactatggtctcatccctgaagaagatattttgtttatcaaggaacaaattacaggaccacctgaatcacccatcaaagatgcttcaaaggtaaatttgtgtacaaccct

SEQ ID NO: 21372 - DNA, 600 bp, Bovine  MMBT22284
cattcctggtttgacaggttgcaggtcagaattgctgtcaggaaaagaagaaccccaccaccagcgcactgccagctggtggtgctcagagcccttctgcagaaaggaacttgctggacctcctctccccacagccgcctccgggatctctgtgagtcttgtgggcaggcagccgagaagtgttgctcctgtgtgccgttggccrggctgccgcttytccctgagggctgccctgtgtgccgcccctttaagtccccatccaccccgagtcaggaggacacaygccaaaggccaggaccyctggaaagcrgtttcaggagtaacatcagcggtagctgatgatgatgtttttggtctttataggttggttttctgttttcytgatttcactagtttgcagcgatgtttgatygctagagaaatagatcatatagaaaatcctaaataccattccctaaacacgaggttgaatgcgccttctttgcttttatcctgcacatatagtaatatgtggcttgttttacacaagggaggttataatttacaggttgtgccatgctatgggttttttttaactttttaaaaataattttacgtttg

SEQ ID NO: 21373 - DNA, 600 bp, Bovine  MMBT11374
tgaagccccaatactttggccacctgatgtgaaagctgaatcattagaaaagaccctgatgctggcaatgattgaaagctggaggagaaggggatgacagagcatgagatgaytggatgacatcactgatccagtggaccaccatctctgggagatggtgaaggacagggaagcctggtgtgcagcagtccatggggtcacagagagtcagacatgactgagtgtctgaacaacaacaacaaattcagtctctcaaatctgtgtacaaaatacaaataacttaaaaatagtctaaacccwaaggggcttagatattgtgggaataactttcaactatgttagggagatctattagttggctyagtagtttgtttgttttagtatacagccttgtcagttcagttttccattcagaagacatttagcctgagattcctgctacaggaacagcagtagctgaaatgctaaataacagtcctttacaggggcaagtgtatagtgtaggctgatctcatcttgtgtacctgagaactataaaaagagagtgtactgtgaaatagcctaatatgtatatttatatatgttgaattgaatgaccct

SEQ ID NO: 21374 - DNA, 600 bp, Bovine  MMBT19110
ttagtactgtattcatatgaaataatataaacaagtgttatcacctacagggaaaactgaggaccaaaaatagtaaataccttaacccaggctatacaacctgccactaaattaaaatctgtcccattcccttcagcttgtattctatttagcattaatatagtttagtagtattcttactttgttcactcagcyatcttacaatcaggtattaagtgcccatagatttcaggtgctgtgctatagaataacccagcagttaagataggaagggctgttcagataaggaaggctaaagamagacagggcattaaatgagattagggctcctgtcagtggtcagaagcagcatggatgattctgagatacaaagtcacttttctcctctggaaaggctgttttttattgatgctgttcatcttttaaaattatgccaatgtgataatacattaatttatataaatagaagccctaattcaaggtcaggcatatcagcaggatgaaattaaatacctcagtctggaactgtagggggcccatcgaccactttcaacctcctcagctctatagataagaattctttgaatttatacaatagca

SEQ ID NO: 21375 - DNA, 600 bp, Bovine  MMBT00630
gttaggaatccacctgccaacgcaggggactcggtttgatcctggtccaggaagatccaacacgttgcggagcacctaagcttgggcgccacagttactaagcttgcatgccacagctactaaagcctgcatgcatagagcctgtgttcactaagagaagccactgcaatgggaagcctatgctctgtaactggagagtagcccctgctcactgcaactagggaaagccraatgcagcaacaaagacctagctcagccataaatcaattaattaaaataagtaaacaaatgaaggtacckgtgttccycccaaaaacttaatactggccgactttattctttctacaaacattcaggaacctactgaacagagcttgtactggaggatacaagaatggaaagattgcaatgggggtctatygtcccgagtccagcctcgtggaagtgaccactattcaaacaaattacccaacgattaaatcacaattgtgttaagtcctgatgaagaatcaggagtggctctgagagatggcacggagatagaaaccgttcttagagaaaggtgagacatgaaggtgagagaggaaggagatgaaagat

SEQ ID NO: 21376 - DNA, 598 bp, Bovine  MMBT13529
  misc_feature (1)..(28): n is any nucleotide
nnnnnnnnnnnnnnnnnnnnnnnnnnnnaagaaataaaagcatacaggcaaattggaagttatgactgtttaggaacttaccgatgagagcagatcgtaagactcaaaccaccacctgagataataaacctgtctccaaccctctagattctagtttacccaattcttctggcaaatacttcccagctataacagctacaacttattataaaaaacttttacttttttaaataaactaaaaaacaaataatgtaaaccatcacattttgacaagaagaatataacaagagtatggaaacrgaatttaaggtatctgttaaaattacctttggatcaaaagatcctttatttttaaaaagaagttcttcaacactctctcttatttcctttggaatatttcgtgcatcaaaggttgctatgtcttctcgcacccctctctttgcaaggaagctagaaataaagcatattattaattcaaatgaggctaaatatagtttgctatttttaacaaaaatatcaatttaacagagtggtatatacaatactttcaatctattagttaaccacagaacagagtaattttaaagtacttaagttt

SEQ ID NO: 21377 - DNA, 600 bp, Bovine  MMBT11100
ttaaagaattggacatggcttggtgaccgaacaacaacaatgaagcctgcgtaaaaacccaaaaggatggtgtttgggaagtttccaagatgatgaacacatggaggtgctgggagtggggtgccyacaggggccatggaagcactacgccctttccccatgccttgttctatgtatctcttccctctagttcctgagttacattatgtccgtttataataaacctgtaatctaataactaaaacgttttcacaagtgccatgagccactacagcaaattattgaacccaaggatgggtsgtaggaacctctgaggtaacaactggagcttgcaactggcatctgaagtgagtatgggatgtggtggaatggggagtggtcttgtaagactgaacccttaacctgtggaatctgactccatctcctcgtagagtcagaatcgagttgagctgtaggacaatcagctagtgttcyaagaattatttcttggtatcaggatccctacccctcccctccatattaagcactaactcacattgcccagtattctcattcatgcacttgtgtcacaggcaaactaaatgtgccttcaaacatgct

SEQ ID NO: 21378 - DNA, 600 bp, Bovine  MMBT22925
atcgaacctaggtctcctgcattgcaggcggaatctttactgtctgagccacaaaggaagcccagtcagaatttacagctggatttcattcagagtggttgaaacccaaggcagttttggttaatattttagtcgctactaggactaaaggaaattctaaaataagtgtctgactgttgttaaacaatatactatacagtccattcaaggaattatcatcatgctgtccttcctgtaaaaaaagtgatgctaatgaccagctgacagtagggcctacgtagtgacttgttttttcaaggrtgctgggttctgctactctctcctgacctctcagtgagagcaatgaaagaagttaagaggccagagtgcagctacagagagaatatgcattgctctggcctcattaacaccgaaactcaaaccaagtgagtcaaacaatttggagaaacagttcccttttcaactcccaggtaaggtgaacctgtgaaaattgcctatggacctggtgccaagttaggtaaacaataaaaacagagagctggttcctcatccctgaaagatgaaaagtctcaaattgagggggaaggaggaaatccaatt

SEQ ID NO: 21379 - DNA, 600 bp, Bovine  MMBT22817
ttggaagcaaatcatgttttcttgtattttctgaaacatttgtgaccagagggcaaagctttgtactcaagggatagagagtttatagatctgcttggaaatgcattttgccatttttttaaactcaattttataaatccctggatttatcacacttcaggaaaaaatctaagtggcattgcacaccacaaagggacaaggcagaataaaaatccctccgcctcgaagactatgaagcggatggcccaagtatggaagagtgaaaaccttgacatggcaacatattcagatttgctccaycccatcaagtctttctggagaaggaaatggcagcccactccagtatttttgtctggagaattccatggagcctggcaggctacatgactgagcaactattactcattcatcaagtctttgaccgcacgtctcttccttatttttgaactgcattcttagtggaaaggcctttttctgaccgtggacacacatcagagtagcttatacatcttgaatttcaattatgtgccaggccctctataagtggttaaatttagaagtttcaacatttttgaagttcttctcaaaacctcaggaagt

SEQ ID NO: 21380 - DNA, 600 bp, Bovine  MMBT10947
ccccagtacaattatagccaggacttcaaccagagagccatgtctgggtctagccttgctagcatatatggctttgataacgcaggactaaagagtctcactctttggcattcattgttcctaggaaaattccagctggaatctccacactatgtactttaatagcacagggaataccacatcaggaaactaataatttctccccgccgaaatgacctcttctttctaaacaggggcccagtaattctccttggaaaattatagttctgttactagagtgtctcttcatctggaaggaawactgcccattcatacggccaggcaaggatgaataaaacatgctggtggagaaatacactaggcgtgaggtcccattcattccattctactgtgtcagcacattctgcagaggtaagtttcctagactgccacaacattttgctatttcttacttaaaatagaggcggagggtagcatgtggcttcctatcatgttaaagcagacttgtatccaagaatagtgtgcaaaagtagaagtgtycctgtttatcaaagatatgtaagaggttgacacttcgaaaataatgcctctgcttagaag

SEQ ID NO: 21381 - DNA, 592 bp, Bovine  MMBT18623
tcaaacaacacatgttgcagtcaacacgaagtgataagatgacagcagaagcaaaagaaactcacctccatcctgggatctctagacatcaagtagtgagctgcttgaaggatcttgcaatacagacaagcaatcctgttattctaaatcatctttcttctttcttcaatagttgaaagttggctgcaactgaataatagaacaaagtctgagcttcaaaatcatgctgcgtctgggtccctttgactgtaagaaatcagctttgaagactacatgaggagcctctgatgtgatctaagyttgtcatttttcattgtcttttaaaagcattcaaaaatacttagactctgttttaattttcaaactttctctattcctagctcaagatttctatttacccaaagcaaataggagataatctcggaatagtatatcccaggccacgcctgggataggtcaggtagtcatggattttgtatccaatggatggtgtttctagattaaaatattttcaaaggtaatgtgatacaaggctcccactgctgtgactgcattggattatgctctggtagtccttatccactaactctat

SEQ ID NO: 21382 - DNA, 600 bp, Bovine  MMBT18555
aggacacttgagtcatggggtccttggcagctgtctttgagaggtaaataacttcaaaaagtccttgactggaagataaaatgtgtgcttttatgcttactaaaggccatctctagacttttctctcatttatttttatgaaatcaatttccttaaggcccaagagtatggtatggtaaaacgaacgagacctggagtggtgagaagagagatagatttccagcaccatacaggggtctgtggtggatgaggaaatctagtccatgcttacctctctgggactctcctcctcactccccrtgtgccagttgtactggaattttcccatcagttttcctgagatgcgtaccctctgagtccttctggaaatctctcctcatcactcttcctttggctgattcctgtatagtcttcaaatttttgacattctacaaagaatgtcaaagaatgacaaatatgtcattcttcagggtcctttcctatttcacttcttcttttttccttttatccttcatgatatctgaaatgcaggtgtgattactgagatttgagcagccattttggaccatgaggtaaaggttaaagctgtacatggcagaa

SEQ ID NO: 21383 - DNA, 600 bp, Bovine  MMBT06846
ggattttctaggcaagaatactggagtgggttgccatttccttctgaagagaatcttcccaacccagggatcaaacccatgtctcctgcattgtcaggcagattctttactgctgagccactggtgaagcccattacatttgataggtgagtgcaaattatccagacttccctaaaaaatgaataataaaagaaaggcgatgcttctcatccctaaagtaggccttgtgtttacacactttctgtatcaaaatgaagtatggatcccagcaaatccactatactttattctcagtgccaytgggcatttctcacagctgcctaagctgccttcagtaaattgttttttcctacaacacacatttctctctttcatactacaaaatacattatttatgtgtatgcctaattctgttattggaaaaagtaagttaatttttagagttattgattttattttgtcaaacatatgttgctcttttcttcttgtgactaaaacaaaaagaactatgaaagaaacaaacaaaatcgatatttctctattaactacgttacttaaaaatcacatttggttcagagaaatgcaggatatgagatagaa

SEQ ID NO: 21384 - DNA, 585 bp, Bovine  MMBT10556
ataaatggaactgtacaatatgtgtccttttgtatctggcatctttcactcagcacagtgtttctgagccagctgggtatttttaaacgtacatggggatttggtatttaaaggaatgctggctgaatccagccataagcaaatgaatcacttctcaatgtgactcctcctccccctcacatctttatcttgtaagtatggtgtttgcatcttggtcctctccagccaggcttgctttagaggtgccctgactccccaactcctatacatgtgaaaggtttggcttgactctaccatacygcattttttttgtatttttttgtagattttttttccctataagtcagatgccataaacactcaaataacccaccttataaaaagtatgtttacaatgtcagaagaattcaaatgaaatgtaaacccttctatttacaatttttatacacataaaccaaatcacaaataccacaaataaatgtgggcttccctggtggctcagatggtaaggaacttgcatacagtgcaggagacttgggttccatccctgggtcaggaagatagatcccttggagaaggaaatgg

SEQ ID NO: 21385 - DNA, 600 bp, Bovine  MMBT00663
catttgctctctccctgcttctttttaagctgcatgcatttagaattaatcagccaagcatgactgagagttttgacaaactcaaaatactagagaaagagttcaagatgttttgatgatcctcaatgcaaaaatggttaagccgttggcctaggcatttgttgtatctgaagtcagtgaagttttggaccacagcagcctgcccagtctcctaggtgaagtgggagatgcatagagggacactgagggtttgtctcttcttaaccccaggattcacactgcctgggcagtagtcagtaycagatggaccagaaagtcagaatgttgagcatctttccagcgtcagagcttmtgcccttggctcaggactggaatcccaaatgctgcagtttgggacaaatctgataccactcactgctcccagggtttatatttcagttctggaagttcatgatgacaggtgtacagccaggcccagctggatgagagagtcaagaggtcacatgacttaaaaattgatgcacagccttctcactaagaaaacaaatgaatttctttttttcttataacaaaaacagtaactgcttttctgttatggaa

SEQ ID NO: 21386 - DNA, 600 bp, Bovine  MMBT08612
gcaaagataactttcttgaggaggtgagactagcgtttgatgtcaaaaaagacagtgtttgtacagcgtaggggaaaaacagatggtttctgagatgtgcgaagcaaggaaagcaaagggagcctggtgtgtatgggaactgctgaaacagagcccagattgcatgttaggaagccgtgggaaatcatgggagaccagtaggtcgggccagattctgatgaggcttttaaagttactgttaactaaagtttgagatttttctggtagctgaagcaaatgattgattgatgaagcaggggrtggggaaacattgcactgactaaatgttgaccattataattttcagcgcaacagctgctactgaaattgcagtcattcaaaacgaaaaatagacactgttgttctgaaatagcttggactatttggaaccctggagcctgagtgctggcgatgtggtttcactaagaacatgatggagtgcgggttcctgtttttcttttttttccataatgatttgttctatggattgagaattcaaactgagcaacaatttcacagtcggagttggagtgtgggttgtataaagttgcagaagcattt

SEQ ID NO: 21387 - DNA, 598 bp, Bovine  MMBT16264
  misc_feature (1)..(21): n is any nucleotide
nnnnnnnnnnnnnnnnnnnnntcttatgagattacgcctaccattttatatagcctcatcatgttgtggttagtatgatcatttgtattctcatgaatccatagtatagactaaccctttctctgcttataatttgcaccacaggcactgagtaaatcatattctaatgaattatttttaaaaactgttctaagattcttgtaatatattaaactatatgatgttagagttaacttgaaaagaaagaaacacaaaagctttggtagtgctttagcttgcaatttaagtgtttccaaggtrtacctttgacatacatactctgtacaactgacccaggtattataactaaagtataaacttctcagtgtaatgtctgctaaaagcttagactgctcttttctagggcccaggaggcattaatttaaaagaggtgtcatttggaagaactaatatatatcttgtggcagtagaagtgtctgccacctcatggggttggggaaactcactttagttcagttcagttcagtcgctcagtcgtgtccgactctttgtgatccattgtgagaatttcacagaattagccaacattttgcagacc

SEQ ID NO: 21388 - DNA, 484 bp, Bovine  MMBT09065
ctgaggctggaacaggtaggtaggcactctgtatgctcctgaggaaataataagaaaggaaataaatacactcctagcttttgaaagtttccgtctcggaagcttgccaaatacacgcagtatgcagtcttccaccaggccttggtgagggtttaattacgcggctgcgaagcatcattactgctaaccaggagaacttgctaactgaaagagacctggcagttcacttcctccacagatttcagatttttctttttcatttttgctttattaagttggaactctaatggaaccttccckggcactcatctcctagtaactctttgaactcacaccaccagagagaggtggcattgactgaaccttcacaatggcgaacacgagcaccgattaatcagttcccttgaaaagaaaattggaacaggtagagctggagactggctttcagacacaggagttggaatcattattctgaaataatctc

SEQ ID NO: 21389 - DNA, 600 bp, Bovine  MMBT06519
gtatttttggagaataattaaatatatttaatttaagaggaattattttggctaaattccctagaaacttttgctaattaagaaaatagtatgtgtagaatggccacctgatgtgaacagtggatcactggaaaagagggcgtctgccttcattctctccctgatgctgggaaagatagagggtagaaggagaagagggcatcagaggacgagatgaatggatggcatcaccgatgcaacggacgtgaacttgtgcaaactttgggagatggtgagggacagggaggcctagtgtgctgyagtccatggggtcacaaagagtcagacacgacttggcgagtgaacagcagcaaatataatgtggaaagcaggaacacaggactgggcaagagaagaagctagtccttaacaccctacaactggggcttcagctgatcctgcaaggaagatctcagggaccaactgctgctgggagttcagcatcagttcagttttctggaagtgaagaaagtggactctggaaccagactatatgagttttaatctcatgcatcctgttaatagtaagctgtgtgatttgatcaagttagtcaacctctc

SEQ ID NO: 21390 - DNA, 600 bp, Bovine  MMBT06454
caggctgccatggaaatggggatgaaatagactccagacgtcacccagctcaagccttctccacagacacggtgccgcggagaaatcggggcctctcttcagggctcagactgtaacttggggtgactgtgaatgctcagccttcgccactctttaggatgtgtgaaatttataccccaagaggccaaaagccagatacgccattcatcacagcacaccactcagcacacaatagccatgcgtgttctatcaggagtcactgatctggggcccactggatgtatgggtttaagagagacyatacgcaaaataatgtgcaaatacattctctagtgaaagggaccatagcctttctcagattctcaataggcccatgtcttcctctcaaaaaaaaaaaaaaaggagagagagagattttaagawctttgttctacaccaaagaaattgtacagccggctcaccaggccacaagagcccttctcygagatcacttccctgtgaaagcatcatctatcatcacccagggcaccaagcggcagctgcaccacagtcagaaaactccaaatggyccagcagcccaataartcacccrcccatcag

SEQ ID NO: 21391 - DNA, 600 bp, Bovine  MMBT08068
tctagaagtactcacatatgacagttcaatacaaagtcctggggaattgctagaaagagatatgcattctcataagaaagacttaatagcattcagagcaaattaaatgatatgcacttgtagagatttgagagtaagcgtttttagttgtactcccatattacatggctttttcctttcaaaaattctactgagcataattatgaaaatgactgataatttagataatatttagtgtcagaatttcaaaaacaaaacctgaatgtttactctaaaagtaattatccctcaaggaaacayataaataaagttacagccattgccacaacaatccaaccagactcagactatatggtaaatttataagaaagttttgcagtttgagtagtctcaataaggtcgcataaagatgaacagaaatgacattttatgtaagaagccggagatttaagtgtagaatataagaatgctgagaactaagaacacgaagatttaaagagagaataagtggttggcagaattatcagcactcaattgcattaatctatagagaaggaaagattatttgagaggatatggaatccttcccatttttgatat

SEQ ID NO: 21392 - DNA, 600 bp, Bovine  MMBT03474
atttaaacacactcgtcccacgtactgagacaattaagccacaggaggtctttatcaaataatgcactctcttgcttttcccatacacagtaatgagcgggaacggaggatttaataccagggtaggcgacactcaacagccacttgcacagcttggtatatttagctaagtccttgggcagaaaaccgtggctttgcccatgatatgcactgagagatgcctgtcatggcctgaaacaggcctgtccagcttttcaggaaaagataagcctcgtccaagcaaggtaaaggccactgccrtgcaggtttctgggcctgggtagggctttaatttttaatttcatctccacctagcgccagtcctgtcttcactaggaggccccaaccccacccaagcggcagcgtgctttctgcttggatcatccggccccagcctcctggggccctcaccgtgcctttctaaccagaggctgggcttgccctggccaggcccctcccacggcaggctccattcatgcagacacgcacgtatataaagtatcgttcaaccaacccagacaggccgcggcacagacggggtccccttggaggggcccgagt

SEQ ID NO: 21393 - DNA, 600 bp, Bovine  MMBT08556
cccatccctgggattctccaggcaagaacattggagtgggttgccatttccttctccaatgcatgaaagtgaaaagtgaaagtgaagtctctcaatcgtgcccgactcttatcgactccatggactgcagcctaccaggctcctccgtccatgggattttccaggcaagagtactggagtgggttgccattgccttctccagaaaattttttttttttttgctaatgatatttaaattttttaacagcattcaactctttgaaggacgctgtgttgtaatacacatttcattttttattyctgctatttggaaagtaacttgtgatgccattacgggacctggggagattatgggtggtcacggtgatggctgccgcaggcttgtaggaccctctctggagtgcttgagtgagtgggtgaaacccccgttttctgtgaaatagtgaagtggctacctgtcctgcagtctggggacaaggactaggagcgccctttgctgttgtacctccaggctgatgtgagcagcgctcacgggaaatttctcaatggtgacagtataaatggacaaattctgaaaaaagtttttaaaattctaccttt

SEQ ID NO: 21394 - DNA, 600 bp, Bovine  MMBT07480
agagaccgcaactgtcaggaaacttttctaattcagaagagtcattaccataactggaaaaagaacattaaatgcgtattacaataaaagatagtcatgttctcatccaccactgtataactcacatatttgatccctacatttgtcattgcttatccaagattagaaaactgtgtaccaatagagtggaaaataaatccaggactcctaagctgcctctgtgaattcctcctttttgaactagtgaatattagtggaactggaaaaaaattactaaaatgtcttattttcttttgtcgyctatttatatagatagatgtacagaaacttcttgaaatttccaagaacactatccaataaatatctaaaggtrgatatggaaaaattaatcaaatggatgtctttcaatagaaaaattatttctctgggtttgttataaagtatcctgatgatcctggaacttgcaacaattttaatagacactctgtatggagaccttgttgataaaccattctacctttggtaggagtatggagaaatgtagtcctataactaggcaaatactatgatattttatggtgttataagatttattataac

SEQ ID NO: 21395 - DNA, 600 bp, Bovine  MMBT04944
gattgcccaaaccaaaactgagactttccttcttactcacctacttaaccaaaagcaactagtcactaactccttttgattctaattctctcaaacctgttcttcttctgatccctttctcctcattatctttctacatgtatttctctgatttcaactaggccctcttccaatatatcctcctcactacccaaagcaactgtcaaacaaatgctaactcttattaagtccactattttattttaaaatcctgaccatcaggttaagattcaaatgcctttatttagcataagataacayttaccatctggccactgcctagaagttaatgggaaccaagagaaccccaagaagacaatggcgcgagcgcttactgcartcascactcctctcccatggacgccacatacatatcaattcttcttacaattatctttycaaaggcamcaaataattttactattcgaggccaggctttacctgatactaaaatatgtgatccactggacaggaattagatacgattttattatattaaggcttataccattaggctgctgttgcagtgaaatttaatacatttttatgtaggtagaaaga

SEQ ID NO: 21396 - DNA, 600 bp, Bovine  MMBT05292
acgagggagrggggcagagtagggtagcaggacagccccaggctctcagaggtggggcgcccagcccgcctccccctttgcaaatgtgattaggtctctgcagagcagctgaaatcaggttagcatctctgagccgagcccagtaatcacagcccggagcagagcaggtgctggggttaaagcggcttctgagaatgaggacaagctgactcacagccctcaaaacacgaatacatgggccctgccgtcaccagcctggcacatcttcctgggaccctgggtcccatgctgcccacatgytgtgcagggagctgcccagggatgggcttggttggaagggcctccagcatggccagtgtgcggggttctttaactggcagaaccagagctaagcatacctgcgctctcttcttggtctggtcctgcctgtttatccccagaccccacgctgagtgtctcacttaagctaacagtaaagtagggggtcccaaagacacccaaatcaggagggtcctgatgagtgaatataatgtctgcaaagctgagacatgttctcagctgaggccactcccaggactgggcagtgttttcttgatttta

SEQ ID NO: 21397 - DNA, 600 bp, Bovine  MMBT01697
aacaatgctttttacaacaccaactaaaaaattaagccaactcttaggaactcaactctttgattttccagatccttgccccatgctatcggtatgtttttctttctactttttacccacttgacattgaaaattgagttggaggaccattacatagacaaatatctgtggatttgtccaccaatacagtgtcctatctgtgataagttttattatttagaatttaaatgtgtaattagtgggggaaaagacctagaaaaataactaagaagttaatcataaattaacttagtgcagtgyatattgaatgaatggctgtcaatatctcccttagcaaacatgagaaacacactgagccaaaggcacactcaccaacctccaggaccttcatactctcatctcaacccccaccaagcctccttctgatgttgggtgggctgacgcacaggcaagaagtagtgaggagccaggggtaagcccctttcagggaatggagaattgacgttagcaatcagactcaatttctagctctcactaagtttatggatattaactgaatttgagagcaaaccctccaaggaacttagctgaaatcatctc

SEQ ID NO: 21398 - DNA, 600 bp, Bovine  MMBT08390
gagagaactattggtgtgactatcacataaaatacaaacatatttcacatatatattttgaataatttcatttcaaatgtatgtcattctatcttaatactaatatgcatcatttttgtgatctgctttattttattctcactagaacaatggatgtgtggtgagggagcaataaatagaatcatctgaggagtgatttgaaattgcacattctcctttgagaaagagagttggcttttttgaaaaaaagctccccaggtggtgattaatccttgatacccatcccagctgataaccagyatgctagctgcaagataaaagcatcctacactatacttatcaatttgcaatgaaattaaatgagcatagggtatcaactttcttttcctcagtgaaaggcactgaaccagaaaatcaaataaagagttactttattaaaaaattaaaaagctcgcttactctacaaagatacattttgagaaatattctggtccatcaatataaatacctgcttggagatggaggcgtgtgaagtgacattgttggtacccctgttgttggcgtgacgtggctcggtaactgagtgccttgtgataagct

SEQ ID NO: 21399 - DNA, 600 bp, Bovine  MMBT11148
tatggctgatcactactaaacctatttacttgtttgtgatttttattctactataatgatttttattctactaatatcaaccttttcatgatccaacatcacaattattttagtaggagcaaatataataattactgccctatattccctgtacatgctaatcayaacacaacaaggaaaatacactcaccatatcaacaatatttcaccttccttcacaaaagaaaatgcactcatatcactacacattctacctctattacttctatacctaaacccaatgacatgggttctactctratgacatgtcacatgttgggtagcaacttggacttttggagattttttttttttttgcatagtaaatatactgaaattattggaagtatttgtatttaatgmcaaaaattttgaagaattttatgttagttctgtttcacactcaggtagttttgatagcttgacttttaaagaatccttttaagatcatgaagcattaacacatttcagaaatactaatgtagacctgaagataatgatctacacacataatgatatacctgtcaagagatgattaataccaagagcaaaattcatgaa

SEQ ID NO: 21400 - DNA, 600 bp, Bovine  MMBT07786
taaatattcactaagtggaataattattaacaagaaagaaaaaaggtctgacataatatgaatcaatactaaataaaaacaagtccattttctttacatcactattatagattttgacctttactttgtaaatgtgctatgaatcataagatgctgctattcttcattccaatagctcttctataagaatacratgtcccaagtttagagaaaattcgtattccttttttcaaagcaaagcactgctgtgatttttttwaaattgttgtttataacaagtctgattccagtaaacagtastgttgtgattttggttaactttttctataagtratttatcatgtaaaagaatagtgccgttttttatagctgttagaatatattttgtgtaataattttgtagtgatactaactctgttatgtgttttacaatgacaaattttcacatattgaaaagatgtgagaaacgtaataagcaggaaattaaaaacacaggaatacaaaggtaagagacattataataatggttagaaatttaacattttatagtataaagcgttttcacatactgaatctcatttgaacaaaacttacaagact

SEQ ID NO: 21401 - DNA, 600 bp, Bovine  MMBT05344
agaagttgcccatttcagagaagccagaagttggcaatttattttcaaaagaaaaatgttaagcactgtaggaaccaaacaaaacactaatggcaggatgcagcccagcagtctctcattggcagcttttgggttgctcattaagccactggaatgtgacaggaatccttgtcagatttgctccatgtcccacacacactgcctggaatagagtaagcgctcaataagtgttgaattcgaaccaggcagctaacagaaatgtcagtaccctctctgcactgtggtttgacgttcctaagratagacttctgactgataatactgtgcacctgggtcctggtgaagcttcgctttctggttgtcagaagaatgagactaagacactttgcattcctgcttggctctggctttgctctgattgcatatccaggaggggcagtgatcgcaggatgttgagttactgaagtcagaagtctttggttccagtttcagccggggcacttgttgaacagacacatcacttcacctctctgagtttgtttcctcatctgtaaaatggaaataaatctggcccttcatgccttgccagggctatgaatt

SEQ ID NO: 21402 - DNA, 598 bp, Bovine  MMBT12823
  misc_feature (1)..(78): n is any nucleotide
nnnnnnnnnnnnnnnnnnnnnnnnnnnnnnnnnnnnnnnnnnnnnnnnnnnnnnnnnnnnnnnnnnnnnnnnnnnnnnctttcccctcactcccctgcgcttctctggtctcactccctctctctccacaccgattctttttctctttgagctaagcctgtactattaatataacatcttctaacccaaaaagcagtggtcagaaagggaaagtttacaggttaagacattttaaagagaacagtattgatgggcatttgggctgcaggcaaaatacaaacctgattctgtataaaccaygcagtctgtaattttcttccagcatacttcaccgttttgagttacaatgctgctgatgtcgcaactttctctgacttcaaacccaagtttacagatcatgtcatacactgaaggagaaagacaggtggcaatcggctccccaactaatatctgaaatataaaacataaaacacactcttcaacagaaaatattaactttataatatatttaagtcacaggaaaactgttatgtcttatagaatatactcaggaatagttactgtgttaacactttctggatgtcagaagaactatatg

SEQ ID NO: 21403 - DNA, 598 bp, Bovine  MMBT12668
  misc_feature (1)..(57): n is any nucleotide
nnnnnnnnnnnnnnnnnnnnnnnnnnnnnnnnnnnnnnnnnnnnnnnnnnnnnnnnnccccccccccccccttattttataggtaacacataaatatctttgcttgttaagaataattctggttaaggctgaggttccctttgtgatgctctgtttgtattacaatacatgatccttcactgttcattttcttataaaatgcatggaagtataaaatttttcctccttaaaggacaccaggaatttaagttctttcctctgaacgctttcctatgtaggtctagctcacagagttgactytgcttcatatttgtgtctcctgcaagctttaatgcttccaaattggctcagctgtggctctttgccttcacttcaatttatcaggagtagcttcatcagcaaaggattcaatgcccaatccaaaacctgtttgcttatgtaagacacagtggaaaaggcagctccccttcaatgtcatggaagctggtgggagtagtgactggagaacttgtgtcctagaggggcacccactgggagccagggaaaaggaaaactttcctctcttgtgtcatctggtccttccagctgttgctcagca

SEQ ID NO: 21404 - DNA, 598 bp, Bovine  MMBT11229
  misc_feature (1)..(125): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagacagcccttcaaaatggatttccatttgaaactactcccaaattatatgctaatgttttaacatggtttattgaactaaaataatgcaggtacagagctttaaaatacatacatatactagaaggcttgtaatgaaaaaagttgttccctggcctactctttaggggcgrtagtctcaactctattacgtattcatccagattagatgcatatatctaaataaatccatatactactaattcttgatttattcattttaagggttatttgttgacttcctgccatgacagttaaaaacatgagtctatcacttctgttccccacctcccttatttatgtaaaaattttagttaaaccaataatcagcatttaaattatgtatgcaaatactgtttaccaatgagccaatgggtactacaactgtgccttataatttatacagcccttcatttttcttagagttaatta

SEQ ID NO: 21405 - DNA, 600 bp, Bovine  MMBT01111
cccttccaggaagaacacaagggctcctgagtgcagaaaagggcaattaactaattcattgtgtccttacatttctataaaataacaccttttctgagttgataaggtttatatgtctactttttaaaactggcaaatacaaaaagtatgaagaagtacttataatcagaaccagctatgtagtttgtggggtccactggaaaataaaaatacggggtcccttgttcagaaatcattaagaacttaaagacaatgacagcagagcatcagactaagtctataattctcctacatgagggrccctgggcagctacacaggttacacacccatgaagacagtcctgcttattatcccactccaccccgaggcaaccaccgttaatatgttggcataatttattcctttaatccctttttatgcagcttttattatgtggttgagatcatactctaatgaaaacttaatatctgatttttatacttgatattattttatttgcattttccatgacattaaaaactcttagccaccaaggttaatggctgtataatattccatcgtgtgaattagttgagccattccagttgtttctaatattt

SEQ ID NO: 21406 - DNA, 600 bp, Bovine  MMBT12393
atactgatcaaaaggagcggaccccttgagatgcatttgacctggacaattccttcaataatctggtctagcaggctcaatttctccacattccctctagtccagtcccattaaatcattctaaaggggttaaataacagacatcccaacccagatgccaaaaagcatttgatgatgggttagatctgccaagcaatcattgctattcatcggtaaaattagatgtccatatgaatgtgcgtatagaaggaaatttcagtatgtattgtaactgtgtgtggcagtctgttgccatggaaygctcacttctctgatatttactgtcagacttcattcacagatatttcacaggcagatggtttctttcactggctcaggagccacttcaaagtgttttgattcctgaccaagtcgtatattatacttcctttaggaagattttcttcccagctgccgactttaaaataaaatcaagaataatcaaaaggttgcacaaccctttcagcttaactatcttcaaagagcagacagcaaaatcttctttaccatagcgatgtattggaaattaaataatatctaacacttctttaaaggcaacat

SEQ ID NO: 21407 - DNA, 600 bp, Bovine  MMBT08774
gagcccatgtgagcaactagggcttccaggagtaattcagtaatgtcttaacagattaagtttctgagccagccgcatttattctgtgaattaattagaataattattttaaaaatctgctagaagaaaagaggttgaatgaagactcttaatttgctctgtactggattttggaagttaaaccagcattgcatattgagaaaatcagccactggaaatatgtgactattgtctattctaataggttgctttagctaaatcttatattattttatggatgtgtgaggggattagaaacasatccccaccttatggttcagattgttccaattctttctgaatgaaacttggcttttattgaccttggttgaaatcctctggcagccagggtcccaaataaaagcattactgcctcgcaggtgtgcaaactctccttcgccacactgctcatctcttgggctttactaatttcttaaggcagaagctaagcagggagaaatccagtgtctgggcattagggttccttctcctcctttcctgagatcacagtgttattatgtccataactgtgtgattaatttaacatctggcttgcctact

SEQ ID NO: 21408 - DNA, 600 bp, Bovine  MMBT00720
gttcccactttaggatacaaaactgtatatattacattttctaaaatctcctttttataattttatataaaaaaagaagatgcattaaatcattaaaaattaactgttctacatgatggaattttagttgattttttctatttactttttgggtattttcagttttttattaaacaaatatatggtatttatatggagagtataatatatttttatttgtactccttctctttatgtgcctctcaatttagtacccaaatctataagaactcttagagaaaataaatatcagtgattgaytttttrgctggccaggtgttggataagarccttattattaatactaccacatttatttattacaatacccctctgttatggatgttcttgtgcttttacaagcagcaactctgggttttctctccaaatgtttgtgattttaaagcccaagctcattcgtatttcacaaaataacttcctaggagctgttaaaacagattttttatgacagtcaaggagggtatacttggaggatcccaagcagaattactcttactctgagtattgttactctgaaagttctgatcttttatcttacaa

SEQ ID NO: 21409 - DNA, 600 bp, Bovine  MMBT07476
cttcttctccagaagtctcttttcccactagcagtcactaagcactcagtgtccactcatggtccctgagaaaccataggaaaaattcttcacatatcacagaaagtgtgtgctctccaagtgtttgattttggccagtaacatggctagtctcatgcctgattgtactttcaaaccatattcgctgcctgattaggataatctgtgtcaaaattgctatctctgtgtagcatatctagaaggatcctaaggaccagtactgtgtgtactgaccttaatttatcctaccttaattatttyccaatctatttatctttctcattgtttatattttccaccaattggtctgtttttcttccattggtacatatacatttctgggaactacatcaaattctttcttcaaaggagaagtgttatataaaaacataaataaataaacattttttgagtagcactgaaggaacattatggttaaacctttagccagaacttatttaaatgaagagcattggtggtctgactttcttaaatgttttaaaaatttcctagcattctgtgagggtgtgaatgataaatgatacattatctgctaaaatt

SEQ ID NO: 21410 - DNA, 600 bp, Bovine  MMBT02403
caagttctcagggaatgtgaccagaggtccagaagggtggaacagcagttcacccaaggcagacaagagtccagtgtagccagaactctgtgctcatgatgcggagagatgggaagtgaggttgagataggttgaggctgaattctgggttctattttggggtaaaatttcaatatggaaatttctgaggaaatcatgaattttaaagcaaaattgcaataagctaatgaggatgtcataaaatctgtcaatccagaaagcatgcttgatgtgtaacttctgctgcagattgtgggacaygtgaagagccttccatcagagacctcatcagcttcctccacctaatacccgccatcagccagttacacactgctcagtcaatcaatggtcactgataaatatcagagctttccaactcacgggagaccgatgccttgattttcctcgtcttctgaatcaatgagttggcagatgttctcaagcactggtggtgggtactgattgaatcctcctattgagagaggaaaatgatagttaaattttaaactataaattgtatgtgctaaggggaaaagaactgcagtaggaatcttcgtgaag

SEQ ID NO: 21411 - DNA, 600 bp, Bovine  MMBT08840
tctttaaaaaagaagcagaattagtcatttctgaccttaactatttatagtaacaatgatagagaatggctacaataagtcatattttggctcacaagaaagggaaagtcttgtttttcacagttcctttagcagttcaagttcagctcttcaatgataaatgctgaataaacattttaaacatgtacaaaatcactgagtaattatatggtgttattatatagatagatatttttttatgtaagtgtgatgtatctttgctggtttaaccttatctggtgaaagaatcaaatgaatgcmtactgggagcctttcaagaatgggtgcaatcctctaaattcagaaaataagtattcttaaagaaaatgggtcaacaggccaccaaataaactacatagtgatggatattrtcyattgtttgaggttgtcgtcacaccaaaaacagagtatacttcatacctctatcacttacagataaagtacaaactcttcttcctgccttccaagtgctcactcaatagataktccattcagtcttctctcctgcttatccacaaaggccctgcacttcacaatgatcaatcttcttattttgccttg

SEQ ID NO: 21412 - DNA, 600 bp, Bovine  MMBT03387; identical to SEQ ID NO: 4675

SEQ ID NO: 21413 - DNA, 600 bp, Bovine  MMBT03010
ccatgatcatgaggccagtcctcaatggggctgttccatccttgcccagaaggtgactgagagagggcaggagtggagaggcagtgagaatgtgaatactcttgttggcagtccccctggtcaccccaaattaacaggtccccaaaacagggtctctggcttgagggcagcagctgaggtccagggtgggatcctgcttcctagactgcactttgtgctgggaaacaaactcgaatacctatgggggcccaagcagtcatataaatgatagttcacttttcatttgttaggtatttctgygcaccatttcattttgtcctcccttctgtgtgtagcaagtactgttacatgcccatttcacagctcgggaaattgagacatggaaagattaagaatcttgtctgtagtcagagtgctggttaagtccatggtcaatcagctggcctccgaagacctcacgctccattgctactctccgctcccctctccaaggactctcccagctctgatggctcttacaccactgcccagcatccaccccatcctcagagctgttccacacctccgtgtacacctggcaagcgtctgcttaaatgaagt

SEQ ID NO: 21414 - DNA, 598 bp, Bovine  MMBT09088
  misc_feature (1)..(14): n is any nucleotide
nnnnnnnnnnnnnncttatgttttaaaaacaagtaagtttttgcatgaaaatggttcttgagaagaatttgaagtatttaggcggctagagtattacagattgttttggtaacactgtagtgacctaatgaatgctgtatcaaaaaggtaccgtataaatacaccctactgacttttaaaaatatagagtatatatattattaagtttctggcaacttggaatcagtggagtgcaacagatagtttcattgtactagaagaaagttgtatgattctgctatagctaattttgttgctgtycctgctgttgttatgattattagtattttactatagtgaaatttaccaaatctatttttataaagtatagcaaactggcaggtcataggggaaaatgaggtcaaattttaaagtaagtaataatggtctcaatattttttcagtaagacgtgtagataatcatgttttagcataaacataattaatatctccatgtatttgttgtaagatttacctaatgaaatttcatctctggcttaatttttatatctaattgatgcatttaaagtttaaaattgtcagaagtttggtgttcatt

SEQ ID NO: 21415 - DNA, 598 bp, Bovine  MMBT08061
  misc_feature (1)..(137): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacttttctgtatttccttatttttcttcaaaacaacttaaatcactattaatcttgaacaaagacatggtttgatttcatgttcttactgtagtacgtttcatctggaatgtagaattgtggtgggcccttcatgcctgtggctaagagacacttgaccaratgttccagggataactcataaattactgcttatacaacatgaaatacactgacatgakattgacatcaaagagtgggtccccactgaaatcatggttgctgatattaaagttgaactctcagattatgtctttgtagaaaaattaaaatcgaggaggatcgtaaactcctgcatttgcagtaaaccagcctgaataaacaagcaatgacagttgcaggtaggaggtatacttcgcgtttgttggaatggatatgtagccaatttatctaggagttagcataaggtctctatgttctt

SEQ ID NO: 21416 - DNA, 600 bp, Bovine  MMBT05205
ttccatccttgtctagagtacatttagtcttactttaccaaaaaagactctgtcttcagcctccactaaaactgctctcagtggacatcaatgccttccttgggaaaataacgttctttcttttaagaatgggttctctaggcagcagtttttaaatgttgacttccctttcccttgactttttaaaagttgcataatttattgaggtgaaatggacataacataaaatcaatcatttgaaagtgagcagtttactggcctttagaatattcccagcgttgtgcaaccaccacctctatygagttctgaaactgtatacaagcccctgtgtccccatcttttgaagtaaaaggcttcatatttagtttcccaggccccctctgagactcaaatagctggctcaagagttaatgattagaaaatgtgaacatgttgaaacaaagagctgttgggccaggaaactggtaacaatttcaggctgtaagttggccacatagcagttacctaactctcagttccctgaaagatatagataacaaaagctgacacacattcctaagttgtttttcagaaaccagatctctatcatatgaaaactgc

SEQ ID NO: 21417 - DNA, 553 bp, Bovine  MMBT11180
tttagtttatgttgtaaactcttctccaactataatttgagactttgaaagtcagtcctgaccaatcttatgcaaccttattttttggcacatttttttgctacagaaacacagattaaaataatttcccaactttgtgggaaaatgagaaactctcctgttgtctggcgagagacaagagaactgtgaaatgtcactgttgggctttgagttgggatccagagtggagcatgtgtttttggaaaggaagctctgtaaatggctgcagaaagcagtagctagtgggggaggagagaatcytggctcaagaagatttgggtcacaataaaaagtactaggggctttcctggcggctcagcaataaagaatccacttgccaatgcagggaatgcaggttggatccctgggtcgggaagatcacctggagaggaagtggcaacccactccagtactcttgcctcggaaaccctgtggacagaggagcccggcaggctaaaatccttggggccacaaaagagtcagacaaaacttagcaactaaacgacaaggaagt

SEQ ID NO: 21418 - DNA, 600 bp, Bovine  MMBT10387
ctctgctratgccttactgaatttgatcctcaccayctcattcatgagaagggagtcactctaaaggactaaaaaaaccacagaaccagagtgacaaaggcatccttccaacccacattgctggagtccaaagccaggttctttcccaacacgaggccaactccccagcaacagctcagccctgagccaggaagcagaaaaatcgcaggctgtggaaatcccccttagacctacttaccccacagtccttagcrcagggagctctctagttgaccttgcgtgcacacatccctatgcagrcctacacttatacccgattgggtgtacacactctgtacacaygcaggtatatgctactatacacagttacaacatgtgcgtgtgtccacactcctatgttataaagaattacacatgtggtttgggactttctggtggtcctgtggttaagactccgtgcttccaatgcaaggggtacaggtttgatccctggtcagagaactaagatcccacatgccagctggtgtggcaaaaaaaaaaccaaattatatacgtgatatatgtccgcacatatgaagctcagtgcttaaggcttacatt

SEQ ID NO: 21419 - DNA, 600 bp, Bovine  MMBT08329
aaaacagagcccagcccatgaggaggggattggccttgtagctgagtggctagtccctgagggggcagggcctaacctgacacctgccacctacaggctggactcaggttgggggcagcagagagctgctcccaccccggagcccacgcctgcaccaccctggaacccaggaaaaggcaactctgtgaatgtgaaagagcaaggactctgccagcctctacaagctccctgtaacaaagcttgcccagggctgcccagccactgcagccccaaagcctgggtcttatctccttccctccygtgggaaataaatgcacgcactggggaacacggccagcaagggacccctggcatttgagtctcctctgagcagccgatastccaaggacaccaccctgtgttctttctttcctccacttcgtgtgattacraaggtctgcccaggctggacacttgggttccaaatcattgaacctgaggtcaaccatttgcctggtctttcctcagttactgctgtgccctcagcccctggtgcagtgccaggaggcactgggaaaatattcttggaatgaatgaatgaatgaacacacactgtcttaa

SEQ ID NO: 21420 - DNA, 600 bp, Bovine  MMBT12142
ttcagaggccatatgatgatgaatcacggtcctgtttacagtgctaacatttttgttctcccttgtagctatgacaggagtctgaagagattttcagctyattctaattttcttccatgaagctgctacttactgtccarggctgatgctctttgcagaaagtatcctgggtagctcagggtttcaggatcttaaaagtgtctcctaaccagagtgcaaggacctaaaggcccttaattaagtttctaatcacaaacaagatggtcttgtattaagggccctttgaaagtagcagcaatygtgtcattgtgtctccgtcccgtcaccgtatcaaataggattcttattttagcactgaaagcaattctttccttgtagagagtgaagagaaactctcaacagtcagtytgacgaacagaacacagtagagcaaaacacatttccttttctctcccacaaggctgtggagctgactttattttatttgacaattacagagcgaatgctattttacaaatcttgggctgtttaatcttcgtagcaaccttgtgacataggtactattgtcatctccagtttacagaggagaaaaggacacac

SEQ ID NO: 21421 - DNA, 598 bp, Bovine  MMBT03248
  misc_feature (1)..(29): n is any nucleotide
nnnnnnnnnnnnnnnnnnnnnnnnnnnnntttattacatgaatatcccaggtatcccaggagcgttagtggtaaagaacatccctgccaacaaaggagacgtaagagatgtgagtttgatccccgggttgggaagatactctagagaaggaagaggcaacccactccagtattcttgcttggagaatcccatggacagaggagcctggcagggtccaaagagtcggacacgactgaaatgacttagcatgcacgcacacgaatattatctgttcaacaatatgaaaaattaatagatggractgaattaaaatgagacataattctttctagtgattagttattgagaagcatggcttaaaagaagcatattttactattctaaatttggagtgaaatcttttagaaagttcttatttaacaatcaaaattaaaagatctgtkttgtctgctttgaaaggagttatgttatcatgagaaagcgtctctagatatgtgcatttctctttcttgactatttatcaaagaagactttctggattgaacctactcccatcaccagatagatttcagcctctcacaaagaagttatgtgcttt

SEQ ID NO: 21422 - DNA, 600 bp, Bovine  MMBT10842
cctaatgctcctgatgaagtctgtgagcaacatatcaagggtaaccaactgcaattgagtcttagaagtatagggtcagtttagaactacattttctccccttgtgttcttgggtggaaggggactggcataagtaaagtattctgctgagaattatgctctacggaatcatttttagtcacgcctccgaaaacaactcggttttaaattcccagccattgtctgtgaagcctggcaacaattcttctgctgtcccttcaggaatagcaactgatgtctctcctaacatttaggttaggygtgcaaaaactgtacgagcttaaaaacattcaactgtccattccagagagggcagtgttagtggtgggaatcatcattcactatgactacagctgctactttcaccatcagtaccacagcccccatttcctgagtgccttctggttgtcagacatagcactaagctcttcacgttcattattttattcacaacaacccatgggtgtaggcagcgtatttgtttttgttttacagatgaagaaattaaggggcagagaaaaataacttacctaaggtcccagaggctgtaagatgcagaac

SEQ ID NO: 21423 - DNA, 600 bp, Bovine  MMBT06836
tttaactatctttttctgtgtgtttaaaaatagcatgtgttacttttaaagattagaaaatatttaactttgttgtagctgtttttttattgtattttactttattccctgatatcttcatggatgtatacctcaaatatgtaagaaaatacttttacttgtggctttataagcgtcagtaattcctcagtccttaaaactatcttccatgccagttcgtgaaattttcacaaagagtatcttacatctgtgatatgaatttgttgtgaggaggttgtttcaaaattggaatagagggargtcaaggaatttttagtttttcttttacctcactctccagaactacccccaacagataccacaagcaaagaactttattttagttccaaatttaagaatagtggctatatatgaaggcatttgacaaggacaaagagatttaaattggagtatattttgaaataggtgaagtcatctatatagtaaggcatgctgctgtagggtaaaatgcataatgtcaattttcagattctttttcagtatcttaggattttgagctatagatttgaaatatacaattattgtcagaaagtcctaagc

SEQ ID NO: 21424 - DNA, 600 bp, Bovine  MMBT00638
tttcagtctgctgagaattttagatgagtatgcatcagatgggcatgaaggcctgctggggccccaggatttactggacttctgttgtgcctttcatagtgacctctgcaagtcctgagggtgagaaaggagctgcgggcaaagggtttggttcttgatgatgggggtgaggctcttgcttcagtgagaagggcataagctttgaggttagaagaatttgagttctactcctaacacatcttctagctgtgtgacttgaggcaagataccttatcttttgaagatagtcacctccaaaaytaaaaaaaaaaaaaaaaaggttatggagagatcaagtttagtaactgatacccttggggatttggtaagattagaagtgaggtatgccaagccactagcccgttgcctggtactaagaagttgttcaataaacactggtaaagtttgttattcttgtatgaactgaggattcaggggtggaagaacatatggaaagtcttctctctatattttaaaagtccctgcaactcaaggagaccctactgtgtgctggactttgcgttaggccctgaaaatagaaagagggtctaatcacaaccc

SEQ ID NO: 21425 - DNA, 600 bp, Bovine  MMBT10076
taatcttaggctcacagaatttaagtaatgaacctagtaactgggtctcggtctaagctttctggctccttgtttggtgatcttccgttttgctttcttcctgaaatttgcccgttagcctgtgttgtgtgagagacgatccacctgctgcattttgtattcacagcactggcgacgagtgacaaacggcgggaagtgtacaagcgcgtgtaggctgttcccttctttaacctctgtctactgcagaggctgtaactccagaggcctgatacacatgtctacaggtaataaatctgtgtragttatagctgtatccttgtagatttacaatgataagttttaattcatgtctggcaacatatttacataaattacagcaatagagtaatgatgccatatgctggaatgttcacccagagaaattcaagaggcttacggcagctggctttcttatggccacaaagggccgccctcatatatatgagaaagaagcattgaatttggtattgtgggcattatacagatgttttcttactcttgacatttgtctgaaagtaaactatgcttccagtgcctctcactgcattaatgaatagtctc

SEQ ID NO: 21426 - DNA, 600 bp, Bovine  MMBT07991
gtgtgattggcatctcttctgggtgacagagaagacttggctcaatagagaggggatctgtagttgtaggtaatgcacaaagttggcactgctcataagtaaccactgattgattatatctttttgtaattgttaccttcttactctatcataaaaaaaggaccatcagcttagagaaacagaatgaacactgaactrggcattcaaagataagggttctaaatttgattctgtaacttacaagttgtgggacttacagatagccaacaaattttgttagactttgtgtttcttgcccascaaatggagaaagattagactctatattcatttatggcccttccaactctgatagtctataattctatgagccaaaaaaccatctcascatcattgtaatagctttattttccaaaaattgaagaccagagtatttacataacaataattttgatttataagggactcagcagrgtttctactaagagaattttatccaaggcctttttgtttagacttcctttctctacatcaatggaaaaacaaaatttctcagcttactcaggtacacatatcctgaaacagtaaaagaggttaaaa

SEQ ID NO: 21427 - DNA, 557 bp, Bovine  MMBT07160
ccctgcaaggataggggattcaatctgtgttgtcattcagacaggattagactttggctttgcttttcagaaatcttgaccttgcaagaaaataagggtttcacgcctcgcttttattcttttctttctttttttctcctagaagtcatagaagttttcaggtgctaaatgagctgggaatttaagtccctgagctcatcattgtcttcctttaagttttctagtacaattagcaatgaccaaccaaccaatcaatccaccccattaaaatgctctaaggttgcaaatacttggccactyggagtcctgtcttttgtaggaactttatcacagatatctaaggctaaaatctgagtaactcttttgccatttcactagagccctcttcaccaatggcaacagattcattaatgcctttaaatctaatcagatcagagaaccaattccagaaaactcagaacctattcagagaacccgtccttaagctctgttccttaggagctattcttggaacctcaggcagttgtgtaaggtcattgcctccatgtctgatggtg

SEQ ID NO: 21428 - DNA, 600 bp, Bovine  MMBT06932
gaactgagaaccagagggtaggaagcacaggggaagggttctgagctgaccttgaccttggcagtgggtcagggagggatgagtcagcagagagcagatgaaaagaggaagaaagagagcgcgcgggaatggaaatgtagtttgccggagctcagaatcctctcctttcgatttgattccccgaggaatacagatccccacgggggatggtggtggagaagtggcccaattaggactggattcaaagaaatcgccggtggccctttgtgtagctcattagtgaaagagggactggaggcrgcggcagcgtgaggagggtcccggcaaagaccccgcagcaggaggagacggagagcagaggagagaccactgggagaaaatcatcagaactcagtgttccccaactgggcaacttgagcgcttgttatctgcctctcctgagtcgggagatgggctggagcgtgtgaataacagatgaagtgctgtgtagatgatgttgattagaatgaacagtttaacaatgtgcttaaatgaaaatttcagggctggagacccaattaggagtctcattagaggctcagcacaaggggcgccggcttt

SEQ ID NO: 21429 - DNA, 600 bp, Bovine  MMBT02896
aggcaagcatactgtggtgggttgccatttccttctccaggggctcttccccacccagagatcaaaccaacatctcctgcactggcaggcactggcaggtggattctttaccactgagccacccttaccatacaggcactgtgccaactcacctggcatggtgaggttggaaggatacagccagttcaagaaatgaacctctcacattgcaattggcaccagaagcacgtgggttgttaatgagaaacaggtttgaaatctatggagacaagacttagcctgcaaaattgattccaacawcagacatgcaaaaaagcagtgaaggaatcagttctcatctacaccttgtcaaagcagaagttcacctctgtcaatagtatactcagtgatgcagtatatacacagttataaagactcagacattattttttcttttttatgagaatggcatactaaatttcaactgcaacttggccggaagtttagctttttgttttaagtgagaaattacaaacccctgatttgatttttatataaagcatagcttgttttataatgtgaatgtgtttaatagataggaaaagttaagataagtatcta

SEQ ID NO: 21430 - DNA, 600 bp, Bovine  MMBT11646
agacagcccaacgtgccccttgtaacttcagggtgtggggaagacagtaagagggctccctgaggtcttgttcataagtgcacagatcccagtttttgaggggttttaaagctctttttgtgcaaaagagagcaacactatgacaaaacgattattttgcattggatagaacaggaaaaactgcagaatctacccaattttcagctttctgggattaccgcatgcctcgtgtttttcaaactgaaaaatgtagcatttttgcttcacaggcaaagctggaaatcagctatctgctctaaygcctaaaacagtggatttaatccaagttctcctagggatcctgttttattcactgccctgagcttatgttgggcttccctggtacctcagctggtaaagaacccgtctgcaatgcaggagaccctggtttgattcctgggtcaggaagagtgcctggagaaggaatggggtacccactccagtgttcttggacttccctggtggctcagatggtaaagaatccacccgcaatatggacgacccgagttctatcccagggttaggaagactccctggaggarggaatggtaacccactcca

SEQ ID NO: 21431 - DNA, 598 bp, Bovine  MMBT09369
  misc_feature (1)..(26): n is any nucleotide
nnnnnnnnnnnnnnnnnnnnnnnnnnatgagggactatggaatctatcctttgcccattacatgcatcatagttcaaaccacctaaaaagggtgtcttcatgaccccctggtcggcatagcctgtatcatttccatctaaataaaccaatctttttcccctcaaaatagaactctgctataatttgccctccttccataaaaactggagagagagaaattcaatggaaaaattgagtcccaggatgccaataaagccggggtgtctgccaggcaggatctttgtgtgtgtgcatccctaygccccccagcaccagccagtaagatctctaccctgagagaattacattctcacctcattctccttgtgacctggggtcaggtaggaacagggcaggtttgtgaacttggaagagagtcgcactaacaggcccctgtggtaatgaaatctcgaccatcacccctgtaccagactctaatcaactgagtgggggggttgttgcctctggccaaaggagcagagataacaaggtgttggaggagtcaggatacatcaagcaagcactccaggcagaggtgtcttcgtcaaaaagcctctcc

SEQ ID NO: 21432 - DNA, 600 bp, Bovine  MMBT11141
cagaatgtggttgctcacacccggaacgattaaacactcactgcattttttcaaggcaaattccacaaktcacatagttttagaaatcattacagagaaaaagaacaccacacacagtactttcataagagcaaacgctgtcatgaccacagaataccaaagaataagctctgcacatattcccagtttcatctttagttttccttgtttgtttctagacactattttctctgccactgacagtgtttaccgtctccggttgtcacataatgaaacagaagccgaaagcctgattatggygttagtagtttagaaagacaccaacatagctaggtgtcatattacctttgttttatttttattattttaaaaattctctctcctgagacaggctgtttttttagtctgaggatcctgaggaatcctaggtcagcagagttttggtaactggaaggttacgctcatagctagctgcagggttgagatgggcttccttggttgctcagttggtaaagaatccacctgcaatgtgttcaattcctggagagacatgtgttcaatttctgggtgaggaagatcccctggagaaggaaatgcaac

SEQ ID NO: 21433 - DNA, 598 bp, Bovine  MMBT08153
  misc_feature (1)..(47): n is any nucleotide
nnnnnnnnnnnnnnnnnnnnnnnnnnnnnnnnnnnnnnnnnnnnnnnaaaccagttgggcccaacagacacatacagagcactccacccaacaacagcgcaatacacatttctctcaattgcacaacgaacaatgtccaggacaggcccccaaacaagtcttaatagattctttaaagagactgaaatcatacaaaatatcttttccaaccacaatggaatgaaattagaaatcaatagcagaaggaaaactgaaaaatccagaaatatgtggaaattaaacaacatacttttcaacaaycagtgagtcaaagaagaaatcacaagggaaattgggaaactaccttgagacaagggaaaatgaaaacataacataccagaacttacgggatgcagtgaaagcagtgttaagagggaaatttatagttgtaaatgctatagaaaggtctctaatgaacaacctaactttatgctctaagtgtctagaaaaaatgatactggctgacagtttatgttctaaggcctcagagaccatgcttcctggatggtatgacccaccctgacttcaaatgttccctcggtgtttcaacatctgcagc

SEQ ID NO: 21434 - DNA, 600 bp, Bovine  MMBT07832
acatagttctgtgagctgttgaacttttgaatagctttaatgaatcctgtagggtcttgcactcactcatgttatggctgggcataaaaatgtcagtctttttctaaaagttaatgactcagaaatcttttcagatttctctggatagcaaacagttttttctgagtgctaggttttgttggattgtctcctttgcaacctcatttgagtgagaacaggcaattaacaagtatcacgtaaccttaagctttggaggcaccaaatataaggtagcaaaggtggaggattatgctgttttayatgcatgtggtcgagttaagccaggagactctctgattttgcttcctcatcaaaaatgcacttgtgccatgcttccctctcatgattatttcatatttcaagtaagcattcaatatctgacaggtttaattgtgggcattgaggtaacatggaaaataagaaataaaattatctgctttcataagtatatattctaggggaaaagaaattaatgtataaaaagtcataaagacaaaggatacaaaatataacttcaccacacatggtgatcaaggaaaaagtctctaagaaaacgatata

SEQ ID NO: 21435 - DNA, 600 bp, Bovine  MMBT10821
attgccttctccaaaatgtttactatgtgccaaacattgttgcctggcactctacagaaaatatctcacttgatctttttaacttattttattttttatacagttttaaaggttacactccacttatagttattacaaaatattggctatattcactgtgttttacaatacatccttaagtctatcttatacccagtagttactggtaaccattggtttgagctctgtgtctgtgagatctcacttgatctcggtagtaaccatctgaggtctgaaacattatccctgttttaggcatcmgttcagtaggcagttctcagagcctaggactctaaagccagtgttcttccttttctgccatggtaccttttttcttccctaatgttttagccatgcctcatggcatgggggatcttagttccctgagcagggatcaaacctttgccccctgcattgaaagcacagaatcttaaccactgaaccgccagggaagccccgccgtgtcatcttttaagtggctagttttcagcaaaaagaaggtacactgtgtgttatggctcatagtatagtttttaacagataacaaatttttagaaagca

SEQ ID NO: 21436 - DNA, 600 bp, Bovine  MMBT01452
ataacatttaatggtgaaatcagcttctaaaaataattctttatcacttcaagaagctttattaggaggttcaatttatgattcacagtattactatcttagtgaaaaaattgtagttttatattctttggaaatctccaagttgctggaggccaagtaaaccagattagtaccagtttttaaaagattcaaaggttcttaaattcagaagtcataattgctttaagaaattgtttcttacaacccaaatgtactatcatcagctgagcagcataatacagacttagtatgataaggtcyatccatgcccttcttctgaagtctttatagaactgaagagtccagggaggacacagactgcagaggaagggcatattgagggttttcactgggaggggggagcggggcagagtgagcagtggtttagcccagggcacaagcagacttgtaaagctgagttctgcttctgagtgggctagagtaggtcatggtacaccaactcacttactgacaaagagcagaaaaaactggataaataacaaaagttatacttttaatggcatcagagagttgaggaagctacaaggatcaatggactaa

SEQ ID NO: 21437 - DNA, 600 bp, Bovine  MMBT06613
aatgggaagagtttccattttgcaagattaagagttctggaggcaggcagtggtggcggctgcacagcagcgggaatgtgcttaacacaaccaaactcacacttaaaaatggtcacgatggcaaatttatgttgtgtgtatctcgccacaagtttttttaaagcccacagctcaagagtcatgtccctcttctgaagtctggagtcgcacctgccagatctccacgcatcaccctgaatgtagggggtgacacctggaaccttgttggaaactgagatcttatgggaaccatgaaaaatyggttccactccagacctcctgaaccagaaactccagccctggaattatcactgcaacacgtttgtcagatgactctaatgtccctcaaatatgagaactattgcccaagagtgatagatgtagggcaattggaagggatatgtttgaggtgtcttgaaggtagaaaaatatgacttggtgtggaatggacacggggcagagaaggcagaggctggatagatctgaatgaatgaatgtcttttaaaactattctgctcttactttttcttccttttactagagtcagaaagaaaaaataaa

SEQ ID NO: 21438 - DNA, 598 bp, Bovine  MMBT12747
  misc_feature (1)..(31): n is any nucleotide
nnnnnnnnnnnnnnnnnnnnnnnnnnnnnnnaaaaaataatttgaaatatttttgcttaataatgcctgttaaaaccaatatattccaatggtaatcagaatcaactaaggatcctgaaatttagttttgtaatgaagtaactgtgtgactttgccagtatctctaatctctcaggatttgttttctcatctgcaaaatttctgcttgaactagacaaccttagtctctaaagtggaaaggaacagtgaggaaactcccactttttaaatatatatagtgttaaatagatttaaaaaaamacaacttctttttattaagaatagtagatatttgaaagggcataaatattcagcaaaaatggtggccagattcctgacaagcaaactctggtgtgttttctcattaacctaaattaaactatgatcgtaccccaaacagccttatatgtctgtgggttcctgccaatatgcagttggatttctcctctgcagctgtctgtgatgctccaaagagacaagtgaatactgttgtaaaataaaaagtggagaaatggaatcattaaagcagaatgaataaattacaatgaccttatacaag

SEQ ID NO: 21439 - DNA, 600 bp, Bovine  MMBT10581
gtaagagcaagcaaaacacaatcaggcaattaatctgtcagccttaatttagctcagctgacttttcgcttaatgctyataaatgtggtgccttcgattctgggttccatagtaacctccttctcccaaagcaatgactcatctctgtagaggttgcccttcggtgcaagagaagaaatccagtgctctgggaatgcgatgggtgtccagagttgcatgaaacatgctgtttatagcatctccagtgtcaaccyagttcccagacaccagccatcgcctcgtccccaaatcacccctgcstaagctgccrtatctgagacaactggacaacagacgcaagtgtccaccttgtggtcactgcctgacatcacagcctcctgaccccagctctccccagtgaagccctgagttgggcatgctttcagaaagagagtctgcaggagacagcattctgttaggtgttgtgtgaggtctcgaagctgaacacctaggcttgggggcaggtgacaaagaaacaaacccayaagacgtacttcctcctgagttcccmgccagagcaggccctgaagagttctccagcccattcagactctgacaaac

SEQ ID NO: 21440 - DNA, 598 bp, Bovine  MMBT13501
  misc_feature (1)..(54): n is any nucleotide
nnnnnnnnnnnnnnnnnnnnnnnnnnnnnnnnnnnnnnnnnnnnnnnnnnnnnntgcttctgtggttaccagttcttggggtgacacaacatacttgggagtcttccctgaccccagattgtgcagtgttcttcctgtagaatgtttcccctaattttgccaccctggtatcgtccatgaacattactaatacctctccatcctgccccaacttgggctcgctgagtccatcagtggatatgtgcaacctttctccaaatgaaagactggatgtgtgagtggggtttggggaagggggtmattggagatgggattacactttctggtacctctgtctgcagaaaccattcttgggcactagagaaatttccaaggtggttaggcttctttttttttggtgggagggggctaygccacagtttcagacttggtttcaaatcctgaaaccaagtttcaaatcttggtttcagaccagggattgaacccatgtccccttgcttcagaaggctggagtcttaaccactagaccatgagagaaatcccctggttaggcctcttggttgattccctatcctctgtttcttcctgggaatgatgg

SEQ ID NO: 21441 - DNA, 600 bp, Bovine  MMBT04885
ttcgaagtctagattatgtaaaaaggctgacataggatttattgaatttttaatgacatatacacaggctggcatccatgtaaggctggcatctggtgttctaagttatcactggtaaagtttgggttcatcatgacagcaacttcagaaaagcttgtgctgaatttattctttagcttgaaatcttcagtcacttttctttagcttattctttcttttcatgcactgtcaagctctggatttgaaggcaagtcattcaagtttaaagactggggaatccagatagtctcagacatgaaygttctttgataaacttctaatgattcttaagaattttggaagtacagaatcctctcagatcctacccaggaaagtggaatattaaatagtataggctcagaggaaattcaccacaaattaggaatccttctaaggaaaaatgtatcctcttcaaagtctcacattcttacttcttaggagctggcagaacacaccaattgatctttaagttattctcacttggcactgaatctctttgtgtaagttaaacacattaacagacataaaacacataacaaggacctactgtacagcacagga

SEQ ID NO: 21442 - DNA, 600 bp, Bovine  MMBT12425
atgtttttattaagaagttygggttctttaaaattttagcacttttaaattaaaaaattatttgatacatgcttctctagtcaaaatcagatcacatcaaaggggagatggcagcagcttcttggaaacttagctgttcacaccactgggtgcccttgttcttgcacattgcttggaggtttataaaacactttatcatgcattatcttagggggttctcacaacaaagtccttttgatcttattttataagtgggaaactgctcaagtgagtcacttcaacaaggtcatgagtgaatgscatagctgggaggctggtctatgactgctaactccagtgttgcctgcaatgatctctcagacagagataatgtagttgatcttcacttgaacgatatctgtgtattaacacaaaagaaggaaaactgatagtttgggatggagctgaagaactgagacaaaaataatataaataagcctgggggagtttgtaaggaggagtgaatttagcagtgctgattttgctggaggctttttatttgttatgattaggcattccaaatgccgctgcgtaaccttgaaaagggaaacaccatgatga

SEQ ID NO: 21443 - DNA, 600 bp, Bovine  MMBT12716
atgacaggttttaaaatgcatgcaatgaattaaacattatggagttgaacctgaaagtttaaacttttatcttaaaattatacctctactaataaaacttcatagaacctttgaatattattaatgcacccacattattaatgcacccacacaaatccaatatgtgtcaagaagtttaggtcaagttcttaaaatatactatgaatatgatagcatatgttttttttattgatcaagtatgctaatatcatctaaatgaaggctcaaagggaaaaatacagagccatgttggatttattycattctggatactagaaaaattcaaagaacatggaaaaatagagattataggaagcataagtgtttaaattattaagcaaatgcacaaataagtatcttattatctaattattttcctttctcttgggttctttagaagattacagtcgaagtattgttcttgatgctataggattcagtgcctttttaaataccagcatattcatcagactttttcacctgctttataaatataaaatacatttttggttatcatgtatattcatagtgatgccttgataagaagtagatagtaccaag

SEQ ID NO: 21444 - DNA, 600 bp, Bovine  MMBT05498
gatttatcattctttaagtgaagaatttggccttatttaactgttttactttttctcataaaaatagacacaaactcaaatatgaagtttatatttcatgaactgctaaattgttaggaacaggttgggtatatatcttatgtagatcttgtttctcccagaatctttaaaaatggcattgtttgggtcatatctacctataagcagagtccaagcatttcagtctgggattcaggccctttggcaggccaaagaacactgttggggctgtatttcatactggtaccccctagggtataraatagataagaaaaaagacagagaaaagatcttgagatgcagactggccttagccattaccaatactttacatattgaaagttatttctcattgacatcaggaattttgccaatctaattattttatttattaatgagctagagaacttggctatgagttttaatattgaattatgtttgaaatgagtatataagttaccctgataagttagtgtgggtatcttttctactaatttgattcctaatgtgaaagttgttgatcttcacataattcatggatattctgttccctcatcttct

SEQ ID NO: 21445 - DNA, 600 bp, Bovine  MMBT01484
ttcaaaactcattttatttccccaaggtccttaagagcagttactttctcatatatttatttattcattcatttatttttaattcattcaacaaatatatattagatgcttactatatgccagggatcatgttaaatgttgtagatacaaagattaataagtcacaatagatgctcttaaagagtttgcagtatattatgatggcaaatataaagaatgacgaacacattgcaattacagggatgagggtagaaggtggtagcaggaaggaaaaaaaagtgtaattaatgctagtaggaygtgaggatacaagacatgatttatagatatcctctcaagtatggtttgaatgatgaatttttaaggcagactaggatgggaggaaatgttactattaacagatgaatattacacatagggaaagaactagaagaagacatatcacttacaagtgttgataaataaggttggagagatgaaccggtgaaaaacttcataataagtaaatttaaggaatttggacattgtcttagaggacatggaaaactattagggaggttttattaactgtggaaagggagatgaataaaataatctaat

SEQ ID NO: 21446 - DNA, 600 bp, Bovine  MMBT09525
ttctgccccaaagaggaccttggtgaatgactcgggctgtgtgagcctgagctctctgctgtgcaaaatggggcaggaggacagagctaacggttcctgcccgagcactggcctcagagggaagttgtgagtgtctgataagccctctgatcttggtgactttctgttgcatccctacaccccactctctccaccttcttgtgtataggcactcacacacaaaacactcactcacacacacatacacacatcagccagccagccgggctaattagttatacctccaaaacacaccctgarttttgaacttgaccaccctttgcaatctccacttccctggctcagtcaccatcatctctcatcctcctttccatgaccatctccctgggcttttgattctcctcttgcctctcacatccattctctgtagatcagccaaatggatcattttgaaaggccaactgaatcttgtcactcccctgctttgaacactccagtgactccaacacagacagaagaaaatccaaactccttttcctggcaccccagccctgtgtgatatggacttcagcctcctcccacgcttaaccttgtcccgtt

SEQ ID NO: 21447 - DNA, 600 bp, Bovine  MMBT10346
ttgttagagtatggaagcaacctagggcttccctggctgctcagcctgtaaagaatctacctgcaatgcaggagatccagcttcaattcctgggtgggaaagagcccctggagcaggaaatggtcacccactcyagtattcttgcctggagaatcctgatggacagaggaccatggcgggctagagttcaagggaytgcaaagaatcaggcacaactgagcaactaacataacacacggaagcaacctaagtgtccatcaacagatgaacagataaagaaactgtggtacatatgtatgsagcggaatactacctagccataaattggatgaaatattgccatttgaagcagcatgggtgaacttatgctaagtgaaataagccagagaaagacaaatactgtatgatatcgcttatctgtggaatctaaaaaatacaacaaactggtgaataaaacaaaaaagaagcagactcaggatctggagaacaaactagtggttactaatggggacagggaaggagggcagggcaatataggagtaggggatgaaaaaaaagtttattataggattatatgaaatcacgtgtgtgagattttga

SEQ ID NO: 21448 - DNA, 600 bp, Bovine  MMBT01825
tcgttaattttgtttgactgtatacctctactctggagcggtgctctttgaaaaggtgaagttcattttatttttattttttacgattgatggtgtggaggggaaggatgagacaggaagcagagagataagctgataaaaatgacaaaatacaactttatgtttaaactggaagaacaaaaggctgtttatgagttgtgatattatttggtattgaagagtaatgcagatgtaattaaagtcttccaacccaaagttttatccagagagataaagactttcttttcagagtcaggcagyatttatctcatacaagcaaccctggtgcatgcagctcatttatatgacagctattatgaccatgatatctagagccagggccagaaacacggtcccaaatagaatctttcaatacctgtggcgtgaaggagtgagtatgcatacagagagggtaataaaatcctacatttgcatagtgyttttctcttctttcaaagcagttttacatctattagaacacaaaatggtaatgttagttttttttttttctaatgatcatttggccacaattctctggattatgttgttgaactaagctga

SEQ ID NO: 21449 - DNA, 600 bp, Bovine  MMBT02236
atttaaatcataacttttactgattgttgctccagattctatagaggagaaacagaaaaaaattcatttctggttgcataagttgacaatgatgtttaaaagacagaaaataacctattaaagaatttgaatagacagtgagcaattcatcgtcatgaatcaaaagtataaaagtaaatatttgttttttcccctaaatatcagaaaatatttactttcacacatgatcacctgaactgcttgttcttttgtcagagaaaatagtaagattatcaaggacaaatgtatcaaatttcatayatgcaatgctatgtgccaagcagggtagaaatgaaaaagtgacataaagmttagtttttacagtcaataaatttaaaatcttgctctctctttaacttgttatctgataatgagctaatcactaaaactggctcaagatttcttctattaaaataattcacaaagaattcacctgtcacatccagcacagcactccaggaagtctccccacttgaacttgtagccacacaagtgtaagtgccagtatcagaaatctagtgtgcatagaagggagagaataaaactgttttaattgatttg

SEQ ID NO: 21450 - DNA, 600 bp, Bovine  MMBT02408
aaacaagaaaagttcaatcatttaccttttcccagcttgtttttcaaccaaaaaagataagaggttttgtttgtttctgtttttgtttatccaagagaaaactatatgttttcagagcgaagagttctaatccataccatctttataggaacgcaacagggatcaattcactttagaaaataataaaactaaactgacctgaaaatttctaatctttgggtttctgagagtcactctgcaaataaaagaagagtcagcagggacaatccagatctataaacaccaaatatttgctcttaycatttcaagccagagggagtgattcacatgatatacatttgtactgacttctttgtccacactatttctgaggaagaaacttaccttcctaaatgccaactactacctctaccgtataatatcagcccacctcacacccaacccacgtgctgaaaggaacagttacatcttctttttaaaaaatcaacttcactaaagtatctggatgagttttgacaaatgtgtacacctgtgtgctgctgctgctgctgctaagtctcttcagttgtgtcccgactctgtgtgaccccatagatggca

SEQ ID NO: 21451 - DNA, 598 bp, Bovine  MMBT08790
  misc_feature (1)..(166): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacactaattacatagacatcacgaagtcctatttgtcctcagtacctccccagacagcagggaaataataccaagggtaggcatgctaagtgatgattcccccccaccttactgtcaatcatcccagagcrctcacaggggcaccccactcaatctcattaccgaatcctaagggtaggactacaatactcaccaggaascacagttcaaacagcakgctgcctggccaacatgtgagtcataatgactccttccctgattttaggttttggtgttaatgcaataaatatcaggtatttctcatttaaatccaatgttacaatacacagacaaagcaacaaaacattggtaagttcaatttaggaatctagataagaaatacagtcaaaggttgaagttcagagtcatttaatcccatttaaaaacaaa

SEQ ID NO: 21452 - DNA, 600 bp, Bovine  MMBT08824
ctcactgctggcatttggaacatcgaccccgagtagacagaggcgacggaggacccggcccaggggtgggctggagatgacctggagtttcagtagcaactcttcatcatcaaaccctggtggttaattacttctaaaatcaaggctgcacacccacaagataactctgccctcgtttcatcctttgtaatttctaggagatgagagatagatgtacagacagagagatgggtagatggatagataggcagatagagagagagagaatttacagtaaaatctcagacagttgggaagaasagggtaggcataaatsagttccctgagggaagaaagtcagagctcttcctggctgaaatccagatcttcactgcagacagttacaatgctatctgttatctttctgccccaaggaggatccagcaggctgggcacacttcccttccgagaagtaacaataacacaattaaaacgtttacattttacagcctcttctatttttcaaagattttttcaaagagctccctgcttgcacatcccaggagcaggcacagcaaagacagcagagcgtgaagaaggaagacggagcgtggatccgaa

SEQ ID NO: 21453 - DNA, 600 bp, Bovine  MMBT04967
ataactggcaacccactccagtgggggcttcccaggtggcgcagtggtaaagaatccacttgccaaatcagaagatgcaagagatatgaattctatccctgggttgggaagattccttggaggaggaaatgacaatccactccagtattcttacctggaaaatcccaaggaccagaggagcctggcgggctacagtccatagtgtcacaaaaatcagacatgactgagcatgcacatatacacaatatttgatatagatattctataatcatttatattcaacttttaattcctgctctytgaataagtatccagtctctctctctmtatatatatatatgcatatatccacacacacgcgagtaaaggtcatcatttgttcattcatttaggtattacaaggagttatgaaatcaatattataaaaattatatttttatgatttgtagagatgcagacaaattacacttgtgcaatatttcaaatgtatacatttccttcacctgcattaacattacattgataattataaattagtagataaaaataaatttccgctgttacctaaatatagatttgatgatgtatgagtctgagaat

SEQ ID NO: 21454 - DNA, 600 bp, Bovine  MMBT07410
attctccaagtccaccttctcttcaaagagctgcctctccttccagtctgggcttgcctgcatggtgctctttggggtggaaaattccttcaggtcatcaccaagctgggcgatgggaggatgggcgagctccaggcttcctttcctcggaagggcatagatggcctctttatggttgtctccctcccggactctgctgaggacggggtaggacagctctgcttcctcgaaggacccatactttgtaaccccgccatctccacctgtcaagcctcccttgcgttctgtctcttcaaattytctcaacattgctttgctcccagcaccctcgaccgagggctgccagccttgggatttcaggatgcttctaactggggagtcggagttttctagcgaagaagcaaacttctgctcagtggcaccaaagctgtcatctggaagtggctttgtccgaagatttcctgcatacatgggggggacggtagatgccacggtggacacggaagtgttaatggtgggagagaaagccatgagcttgccactctgcacctgggaggagacagttcaaaaataaaagctgatttaaaaacaccgcttggg

SEQ ID NO: 21455 - DNA, 600 bp, Bovine  MMBT02224
gtctaccacagcatccctagcacccagcccagagcagatattcaacctctgttgagtaaacctctctgcatcccattctgtttgggggagggggtgggtgagaggaggacttccatggagatgctctacggaaaactaaacacaatccttgaggttggtaagtactgcatctgaggtgatcctccctgggctcaggggcagtttctagtattcctatgggcacctgagggggccacgtttcagactgtttgccgggtacctaaacccacagatgtggtgacaaggtaatgacccgatttkgtgagccgcttgtggactcagccatattcctcacaatcgcatctcttcacgtggraacctctggactgacaaaaaatatctcacttgatgaactgattttaactggcactacctgccctgcaagacctcaaagacattttttcccaaacaactaattttatcttcatgccccagcacacctgcagccctggcggggctcagcacccctcccagaggatgcataagcagcaaagtctgttttcctcccttgtgtttaaaggggaagccccccgcctccaacaccgaaggttctgtgggctg

SEQ ID NO: 21456 - DNA, 600 bp, Bovine  MMBT00755
gcacctaatgagcatgaaataattcctaagaaaacaaaataagctgtcatgatgtgtttgtccccagtgattcttatacattatcagatgttgtcacctctgctatagtgcacagcatatgaataagttattcttgcttgagtaactgcaactacttttctataaacagtctcactagtgaaataagatgtcataacaactccagaattttcctctctgaggaacatcttctcagattaaggaattaaggaaaacagagaacataggttgaaggtatatgagtaataagagcacttaaartctgtgaatttttagtgtaaacaaaaaaggcaaccaagcaatagtgttacagattgaaaagttagagaaacagaaagaaagkttgggtcacaaacaggcactgtgctagcacatgggaatcgaaaaaagtgatatatatcaggctaagtaaaaagctgcagagctttgcatacgtagaacatgggtcatttgtcatgggcagagtttctggaagattggatatgatctagttctaaggaaaagggctaaaatttccaacagcaaatggcayaaaccagagagtaaaaactatgtgttttc

SEQ ID NO: 21457 - DNA, 595 bp, Bovine  MMBT11970
tattgtttaaaattgtaattttttatgtatcctagatgtatacaggtttttaagtaaaaaaaaaatgggattgcattatgcatattattctgcaactttctgtcattcctcttactagcctgtcttagaaactgtttccatgcctatccatggaaatctactttactctttccaacttaaacatagaatttccatggtatataatacaataccaagtaggggtagaccatactttatttaagcaattctattatggctgtactttgagttgcttccagttgttattacaaatgatgctaytgtcatccttattgttaatacatattattgtgcattagtttgggtatagcataggaataaattcttttattgggtcaaagaattattgggtcaaaggatttgtacttttgaaattgatggacactacaatttgagccttcaaaatggcttgtaaagtttataaatcccaccaacagtgagtgtgagtttgtttatccatacacttaacagcaatgggtattctctcttcataatagtcagatggtcattaattcagtttgcatttttctgataactagtgaggctgtgtgtgtca

SEQ ID NO: 21458 - DNA, 600 bp, Bovine  MMBT12083
gaaggctggaggtttcagagcaggggagtgatgtaatatgatttatatatttttaaaaaatgtcttcttactccttgctcatattaacaatattattaccaatgttactgtcctcttgactttctggtttggatgaagtgagttcattgaatgcctgttctgtggcttccaggacaccagtggccactaagcacccagcagctgagagtccartgccaagtatggctacagaagatcctgaataagtatttagtatcagccagggcctcatctggcttgctagatggtggatccaaatcraatgcaccatctgctcagccttaatgcagttttaggggcaaagcagagaaaattgtgtagtaggagcatccctctaggaccctttctagcctgacttttgccatcagcatctctgtctgacgctgatcagggaagaaaaaacttctcgccccacctgagccactccccaagtcaaatcactccacagttgaagagcatgctgggtgagctcccatgagagtgtcctcaaaggctcctggaccctcaagaatgtgagcagtaattctcaaaatgaataaatagttctaaaggaacatctcc

SEQ ID NO: 21459 - DNA, 598 bp, Bovine  MMBT07673
  misc_feature (1)..(39): n is any nucleotide
nnnnnnnnnnnnnnnnnnnnnnnnnnnnnnnnnnnnnnnctttaaagctttacttagaattgaatgattctctttggagcattaaccaaagaaatcttggtatttaatcttgaacaaaatctgaacttcatttcattctttcagttactttatcctatatattaccgtaattctttggctaatyagttagttcttcaaagtggagtttgcccttcaagtatttataaacacagaaacttgtttgcataaaataaggcactgaacatttactctctcatgataaattttctggttaatctyctttccatcgggaaaagatttctttaagggtttatttaaaggatagctttatatttaagctatacttaaattcctgaaagcctgcactgcttttataacttctatttgcttttatctaggccactgatacaggagaattagtcaggaatggaattcccctttggctttggactcaatctctgtgattaaatccacaagggcacaacaaaaatgatttaccagggccacctcaggcagttctatgtcttggtgcttattttagtacctaagttggaaatctaacacaaccctatcctgg

SEQ ID NO: 21460 - DNA, 600 bp, Bovine  MMBT01255
attcactacgaaaacctttatgaagcacctactctgtcagcagaaagagtgggccctttgaagaagggagaaatgaatgacaaggtaccccctctgactcttgctggccatgtgacctggtttgacctcctgggcctcaatttcccttcccctctgatgagaagagatgatgacctcccagcccagtgatgagataacctgagtaatgggccttttacaggcccatcgagtattcatttctttacccttctccccagctctgtgaaaaccaaggcagtcttagcctcagtgatggacagwccagggtgaagcaggccttggagccctcggtggtccacatttgatttcctcttcctccagcagaaatatcaatggagcccaggggagaggggaggctcatgcatatgataggtgtcaaggatggcgtttgctctttagactagcccggtgctttgttattagcatttaataggtccccagaaagctttgaagataataataggtctcccctccctttcaactgatgatcttgacgtgatatacttatgtctgtaataaaattcaaaggttctcacaaggagccaagacttgctcttatct

SEQ ID NO: 21461 - DNA, 598 bp, Bovine  MMBT06267
  misc_feature (1)..(2): n is any nucleotide
nncacatgttatctgatattagggtttctatctcgtgtgcttcctttccatgataaaatctgtgcccttctccaagtacgtcttccctcagctgtccaggcacatgataaggtgtcattcctggtccccttgtgtttaggagggccactggaccaacgaccatgcagcacgtttaccacttcatgttgagctgtttaaatggctctgcagaacctttctgagctctccctccctctgagtggcaggtggcagccctggagatggtggctgtctatcactcagcacctatggtgactaccrtgtgcagagcagaatcatggactagtaactgagtaagcaaacgtaatatttgtttaagtcactgagatttggaggggctgtttgttaccacaaataacccactgtaacctgacttactttctgtccactttgttttcccagtttctttattatatgaacgatataattttgcttctatgtgctcatgttttcatggtaaataagaaaaaatggagggatgaatttaatatactaagtcatttagtctaattacctttataaatttcatgaagggaaagcagacagtagatacattcat

SEQ ID NO: 21462 - DNA, 600 bp, Bovine  MMBT09783; identical to SEQ ID NO: 4788

SEQ ID NO: 21463 - DNA, 600 bp, Bovine  MMBT11835
aagtacaaaattaataaacacggtggaattcactattatcgtaaaccagccagcaatattttatgtgcaccctagggtttcattttggaatttcactcttcagtggatggagatgaccgaaaatcaagttgagtttcatcagtttgtgaaacatccctcaggagttgtatggtcaacctgtctccagatttaatcatttataaagcttttcacttttcagtcaattaaatattgccacctgagaagctatttctgaagaagctggackgtgtttctcatggcgtggaggcatttctccayacctgggcttcccagggtagacgggctctttgtggggtggctctgacatgttggtgcaggaaccgcgtgggagggaggaggggaagtcctgcctccctctatccccacccagtccgttctgctcatgcacacgccacactcatcttggaaacatgcaagtcggggtgtcgcctggggagacggttgattgcggtcactgagtttcctaccgtgataatccctgtgcctggcagccagccttccctgtaccctgctcgctggctgcccaggctgtggcagagggcaggggtggctcctctc

SEQ ID NO: 21464 - DNA, 600 bp, Bovine  MMBT11337
ataagaagttatgtttacactatactgtagtctgttaagtgtgcagaagcagtatgtccaaaataatgtacatgccttaattaaaaagtactttaatgctaaaaattgctgaccattatctgagccttcagcaagtcataatctttttgctgatagacttactcagtgcagggttgctacagccttcaatttgtttgaaaaaaaaaaagcaaaccaacagtatctgtgatgtacaataaaatgaagtatgcctgtactgggttgtgaagttttcagagttttattcttaatttcctagcrggaattctatagaaatacagtccatcagttttaagcatgtctctatcagatgactttctcttttggctaatatataaagagatatataaargaagttatgctgctaaaatgttattttatrtgcataaaggaaataacaatatggcttcttttagatgctgtttggccagaaaaacactattcctaccagggatggaggtggccagagtaggtgatagatgagtattcattgatttcttgattgatgaacctgattatgagaaggaaatatgttaatactgtttttaayagctttatagg

SEQ ID NO: 21465 - DNA, 600 bp, Bovine  MMBT04354
atccatcaattataccaatgtaccaatctggtgggggatgttgataatgcaggatgatacatacgtagggggacatggggatataaaaatctctgtatctcctccttgattttgctgggaacctaaaactgctccccaccctccttgcaaaaaaaaaaaaatcttaataaaatgcacaaattaatcttttaaagaaaaaaaagtacccttcattgttaccaaactttgattttcagctttatgtcagttatgtacatattaatcagaaattagttagcatattattggaaattttccctyttaattttaaaaaattgcccatgctatttttcatgaactagttctatagaagcttctgtagtttaatttatttgggaaaatatgttttactcaaacttacattctatctttttcttacactttgttttaattacctgagatcctcagagcagtaaaggtagaaaaaaaaaataatgcaggtaacaaattactgccttggttttattatctattacttcactattgcctgaagtacactatttattactttcagtctgcttgaatttcttatcaggtaattctctgagtcttaaatagttt

SEQ ID NO: 21466 - DNA, 600 bp, Bovine  MMBT10087
cagttattttcagttcctaattagcaatcagaaatgagctaggacattttaatcccataaaaagttatcattactaagcatcatttatagactggggcttcctcgatgtctcaggagtaaagaatccacctgcaatgcaggagatgcaggtttgattcctgtgttgggaagatcctctagaggatgaagtggcaaccactccagtattcttgcccaaagaattccacggacggaggaggctggtgggctacagtccaaagggtgacaaagagtcagagatgactgagcatgtacccaaaractgtttaactacaaatatcttgtttaattgactcacrgtcacagcagatattgactttttattaatctacaaaattttaaaggcccttctaatgttaaaagtaacaaaaacataaatagaataagaaatgtcttcagttcagttcagtcgctcagtcgtgtccgaatctttgcgatcccacggaccgcagcatgccaggcctccctgtctatcaccaactcccggagcttgctcaagctaatgtccattggagtcagtgatgccatcctatcatctcatcctctgttgtccccttcttc

SEQ ID NO: 21467 - DNA, 600 bp, Bovine  MMBT04757
tcaagatccacaggttaaacaaatgctcaaatatcctctgaggctgtggatatcaaactctttagaggcacctgggattctgattcacaagttaggatctgtgaatgctaaaagctcctacatgcggctgctctagggtagcttatcattaggcagagtgaaaccatgtctttggtagtatgtcacacaggaagacaaaatcatctatttctagtgcagtggggcccacaaaagtccctgtggttccaagaattatgattgcagtagcagctcagcaggcataataatatttctggtaaytgaaatttctgaggcccatgccacttatacaaattggtatctgaagagacagaagagagggggacacaatttcaaggattttacctcctataggtctaaatgtgctttaatggtatgaagattgaattcttaaatgctctgatttccagttaattctccaatgttcatatttttacagtgaaaatctgacttaatcctctaatggtggagatggttgctatgatgagtcacacctgtgtcttcacctgtctcagggcagtttcttaagatgttctgagttctatgcagtccattttcttt

SEQ ID NO: 21468 - DNA, 600 bp, Bovine  MMBT09142; identical to SEQ ID NO: 4511

SEQ ID NO: 21469 - DNA, 600 bp, Bovine  MMBT02492
cttttctggtttccatttaacttcaaatcctaatcacagaaaagaaaccttactccttccctatcctcccaagcctttccccctagaaactcacttgatgatcatgtaaacaaagacaaacttaatataatctatttatgaatagtatttcaaaaatgagaactatattatagtcacatgcttttacaattggaaagactgcacaacaaatactgaaaatgttagttgtacattatcacagctcagaggaagagagaagacatgctgaagaggcagaggacacggctttaaggaaaacasaagccgagaacaggcatccagggcctttcctgcagtcagagacttctaaagccacagaacatttcacatcaagaaggataaatgaggacatgacctctcagttcctgtccttcaaagcaaaagcaagccaatcctatgacaattcattctttgaagttttactattggttatagatgataggtgtttcgaaactacaaaatctcagcctgaatatttagttcctacaaccttattcactccataagcattcataaaatattacctttttacatttttaaacttgtatacactttcatatt

SEQ ID NO: 21470 - DNA, 600 bp, Bovine  MMBT02676
gagtgatgatgcctaggtgtccatgtgggatagatggggaattgtggtacctcgtgctgactcgtaaagacaggctgagtgacagcatggtggtgaaggcagattggggcttcagtttacactgatccagctgcataactgggattgagaaataccagctcagaagcagcaggatcctcttccccaggctggcacagcgtgccagttcagccgttcaccaattccgaggtctctgtgaactgtaataggctggaaaccagtgaagtttaaatgaatatataacccgggcgactcctctgrgtcagcatcttaaagtatggccatttttctcacatttctaacaccgtttcaagggtatcttacatctcagttcagatttgccattctatccaattggatttcttttcaattcaacccaattttaaccccaatgttcaagctattttttcccattatgcccataaatggaagcaaatcatagtatcttgtataaatgcagctgtttttccttgtcttctcttttctcattttagatgaaaatcttctttctcctttctttttattaaccacagcaccctccctctgcaccccgctgacttc

SEQ ID NO: 21471 - DNA, 600 bp, Bovine  MMBT06916
acaatattattaagcatcatcaccatactgaatcttaggtctccagaagttatttatcctgcataactgaaacttctaccctttgaccagcatctcccgactcccctcaccctcctgcccctggaagtcaccatattctactctctgcttttgtaaattctacttttggagattctacatgtaacagagatcatgaaggaattgtctttctgggtctggcttatttcacttagcataacactctctagtttcattcctgtccttgcaaataagatttccttctttttttaaggttgaatrttttactatattttatgtatgcataagcatgactgagcgacttcactttcacttctcactttcatgcattggagaaggaaatggcaacccactccagtgttcttgcctggagaatcccagggatgggggagcctgctgggctgctgtctatggggtctcacagagtcggacactactgaagcgacttagcagcagcagcagcagcagcaagcatatatagctattgtcaaaaagacaaaagataaatcttggtgaggatgtggagaagaggaaacacttgtatactgttcggtgggaatg

SEQ ID NO: 21472 - DNA, 598 bp, Bovine  MMBT03153
  misc_feature (1)..(64): n is any nucleotide
nnnnnnnnnnnnnnnnnnnnnnnnnnnnnnnnnnnnnnnnnnnnnnnnnnnnnnnnnnnnnnnntttatttagttccgattttcttaaatgcaatttcactgttcttggataaggaaagatatattattaatacttagttattttttctttcagatgcatgtatcatatctgaagatagaatgaacaaaaataacatacagttaaaatggagaaaccccccaaaaagatatgctaaaacaggggattttattgaatttgagtgtaaacattcacataaagagagaacacccatacaatcwtttcgagtcctctgtcaggaagggaaatttgaatatcccgcatgtgaatgaaacaagcacaacttccctggatgtacgcttaaaagtaatcttagaggtgggctgttagtatttgttatgtagtcactgctacagttattttctttatactttcagggatggtttatcacagttttaattagaactctggattttcagaggttcttaaatttgtaagctgagtagccaaggcttctttcatagcaggaccatgygtatccgagtcctgagtccccctctcctgtaacacacgcagaaa

SEQ ID NO: 21473 - DNA, 600 bp, Bovine  MMBT01000
gaagacccagcacagccaaaaatagataaataaatttaaaaaaattttttgttaaagattagaaaaaagaattaggttgtgctggcacagagcaggtacttaataaataattgtcaaatgattgcataggtaaatggcagcatcagacatggggtattgttttgtttatttattttggtaagaaatggtgaagttttaaaaagaagctggtataattgtattatgatgatagctctgtggagaacaaggtcaaccacaggcagggacatgatctaagaaaccatggtgattgtcctaaaygatggactgcgtgccctgccccccacttcccatcatcccggaaagcctgcttctctgcctctgtaagaagccaggctccaatgcttcccctcttttgaaatatttgtgggtcagtgaatgtcaacactcaggttacatgcagagtgtgtttaaacacacactgggaacatcaacacatatcctattcctaaggagaggaataaggtctcctaattgcayttgtgtgaargttgacatggctcccaggaaggatctggggaggtgacacatagtgtggccgtcagccctgaagtttgtcga

SEQ ID NO: 21474 - DNA, 600 bp, Bovine  MMBT12974
tttggtgatgttaactagcttgtcctatatggagaaggaaacagaacattatgttaaagccagcagagctttttgagatcaggctctgtggctttcaaactgtgctctagggaaccctgggagttccatggagcttttctggagactgtgtgagacgtgagggattcctagacagaggggtccaggtgcccttaactctcaaccatcttctacttccattcattttgtttctcgggctttcacacctgattttagttgaagaaaggtttctatggtgaaagaaaggtttgtaccttctcmgtatggtccaaatccatccttttagagaggaaataataatataataacagtaaagtgcacagtgcctaaacaatgggccagacatggatctaagtgccatccttgtaatggcttttttagctctcacagccaccrgtgggggctggcaagcaatcagcaaagtaccagacaatgggaccgagccctcaccatgtcagctgttaagtatgtgggtgacatccccaggaggagaactaccgcttcctcgtttacagaagacactgggcgcagaatagctatgtggactagctggcctgatgc

SEQ ID NO: 21475 - DNA, 598 bp, Bovine  MMBT06477
  misc_feature (1)..(161): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtagaattcccagtgaggaaaatgggattctgttcaagagtgtggcaagaatggcattgatgtataattccaaatgggaaactttaaatgaattttctgtagtttagtgcctacagagaactgtttgactctgggcwactggctatatacttattaatattyctcctgattttgaaatcagttcaaaacctgagtcattctataaccatttttcattgacagtcttgtcaatctaaataacagccttatgataaaatcatttagaatgctatgatgtctcagcctaacctcattgtctgtttatcacttcttaatktgtatttgtcagatttttcttacatggaaaatgcattttaaaattatactgtaatgtatatgacataagattatttaaaatagtagtacttctctccccaaatgtcagtgtgctggaat

SEQ ID NO: 21476 - DNA, 600 bp, Bovine  MMBT12929
gggttctttactattaccaccacctgggagccccgtttagaggatactgtgtgcctattctgtgtgggacacagtgctgggggtactttccacaaagcaatgtgacgactaagaatcagatgagagggccccttggctggaagccttctccagagcaagtggctcaacccattagaaggtggaggcacagactttgctgcagggttaacatgttggtataaactctgctgcataacagctgtcacgggagcagtgtagagacttaagagatggatgaaggaaaagaaaaagcatcaccayggggtgcctgggatgcagggaccgtatcagagactttcgcaaggaaatcacacctgggactgcttatgtatacctcgtggcatcagaaaaagcatcaacctgacttagagagaagcctcttccgtgaggaccgaaagggctatgctcttgtgattttatgtctgaagccatcaaacatcctacctggtttgctctttcaaggtccgtcatgatcatttcaatttcgtcggccctggggaggtgagagggagagagcaggttagtcgatgggcgaggcaggctcaggggccaccactgttc

SEQ ID NO: 21477 - DNA, 598 bp, Bovine  MMBT09986
  misc_feature (1)..(196): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctgaatctattaaataggaaaaactagcaagagttgatagggcacaatatttatgtgcttatatttaaatggaattttaagcactattaatagagcactaytttcatgtcacagtttagcttaatggaatagagtcagttatgtaagagcactggtagtgtgtgactgataactagcgtattttaggaataaaaataaattgtaaggaaatttttgtaaaaaaatctgttttgaaaggctgaaatatggtgatttaaatgaaaattctgtagtcataatacttatatctggttagactgagtacaatttttagraaaaggagactgaatcaactttgwaagtctcttaagaaccacatcacttttaatcactgaaaaaattataggaataagttactgc

SEQ ID NO: 21478 - DNA, 598 bp, Bovine  MMBT02597
  misc_feature (1)..(84): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnntgagaacatgggagtcctgactaaaagagataatccaccagcagaattcttaggctgaatgggtgagcacatgggacaagatatcatcaaaggaagaaaacgagaaaataacaaaaacaaacaaaaaacaccttatgttattactagggaaactcctgtgttatgtgtggattgaataggacacttaacatatagtctgttatgtctgagaaatastctgtacataatgagctcaaactatcttaggaaacacatgcactagtgagggtcttagatgtaaggtattctactctactgctttgaaaacatgaaataaaagcaggaaragggaggaattaaaaatacttttatcatctccaaaaatcttagcggcttctatgattttgagaaataaaaacaaagaaaaygacagaaccagctgtaacagatggtactaattagtatcttagaattcattaggaactatgtcaaagttgactggctatttgcaaaaatatttctgataagttgtcta

SEQ ID NO: 21479 - DNA, 600 bp, Bovine  MMBT08126
ggagattaaatagcctgagaatggctttgtatattaacttcagggaactcaggtcttgccctaaagagtgacacctgatgcctcaattgtaggtaatacatctttagtaaacctcagatttcaagtaggctgctcggaaggtgagacaaatcacatccagcccgtaaatgtctttctttacggagactgaaatgccatccctgggtactcacatttacatgaatagcagatttaacacttgagacaattgaagtttctcacgaaatgatgagtccttggccttgttgacaaagtgccccrtgaagagcactgctgtcgtctgaactgtcagcagaaaaggtataatgtgattaagaccaagtggtaagccaagactttgggtctggtactcattggtggaatgacttcgggtcatttctcattggtggaaatgagagagaactggaccaagcacagtcagatggtagcagaagaagaactcctggtcacttatttttccagcagttaaaaagctgaacaaacatggatggacctagagattagcatactaagtgaagtcaggaagacagataccatctgataccagtcacatgtggaatt

SEQ ID NO: 21480 - DNA, 600 bp, Bovine  MMBT10240
acacggtccatgtggacaggcccctgctcagggaagccctcgtgtccccaggagtctgggtyggtgtgggatgatcgggccacgccctccccctactcctgccggggtacacgtactacatcgctcttgctggtatagacacggtccgccaggctctcgatggcaatccacttgaccggcatcttggcgatgcgtccctgacggtagtagtccccrttgtagatcttcttggagagcccaaagtcagccacacacaccgacatgttctcattcagcctgcccagattgggggagaggaayggggtcacagcattgccccctccaccaggaagcctgccctcactctcagacatgtctctgtctcctgccctggctgtcctgcttcggggtgaggatcggtcagcccccaaacctgggagggaactatgttacttcttataccctctgtgaaaggtgggtctgaaaagggctgctagggggccttcccagctctggctttttgccagattctaaggtccttcccaggctccttgggttggattctctgatattttwaaaaaawwtttaaatagttatttgacttcactgggccttagttgc

SEQ ID NO: 21481 - DNA, 600 bp, Bovine  MMBT03036
gccttgctggtttgacaaactgtggtgatggtttctaaaacaatcctgaagaactcagggagaacatgatctccactttcaggcagcttaggtctgaggagtgagaaaaggagaatgcgtcatctcagaggggaggaaggagagtgatattcagccctgtttctgacaggaaaggtgaccagcttgaaactggtgggtttgtccctttaactcctgacgagaattattctcttcctcgctgagctctggctgcgttgtagaaggatgcctgccagaagctaatcaagagttttcctaagygtgagccaagccttaaatggcccactattaaaagctgtgtctgacattaccagtgatgtcatttcctcccgatccattttatttgagggaggctcatttgtcttcagccaggagagccacattgacttgaatattgagctgcagttagcagcttgaagcctgaggcctctttcatctgaatttgtgattctagtgctttaagatccaagaggccgcagcatccctgaattccaaaagcattagtgaggtaggcttgctttctttttaaattttttttaatataaatttatttactttaat

SEQ ID NO: 21482 - DNA, 600 bp, Bovine  MMBT10236
ccgaagcgccctggccctcgagccgatgactcagcatatggaagaggggagggggtcagcctgagtcagggatgggaactcctccccgtctccagggaatcgaaactggtattccctcctccaggacagcggccagagccgagccggcccctaggaaccccagaaagcctcccatctctcgttctcccgccccttagtccgactacgagcacagggatttggagcccaactgggcggcgggtgccgggcatctcccttttccctccttttcccgtagtcctcaagcctctgtttacaggmgaccaaaaccctggttacagagaggaacccgggcgtccgggtcgagcctcctcgtcacggcttccaggaagccccccccttcccccgccccttgtgagtgagtcactggcgagagggaggctgcaaccgtgccagagccgcccgcagccgcccagctcacgggaccggccgggaaggcccctcagcccgagaaagcgccgcaccagggattcccccgtgctctgtcggacgggcagatcagcgagcctagcagaatctcctcacctcaataaaagcccgcagtccgcggtcacaacctgc

SEQ ID NO: 21483 - DNA, 600 bp, Bovine  MMBT07598
tctctactcgcatgcttgcagcaagaggtgaaacaggtgtcgatcacacaactgcctgacaaccattcagtgctgatcaccgaacaagcatgtttatttaattatcccaacaaccataattgagccacatctaagtttctgatgtcactgacttcaactattcaactccagataaatactcaacttaaaaaaaaaaaacctgaaataagtgacaactagaaatggctgaatcattgtacgttttagacacaaccattaatcttagttttgctatatgctatttggtactttttgattcartagttgggattacaaaaaaaagtttctgtattcaaacctatctacagaatgtcaatataaaatgtgtgactatatacatttaatacacacatacacacatacacatactctcacatatctagaaaccagcacttaagcacgtctccaattctcactaatgactcaataaatcatttgttaccttaagaccagcttagacactataaggctgcaacatatggctaaagaggtcaaacacaagcacccacagtcaggctgattaaattgttcctcctcatgatttttcacaagtagtaatac

SEQ ID NO: 21484 - DNA, 600 bp, Bovine  MMBT05814
aaacagccacagccataaacctttcaagtaggtgcagagaagagctgtttttcatcaggtcattgtaggcagcctgggctgccaacttcccatcaaagcctcataaactcttttacgaggctcataaaacgctgcctactcctgttaggggagaggaggacggccatcagacccaaatcatgctggtttcaattgcttcatttccatacatcagactccttggaaaaccaaaggcaggccacagccagataataaagtggtccttgtgttcctgtggtgctcttttaccaggcctcccamgccctgtgatgcatagtagtgtttgattacccagcagagcaattctgggtggtgaagtcggcagcaaggatttcagggaaccacagctctygttcagagctgaagtgttggctgccaactgggttctgctttctctstcgggatgtttagagagaatcttcctgacaatctctcatggcttttccactgcagttgggcatagaatctgccccattcttatctttgtcccttgcaaggattgtgggtgtcaaaaraaaagataaccaccaccttgttaattaggttcatagatccgccaag

SEQ ID NO: 21485 - DNA, 600 bp, Bovine  MMBT06425
tctgctggaagatggaagagtctgagtagtgtcaattcctggattaataaggatggttggctgaagttcagatctcaagaaaaggcaagagaagaataaagacctgggagaaattgctcttgagccctttagactgtgaggtgctatgggaataaataccactctaacagtttcaggctatgtcgcaattctscctgcgcttagggaaaaaaaaaaatcctatctctctttgcaatgttaacaaacttcaaagcattctgtttgttttggaggaaagaaggtggtggagaagctgtgagsctccatcgcattgcagcaagggccacagaggagcgcaaacttgaagaacggatagtagcagccaccaagaaggaagtcggattgtttctggtgctgatgggagagacaaagagggtgaaatgggaattctcatggggttatacattccatccaagtgcatacttaggtacaagcttgaccacgccttcctcattcccatgcttagctgatctcactccaaagtaaaaataaaagcaattcgcaatcatcctattatttcctttggcttctggagcactgacaggaacttgtggaggggtc

SEQ ID NO: 21486 - DNA, 600 bp, Bovine  MMBT02558
agagttcaaggcgcttttcccaccgctcagttctggctgagatctgtgttctgaagacctatacggggcacatgaaggaagttaatgtatatcgagaagcaaattcagctagaaagtcagccgaaaaacctggctaatttggatcaccaagaaccttggtaacaaagctctcatcagacttttacttggatgtttccattataaggaccacttttggaataccagtggctgcaatgcgctaggtgttattgtctgtgattgatttagacttcagtgatgtgcaaaaggcaaataaatgcrataccatttttgttgcagaaagttctgcctcatcaaaaaagtattggctttttggggggagggagcttctcacaaagtgtattagtaagattgaatctttatatagaatttgaaatgtcatataagtgggagatgtgttgaagggcaacagacmgaaatatgttgcccttcaggaagttttaaagacatggtaagatttaggcagccagtttttgtcatgggcatccatagattattattagttcattttctgacagtgatgattcataaagtcagaacaggctacctgtttaactagaa

SEQ ID NO: 21487 - DNA, 598 bp, Bovine  MMBT08888
  misc_feature (1)..(156): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatgactgactagaagtggtgaaaagaggctgggatcctggataatgacaatattcacaaagagtccaagaggaaaagtctggctgaaaagacatgaatgctgttaggaagaggctgaatctgaggtacctgagagacactyaaatggaggtatacagggggcagttgggcacatgggtccggaactcagtagagaagcctgaacagaagctagaggcatgtggattttcagtacgtgctggtaattgaagccatgactgcagacggggcagccagggaaagcaatcagagtgggaagagcagactgaagcaactctrcatttagragatgaaagtccaaagggacccaataaagggaactcagaaggagctaacagatttgacagcaaagaggactagccaaataggcaaagccaaaggaggaagggacaaccagcaga

SEQ ID NO: 21488 - DNA, 598 bp, Bovine  MMBT03853
  misc_feature (1)..(34): n is any nucleotide
nnnnnnnnnnnnnnnnnnnnnnnnnnnnnnnnnngtgactgacccccgactctgctccctgggtctttcacttccggagtctagcctggtcttacacaatgctattgttaaagagaaaaccacaagctttaagatgtcacttgtgctaaagcccaggataataaatctcaatttagtacctgacttattggcagttttaacctacccagaaatgtcaaccagttgtgagttttttsgtcaacatcaatgaagtcatctgtcacatggatcctctccatccccctcaacaccctacctacrgaagaagatgacttttgcatgataagacctttttattcccttacctgataaaagaagctgtcctggtctaaaaataattctttcttttcttctgctaataactcccttgctccaaacttctccctataaacaccttccactctgtaccgtgccttgtagcacccttctgttttctaggtgggatattgcctaattcatgaattcctgaataaagataattagatcttcaaatttatttggttgaattttgttttttaaacaagtggagacttcaggtgtccaagaaagcacaaagaga

SEQ ID NO: 21489 - DNA, 515 bp, Bovine  MMBT10586
ctgggagccgatggcaaagcggcgcttgagctgcttctcgatgcggctcagcagctcctggtcctcctggctggtgaagccttccacccctgtgggtgcgaggagggaggcgggtcagcgggtggggacctcagtctgcccacagcggggaagagccagccagtccccgaagagaacatgagaggaagacagagggggagcctggggacagccaaggcctgagcgagacgacggacagaggcctggagtcaaggacagggcaggcatgagcagaaggatgctgcaggcagagggaacagyaggtgcaaagattcagaggtgggaaacatgcccacttcattcaaaatctagtcgtagggccagggacagggccagagtgggggccacatgggggccaggtcccacaggctagagggcacagcccaagttttcctgattctggtgagtggagcagccactggaaggctgtgaggagggcctcgagctgaggacagcacctgggccccaggtggcta

SEQ ID NO: 21490 - DNA, 600 bp, Bovine  MMBT13698; identical to SEQ ID NO: 4670

SEQ ID NO: 21491 - DNA, 600 bp, Bovine  MMBT03584
tcagataaacctcctaaagcaataaagctagttagtggtaaaactatgaattcaaaatgggcctgtctgaatatgagacactttctgtcaactagaatgggcttcttttatgttacagacttagatttatgcagctttgaagaggattagcacagatattttctttcccaagcaccaggtccttcccaaattaaaacaactaccagatctcagctatagcagcattctaataactgatttcttttcacaccctgaaaggagaatgccaacctatcatgattctagaaacaaataatatckcatatatgaaattgagctgtaatagtcaaaagatggtgtgaagtgttggatagtccttacaccacggtagatcaatagtagaaaataacagagactttccaatattagccaatacttattttggtatatgatgttcttgttgactcaagacctacatttgaaaattctgagtcttctcattttcaactttcttcatggagaaatatcaaggaaatattatttccctttaaatttatcctttggaatctacaggataatctagctaaaatgtgagaaataaaaattcagtgacatgttaaa

SEQ ID NO: 21492 - DNA, 600 bp, Bovine  MMBT06156
ataattttagaactggcagcattggatcttctgggtgatgaactgttagtatgatgaacatcactgaaattttgaataatattaaattataaaaattactaccacaacaaaaaaaatacaggtaaattgtaaagtatatgtrgtataattctaaagtcaagaggaacatggaaaggctttctgctcaccatatttatttatgcatcagaaagaaatctggccataaaaaagagcagtctgtcattttacaaaaattataaaatcagagtttttacaaatattataactattgggaaaatwatgttggaagatgaagccaaaacaatagtgaacatttctgaaacataaagggggctagaacygtgttagagaaaactgctagagctttatatgttctaacacaggattagtaaatgttctaagccatgcactgaacaagaagtccctgaaaagcctgatggcagaggtggaacttgtcattctatggataaatagatgttaataaaggttatgaagtttttaatcagccacagccatgttgcctcctgtctctgtgccaggagttcattatgagatagaagttaatacatataagtaaaa

SEQ ID NO: 21493 - DNA, 600 bp, Bovine  MMBT10926
agaaaaaggaggaaagtatgacaaatgtgacagagtcctaagaaggcactgggaaaagtgcaaggctgatggtgaggaagaacttcacttcaccagagagaggaaaaatatagtttatgccactctaactgtaatcctttgcatcttctcatagctgtggttaggtcaacgaggccttgtttttagctcttcatcctctcactcaacagtcaaacctgaagaggcagaaccacaccctccttacagactatttgttttaaaatggagtcttttgtatagaaatttgttttgagtggctamacttgattttatgtctgtaatgagtgttctcatggtgaagtgcagcctttcaaaggaaggctttgaaaggccttcctatacttactaacacatttacttggcccagaataataagagaagccatccaatacaagggcaagcatctcaaacctaaacagaatatttcccttgtctttgtctaagtaacaaaataaaaattattttgcttccagtcagacttcaagtcttgaacatctattgtgtttagagaacaatttcttaggtacaagaggctaaaagatacagttgaaattaaagatc

SEQ ID NO: 21494 - DNA, 598 bp, Bovine  MMBT02299
  misc_feature (1)..(165): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgtatctattggtaagcagattcttatggcccccacccattggttactacatactgtgggttaattggttttataagtagttaagttcttattttcttacagtttcagaaactgaggcttccctgggacttsggagttagagttgattttcctagcacaaccttgccctatatacagggtgttgcccttctcatccactaacctagcataatattttccaccttcctaatctttgtactaacataattgcaataaattgctgctgctcttgaagataatctctcttctcacatctgggtttaagtctttctttaagtaaagctacttaagcaatggggaggaaagagcttttccataaagttaaggtctttcctgataaaggtaactactccacccctccttcccagttagatcccctgccagcaatagc

SEQ ID NO: 21495 - DNA, 604 bp, Bovine  MMBT13864
  misc_feature (1)..(4): n is any nucleotide
nnnngatcctataatctggtggagaacagaagacattcatgcatgattatgagctagaaaatgctcaatgccatgagagtcctacaagaaaattctttgaggattcctcaacctgagagattactacagaggtagaagggaagtcttcagagtggaggtgcagttaatgctgaaccccaatggatgggcaggatactaaacaaacaggctttttaagcaaaggaataacaacggtaatggcagttctttcagtaggtggtcccaaagatggaggcagcccagctgagaactattccgatattaycccaaatagtccatttggagtgaagcagaattgtgcagaggggcacttgagcaggagaatatggttctagctggatcgtagagagccaaaatgcccaaccagggaattcagacttgatttagcagctagtaggaagccggtggatgtttttggacagtagggaacatcagagtatataagaaaaattaacctgcaaggagatgtaacatggaagggagtgagggataactgaagctggggacggctgagggcagcgtatcagactaccccaagccaatgcagggcactggccatgggagt

SEQ ID NO: 21496 - DNA, 600 bp, Bovine  MMBT06919
gtattgttatccacagccttttagggagtgatccaaacttgctctcaggagcgtaatggaaaccggacagttacgaaactaactttgctttcctgtaagacagatgttctctgatccacagttgaagaaacaatgaggccatttatcagtgaaaggagctgcttctatctgaactcaggaaattgatagcaaatggctgagaaacaggttgttggcagttatgcccgagtagaattaattaatctatacattcactagacaaatatttattgataatattctgtctgtcagacaccatgmtaagtactggggctataaaataaaattaatgcaatcattgggaagcttgtgagtctctgttaactgtgtttctccttgggatgattcaatttaaaaaaaaatggctcttgaataggtttgaacatctcaaaatccaagagtttcaaaacacatgagtaacgtggcttgcctcccatgttattgataatgcttgcctttgtcctcagaacggtgttcctgtcacagaaagagacaaatttaattgtgatcaccagggacagtgtagcattataaaaaatgccagaggacattctactcacc

SEQ ID NO: 21497 - DNA, 590 bp, Bovine  MMBT09010
ttccagttactggtcatgcagaactggccacagtctacccagtgctgacagaaaggtcaaacagtctccagttttgttccagccaggggtcactcaccttccatgagtttggcaaaaggttccgggcatgtagaaggaatgggaagggcaagcttgttcatggccactccataagcaactgctaagccatcgattccccggaagggcacctcaccagtcaggagctcccaaagcagcaccccatagctagggagaggaagaagacagaagtcacacaatgaaccacagctgtaacttcaytgaaatagctaatgaggctttgacgagcatcccacatcttctctaacatgtagggagactaacagaacagacatactgccgtaatataaaagggaggccaagccctactggctataagcaaaaagccctactggctataagcaaaaactctggagtcaatcatactcggtttcaaagtcttattcttcaaattcctcatctgtgaagtgcgaaggacatgagcagttggacaaggctatcatgaaatgaatgctctattgtttaaatcatgctcaagggccacagctatt

SEQ ID NO: 21498 - DNA, 600 bp, Bovine  MMBT08601
tatatagatttacatttaaattagaatagaatgtatatttttaatgtaagcacttgaggcattttaaatttattttaatgctttgttaatattctgtactaggttcagctttctctatacacctatttgtctgctgaatttattggaactgctaccatttacaccaccatacgcagagtaggaacagtattacagcttatgcatacactaaaatattactactgggtcattaatcctgctgatagtagtggcattacacccaaaggtttaggtaagtacagtattacctatgtaagttgkgccatggtgatgaaattgggaaagaaattagatgaagaaatattgggaaaactttgatttgagggggaaaagggaatttattaagttaataaaagtagggaactgtatccatgtaagacagatgttataatttatcagtgtatagtaatatattataatttaaaaaaaataattttttcccaaatctgacattagtaagcaatttgaaattgccacaatctgaaattttatattctctactgttgaaactgtacagaattactactaatttatattataattgcaatgtatactaattta

SEQ ID NO: 21499 - DNA, 600 bp, Bovine  MMBT07919
aatatgattttctgcaccttcagattctgtgtgagtcccagtagaataaattatgtcacattattccttttctccatatatctcatattatggttaattacattacatgaaaaaatgtcattttttcataatgtaaccttgaatcattgtctctgataataaatacctaagttctattgagttctgtatccttgtgagtttatttgagattaaaaaaaaaaaaaagcttctgatatcctgaaaaattactcaaattctttcctggcagaagaaaatgcttagaatcaggaggaatttagwgaacacagaggcaagagggtatctctgtacactgaatcatgtgagatgacttagggccttagtagaagcagtaggtctcatgtgtagtggcgactaagcctgaaaaaagaaatagaaaatggatgcaaagactataaattcaaagttaaagagttttccttttaatcttagaaaatgagaaaccagggaaagtaattggaatactagtggaaagatgaagaagcatttgagaaagaaggaatgctggatataactcaaatagaggtctttgtgtgacttttatgaagtaggtggaggttc

SEQ ID NO: 21500 - DNA, 600 bp, Bovine  MMBT02960
atacatggaatagctaatactttctttagaaaatctaaagaatgctttatcttctgactctaattgcaacatagccttatacaatcttgttaactagaacagtcatggctctgtcctgcaaaaactttttttcggtgattcaaatcatcacaccctcacaataaagctaaatattatttctgacaaataagttactcaacagaaaacaattcattatttttgaagcattctgatttttgttgtcttcacatgttttcatgggaaagtgaaatagattttatcaatccccactgtgcttarttgctcaatcgtgtccagctctttgggaacctctggactgtagccagacagtctcctctgtccatcagatttttcaggcaagaaaactggagtggatttccatttcttcctccaagagatcttcccsacccagggatcraacacatgtctcccaaggttygaacccatgtctcccatgtctcctgcattgcaggcagatttttactcactgagccatcagggaagccccactaattatatgctgtttcaaatggaaatcttactggcatctcttgatggaaacaaaagtgacttgaccca

SEQ ID NO: 21501 - DNA, 600 bp, Bovine  MMBT04288
gagatctctgaggtatttagttttagaatatcaagatattttcaattgccacctggttttcctccttatactatatattatatttgtcatttttatatgaatttaccatctttaattctgcagatagtttattctgactagtgaaacagagcaaaggtatgttttgaaaaattaataccccatcacttgcacttaattaatgatatcctaatataacaaaaatcaacagctttgtgttaccttcaaatcattctccatctcacaaactatacaccaaaataggtgattttgtcatagttygcacattgctcttaacccatatttctctattagtattataagtggatatatcttcatttaaatagcttcagttaattatatgttatgcatgcattagaagcccttcaactayggcccatgtggtgtacattcacattctttcaagatcttaaccagtgtcaaaattcttgaaataaatawtgctatacatgtatctttccatgttgttggcattcttatgtagttatcattattgactgaaagaatatattgctttagtgttaatacatagttcagttcagatcagttgctcagtcatgt

SEQ ID NO: 21502 - DNA, 450 bp, Bovine  MMBT09347
aggctgtccacactcaacgcctggctgggagagcacagctaaaattgcagtgagcggtagggaggcactgaggacgtagtcacccaaaccatcattttggcacattctgttctttgccacaactaccgaacctgtttcccccagtatctgagtggagctacatgtgtgcctgtttttgaccaggaccaaacttggttttgacatcttgctggatgacaagctaatggttgagggtggtcgaggacggtctcttgagttttgcaaaaccaaggtctgccctgaacaggatcccgggatagrggtggtagaacatacagtggcggacgcagaggcattcgttcggggggtggtggtggtggtttccccgcttggtggtgtccaactcttttgcgattccatggactgtattctgtcaggttcctctgtccatggatttctcaggcaagaata

SEQ ID NO: 21503 - DNA, 598 bp, Bovine  MMBT05776
  misc_feature (1)..(29): n is any nucleotide
nnnnnnnnnnnnnnnnnnnnnnnnnnnnnatggagctggttctggttacagactttttacctcttgctgaggacacatcccccaatgtgggttattataagcacctgatacacatttgccaaagaattagagacctcttatctgtgatcaccgatgtgactgatctcagttctgtgtcagacttcactctttctatatgagagcaggggacaccttgttttaccatgagggccctctttcagcaccgcgggagcacagactgctgggtcacactcggctgcctttctccagccctgctcrccactgcccaccagctgcacaggttcttaccctccatctccctgacgacaggtgtgacttttgaagagtccatgcctcatttagctctggtaatggcttaattgagtcggaaaatgcaaggacaggagcgtgataaaaaaccagctgagttgggttcctgttagtcattggaaaaaactaccagggaagggacaagaaaggaaggatggactggagtggggaggagcagcatggggtgccgagcaaagtggggcagagagctcagacaaagcaaataaagaagattaataggagagga

SEQ ID NO: 21504 - DNA, 381 bp, Bovine  MMBT01947
tattccaagctttcttcttaggagaggagtggctacagacttcacttaaggatgaggctcatttgatgggagaccgcaccccttccagtcgggaccctgtggaggtggaccgaggggtgagctcccttctaagacctgcctctttatcagtcgagtgctacagacacctggggacaagaggctgggacttccattaagtccgatgcaggaaaatccctatcgaattccatcttaatgaattctggagagtgctgcccagattcacaggtaccttgatttttaatacaaaaaaatatcccygggtgtcaggaggttcaacttactgaataatacatttcctacccttctgcctggttctatataggaaaaacattatcaggt

SEQ ID NO: 21505 - DNA, 515 bp, Bovine  MMBT10817
ttaatagcatttttcatgttctctctgttcagccttctctacctcccagtgatatacactaatgcttttccacgtgtccagagaagagtcacctctactcaacactaccatctccctgtgggtactgctctctttcaggattctttgtcacatcttttcagtaccactatttcataccataatgctgcatgttcttcggatttctcagtattcttcaatcaccctatgttcattagaactagaatcaatgcttccctcccatgtaaacattacacttttttctgcatatgaatcctccamcatttttcaaatcgttgaattcttttatgctttttttcttacttacaatgaatcaccaccatcaccaccaccccacccccaacatgacagataagactcagtttgtgacttgaagcatctacagaaaaattcaagtgataaacataacattttacaggacttcacatgctcccaaatctttattcttataaaacacgtttattagtaagatttat

SEQ ID NO: 21506 - DNA, 598 bp, Bovine  MMBT10464
  misc_feature (1)..(47): n is any nucleotide
nnnnnnnnnnnnnnnnnnnnnnnnnnnnnnnnnnnnnnnnnnnnnnnttctctttgatgaaagtgtgtatttattaagtagttctgtaattaaaattttgaaagagtgacttatacagtgctctggaataatactatatggagagttatagatttttaaatatatcattgtgtcaaagtattcctgtgcaggttagcttgctgttaaaactattgcaatcttatatgattaacatagcaaattaaaggaaaaatagtgtgggataaggataattgaccaacaattaaggagaaaagtagyacagcattacagggtatacaaatataatactgtttttaaaatttctaatttatttgttttaaatagggcatgtggtaaaattatactagaccaatgaaattcttctaggaaactaggaaaaataactctctgaatatctcctagaagggataaaatatttgttacgaaatattttagctttgtatactaatatttatctttttagaaataagaacagagttataacaatggcataaactaaaataaaacaatgaaaatacatattacttttataaaataattagcaatgattaaataa

SEQ ID NO: 21507 - DNA, 522 bp, Bovine  MMBT11756
gagaaagaatgattttctcagtcaracaaaaattgagggcatttgggctggtagacctgccttgtaagaaatattaaagccattcttcagagrtaaggaaaataatataggtcagaaactcaaatctacatraagaaagaagaatgttgaaaagaggataagygaaggtaaaagaaaacttatttttccaattcttctttgatctaagagataacagttgcccaaaataataatggcaaaatgtatttgatttatgtttgcttacatatatatatttgtaactgctaagtcacttcagtygtgtctgactctctgcaacactatggatcgtaacccaccagkctyctctgttcatgggmtttttcaggcaagaatcctggartggggtgccatttcctcctccaggggatcttgctgactcagggactgaactcacatcttttttctctcctgcattggcaggcagggttctttaccactagcaccacctgggaaagcctatatatgtatgtttatgcttat

SEQ ID NO: 21508 - DNA, 449 bp, Bovine  MMBT02730
tcaagttcacccatttgacagtcattatattttctgcttcatctctgcttctgtaagctctgctggtgtcagaacacatcattcattcattcaatcaacaaagatctacttaatgccagttttcttgtgtgtgtgatgaacaagacaaatccctgccatcatggagcatatgatctagattttaaaatttatttctgtacttgaaactacaaaggtagcagaatttataaagctgaaaagaaagtaggtaataattatgttaaagagaaataaaatattaaaaattaaaaatggtaaaamtggcctgccaattagcagaaatgcaatatgatatagttaaacattggctaaagcaaagtttcatarggatttatagaggtagtgtggtcattgagatgtcaacataggttgttccgacttcagttcctctcacaagtagtgtgtgtctg

SEQ ID NO: 21509 - DNA, 598 bp, Bovine  MMBT09043
  misc_feature (1)..(92): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcaagaactctgtttcagaagaataatcatttggataagttgactttctttcaaaagaaagcaaaatgtagggcatttacacctataaaatcaattgtcagcacttaagaatgatggatgcttgtttcatgacagatgagctgtcatggacacgatgcttgtatttttacatacgaatttcttggagatataaaatatggagaaartgatcacttttcactgactgtggaatgcttttcactttaacccacctgacacttaataggtgactcgttgccccaaggtaaagcccttctgaagctttcagacttgaatctgaattgatttgatcccaggagattggtctaccttgattattctgttgtcagcctggtttggcaattggttcaatgagtctgcctataacggaggtagggagagagaagagtggttggggaaattgactgattgagagccatctggggattttacttaatgagaggaaatttagaagggtccatgtca

SEQ ID NO: 21510 - DNA, 598 bp, Bovine  MMBT09164
  misc_feature (1)..(41): n is any nucleotide
nnnnnnnnnnnnnnnnnnnnnnnnnnnnnnnnnnnnnnnnnggtgacggtgcaaggggggagcacacagagagtaagtgcattgctctaaaagcattcccagtagccatgatctttgtaggaacaaaaatccattgtgcaggactgtaatctgagaaactttctgttaccgtgcttgttcgactcaccagcattgatccctggtacatgtgaccctttgaaaaggagcaccacgttggtgattcctcttattactaaataccattgtgttcataatggccatttatatatggttacactycacgcccgtttggttaatcagcgttcccaaactctctgatgccacctgaccagcataggatgcagacctcggcctcctgatcactctctttaccctgtcctctgttgttcctagatgtcctctatgagaatgaaatagggagcttagcatggctggaaatasggtagcacaaattctggggggagagggtggcgggtgtggtggagggtgtcaggacgaaaaagcctggcaaagtcttgaggaaaataggttatttaatttaatttaatttttttcagttccacaaaatgtctgcatg

SEQ ID NO: 21511 - DNA, 512 bp, Bovine  MMBT11364
  misc_feature (1)..(41): n is any nucleotide
nnnnnnnnnnnnnnnnnnnnnnnnnnnnnnnnnnnnnnnnnggtgacggtgcaaggggggagcacacagagagtaagtgcattgctctaaaagcattcccagtagccatgatctttgtaggaacaaaaatccattgtgcaggactgtaatctgagaaactttctgttaccgtgcttgttcgactcaccagcattgatccctggtacatgtgaccctttgaaaaggagcaccacgttggtgattcctcttattactaaataccattgtgttcataatggccatttatatatggttacactrtttccatacaattcccaacttgattcataacttctctatagacttctcattattctggaaatctaaaattacttcttaataaaaatgtactctaaatgcaaattatcaacaaaattaaaatgtaaattttcktacacggatacatgcacataagtgactcatacctaggaccctggaattctcatcctaaagaaccagagtgtacatctttt

SEQ ID NO: 21512 - DNA, 600 bp, Bovine  MMBT11084
tgggaagatgagtataaaggatttccatcccacacatctctagacaaactaagcaaagactttgtctggtgtaaatgaagaaaaaacaacaaaggacatttgtggcatggtgactaaagggcaagcagtcacatgtttagttaaatgttctcagagatggagctaacactgttagaactcccgagagcttggcacttcttcagcaaactctcatttagaatgaagagcaggcttcctggagttccggagcaatgctctctggggccatacgggagcctgagacaatggagaaatacctgytcctatgtacattcatcaaaatatccttcaaaatattttgaaccaagtgagaaaaattaataaaagctctatgatcaaaagacgtgacaaccatgactcgttgatatatggcagaaaccaacacaatattgtaaagcaattatcctccaattcaacataaaattttttaaagacatgacaacacataaagccttgcactgcccaatcttttgcatacattgtcaagccttataatataaacctgcctagtgagcaatttgaggaccttggaaccaggaaactcagggctcactggacatg

SEQ ID NO: 21513 - DNA, 600 bp, Bovine  MMBT11272
gatatatgtaaaacccactttccttatgaagtgtttattttttgcatatagaatcctttrtaatctaacaccatccagatataagagccatttagttgcatatgtaaaaggacctatttgaaaagtaaaggaataaagtggcctttatgtgcttgggggcctttctggggaggttcaccagagaaatggaagtacacacacttcctcaagaaattcagtgtccctggggtctctaaatcgtgttattttctcactgtacatgaggcctcattgcatttgctttatatcctagtcattctytgtcacagtggcagagatgaatattttcttcactgtagttgttttcctaagaagctaaaaatattggaaggaaattggttttttctcttctgccttatctttgcataactattctcggggatctcagagcagcgtaggagatgacctctttttttattgtcgctgtagcgccaagacagagacacaagcagcaggcaataaaagcaaccctggcctctgcgactgtctttggaactgacaagatgatggttgcactgaatccactggtcagttccaatttagtccaatccctgatttgac

SEQ ID NO: 21514 - DNA, 600 bp, Bovine  MMBT07469
ttatgcgtgtgagttgcttcttgtagcacaggtgtggaacataatcagatgtggattagaaacccagaggattgccattgttattttatggtaagaatgtagttttcagaaatactttgaagtgccgtttggggcattttaggggaaaattttatctgccctcccgctgatgagacattgagagattcttttgtcctacatgtagtctaccattgctcttagtcatttttccagtttccatccttgtgactggtgctttatgtctttgcaaattaaatccatattttcccctgctcctckttctcttttatactgaaataacttgtgacatttgaaagttaaattctttgatctcacattttacatctttagatcatttgacaggattctgaaatgcttttaatgagctatgtcaccttttcaggttatgataacacagtgttctcmttgtatgtaaaactgacattttgtcaaatggtttaggtattaatgcatatagaatttggaaagaaagatgagactacatgatctgaacattaagaaacgcaactcagaacagtgatccttgtagttctattttagcggccagggcctaatgag

SEQ ID NO: 21515 - DNA, 598 bp, Bovine  MMBT00724
  misc_feature (1)..(119): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacatgaagaatgaactagtaactaacaaagctatatgttgattaaaacagcatgtggttaatttttaaagattgctgatctttattaaggatggtgaggctaaaaaatcaaatatttttggctaacatatctattgaccagagaggcagtgataaatactctggtcattaaaatgctwtttcagtcttgttaccacaaaccttgactgcatgaaacatagttatagaagtaaaattcaaaaatctattaggtctctgaagctctctgtktcttrtatctacagaggggagctgagmagtcacattataatttgggaataataacatacaaagatgtatgttatttgaatattgtttctatgttcagaatcatttcagtcaactcagtgcctcccattgcccttcatccatcctaaagtcacattgtgtacttctctgagctctccaaataggcaccctcttgttgccaagcaacca

SEQ ID NO: 21516 - DNA, 600 bp, Bovine  MMBT06763
attccctggaggttgcatacagtcttgtcctaaaactaaatttaaatactctgttatgttcccaagtattaagcaagtttttattaaaacaaatattcttatccactgaagcagacaaaaatattgagtctgagtgagaaaaaaagccctaatcaatcaaaacaggaaaacttttctgacaaaaatgatactttaagtctcttttttaaaagcatattttgatgtaaaaagatacaaatataaatgtaagtatagtatttacttgcaaaaatcacagtgagattctgtggtatttaagtrtattgctgttaagttgttagactaggaaacaagagtccagaatggcgggggctaaaagacaaggaatggaaaagcccgcaaaaatagaacaagggaagctccaaggaccggagtgaggaccttaggtagagcaaacaacactcctggctagcccaatttacatagggcaggcccagggggagaaagaacatataaaaagaggtgccaaagggctgggggtctctctccctccacccccactccccgtgtgctggtgtgctcttctctttgcatctttgggtcgacatgccctcacgcctc

SEQ ID NO: 21517 - DNA, 600 bp, Bovine  MMBT20043
ttgggaagtccaagatcaaggtgtcggaagatatggtgtcaggtgaggtcctgcttcctggttcacagacagctgtgtcttcttgctgcatcctctcatggcagaagggctgggggagctggctggtgtctttgttatgagggcaaatcccattcatgtgggattcattcaaccccattcaccctcacgatctaatcacctcccagaggccccatcatttgggggagctgggtttcaacatatggattttggtgagggggagacacaaatattcaatctatagcaacctctttcattgtmtagtttacatgttttgtctctctcttctaaacgataagattctggaaggtctgaaccatgttttcttcattcactacctgccttactccatcagcaagcagtgcttgtcgctcctgtgtccacatccattcatctttgtagacttaatgttgagcaccctgcctttgaccaagaaatgaatccactgctattcagagattttcctgtcttctgactcctctttctcttccccaaccaagttgctttgggaactaagggaactagcttcccctcctctcgtagtgagagaggtctggaagt

SEQ ID NO: 21518 - DNA, 600 bp, Bovine  MMBT00788
aaaggggacagtctgcggttgaagtgagttgatttatatacctagtgcttaacagccagagcagctcaatcaacttgcttttcctctctctttccctcaggccttccctccagctaatgatagttttgacttccacactgtaagaaaatctggtacctggaaaaggcagaggttacttcagttcaaccagcaagccaactgcagcactgagaatagatttgccctctctgccgcgctggcatgggtcctctgcacaagctctagccttggggatgtggagatggttcccatatcaggatkcggatgacacacaccaaaggagagactgcttgtcaagttaatttctctccctcacgtttggagaatggaagggagcttctccatctgagatcttagggccccagtatatgcctgtgttatatcccatactctttttaagggcttgtgagtatgtcacagtctcagccttatacttaagcacaagcatctttgtgttgaggggggaactcggaggtataagctatttaatatgctgggagcaatttgcagggatgcagcttagccacgaaatctgcttaaggatgctgaacatcaaagtct

SEQ ID NO: 21519 - DNA, 600 bp, Bovine  MMBT04261
atgcattggagagggaaatggcaacccactccagtgttcttgcctggagaatcccggggacgggggagcctggtgggctgccgtctatgggttcrcacagagtcggacacgactgaagtgacttagtgttagcagtagcaggactaacgtatgaacgaaatgtgtcctacaaataacacatgaaaacaaagttagaaatgagtataatcctctgagtgtgttgtatgcaacagtttataccttcagttctgatcacagacatgcgcttccagctaagggccattaatccatttactgctrcttgttggagtgaagagaaattatcaaagacttttccatatgtttcagtgaatacctctttaattgtggattgttcagcttccttatttttctatgtatatggcctctttgaagattcctaaagccaattctctttttactcaaattaaaaaacagcaacaacaacaagyaagctactgtggccacagttctgattcctttggtcgtgacaacgcctgcctcgttcttaatatttcatcctaacctacttccacactgagtgtacttctgcagcagtaaaataagatgtaaaaacttaga

SEQ ID NO: 21520 - DNA, 602 bp, Bovine  MMBT11292
  misc_feature (1)..(2): n is any nucleotide
nncacatcaaactgcacttctaaagttctgccgtcgaagaaatgctagagaaatcagtttgggaccacgagtgatgttatgacaaccttgtagactctgccactttagaatgaaagtttcaagctgtaaccaaaaaaaaaaaaagtctctggagccacggtttatccaatatattgaatccagattttgtaaaccacaaaaatgtcatcctagagatcatatgtagaaacatgttttcttcagaagttttaaagtggaaatcaaatatacaatgaagacaattagatgaaatttggaaaaarccaagcccaggagatctggggcaacttcaggctggggccagtttgcaaagggaatctatgcttcccaaacatggtggaaggggagggttccaggatgaagaggtaagggtagggtcgcaaatggagggatacagttcccaaggctaaagaatcccaaggatttgaataagtgggagagagcaggattttattttattttttaaaaatctgcagtgttgcaattttactgtgtaggatttcrttttatctaatcttggtaattccgtgttggatgatgctggtctccgctgtgtgctctgc

SEQ ID NO: 21521 - DNA, 600 bp, Bovine  MMBT20972
cctcctctcccttgctctgtttgtggggccccctcagtggaaagaagcttcccagtggttcagcagtaaggaatccgcccacaatgcaggagacacaggttccatccctgggtaggggaggtcacttgaaggaaggcatggcaacctactccagtattcttgcctggagaatcccatggacagaggagcctggcaggtaacagtccatggggtcgcaaagagtcagacatgaccaaagcaacttagcatgcatgcatggcatcggtggaaagaggtgcaacttggatgtaagatgtggakgtggggcccacctttccatgtaagacctaacgtcttacatcgatttttagcatgaggacccaactttagatcgaacacaggatcaaatccttcttatcattaaaagaaaatactttttaaacgattcacaacaataaagccctctgttttcatctgctatcaccatgcctgtttctcagaaggttttgaaactgaaatttcaaaatatcctgagtaataagactctcttctgttactgaccacatggaagcaaaaataatgagagggctgagaatcagcatgtttacagaccaattctta

SEQ ID NO: 21522 - DNA, 600 bp, Bovine  MMBT06287
tcgaacccgtgtctcttgtgttggcaggtggattcttaaccactggaccaccagggaagcccccagtgtcagcttttgaggatatgaccaaggccgtgctgccagcccagtgcccagcctggcatgcttaaagaacgtttgcagttcaaatctacgccctcctcacccgcttgacgtgtcatggttggttttccaaacccagtatttagtctcgtagactcctagtttcatggtgtctgccgataagacgctaactcaccattaaaaggaatggatcagatggaattcaggtgcaggatsaggtctgsatagtggttctcaaagtgtggtccccgaaccaacaatatcagcatcccccgatgccattagacgtgcaaactctcctgcagcaggggtccccaaccyccgggccatggaccagtaccccccatcagatcagcggtggcattagattagaaataaagtacgaaattaatgtaatgcacttgattcatcctgaaaccacccctccctcccacgtgtgtgtgaaaaaaccgtcttccatgaaaccggccaaaaaaggctggggaccactgctctacaggatcagaagctcggact

SEQ ID NO: 21523 - DNA, 598 bp, Bovine  MMBT07058
  misc_feature (1)..(168): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattgccccgttcttaaagaactccgctctagtgaatttagggggcaggggcaggggcgggaagacaagtacgtgtgaaaagtatattgattccacaagaggaatagtgtaaggctgggcagaggtttttmaaacagaggaaacaggtaaaaaggggaaacagcaagaggagggtggaggtgggggcaggagaggggcgtgcagggctgggccccaggacttctacctgccacctgccaagtcagctctgcttttatcaattttatatgaggctttaaatgaaatttctttcaaaaggggaattctgctgatgtttaaaacataaaagagttgaaaactgatttaaagaaagaactcatgttgacctggtttcaaatctcagttttaccacttactcctcagtgtgttcttagactgagctacttagac

SEQ ID NO: 21524 - DNA, 598 bp, Bovine  MMBT08201
  misc_feature (1)..(196): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaaaatcctatagatagaggagcctggcaggctatagtccatggggttgcaaaagagtcaggcaccaattgagcacacatagacacacacaactttacatrtatgaggcccatatctttatcttcagtgtctctatcctaaccttgttgctggtagccasgttgattttgcaggttataggggctttttaaaacaaacaaacaaacaaacaaaaacattgcaggcatgttggtttggggagagattcagggtgcacttgcaaatataggtctggagttcaagaaggttttctgtgttggatatttagggagacttttctatgtcttgagaatactaaattgaccactttggagatcttraattcattattcctcatattaaataatggtggtggtttag

SEQ ID NO: 21525 - DNA, 578 bp, Bovine  MMBT05394
caargaccaagggaaagtgaaccagttctttgattcttgactttggtggagtgagagagggttgagtttaggcagtcatttccccatcttgaatccaagtgytagagagtatatttatttcttaattaatgtgaacagctgtttatgacaaagaaaagatgaaagataagtaaatccattaatacttctttcaacctcatggtttactacattgttttcatttttctctttctctctcactcaccagtcttatattttaaggttctacccttaaatgcartgtgtccattcctattggtycagcttcatttatcaataaattttttgaaaaaaatagttttgatttccctgtgttttccctgagttatttttcacaatagatgaaaagtatcattctcaaaaccaaatcattcacatcacttctcttcagttgctcccctgagtttccacattcacttaacattaatggcccttcgtaaagacatgtaaccttgacctcctctccagtcttactgacttgtggtttcttcttctgacattatactgtcgtagctattaaatgcatgtttcttttgtat

SEQ ID NO: 21526 - DNA, 601 bp, Bovine  MMBT04587
  misc_feature (1)..(1): n is any nucleotide
nctttccaatggccctgtcactcaaacgttgttcatgacaagctcatgactggtagagggacttccctggtggtccagtggctaagactccacactccccatgcaggaggcctgagttccatccctggtcagggaactagatttcacatgctgcaactaagactcagggcagccaaataaataaatgaaaaggggggaaaaaaaaaagctcatcttctgttggttccctccccagcttgaagccttctgctgcgacccccttttgaattcatcgtggtcactttcaatgtttgcttccttyttcactaagcaaaaagtctcagcgtagatcctacaacctggatgatcagttttgttcagagaactttcttccattatgttccaaatggacttcaaactcacatggcacttacagtctagcttgtattatacaagcatttacaggcagacctcagtgatactgtgggtttcattcctgactattgcagtaaaggaaatatttcaataaagtgagtaatacagtttttttttttttggatttcagtacacataaaataatgtctatattgtastctattatgtataccatgatattatgtct

SEQ ID NO: 21527 - DNA, 600 bp, Bovine  MMBT04662
acagaggagcctggtgggctgcagtccacggggtctcaaaagagacacgactgaacaactaaacaacaggcagcggggctgatactcagtgtatgcagcaacccactgggaagggtggtagaataggatcctggagggttgtggctgtggtaggtgttaaccttttagttgctggattgtggggagaagctggactcagggggagcccagggtggggctcaggaggctcagagaagaggctacttctcaaacagcacagaatatttcaatattttaacaaccacagtcatactgctcacmatcagtcaagagtgaggagctcataaaggaaagactgagataggcagggagaaatggggaagaggggttcaaattagttagggccccctgctgggttcaatcccttggttgggaagatcccctagagaagaagatggcaacccactccagtgttcttgcctggagaatcccatggacagaggagcctggtgggctacagtccaaggggtcgcaaggagtcagactcgactgggtgactaagcacagccctgcttggaaaggcttgttgctgccaagaatgactatttggggtcactacgg

SEQ ID NO: 21528 - DNA, 600 bp, Bovine  MMBT12244
ctgactcaatggacatgagtttgagtaaactccgggagctggtgatggacagggaggcctggcgtgctgcagttcatggggtcacaaagagttggacatgactgagcgactgaactgaacagaactgaagttagtgtgagtctcccagtggttgacaccaggttcatgggactcccagctcaaggatggagacttccattgtttccctggggtgagaaaagctggccattctttttcctcaggaagcacagctgctgacacataaaccagagcatctccctcattctttgcccatactcwctgatgtgggcctcaggccctggctgtggggtgttctttaaataatagctttttcttcaaggccttgcctgtgatctgattgatggtggcctgggagaagccagctgcttcagtgggcaccacacacagacgctgcactgtgtttcctgtgtgtctttggcaggtcttactctgagctcctgcttctttccttcattcagcaagtgttttctgaggggtagctttgtaccagatactggggtgcagggatgagcagtaacacatggtccccaacctccagagactcagatttaggacaga

SEQ ID NO: 21529 - DNA, 600 bp, Bovine  MMBT16599
agaaatatctgattaatttcatgagtgattacatgatgagtggtcgagggatgccgctgttctttgcctcttgcaaaggactccgttttgtgccctcacactctgcaccagaatctaagtccagaatctctccagtgtgtctgattctaggaacaagctgcatgaagtccccagagcgtagagccagaaatgaggtgcttcttccacacaactaggctttgatccaaactagcaggggagctgtgtgcagttaggttcaattattctggggagaaaagtggtgagagtattagaacaatrttattattattgcatttggatggyaggtattcatgtttctccatgaatgtgtaaaatcctcccttccatgctgattttaattgaattctgacaaatccaactttcctgaggcaagagaaaatgagaatgttggtattagcatagctttcccccttgttaactgtatttacatatcaactcctgggacagcatacattattttctcctttgtgcctaggttttatcacagcagcaccaattagctctgttaagcatctttctacagatacacaggaatgtgagagatttttactaccaaca

SEQ ID NO: 21530 - DNA, 600 bp, Bovine  MMBT12807
gcgggaggggccggcccacctgaatccctgtgtaatacacgggccctggcaccagaccagccaccaacagggtgttctttgttactttttttttctgacgaggataaataagaactactttttgttcaccctaatatgccctcttgggtttgaggacataaaaacaacagtgaaaaagttgaaaaccatttgttgttgctcaggatctctaatcagtgtattcatatcctcgtaaaacatatgcaaatctcaggtcacctagatttttaacattttcaaatcctttccttacctaagatytccctatttaaaaagttcagacctatttgcatttttgtcgagttgcgtgtaatttggtttttttttttttttttacttaaaatctacttatttatttggctgcattgggtcttagctgtgatatgcaagatctttagttgtagcatgtgggatctagctccctcaccagggattgaaccagactccctgcatctacagcatggagtctcggccactggaccaccagggaagtcccctaacttggttcttcttatttctgtcgagttactcaaaggactctcaatacaatgcactgacatt

SEQ ID NO: 21531 - DNA, 602 bp, Bovine  MMBT11816
  misc_feature (1)..(2): n is any nucleotide
nnaatacaaacatgcaacmcatacaagtaattaaatgttattataaaaaagctacattcttcagtttattcttttcccatcytaataattttcacatttrtttcctaaatctgatgtgctgtgaaaaaaataagctttttaattcaaattagcacaaggcagattgattcaagtagtaatttagtatctctagtaatttaatccttccaatagtaacctaccatttctctaataaaagagaaatatctaaacttcaccttcaatatattctgaccatattttacccatctaacaaaatctcycccaatacccaaactaaatatttctctwttaagtcaatctatacctatttgttgttgttgtttagtcactaayttgtgtccacctctttgccacaccatggactgtagcctgactagctcctctatctgtgggatttcccaggcaagaatacctgcatgggtcatgatttccttctctaggggatcttccccactcagaaatccaaccttcatctcctgtgttgcctggcagattcttgaccaccgagccaccaatctatacctatattttgaaattattttttcctcattgcttgtctc

SEQ ID NO: 21532 - DNA, 600 bp, Bovine  MMBT06706
taaaatactcacaataacatagcctatctttcctgatttgccaggcaaagcagaaataaaatcatgctgtctgkgtataaggtaaaaattaactgttgtgacacttcatatttgtattcctctcttatcttctacattttataaaactaaagagtactaattaaagttactatacacttgaggaactaaaaagaggaagagatccttcartataaatattygatctaaaagaatgagaacaagctaggacagtatagcatgtggtttaactaagttttatataatgaatgaaagaaaccraactagttagccataatttagggtagctatgacactttgaaatgtacaagagatgcataataagcagagaaccataaaatatttgaatcttttcaaaataacttctttactaataactgtatgatttataatgttgtctatgatgcagacacaatcactattaatgtaccacaatgttttaaaatctcagagtcattaccctcaaaaaccttagttctataaatattcctgcctcattcattttgtcatactgtgcagcactgaaataatataaagtgacatttactataaaaagcatac

SEQ ID NO: 21533 - DNA, 598 bp, Bovine  MMBT11803
  misc_feature (1)..(101): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtggggcccactggctccatcgaaaggctctgggacgaaggctcgctcctggctcctgactccgctcccggccatccctctgctcccttctggaactgcagcaacaacccacagcaggtagagaaagccacagagcagtgtcagcgcaatcacgctggagaacaaggcttctctaagcagactgtttctgggtgccrgctgttggcaggctggagggaccaggcgaaggctgtctgatggactgctgggcgcagagctgtggcctgctcacgctgcagagcctttttgatacccagcctgggccccccacggctccccattcgcctttgttctgggagctccgcccctgctccctccccactccccctcctccagcatcctgttcgacgggcaggatcagtgccccgcccttctgcatccatcaacgggacaggccgcgggcagcccacgaaggccagcctgggtcagagggggcctcctcaggtaccctcccga

SEQ ID NO: 21534 - DNA, 600 bp, Bovine  MMBT04876
ccttggaagaaaattccctttgtttcctgatttccattatcataaaactattaaaacatcaataagaaataaattaagatctatcaaatgaataaataccatctcacctctatcttaataagtgcatcctttcagctcaatgtttaggagtgattatggcggtttttctgccaagacttggtatggagcaatacaataaatgatattttacacatggtgtgtttactagatgaagttaaaatctagttcaaattagagtgtacaggttgatatcattagtgttactcatgtgaagacttwgggagattctggtcaaggtgctgggcactactaagacccaggtctggctcacgcttttgagaagtgtgacaatgtggggataaatatccttttggtttagctcggattctgagttattttctctccaagcagtgcagtaggaagtccgcaccaattcctcagaccagtccaggtcaggataccgactcagctgagcccttgctgagacctagaggaaggggatgggctggtgaggttgctcaggacgccyggagcttgttctcgtgaaaggggcccgggggacccagcagtcagccaagg

SEQ ID NO: 21535 - DNA, 600 bp, Bovine  MMBT14434
aatcgcttttataatgacaagaagagaaatcaggtcaagaaatgcatgtgaatcttgttgtggagaattaaattagaaaagtygtggaatacttagaaatcaactgagttttcacattgtggacaatttaaagggagggttcagggtgattagcccttgggcagaatatggttttagacatgttctattctaagctattaaatacaaaatgtataaatgttatcttaaatatcaaatattaccaaaggcaatttaatagcaattaattttgtgtcrtctcaaaagctccagttgaaaacrtctttgttgtaataaaattcctacayytcttaacccagcattttaagtaatgaatttaattatgaagaaaactgctgtcattaaacccttcttcttaatcatgcctgtgtttatgrcaaaaaaaaaaaatctgttgccatggaaattttagtgtcaaagttgcaactcataaagctttacagaagtataaagtaaaaataggaaatgatctttagcaaggtgaaacttcttccttaatatatttttaaaaacacttaaattatggacagcaggtagattttacaagtgaacctaattttg

SEQ ID NO: 21536 - DNA, 600 bp, Bovine  MMBT10630
tctttctagagaatcaatattattatcataaagtctatccatcaaacaggacttcaggtggctcactggtaaagaattcatttgccaagcaagagacatgggttcaatccctaggtagggaagatcccctggaggaggaaatggcaacccactccagtactcttgcctggagaagcccatggacagaggaacctggtgggctatagtctacagggtcacaaaagagttgcayatgacttagcaactaaataacaagaacatscatcaatcaactcatgttattccatttattgggtctayctatattgctgagcattatttcataatttttctgtgtgcacatacwtcttttgcttggtatattcctggaaaatgtcctgatggccagactggttattcaactctctaacatattcacttgaaagtcccaaaatggaaatagttactctctttttccctatgtccataaatrtcactattatccattccccgccttgctcaagcggctcaccagccttccttggtttagtctctctcctcatattcaatccttctgggagtcctacacgttccaccctctcatgaaaaattttagtttcc

SEQ ID NO: 21537 - DNA, 600 bp, Bovine  MMBT02419; identical to SEQ ID NO: 4516

SEQ ID NO: 21538 - DNA, 600 bp, Bovine  MMBT06736
agaaagatgaagagaacgaaatggccaagggaactgggtccacaagcatcattgtaatcaatttttaaatctatcataaattacagtcttacataaaatattttrgggagaaaaataatttctagctaaaaaaataggtaaattacctctaatggaattctgttctgccaaaggaaaatactccaaatctaattctagtcttcaccctgtaaaaatgatcattatttttagtggtttccaagataatgtgcttcaattatgctcagctattggtttaggtaatttcatattaagtgaatstcaaatgtagtcaaatatcacaaaacatttaagtcacacttttaatctaaaaaaaatctagatatttagacaccttttcctaaaacaaatatattacctttcacaataaccatcaaaatgaggtaaatttttcttttgtttttcatacctatcaataatgtttcttagttatttgcacttaaactgactattttctctccaaagtattctactgtctccactagtttatttttctattattctatgtgaataaaaatgaggcattcctatcatacaacaaaattaaattatgttatatgc

SEQ ID NO: 21539 - DNA, 431 bp, Bovine  MMBT00951
ccaaaaagataaaacacaggagtatccaatttagttgacttcattccatcaagacaggtggttaaatggggaaatttctaacccattaggagagaaaataattagaacataaaatatatgaaatcatgtactttagtattgcaataaaatcaattaaccatagcttttcccagttttctagaacattctagacctcataaattgaataatttaatcataattttttaaggacatacttgacctcttttgactaactggaatttcaacattaatgacccaaacctaactttccacaatcaytggccaagggatttctgtgacttttcaacactaaatatagaaatgaaatttatattaccacacggctctttttcaatttggcatttataccgaacttgaaaaccactctaaattcctcttaatgttttatg

SEQ ID NO: 21540 - DNA, 600 bp, Bovine  MMBT00732
cctactggatagtactgctgcagaatattaaataaaggtattattgtcattactcaaactcatcacaaaactggaatcagacttggagtccgtaacacggtctttttcctgtccacaccctagagaacagctcttctttcttggttacccttttccctgattgataaggcaaaccctttacagagagagactttctcatctctttctccaaagtcaggcacaccgttggggccaagaacaccaaacatgtcctcctattgtccaaaggaggggaattgtctaaggacagtcatttgctcrctccaatccttaaaatctaagatgagctccacatgcacagtttaagcccacattacaacccactcccaatgcagcacatatacattttacttcgtttccttgtgatcgtgatctttcagagcaagatgcaaacagagttttcaaaactgaccgaaccttttattttgtgtctggtaaacacacagctaataaattccctaggaaacagatttgaatgttagacagaagtcccttccaaaaaaggatcttacatacaagggttttcaaacctcaatacatattaagatatgattgaataaa

SEQ ID NO: 21541 - DNA, 600 bp, Bovine  MMBT12426
agatgttataaaatacctgatacatattaaaagtagaagtaatgatacatcacattttgtaagtatatttttgttaaaattcgtatgaaatgtttttttgagaggaataaccaaaaacgtctttaagcagtacacaggggagggcagaggagaaggaactagagagccctgtgccagtgtatttttaccaatgtgagaacttaccgctgtctctcgtgttcctgttttttattgtgtgtacaatggacaaatgagtcctaattgacaacatctagtggtgggctgccgtctatggggtckcacagagtcggacacgactgaagcgacttgcagcagcagcagcagcagcagtcttactagtggtattgatgtaaactccaatctgatgaaaataatttttcccccatgtttgtatgctgtttgacagacggactcgagatgaaatctctgaggccacctggctgagactcagccctgttccctcccgctcctctccgctccctgtcttcccaagtaagctgtggagccgcttgggggccacgtgaccaagacagagtcacatcctctgggctgggctgcaggccccgccgcctcctgccc

SEQ ID NO: 21542 - DNA, 600 bp, Bovine  MMBT10066
actctgctttcttcataatttttatcacttgttgaactctcaaatttgttggtgtacctattaattatctgtctcgcctccgaaatacaaacactctgaggggctttgtcagtcttatactccattgcattctgggtgcctagattaacttagcacttaataaatgaatacagggccaggggtgagggtctggaggcccaggatcagctgtcccccaagaggcctcctgtggcagcagggtcccggagatctctcaccaggcaaggcaggtcatggcctccccaagacttgcatggtgaygatggcgtgggctttcccagcagggttgggggatgctatgtgttcagaattgtaagagttttcctaattcctttaaagagggaaagaaggagaatgacaccagccaaggaatccttgaaaaaagccgcctgcctattgtctgttcccatttctctcctcattcactgtgctaagcttttcagatgtggacgtgtggctttctgagagcaggaagagctctcggtgtaatcagaggcccggtgatgacagagaacattccgtacctgtctttgattacttgggtaagcttaacctcaatta

SEQ ID NO: 21543 - DNA, 600 bp, Bovine  MMBT09518
tagcctcattgcaagcattaatatacataaatcagtggttccaggtactagctgtactgatcctactacacgttaaaataaaagaattgtttggagaactagaagttttgcactcctgtatcattaaggtcattccaggtgctgggaatttctaccctgtatttagctattaatacttctcctggattctaaacctcacttggatgcgtaaacctcattgaccttgaggccagaaagttacctttctcagctgactcacctagaaaatggagagcccatttctgccccacctgccttgcrgcgtggctctggggagccaagtgaggctcagacactggtgttatttggaaaggaaagggctgtccaaaggccttagagtaatgctccaatatccccagaccaggttaatactgctgcccttgtctcctgcagtcccagatctggctggttccccccactggcaccctacccccagtgacacgacctcccccaatccctgccccagggaccccaagctgaggcttaccatagagttcttggatgccctggatgtcatcatgggacaggcggaagttcttagtataggtataaatgggcgcc

SEQ ID NO: 21544 - DNA, 598 bp, Bovine  MMBT11949
  misc_feature (1)..(4): n is any nucleotide
nnnntagcgacggaccaccaatataatgaggattaaaaatactaatatctgaacttgaaagggctacactaaaatgggaaaacagcaaaactctctcactcatgtcatcaagggaaaacaaggtgtactcttcttagtatcatacttgctctccagaaatcctatttactacgagggcatcaagtttgactagactggataaactcagcactgagctggggtggcctttcagaattgctattatacctcagtggccacaatgctgagactacgtcacttgtaatacagctgaagttacaytgcttttaacagtgtctcaagacgtgacaatacttagggaacagattctctaacgtaggagagatggagaaaggctgggaagtctgtaagaaaggagagattagggcaaaacctgagatataatatcaggtacttttacaggtgaagaacagggcctaggcagaaatgaaacatctcctgggtgaatgggtccctcagccctagatgatgggcagcagcactcgggagatgagcagtgctcggaagtggtacgtagtaggaattcaaaatgcctccgctgttataaaaacaaaattct

SEQ ID NO: 21545 - DNA, 600 bp, Bovine  MMBT02904
acttgtggttttaactgccacaaatccaaaggtgtggagccttcatgtggtattactcctcttaggtctgaatcaagaatatgattattaaaaatttactgaaaagttctggcatttacttttctcctttgttaattaaaataatgatacctatgtctcatggttcttttgagaaataaatgaggcattaacctaggaaagactttagttcagtttctggagtgttacattttcatttatattactataaaaacttttcagactacacaagaggaaagacaccatacaagtttatagaaytgaattatgttcagacaagagttttttaaaaatgattttgctgtgaagagaagaaattgatttatattcttacagtgtatatatatatatatatatatgcatagataagtgtatgtgtagtatacatatacttaatacacatacatctgtatgtctgtgttcctgggcaatattatacataattaacatttacataaattactgttacaaaacacctctgtgaatattctcttgttaaactcagcaacaaacctgtgaggtaggtagtacaaggtataaagaaacctcacttggaaagag

SEQ ID NO: 21546 - DNA, 600 bp, Bovine  MMBT07210
ttttccgtaagatgttatggaaaacccaaatgaatatttgggccaagccaatattattgcctgtcctgcccacacccgcactgaatgaacagagacaaattctgtcatgtaattcttcttcatacaaccaactggttagacccccaagtcaatggcatacagtcataaatgaagtcataaacgaaccagagaagtaagttctagggccaaggggcgtgagacagctcaaggcctttaaggctgcaacctgggctggcctctggaaataggttacattcgtgctgaagttatgaggggtgygggcccctggtgagagtgaactgcatgcaatttaaatactaccttgagaagcaaatcaaagtcttagctttaaagttctccaactcacagatctaccaacctaaagcagcccttagtctttccacagtcatccactttgattttggcaaatggatccacaggaggagcagtagggaaagggtaacctggccagtgagaagaaataaagttagaaaatccaggaacagcgtttccaatgagaaaagctactttttagtaggttgactattctctatcgcatgagtctagaaatggtcaaag

SEQ ID NO: 21547 - DNA, 600 bp, Bovine  MMBT10884
tgcaaaagaaacatattttcaggtggcaaattctactccccttcaggccccaattcctatgttcacttcagtcgcaagccaatcttaatagttcatggtatggatattgatgtgctaatggcaaagtatttgcaaactatctatccttaaagttaccccccacccatgtacacatatacacacaaaatgatggttcatctaaaacacagctaaactgtcatcagttcctatttgcaaaaaagcaatttctaaagtgacattagtatgcattcaagttttcagatggattaaaaataacaratttttttttctctgtaattttaggtctttactggcactcatgtactgcaaatcactgatttaagtgggcacaaagatgataataaaggggaaaaaactcgagaaatctttcctaatctgtcactgattaaaacagaaagcaccatttttgaaaagtagataaagtatctaggtaaaattgcatttacttaccctcatcttgaccctatagttctttcaataattattattttgttttaaaaaaagttctgtggtgttatggatcaacagccatgagtaggagtccattttttttttcaa

SEQ ID NO: 21548 - DNA, 600 bp, Bovine  MMBT05323
agctgagagccgaagagctactcttatttataggatcctgagagtgtccgtgatattgggtaagaaatcacactgcagcaaacctgctgacacctgagcgtcaagaaatctgtctctactaggttagcccgagggcagcagaaagtcaagacaggctggcatcagacgccagtgctgtccctccccgtttgtgatctgggataagtgacctccctgagcctcagtttcttcatctctaagatgagaaagacaagaccccatcaaagggctgctgggagggttacaggtgaggatgtattygaggcacgcagcctccagctcacagcctccctcccgtccctgctgccacccgctgctccgtgctctgctgggtctgtgaagcttggctcttgctccgctgttactgtccagtctggaggactatactcttcttttccggagaccttgactttgaatttatgatgccttcactggtactgtgcctgccycttgggatgtaggtgggatgtgatcccaggccagagaaggtgtcagggattgagagtgagtttggctgggtttaggtggcctggcttaagcaagaacactgtgccagggcct

SEQ ID NO: 21549 - DNA, 600 bp, Bovine  MMBT05698
acatttcaaaacttactacacacaagaggcaatttctctgctcttgaaaaccagtttaataattaagactaaaactactaattagtgtatccttttgaatcaatttaggtgctaaaatctttcagccctcatataattttaactattttaggagaagaagcaaaaatatgtgtacatagagaagatgaaacaaaaggaagaaattcacatttgaggctgggtgtacgtgtcatttgcaatcacttaaagcaaacagtccaattcctttccttgtgttgccttctacctaaatggatacaratttttttttagttggtgcagtatgtcattattaatgtagctatattatatgatgaagatgaaggtcataatgttgactgtgaaagcaataatagtgatgataataataatgctaacaataatggcagctaccaattctaaacagttatgatacatcgattactccactggttgttccatgtgagttgtacctttatttctcttaatacaagaaagggcatattattatttctaattaacaagtgagttaatgtcactttaaggattaaggacccctttatgggtctcaccttagttaga

SEQ ID NO: 21550 - DNA, 600 bp, Bovine  MMBT01251
caaaaaagattcaaatataaatcattaacataaaaaagggaaagtaatttaaagttctgcttcaatattaacaagtagtgcactagcttttaaagttttgctaggcaggctggggacaatgctcctctaagccaacttacaaactagcaaaaaatcaatattctcacctaaataggaaaaccacctggagactttagaagacagacacagatacaattttaaataaaacaatgagttctgacattctctacatttttgaaaaggataaaaggcaaagacttactaaaaaatatatacaaracagccaagaagctcaatgacactgcaattccaagatttaggtctactgtaaaagcaaacaataaaccaagccctccacaaaggagcagggtcagaaacaccacaagccatgaaaactgaaacagaggttcaatctgttgtcctgcaaaagttttcatttcatctgaaagagaaattaataagaaaacattatttaagaaataaaacatttgaaaatttcacattttcactataaacatttacctagctagaatgttgctacttaaccatgctaaccaatgttcactttgctaagtatct

SEQ ID NO: 21551 - DNA, 600 bp, Bovine  MMBT08389
tagacatagcatttacattttagaagaaagactgacaggtacacaattagtgtactcattaaaaaattatgtgttctgatttaagaaagaaacaaaatcttctctctattctccttccaaaaagtctctctgactctgcttagaatgtcygtaatagttattcttctaggcttaaggccagttataatcctaayagttatctggaaaaaactaacaaaccacattcactcactaatatttcagaaagaatagtttattaaatcatcagtattgattacttaataaaagcctagggaagtmagacagagaacctggcaattttgttggacctggtggctaaaattgaggactccagaaagaaacaagacaccagaaaattcatggaactctctatttaagcactgtgcattttactatatatgttataccttggtttacaaatattaaaaaaatttgggacaatagtatctacctcatggggttgttgcttggattaagtgagctggcatatttagtgctcaatgaagttagcaatcatgattgtcatcactgttactgttactttaaagaggaagatgaaaagtatgagacaaaagagag

SEQ ID NO: 21552 - DNA, 600 bp, Bovine  MMBT03107
tcccctggagaagggaatgtcaacccactctagcattcttgcctggagaattccatggacaggagcctggcgggctacaaagagtcagacacgactgagcgactaacactttcacacttgaccrtgtttgctcatctctgattttcttgcaatcaacaagaaaattaactgcaactaaagtgttattaattaatactttagattacttttaaaagaacttcatccaactcgccaggcccctacaatagaacagcacaaagactgctgtcaccacctcacgaccctgtgggagctgaaacratcactgagggcaaggagatgaaacatttatgaataagactatttgcagttaccgagctgctgagattaagtgaccagagcagttgttcttttaaggcatacaccgactctgtttaggaaaccgatttcgccttcctgcttcccccgtgcgtcctgggttcgttcaattcaaagccgcggaggcaacagcgatgcagcttccctgcacggtagctgtgatgggtgcttttctggatcattcttgtggaagggtgagaggccttgggattgcttagcttgaaggcaagaaagcagagatga

SEQ ID NO: 21553 - DNA, 600 bp, Bovine  MMBT05227
gtcaagaacgttttcctcatcaccgggagaaaatgccttgctgaagggcaggaggaaaacagcaagatgagtaggctgtgtgacgcgctgccagcaaaacatcccaagtgatgacagctgacgtgctcacagtattttaggatctctccaccactcgcacatttgttccttagatacactgacgaaggcccacagtacagatgattgactctcttcccattgaggctttgctactgaggcataacagtatcaaagtcatggtcctgggaaacacaagctattggtgcaatgaacactacmctgtgtatattaataaaattcttcagtgcctttcccacaggattcgggaaccttcttctttgcctcttggtagcacagcttcctctgcagtgtctctctcctagacattgcctcgatgccaccaacagtgtttgcccagccaggcctctgctgttagggccttgatctgttaaatatgataaacttactctcaataacatggctgttcatagtgtcatgagtggcgctgttgaaatgacagctaaattgaagcttcattttcaaggcctcaactaggaatgcaacaatacaaacgatgaa

SEQ ID NO: 21554 - DNA, 600 bp, Bovine  MMBT04504
tcaaatgcaggatagaaaaattaagttatttgaaaaacttcacacacaaaatctctagcaattgttttccaatgtgattttgccactttatatgtcttaatgatgttctaaacctgtgcctctgtggatagagacagacccagatacagatacagtataattaggtatggcatccrcatctgtgtcgttgcctgcacctctatctatgtatctttgtgtatatgtatgtgtttggtttctgcaaaaataaacattctggaattcagacaaatgcatcaagttcatagcatgttgaaatgratagagggctctctataaataatgaaatatataattaaatagcgtttcctctacttctaacaggcaagattctttcttatctgtctttacagtaaagggagccatataactagaaaaatacaatgtcctttttccctaaaaacaatctaaaacatctaaaaacaaatgatctaatatcagcatctaatcccttaaacaaattagtacaacatacatcatgttaactgttgatgtatatgttagggatcacccaaagaagaaagtgataaacacgtatagaaacggaaagggcttgctagt

SEQ ID NO: 21555 - DNA, 600 bp, Bovine  MMBT06605
ttctgacttatagttggacttaccaactggtgaaaacagctctgctcttcctctctgataaggaaaaaaacaagaaaaaagaaaaatgactgatttaccactctccttgctgtgayggacgcccaagaactcatcaaaggcatgcagtattgtgctctgagcagcgcttcctccagagtaactcaggggctctttggagacaccttcgtataccaagcccgcaggcagtgctgggttatccttccatctaggtaagaacaaaagtcagatggaagtgcatactaggatttaagagtgtcktttctgatcaggatacagatcaagcaagaaagggaacaccctttcctatcttcttttctctcctcttctttcaccctgattccacgtcttcatcttttttgtctgagtctccctttttctgagtcccccaaccattttactcatttcatttactcatttactcattttactcatttctgatattttagggggtcttgaacattcttggcgtgtatgtgagtaactccacaatgagacagaatcagcaaccccaagaatatgctgtgtgtgtgtgtgtgtgtgtgtgtgttagtcactcag

SEQ ID NO: 21556 - DNA, 600 bp, Bovine  MMBT00615
ctgggtctcttcctggactggcctgatccaggacttgttgatttgtaaacatttagaggaacgccccccggtttttcaccttcggtgctttgtgtttgtcaacctaatgactgaaacagctcagaattctcagctgtggggctctcggggctcccagaaggctgcctgcttccaggcctgctctgtggaagtgtcatgcgagctgtgttctgtgtgaccacgtgcgtgctccctgggatgtgggtgtctgtacgcaggtcccgtggtgtctgtctcagggtcctgtgtctgtgtccccartgtaatcaatgcagccctcttcctacccagtcctgagggataatggcatggaggaaaacctgcctcccagggaggagggtccctagaaacccatgttcccaggaacatggaatgtcactggagcctacaatcctccagcacttgcaagtgcccagctcacaagatcaaagtgggaggtgccaggttcctctggagcactgggagaggagacagtgcccagctcccgaggccactggtgggcatccttcggcactgaccaacagggtctcccaggagaaggggtgtttgaaaactgaactt

SEQ ID NO: 21557 - DNA, 598 bp, Bovine  MMBT04846
  misc_feature (1)..(14): n is any nucleotide
nnnnnnnnnnnnnnatagctcaacttcattttaagatgttttgccttctatggcaatcaaaatcaaacttttgtaagtagacgtgtgtgtgtgggttacgcaactcctgtcagcagtgcctgcggtctttgcttgaccttggatgaacagctaagccttggaggtgggtgtgtgcatcaaagctgcctacaagcacacgggtatcccaggttgctcaagctccaggatgagaagagggtcaaggacagtcacctctgggctctgtataggctttgtgaaaggtcacatcgtctgcctaaytggaatcaactttctttcatgcctgtttttatctccacggggagaaatgccaagtgagctgggaattaagaagtcagggagccagctgtgtaaccttgttaaagtcacgttagacgttgggtctcactttgcttatttctaaaacgggaccagatatgtttgaaggcaacttccagctcacattcaggttcttgtttttttcctgggaagatcccaggaagtgttcagagttcaggtagtcacttccccctagtcagatgtcatccagccagcctcctgcatgtcaytgctttgttcc

SEQ ID NO: 21558 - DNA, 600 bp, Bovine  MMBT06667
ctaaaacctctcatttattagggcaaatgcagagaatgttagataccaaaggtattttgaaatacaccctttaggacttcctgcttgacgcattttctatcatagttccatgtgcctgttggagaattatggaacttgtgaggactgtgccatgcgctttcggaactgaaacagagtgactgatatttgaacaataaataaaaatcatccaaggtgtatgctatccaaaaaaattaccataaactaaagatgatcatttttatcaactctatgtttcataaacatataaattaggcaaayacattaacaagtttcctcatgtaaaacagctgaacagactgtaaatttaaccaaagaagagatgggtgagggaggcaaggccaacccctctgttacctttaagcaaaggtggccccaaaggctcaggaaccttcaatagaatgttaaaaaaatgcacaagggacttccctgtcggtaccgtggttaagattctgaacttccctgcagggagcctgggttctgggttcaatccctggtcgggaaaccaagatcccacatgccactcagtgtaggcaaaaaaaaaaagcccaagaagacact

SEQ ID NO: 21559 - DNA, 600 bp, Bovine  MMBT02276
gtctctgagttctatgaaagatgttaagtttcaagatgtggtgtatgatttatgatgattgttttcttctcagtttaactagattctctagagaactgaaaaggaattttcatcaaatcaccctcaggcctctgaaacaccagcaggagaattgtgagtcccctataaccggcaaggccacttcctctcaagtgaagacattttaaaactggtcctggcaaagtaaatatttctaaatgtccttgaatgttgtcatgtcaacttcagtcatgcatctaaaaaataaattcatgacacagrgggcttaggtaagtggatcacaataaaatgatcactatcatggtttttaacatgattattatctctaaccatgatactgatcatttgaaaacctattcaaacccacaaagattcttctttaatactttttgtgtttgttagctctcaaaagcctctcctttgtcttagaaataccttgagctcaatcaagtgcaaatcaagctgctaataatgaatttagtcacaatttattgagagttcactgaaggtgcaataatactaggtgctgcagcaagaaattttaaaagaagtcacactgtc

SEQ ID NO: 21560 - DNA, 600 bp, Bovine  MMBT02771
aaactgaattattaatctagtaataggtcatcagttctctttgctgcccagagttttctatcactgatcatttatcactatccctacttttaacaaacaaacatttttctcttgcatgagaaaaatgagctctaaataatatatctgttcaaatgtgaatatgcaactgactgctaaatcacagattattttatggtatttaattcctcaattgtcattcatgccaaggagtgactcaattttccaaccattttatctattcaaacctgttaaagttttctttatatagtatgttatgayttcatttgcatgtgacatcaatgtttgattcatttattaaattctgtctctattcctctctcattagcttgagataaagtaatgcaatactgttatttaccatattcttctttgtgatgtcaaatcacactttcaatttattaaataactttggaagtaaaagtctaggtctatgaaaatgtctttcaattacaaattaacccaggatattatctgagttctgtcagaaacagaaatgactcttggtattgcaaatagaggaaatttratactggtaactggatatatgcgtgatggaag

SEQ ID NO: 21561 - DNA, 605 bp, Bovine  MMBT09679
  misc_feature (1)..(5): n is any nucleotide
nnnnntagggaagcctggcatcctgcagtccatggagtcgcaaacagttggacacsagtgagygmctgaactgaacsaaagaagaaaaagtaacaaatctcagcaaattatctttctagtcccctctacaagccttgtggtgaacaaggtcagcctggaaataaaataaactatatgaaagagagcagagaaggagatagcagcaagcctaggratgatctaaaactcctgtcaaaatgagaaagttcaccctaagaatgcaaacacaggaaaaatgttctggtaggtcagagtactgactacaygcaattcaaagcracagtcttctgaaatattgcatctgggtgagaagaaggtagaagttaaggaagaatcttkggagattggctgataaaaagaacaaccacagcaaggcgggaatggggccctataagacaaaagaacacaaaaatgtctaaggacattcatctccttcctaataataatatctgttagataaattgcattttctatactagtagaaaagataccatttcaataggaatctgatcacttccaccagtcataaaatagataagagacttccctggtggtccaatggttaa

SEQ ID NO: 21562 - DNA, 412 bp, Bovine  MMBT11662
agtgaaaagatgattatcttaaaaagaaggaaatgttagctgttctgtctcaagtgcttgctgtagacttaaagtcaaacacagtacttacacaatctgttctttgatggctggaacttgaccctcatccctgtcagcagtaatgaaatttaacaaacattgtttaataattccttgctaggaactacagcagcactagacctaaaaatgagtaaatcattatcacttgccctctggatgctcatagtctaatccaggaggcagctacaaaaactatagtatattgtaaacatttcaccyagctatgtaaacaaaagggtttgagaacttgcttcctgtgggagaggaagaaagaagtttgtgaaatctgcacaaaggagttaataacactgtcatcagagccggaaaagaa

SEQ ID NO: 21563 - DNA, 570 bp, Bovine  MMBT02192
tttagatttccagcagtaaacagtcctccaggatcaaccacattaataattagtgagaaactgaaagggtagccacaggaaaaacagctaagattttatagtaactgacaggctttcacagaaatagaatttgtttcgctttaactgaccagtgaaaacaattgattcatttagttaaaatgtcagtcaaaccagttattttaacagttggcagtggttaagaatgaaattagtcaaatccgttgaaaagacaggcaggaatttagataagtctgttaatccccatcaataataaaaaaytgaagggaattccttagtgtgatagagcaaacagagctatgggtgtgggctctcaccttgaaacactgacgtttcaattgggaaactgaccgacaaatacaaagaagatgctaaaaacacttcaaagcaacataatgactatgagaaaagagtaggctggttacaggattaaaaggtttttatctcagcagaaatgtttatggatttgaagaatgaaagtatgaaatgtatcctaatgaaagagaatgttcacattcatagtctgttcta

SEQ ID NO: 21564 - DNA, 598 bp, Bovine  MMBT06908
  misc_feature (1)..(5): n is any nucleotide
nnnnnacacttaaggtacttggaacggcttcagacacgtggtgagtttcatcagtggcacctgtgacctacgggcatcagcatggctggagtgtctcatgaaggtactggctgtactcagtgggctggaggagggccaggggccgggaagggatgaggttttaggaagaaaggactaaacrcacacaaagaacacactcggctcagggagtcagcggtccccaccaaccccagcaactcaccggaactcaggaagccgaagatgcccgtgcgatagctggccgtgaccacaatgaggttrccracagcagccaggaaggagccatccactgccggccggtccccactgcccttgccctccgcggcattgtggaagaacaccagcacggacgcgttgggggsctgcagggggtgcagamatgtgggggctacaggcggccacctccccctccagagcttgggcagggcacctttgccatgtaggtgccagaccgagccaacacacaactctgggtgtgtcaacacacctaccccaaggccaggcaggggcaacagagcagcccaagagagaagtggcaaagctacttttgactggaaac

SEQ ID NO: 21565 - DNA, 600 bp, Bovine  MMBT13815
atgtattatttttatgaatttttaaaagaacatkaaaggaaaaataaaaaaaacatmtgctaagacaacagtgtggggagaagttcgaatggccacygtctgatactctaccgtctctgagacaggttcttggcatagatctgactgacaaaatcttgggcttgaaawtttaggggtgatgcttckccctccctacaggccttgaggtgctgggaggagaacagctcgctcagatgctgcagcacttgggggtgcggcatgtccttcgctgtgcagaagtttaagagtgcataaaacatsccctccagccacttgatgttgaggcttattccccctaaacatcagtgagaaaggaaacaccagtgagyaccacctaaaaaggtctacagggaaccgaggacaaaccccagacagtgaacggctaccttctgtccaagacagtttggttatgtaaacttctttaccagaccaagagccctgggtgtgccctttataacacgtcatgtgttaaccctacctacagataggttaatgtagacattgctaatgacaaatgcatcttgggaaatctctggaatggttcttgcaataaggcgcact

SEQ ID NO: 21566 - DNA, 600 bp, Bovine  MMBT04583
tgaatgctaaaggcaccaggccattcggcggctcttttattggaaggtgcagatcgctcctggggacagccccgtgaaatagcacacacctgtgcacacgagacagacccaggcagggcaggtgaccgagggcaggttcacactcgaattttaggcctcgccaggggacagcacaggaaacagagcactcgcaccataaaactgcagagcaatttccttatcaccatctccacgactcagaattttttttttttttacaaaagtcgtttaccaaggggcaaagttctcagcccacggaaytcccggggctrggctcccccgctgctggcagagtccttccatgtcccgcagagctttctgggggctgggagggggcccctgggtgaggcggcagacgatgccaccgcaccataaatgaggggctgaaatgaagctggtcaagaggtctggtctgggaacttgcttcaactgcccaggttcagggactattttgagaatttcatttagccagagtcaaacaaggcaattggtaacttgcctaatttaagtcacctgtccccaagccggggtcccattcagttcctcctgcattgttggctg

SEQ ID NO: 21567 - DNA, 600 bp, Bovine  MMBT09202
acagagatgaagaaaaatgtcttttttctaggttttgttaaaacatagttaggtaaggttaaagtcttcctaattagccatcccacagctgtgtcttctcatttgcaaacaaatgacactcagctaagaggaggaattctcctcttgtgaattctcagaaattatttagaaattacttagaatctaatttttatacccagggatcctagtaagaagtcagtctcattactgcttatcagaaattacttttcttctcaagtccttttttaccctgaaagagcaattttgataagaagtgamgatctgagtcaaagagaggggaaaatcattgcaaggagtgatcaatgaagttcagttagccaggcttatttagagttgctgagaaatcttcttgccagtgtccaaatcttgcaaaataataagtaccctactcaaaatgtgctttgaaagcattggagaaaaatcatatacctgttatgattaaagctacatcatgatagcatatgcttgaggacagaatataagcaggagtaaagacaactgaaaacaggtgatttgttagtgttacatgattttgggctttgtttctctgagtcctgc

SEQ ID NO: 21568 - DNA, 598 bp, Bovine  MMBT11466
  misc_feature (1)..(104): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttgtaaacttagcctttagagaggagataatcagaatcctgtgacacagtcacactgttacacagttgacatgaattgctttgcattaaagtttttgaatttatttttgagttagatcagatttgacatctggtattaaaagctactgtcatatatgtggtccttcagttaatttaaaaagttggtatgtcasttatatgaaatgcatattctcaaaggacaaagggttttagggagtacaaagctaccttgaaatatgatgtctgctttttgatcagtttttccatttttagtaattcagatcacttcctcactcttacagtgctgtgcacattaacagtgagtgggcgggtagttgaccagctgcgtagtctccgcttttctccaccccaagattatgtattggtctttagtcctctattgtcttggtccattaggatcatttctgtgtcataaaataaagctaaccttcaattcacctcctcctggct

SEQ ID NO: 21569 - DNA, 598 bp, Bovine  MMBT03518
  misc_feature (1)..(4): n is any nucleotide
nnnnagagcttgctctcttttaatcatgtaagagcacagtgaaagggtggttttctacaggccaggaagggacctctcaccagggaattgaataagccaaagccttgatgctggacttttcgccttcggaacttggagaaataaattcctattgcttaagccagtcagtctatggcattttgtcatggcagcccaaactgattaacagagtcaggtgaagaaaatttctaataggtattttagtttggatgtctgaaaatctgattatatgcttaaaaattagaatttgcggcttgaaawtaaaagttttataaactatatctcagtaataggtcttcatccatcataaactccatgttctatgaagtttctttagtgttagaatccactggaggagctcttaaattatgttaacatctttcttaagatgaacatgagggcttgagatacctccaagtaagctgaccaacatcagggagctctgtctttacaattctttttgctctgaayttcttttgataacattgtaccaaaaaaatctttatcaatattttccatctatatgaaaaatgcagctcatagtatgagggctcagaaa

SEQ ID NO: 21570 - DNA, 600 bp, Bovine  MMBT05203
ggcatgcatagtaagtgcttggtaaatgttggccaaggtcccttggccagagttctgttggtgaataagatgaataacagtatcaagagaattttcttattttatattttgctctcctacttctgaggacaaaaatctttcaaagttaaatattttggtctatgaatacatacaaaatttatttattttttccttttggtcaatgaataaggaaacacagaaaaaatcaatctatatcctctttcaaattcccatgatgttatcagggtcagaaatgtcatatttcaacaggatagctcrgatgggacacaacagtttgaataaaaacttccactaggaaaactgccctctgacttctggttcctacagcacaagcaggataagtcaggtggtgactgcctcctaacaaatataaatgacacaattgtttacttggtgcaattttaattcagccttaaagctctctacagccaattttggtactgatctcctctaatggaagattaagtgccttgaggcaaagaaaaataattgttttgacattatgagatcaataagtcctggaaaccattaaactgtatagtgaaaggccctgagcgt

SEQ ID NO: 21571 - DNA, 600 bp, Bovine  MMBT05577
tggaaaataatcttgtttcagttttattatacattaatataaaaagtctcattttatgagacatctaaaagaatcaaagccacttctacagctatatcttaaactccaaatctgaaaacaatttattatattttgactttataatattctatattaaaacagagaaaattccaaatacacactttttacaagattaacatcttaggcagggttttccttaaaaaaccgagaaccaaaaaagcccacaaccaaatacaaaccttttttctccattttctagcactggctattgtatttgtwttccttataaaattttttttactttaaaaattgtgtaactgttggattttaaccagtaatctggttcaaaaattgtgcaaataaacaaaaaaatatgaaaatagtgtgttatcagtcttttgaaaataaatcccataacaatggcactttttgccctgaattgatgggaaaagacatgccaaatccatttgctgaaatttagcatcttgcagtaatgtttctttcctgctccttcattttctttcaacagacaaacaacaaaggtttcttttataaattatgataaattaaaatatttat

SEQ ID NO: 21572 - DNA, 600 bp, Bovine  MMBT05489; identical to SEQ ID NO: 4669

SEQ ID NO: 21573 - DNA, 600 bp, Bovine  MMBT08677
cctccttgaaagtgtctagctggtccaaggtagcctgatcccagtgagtacatcaggaggccaataaaatgctaaagagtttttagcagcgttcctcgataattaagaagagattgtgtacacatttcattttccttttactctttgacatgcacagaatttagaacagtaactatttcagctatttcactaccagcctgagatacgcagggctattaaatctcagagcatctcagaagcatgggtggctggttcaaatcagatgtgaagcctgatctacatctcaacttcttgaatcayatgatgcaacaaattcaagccatttgaattagatttttgctggcaaaataactgataggaacttgtaagataaaatatggtggtagagatggaaagaatcaggggaaaacaacttattcaagggtatcagcaagtgcaaaaagtcactgatgatgatattcagttatcacgaaagatggtattatcaatgcaatattcaaagaggccagtgagttttgagagagcggtagaggacaaagtcacatggcctagcaaggactagatttgttgttcagtcactcagtcgtgtctgactctttg

SEQ ID NO: 21574 - DNA, 600 bp, Bovine  MMBT07281
ctatatagtttgagagtttcttcctcagaaagaacgacttaagtaaaaataagacacagaggccctctcttttcattgaaagaaatcattagcaatctttacactccttgctgtgagaaaaaagtatgctttatgctagtaatatttgctgttttttctacatatgtaaataaatctcatacgtatatattttaaacagtgatctggtttcaagtgtcattacttagaaaaaaagaaagtcattccaygtggtgtctttggcagttacatgcactaggttatttagagacgatttccttygttgatgctgagtgttgccatttattaaattgtgttcgtaatagaacatgtccaatttgcggcttctacagctcaagagtgtttggggttttgaggaattgcaagtttgtaagatggcatgtggcctcaccattttgtttatttgtttgaattatttgatgttagatgagctagagtctcataaagtgataccgtactatacttatgagctgaatcatgcaataatatcttttaaatgattcttcttttagaaagtggaaagtctaaaagaagtaccgtggattcaaaggtaagaactaa

SEQ ID NO: 21575 - DNA, 598 bp, Bovine  MMBT03102
  misc_feature (1)..(8): n is any nucleotide
nnnnnnnncaggcctatttacagagtctttctgaggtcttcactttcctaaaaccttagccactccttaaggccaagtcaggtatctcctcctctaatgtagcttttttcatgtggatcacttcttagagccttataggtcctagaattggtcattaatgaatttctatttcattctcttttgtttcctttatgtaatttagtttaaccatcttaagcagactgtgagctccataatggcaagttctggaatcattcctgaacatcccaggttttcaaattctatgtagtcaatataatrgcaaaaataatgaagataatagcaataattgtaatttaatgacagactatgatttcccaggcaccctgctgaactctttacaaacactatctcatttaacaacctgtgaggtagatattactaggttcagtttacagatgaggaaaccaagcttcagggattaagtagcttgctggagtccagttgtaaatcagcagctgcaattttcaccctagcatgtgtgattccaaagccctttgcartattgatcaagtgctcccctcccctaccaagtctgctacctctatcttatagtcat

SEQ ID NO: 21576 - DNA, 600 bp, Bovine  MMBT03808
gctctttaagtagataagatctcccagctctgcatgaaattgtcctgacctcagtcctttagcagaaagattctaattctaatgaaatacagtggaatgagaaattaacaaacaaagcaacaaatccattatcagccgtttcctcagcctgctctttaaactggagctctcagacattcaatcaggtttgtagttacacattaaaactgccaagtacaggtggacagcttctgcttctgaaatattataagattacaatgatgttgaaaagatcagtttaagtttgaatgttaagtaaaraatgacatacctargaatcattgcatagtttaccagtaagtctggatttctgaagatagtggtttggtgtcttgatttcagatataaaaattacactgcacattttattgtactatwcaaattcaatttctrtatctagaaaatgcatagaactaagtttgcctagggtcacttgcaatgcaggagacacaggagacatgggtttatccctgggtaacraaaatcccctggagaaggaaatggcaacccagtattctgcctgggaaatcccatgggcagagaggcttggcaggctatagt

SEQ ID NO: 21577 - DNA, 600 bp, Bovine  MMBT07560
aagtcttcaatgtgtttcttctcggaaatgtatcttctcttaagagaaagaaacaaaaagagcaagaaagccattagctatgagtgaatttaatgttgcaaatatataaacttaaaattaataaagttcctagaatctgactcttattcttcacaacttaagagcttataaagtctgggatgtataatgggtcagttagcctcaagggtctcagggcaaaagttggttttccccaactctatggtttcaagtaatatttgtaaagtggacttagaaatactgagactgttaggttcccargtcaaatcctgccttcataatctcctgtgcataacagtttatgagaccctagtctcagaaaacacttagaaataaaaagaattaccttggtcttgaaaacattctagaaatgaaggcatatgtaaaacaattatcctccagttaaaaataaattttaaaagaagaagaaaaaagaaagaaatgaaggcacagtatktttaattaggggaaagaagaaaaatattgtgatttttcttctcataaagatgtccctgaagttcatttttggaagatcatgtatgattctaacatctgaaacaa

SEQ ID NO: 21578 - DNA, 601 bp, Bovine  MMBT07600
  misc_feature (1)..(1): n is any nucleotide
ncaaggtggtgcgtggtttgtgactgcagtggtgaacggaagtgagttcaatgaaagagaattaaaaagcaaggataattcctgatttgaggctaaagaggctaagacattgattggtggctccatttgcggaaacagagaagattaaaggatgaacaagttctgaatttcgaaggcagacaatcaagagccagtgcttcacatgctaagtttgattataacatacatagattttttttttttttaaggagtaaagtaactcttgtcaatcatattctgaattctacttgctttccagggstggaataatctttcctctgtgatccttgcatcagatcctttaaaaattccatagattctgcccatttagcaaatggggcctcactgagtggactgcatatatttcagaatctgtttgcgagaagttttttctctggttaagacctcccgagttttatgaaaacatctatttatccttagtcacaaggagattttcagcctgttgcaacttttattggcactgccaaaaggaaaaaaatatggaagcatttcaatagtcctttaactggacccaccaaggtccccagagcaggcgatttgt

SEQ ID NO: 21579 - DNA, 600 bp, Bovine  MMBT07626
ggaaactaggtttctgcaattgaacattatatctacatgtgaacttcctggtagccaagctttaccatattttcaaggtttgctgcactaagcatatttgctatgatatatactatgatacatacttaatgtatatattatagtaaaagtatgtacattaagatgctttacattgtttactgagatgtaggtaaatctcaaaagcagtggctatgaactgaagagaggaatcaggtgtactggtagcttttttcaaacttcagtgcttccccagattcaagtaaacagcagcaacacacycagggcttagaaactgaataccatggcttcctagttggcrtgtgatcactagaatctcaatattgtctattatgacccttacctccctggcatttgttcttcttagaagaaaagagagatcagattaaaatgggagccagcatatattgcattttcttttacaaggtttttacatttctaaactggactgtctgcaagaggaccattcaatgaattttcttagtcaagaaatggcccacgttaacctttgttgtggtggctgttcagtcaataagttgtgtccagctccccctccccccc

SEQ ID NO: 21580 - DNA, 600 bp, Bovine  MMBT09958
tcctgggtcttctctcacctccctggttactcctcagcctctctagtgctgttttccttctgttgtagcttaaaggctgattttctctggggtcccctgttcatcttcttattccccatgctcccttgaggtcattttattgacttgtggtttgaattatcacctgcagtccaaattgctttcccaaggctcagagcactgtggccactgcctctggaaagcctctacatatttggattttgctgccccaactctagcaacttgattcttttctgtgtttcacttttcagtgaatgtcascacgatcttagttgtccaggacagtcatccttgactatccctattgttttatttcccatgtgaaattgatcactaaatcctaattctatatcccaaattgctttattttttttaaagtgtttaagttataatttactcaaatttatttaccttctgtctttgctgattcttctacctccctgtgttccccaaatagaagcagcctcagggactccatggctccctttttcctctcctttctactgtctatctgagtcactttcactttttcagcttttcttccttttccatcatggtttg

SEQ ID NO: 21581 - DNA, 600 bp, Bovine  MMBT03338
caacaactaattcaggtgggycctgaaactctaaagttatatattatgtcatatgctaaatctaaaagcattcaacttaccattcaatcaaacctttagttgatatacaggccawatccccagaaaaaaaaaagtgagtaagccaaaattaatcacaataaaaggaacaagtatttttctttatgctgtataacacagatactttgaaaaacatttttttagacatagagaaaccacattgataatttctaaaataaaaattttacctataaarataaaagtacgcattttggcccatayattttctaaatgcttattccctggtaaaacaggaatctgcattgcatctaaaaatatattatccygagggatgacactttgtgagacggtatgacttagtaaacttatttttaactaaatgatgattcattttcactatgcaggtttcaggtaactacaatacatgyayacatagtcccattcttgggtatctgactttcagtagatctcaagacattgcatctattataataataagtgctagtattatattggatagtatgagcagggcagaacctatgtttgaattagcatactgaa

SEQ ID NO: 21582 - DNA, 600 bp, Bovine  MMBT09612
agtaagagctactgtcagtgacagcaatggtgtgatacaaacaacacgtgcatttggtctttggagcatatcatttgacccacacacctgtctcaggaacaagggtgacttcgtggaggtaaatgtagatacctacaaggggcaggtggaataaaggaggaagctgattagtgacaggaagacagtggagactggagaaccaccaggaaggcctcagctactgttattgctatcctacttccagcagagttttcagaggcctttacagacctgagcatttaatcctcagaacaacctacwgaggctgctaccactgtgattcatttgcctctggggtctatatyctggaggcccagtacttcccagaagttatgaatttttaaaaatgaaattctcaatgttgacaacaaattcctttcattaaacacttcagactcctacactgagctgccaaacaggacaagcaggacatatctgtgggacaaatttagtccatgagctgacaatgtgattcctctggtctatttattcctttcattccactgataagaaagtttatgccaagagagctctgcccatatccacattcctcttctccta

SEQ ID NO: 21583 - DNA, 600 bp, Bovine  MMBT09763
cggcagattgcagtcgcaggctgatgctcctggcagtcacaaacaccctgggtccatagaggccaaattatggcccctcacctgtctccatatttattgatgaggtgagatgggtgcagagcggggaggaaggacctgcagcgttaccactccgcccagggaaatctggaccctaattctgtgattcattcaacaagaaatgtttattgagcacccactgccagtgtgccaggaaccaaccacgggactcctggtccagtgctcttcatgatgccagttgcctctctgctgtgtgtgcakttcaggctgagacccaactcaggagagctggaatcttctccaggagactgtccccactgggtggggaggacactgggaggagggcaggccttcagcagctgcartaccaccatcctgtggtccagagacccagagagraggcaggaggggtctggggagcagtgctcacaggtgggacaggatggggcctggtcagctctgtccattttccatgtttaataaatagttcttgttggacccaggcttcccaagctcttgaggggtgcaggggggcgtcttctcatggtaattcaggttctg

SEQ ID NO: 21584 - DNA, 600 bp, Bovine  MMBT08486
agggtttggacacttacctaaggtatactcacatttttttccctccagggtccatttatttattcatcaaacagatattagttgagggcctactatgtgtcaggcactatggccctcatggtgagcatggcaattaacggtcacacctgaatcaggtgtgaaatgcccgctgtgataagcatggacagtgtacattgtggagacagggcatgtacagtagagcccattacacagtatctgaattgtcacagtgatcagaggaggcttccctggtggactgaggtctaaaagatgaggtcrtggtggtggaggtagtggggstggtcaggagagaatrttgagaatgttccagacgaaatgagataagtctgcctggctctgtggaaggagagagcrtgcagctttcaagataggtaagcaccagtgcgcgaggcaacctggctcttggagagrtcccctcctggatgtactggggccaggaattccctgttcagacctcgtcttggctccattccacagacaacctccctttgcagaaacaaagygtgctgcagggctatcattttagcccmagccagaaagtcagaggaagctgtgtgg

SEQ ID NO: 21585 - DNA, 582 bp, Bovine  MMBT03138
cagtcttcccaagtataatattttctcagattcctgaatagctactgatgatgtgtaataaaacaactgctaatacatctgggtttgagtgagatatcaggaaaacaaaactatcaaggtgacctacaaaaactcacttcccatctgtctccattcctcttcctctaaaacaatatgtagggcaccttggtatggcctcaaaaaagatagggaagagggatgaatgacttttttaaagagtcattcactttaacttcccatactgtataatcctatgttgggggcttttgtgcaattatmatttttacagctagtaatatacacattgtacaaaacttaaaagattttaaaagatctacagaagaagtctccctcccattcatttcacttaatcctccagtgtcttatcccgggatgggggcaatggggcaggcatggatggtgctaagcagtgttttaggtcctggggacagagaagcaaacctaacaaagtccctggcctcaatgagcttacattctagtgtggagagacacaaaatagggtcctgggaagtcctatgagaaaaataaaatagcctgagg

SEQ ID NO: 21586 - DNA, 600 bp, Bovine  MMBT04473
atcagccagggttggcttggcagctagtgaaaatgaaggtggaggtgggaggaggagcgtgatgtgggaagagagatgcaaagacttggagtgaatcactgtctttatcaactaccacatgtatcaaagggaaagtctcgtgtacagagcagattacatttgctgctaacttcaggcagggcttctgacaagccgaggaaaggattactcttttttatggaaattcaatctagtttgatgctggaagttatggattcatctaaaatagcaagtgacaggcacagcaacacatcagacacygctcaggcaaacagtggagtctagagcccacccatttctgcaggagcccttgatggtcagtgctcttgctgttgccatggaagtggtggggaatcattaataattttacagatacttcagggtaggggccaggaaacagcctcttcaaactgtgtgttgtagactcttcatggttaattcagaccagcatacacagcaatagattcrcaggatctttgcacagagcctggggaatggaagggttttctcacacctatggccttgggaatgcagttctccattcttttgcaagtctgggga

SEQ ID NO: 21587 - DNA, 600 bp, Bovine  MMBT05675
gagtgtccatattcagattcatggccaatttctacacattgtatcttacatttttttcccctttgaaatcagttgtattttactctacagccatttgttcagaagctttctgggaaagtgatagagttgaacttgtaggttgaaccacagaagacagaaattggccaggaaggactgaataagcccagggcacagacaggccttggtgtacgcctgtcatgaacagcctgctggggacaaaagaaatgtggtggggagagaggctatgggagaagctggaggaaaatcataaagcagagmtgcttcyacccctykaagggcccaggccactctgagttacagcacttacatcgacatgcagccaaaggttgtatttctcacatatatctgcaatctcctgtatcggatcaaaagctccataaacagtggtgccagcagttgcattgacgtagagagggacgtaaccctataagaaggacaggctgattagtctttctaacctcccctcctttccacacaacgaactgcagtagcattcatttccaacagagatcagctaagctggtgtgtatctgatactatatgtgggactactctccg

SEQ ID NO: 21588 - DNA, 600 bp, Bovine  MMBT00708
gaagaaatgtttgtgattgttatagtcatatcacctgagtgacttttacagtaacttcaatccagggagttacctgaagacccatcacttaaatgtggcttttttaagaagtgggaacttttgtatcatcaggataaaaggaagcacagtgcttaaagaacagactctatccctgactctataagtctatttgtatgctttcaaaaggaaattctcttgggcagataagaagttggcagactgaaaggtaatacataaatttccatgctcaacagtcaggacttgagcaggcttgtctgygatgcggcccataccatccagagctttcccctagcctctcagttcctgtatattactcatggctctgagcaacagatcagggcagtgcttattgttcagggtacaaattcatcatctgaggaggccgttctgaatggaaatctgcccccttctatcctccactctctctcctcctcaagatgcctcacagaatctgaggaggttgggaagcagcagaggcaggagcagttagcactgcattctgtgaccctctgaggcttcttactggacaagggatgctgtgttccctgttctgagtat

SEQ ID NO: 21589 - DNA, 600 bp, Bovine  MMBT04654
gacgctactctagaccttcagagagcaggccctgctggttggtcctactggtgtgcagtgtggtagtcagcacccttcacaaccagtccctttatctttaccacagtgaagactaagaggccatttgttgtccttgtagacatcagtgaagactgaggaagcagcgccgctccttgtctcagaggaatggccagttccgagtctggctcaggaggaggctacagacgtcagtctcatgggtgaggacaggcctctgactggtgtccacctttcccgtcattaaccctgactcagccatcrtgaacccacatttcctacacacacttctttccccttcttctgggctcgatctccacacttctctcagcctgtcattttgtatccctcacaatcacagtaccttctattactagacactcagcctactgattcttgctgttctctgatcatccctctgtattgcctgattccctcaatgtctcctcctttgctcctttttttccccctttgcaagggtcccatataatttgtcattttcacacatcccttaatatctggaaattccacaaacacctctgccttattccttcttcacatcag

SEQ ID NO: 21590 - DNA, 600 bp, Bovine  MMBT09496
tctgaaaactccaagcacactccacactagatacttctgtttctgccagaccttgtccacctcagggcctttgctcttgtgctgtgctctgcctgcaacaatcycctgtcyggctcccacatcactagccatctcattaatcgtgtctcagttcaaatgctcactctctaccttaggagggttcccctgagcaatctgtgctaattcatcacccctcctcaccrcagccattctgttacctttctctattgtacacaataacagacacccctcactttctacaactatcctatttatacygttyttaaaaattaacttataaactaccttctcccattgaagattgaaactctccaaaaccagggatctcttgttcactgctatatcccagatgcctagaaaaataactggactcagagactttatcacacaaatgcacaaatggattgtttctactgctgtttagccccatgaagtggtgggtttctaacacttgagcatatcagagcagactgagtgagtttgtatcagagatggatttctgcattgcatggggagcacttcccagagctcccggatgcaaggaacctgtgatgtgcc

SEQ ID NO: 21591 - DNA, 600 bp, Bovine  MMBT11115
acttttgatatatattacctttataaaccatacttcattatcaaaagaaagaaacaaatgaaaaaataaactcattttcaaaaaagcttccaatatatatccaaggattggtaaagatttagtacaagctcctattttttttctttaatgacacttacagtatagtagagtaagtattcaaggtcagagtaattgctttcagaccataccagaccctcgcacatcagagtcaattatgttcactctactctattgaaagcaggaaattgggagtaatttatttctaacaacaaagggtgrsaaagttgaaagcatccagaggaaagcaatcaggatggtatatgatttaaaaaccatgtcacagaagaaatgatgaaaagaactgcagtgttctatcccagasaagtcgtatagcagcgtaatagytatctcaatatatttgaaaggctatccctcacragcttcccacagagtgggaaagggtataasaggctgtggtagatttattctaaagttctttgaggcagaataaagaaaaatgtttatcagtcaaggagggcaaatttagatcaacacaaaaaacaattttctgtgaattaa

SEQ ID NO: 21592 - DNA, 600 bp, Bovine  MMBT09151
aaaaagaaataagtattctactccattacttgtttattagaagaaagcctccctctatgccccagaaatgatgtgtttatagccttttgacatagggtggtccattaatatccatcaatgggtgggttacagaaaacattagaatcaaagtagaggaaaagcaccattctccaagtctaaccttcatggctagatgaggcacacccaaatataagtgcaattaaaataacattctaaaaaataaacatatatttattagggtatattagaaaatcttctaacaagaagcagaatctgaaytcatacattttatgtgggggagtaaaacaaaacaaagccctatttaaccctctatcagttagataaaatccatcatttatattttttaaaatctctgacaatgaaaactaaatggcatattactctgtaccattaaaataattatgaactaaaatataaaatgagtactgacaggtgacatcccagtataccttcataggattttcaaagtttgtgttcaagctctaaaacgtaacacttctaaacaaagtgtctttggacatgcccccatggcacactacctttccttgtgaaccagag

SEQ ID NO: 21593 - DNA, 600 bp, Bovine  MMBT10290
ggctcacagtccacagtgaagctgttggtatcattgttgtactccacagggcagacaaaacatctgtacccagacatcacataggacagctgaggatgagaacagacagacaaaggagacaagttccagccatcttgcctgggcagtagccacctgcttaggccatgctcctcacagtacctagcaccctaattgcaagctatgcactaactcagaggttcatgtttcaccgtatgtgttattttacctgaattctggaaaaaactgaaaaggagacttacgggctactgaggcctcacmtgtacttgctcaaacaaccaggtcctgaataaatccaggaaagacctaaaggaatctgagcaataactataagaagttttgtcctatttggagaacctatggttcatttttctcaggatctcttcattygaaattacaagtggtgaggggaacagtayagtragagggcgacaaccaagaggaaagaagcagaagaccactaaataggcgagtgagtcctgaaggacagctagacaactctgaaaaggggagagactracttgaaggtcagaagcagggaatggtgcyctaraaaggggt

SEQ ID NO: 21594 - DNA, 600 bp, Bovine  MMBT05677
atccaaagactactgcttaaaataaaaatctgaaaaaaattaagtaaaattccatgacttagaaaatcaggtgccatttgagatcctttaattagagatgtgaccatttggaaatcagttctgttgatagaattcatatagaaatagtaataaaactatttccatgtgcatttttattcctttagaagagtgtgtacttaaaaatagtgctcctctgccctcttggggaatgtattcttagtcatgaaatatagtttaaatgtatcaagaattttaatttatctagacaaaacttttgtkgaggaaaactatctctcatgaaagggaattcaattaagagaacagtcacaggatgaaattccttgagagagatctctctcttaactctaaaccacacctgaaacatgaactgtaacacaataattttcaagttcataaactcctttatatgtctctctcctcctccccaaatattccatatgaagggcttcaaatcccaaatgtgctcagacttaaataagtgagctgctgtcttagagagtttttagttagaaaaaatcagaacagaagagctaatactcgggagagttctctttagca

SEQ ID NO: 21595 - DNA, 600 bp, Bovine  MMBT11666
aacagtcaaaggctttagcgtagttaatgaagcggatgtttttctggaattttcttgctttttctatgatccaacagatgttggcaatttgatctctggttcctgtgccttttctaaatccaggttgtacatctggaagttcttggtcacatactgttgaagcaatataatttggtactttaagtgaaagtgtctatagtcagaagctggattaagaagtgactgaaatttgttggaaagatctatggaggaagttgaagcaatgagtttgaatgtggtcatttaagaatagacaaaggracaaaaaccaaaaaccatagatgaccagccacgttgagggagctactaaatgaaaaaaggaaaaagcagtcaaacaatttgggagaaaaataaggaaagagccatttcactgatgccaaactagtcagaggaaacgcagttttcatatggtttacacttgagaagctcagcatctttgaacactgttgaaaaaccatccaaatacaacattcgttcagacccgtcagttgcacccgccatctagacagatggcagctgattggcccaataaaaaattatggtccaaagggtcctagaacc

SEQ ID NO: 21596 - DNA, 600 bp, Bovine  MMBT03661
atgggattccccaggcaagaatactggagtggggtgccatgtcctcctccaggggatctttctgacccagggattgaacctgggtctcctcccattgccaggagggttctttaccaccagggccacctgggaagcccctctataacccacccatgtcttagaggaagagctgctctgaagaagagtgtctagaacttatcttcagagtccttcctcaagcccacctttctgagttcttcagaatctagtgctgggaaggacccactgatggcgtgggaacatcaccaaatgtgttgtcarggtacctgatataaatcccagattcagcaggtcttgtcttcaaaggactttaatttcctcttctacaaatgggagaggacaatacacatcaccctggattgcttgaaggatgaaatccagttgaagaatatggaagttttcatatttgaagttaggtaattacatggttagctgattggtctttatctgcttattgaaagccacaaatcatagtagatttaaatatggatataaactgatataaatatggatagatatagatttaaatatattctcctcagagagcttaaaacataccca

SEQ ID NO: 21597 - DNA, 600 bp, Bovine  MMBT12854
agatttatagcttgaaaagtgccaaaaaatcaagaatttaaatcctccctgatttatgtctagcttgttagaggctctagggctttagaaatgctaaatgtttgagtgatgctctgaaggttgagctatattcctctttcagctgattattattaacaatggttgcctctaaagctttagtagctctcagctgtaacctttacacttggtacattcctgctttgtgaggggttrtaaattccatgatttaaaaaaaattaggaacatttttgaatttttgtagccaacagttccgagatyggttacctgggagatggagggttaagcatcctttatctctgctcacatatctgagctactttcctgttgaatgctgcaagtgtgtaatgagtgtttactaaagaacaattctttacccaagaagagaccatgataagcacagtcatttgttgtctgtatttgttgttgcttattatggatccaggagcatttggtgttgaaaaccaaacctgcatcccccacatggttactktaaatgatttaaatcaattccttttacacagcatcaggaagtgcaatatgtagtaactaaatatgcca

SEQ ID NO: 21598 - DNA, 600 bp, Bovine  MMBT14242
atcctcacgaagggaaggcaggaggtcaaggaaaagaggaggatccgcggtgcttgctttgaagatggaagacggcgtcttgggcctgtggaaggtggaaatggtaaggaagcgggttgtcactgtactgtggaaggagcacagcactgtggaccaaacatctgccctttggagccataaaacactaacgcgtctttttatgccgccaaatttgtgatcatcggtaacagcagccattggaaatgaacctccacatcatgatactcttatctgtattcagaaaggaggaacctgaagcayagagaggctaagtcacttgcccgagatcacacagcttactagtggggaaagtgcagatctgaaccctggcagtccttctctggaayctgcccttttagccactgtttaccacatgggatacatakgctgtctgtctggggtttgctttgattttgcttacaatttcttaggtagtagatttttccagcctttaaaggctttcakagtttggaaaatttaaaacatatgtgaaagagaatgatgtaatgaactcctcaacacctgtggccaaacttatttcgtctatactccctctccttg

SEQ ID NO: 21599 - DNA, 600 bp, Bovine  MMBT10939
cagcttatccacctagttgccaagtcactttaagttcctcttagtttttcatctcccttgctcccagtctgctcagtcaccaaattcttttacaagataatactttctaaaaaatctccctctctccctatctctgctgtcttagattaggccctgcattcttagtgcctgaataacctcagtggccttcttatctgaccttcccgaacctctgtagtctagaccagtcatgctaaaatagaaatctgatgtcaagcccctgcttataggctttctatggcttcatttgctttcaggatwaagtctaaactcccttccccaacatgcaaggtctttcgtgattcagctcctgccagtctttcacacctcaactcttgacacttgatatcccagccatcctgaactatttatgattccctgaatgggctatgttttctcactcttccgtgactggatatgtactgctagtcctcatacctgggaaaccattttctctgactttgttacttgcttagatgacacctctggaaagactttcctaatgtcccactccctttgccaagtggactgagagctacttgaaggagggaccttgttttc

SEQ ID NO: 21600 - DNA, 600 bp, Bovine  MMBT08076
aaactctacctcacttaaacaataagcttccacttggattgaacctatcattgatgattatatttgctccccatgttttttttctctcattggcctataacaatttaagaatttagttcataactcctctgcagcacataattttcatacaaacaaatgagggtcttaatggattgacttttctatgaaaccaaagttgtttttctatgaaatgtcttttaattttgaattatcattccataaaaagaagtttgactctggtaaaagcattaagcatgagtttaattgaatgggctattygaacatgagcttgaacacatagctatttgggctatttgaacacagctctgcctgcagtggcaatggtgagcagaggtaattttcagacttggcaattaactctaatatttagggacatggaattttaaacctatgcagggacactgaaaaggatgtatctctgtgaaaggactagaaaaaacttccccactgtctcagggagactcaaagggaattgtcaatgcctaggtctttaggttggataaggcaatggcatcccactccagtactcttgtctggaaaatcccatggatggaggag

SEQ ID NO: 21601 - DNA, 598 bp, Bovine  MMBT09825
  misc_feature (1)..(79): n is any nucleotide
nnnnnnnnnnnnnnnnnnnnnnnnnnnnnnnnnnnnnnnnnnnnnnnnnnnnnnnnnnnnnnnnnnnnnnnnnnnnnnnccaaatttttgtagtgaatctcaaaaaggcttcctacataattagtgggagacaatgatggaagtcactcctggcatgggattttaaattcctggtcttgtgtgttttctccaaatggagcagtctcttcacacagctctaataagaggtgttttattcacattatttatatgggtatctttaactttgtattccagatagtraggaaaaatttctacacrggaaaaatatgtttacaagataactatattataaaaagctagtttcattgtgtgtttgatgtcatgtaattaagtcaataacaaatgaaaaacttttttttggtagtcggattgcaaattcactttctcagatcaaactttatgaatcagtttgctcaattttaaagtaaataaatgcacctgggtttctattgcagcaagagagatttactcaacaagctcaacatagatgtatttgtactggatgaaatttacatattaatcaagttctaattgccttttttagccaattgtatgc

SEQ ID NO: 21602 - DNA, 600 bp, Bovine  MMBT05721
gaggaaaagggatgtactttgtttgcaatattgagtctgtttctctatagttttgtttcctgttctcattcttgaccgtcaggactctgagtacaaaaccatacgtatttgtgatataacagtacattacaataaaactatagagagagctcaatattgtaaaatgttaatwtagcgttttctcacaggagaaaccatcccatcaggtgatactgggctgagttcaggaggtcctgtgaagggagaagtcaagcagagccaggaccccgcctggcccaggactacacacaggtaactccractcagtcactgagactcagggcgctcacttagcccttcasagctcacctcacccctgccttaaagagcaacacgtgacccagtgttcaggttgtcctgagccttggacacgattttccattctctgctaagtgtgttgtccagaactaacctgtgtccccagttgaacttggggataagaactccaattgccaatgctgtgcttacatgaaatctgaaataatgaaatccttctttgcaacatgtgctccttagggaaattgttcttattgattcttattttatggaaattgttcttat

SEQ ID NO: 21603 - DNA, 600 bp, Bovine  MMBT08786
gaaaaaaaaaatcaactagccaaaatagactcaaagcatgctaatgttgccactaatatccaagagatatattcttcaccagaaaaaccacttaatggggaagaagggacaatgttagatgtaaaaataacctcagagtgtatactctaccttacacacgtcgacagctctgctctgagatagataaaaagcaggctcagcttcttaaagttcctcccagccctcccaaggcctagagtrctttaaaaagagggtayrtctgataaatagtgtttgaaacaattaccaagtaaaacttargcagtaagaaaatgtggctttgccccagagccagagaataataaaatacacgaaggtatcagtgataaaayggggtattcattcataacagccaatatctctatgctagatgttaccctaagagcatatttaaatttggtacaagcttaggaggcaagtcttattttatccttgtttaagggaaaacamtgaggcatgagggacatgtttggagcaaacactttgctccaaagtktgctccaaactcacaacactaaatagaagtctggcttctagccgaggttgtctggtttcagtacc

SEQ ID NO: 21604 - DNA, 600 bp, Bovine  MMBT01246
catgcagtgactcatcagaaagtctagaatgtggaagctggcctggacagtgtattctttcctccttgttggacagactgggaaatggagatggaaactctgggtggcttgccaaaggtcaacgtagagatagaattagaatcaaggtcctctgagtcccagatggttctcttttcactccatgtgctgcctcctctttggggatttccttaagagcaaataattcaaaagcaaaatggtagagaagagaaacacttgggacatgacccaatgatgagcacaaagcatgattttggggawaagattgacttggaattgaatctctgatctgccatgaagacttctccaagcctccgtttcctcctctgtaaaatgggggcaataaaggctacctttcaaagtcatattacagattagggaaataatatgcagaaagaactcaggggagtacggctggtgatcggcacatacatttcccttgtccctagggctgtgactcaaccctttgcagggagcttggaccagatttgtcttggctgttgccagttaaaggatccctgggtgaggctgtgtgagatgagtgctgtgagttcttacgga

SEQ ID NO: 21605 - DNA, 598 bp, Bovine  MMBT06727
  misc_feature (1)..(220): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacaacatatgccgctttactaaaatgtacatccgatgctaaacgtgtcacaaatagagtgaacagatgcagctctgytttttcagcatgagatcatacctggccaacactggaagttttgtaatccttgtctggggggaaacaacagaactattgatgaacagtgcagttctaaaacattattgaattgcactrtcattaaagtagtagwgagtatgatgtcttcacctgacctgacatccagtatagcactgttacaccattttatatttcagttgtgctttagagagtttcttaactcagtgtgtagattagtttatttcatgaacctgctaaatggcattttgacgtcctggggaaatgattcctccacaag

SEQ ID NO: 21606 - DNA, 600 bp, Bovine  MMBT02847
tccaaatacttttatgcatgttcatttctgcaactgttttctgagcttatctgtttagtaatatcttactaaaagtaaaactcaaaatacagtattactttgactcttttcaactatttcytcctattgagactctactgggtcacaatctcaataggtggataatatgcttttaaattatcatgggtaactgtttaaacacctcttttgccactgcaaaacatgggtgtccttccgttctctgatgccagtatctctaacatctgctacatcaccaaggcaatgtaacatattttaggktactgttttagcagtactccacttccagtaccaatttctgggttagtcatggtcattcaagctytggaacatctgaattctcaaatctcaattttctctcatacaagaagtccaaaaaggagtgtttctaatttggaaatatctatattccaagtagtaatttagccactcatgatctttctctggctctggcatcttcaacatactcactagcttcaagttgatggagaaagagtgaggatgcaaggacttcattaagcctggaaatgagcacatcacttccacttacatttcacaggc

SEQ ID NO: 21607 - DNA, 600 bp, Bovine  MMBT00868
agaaataagaaaaactctctagaatatggaaatttctggaatttcagaaacatggaaaactgtctactatggtggctgaagtctgaatttgttacagatcttccttcagaaaataatattttaattatttgggtctaccctgtagttatgttctcaacattaacaaaaacaatcattaggtttaaactaacattttyagactttkagctgccaccataaaactgtttctaatcacaggccaagctaatcttatatttaaaggaaaaaaatgatcacttctagttagcatattcagtgtcmgaaatgatactataggaaagtaacagttttccaaaaaattaaatatgaccaaaggcatcctttcatggctgaaaaacttccactccccactgcyttccacccacacgtgacttaggaagcagcaggcaagcaagacacttgggaataccatttttggaaagccaagtcaaagccgtggtttcgtccttttctttgcttttcttttgggtcagaatgagtgcaatcattgtcagggtttttcctaaccccatatcatccgctggaaaatgaaaacaaaaataagagaggtaattactttgg

SEQ ID NO: 21608 - DNA, 601 bp, Bovine  MMBT05705
  misc_feature (1)..(1): n is any nucleotide
nttaaatgattagaaattcccagttaattactaggaaggaaaataatttaattatagttcagcttttacgtgggttactggagtgaatgttaagaaggaccctttcaatcacttttccattaaaataaaacaggcacactgagagatgtaattctccttttttttttttaccctttccaaattatatcatttaaattgtgttcaatgtctcagttgcttatacaaacaactgtgagcattgtaattgacttgtgagacaaaagctcaacttatgcatatggtgagaaacactggggatttmtaagtaaatattcaggttaaaatttatagacatcttgatatcctggttatattgccttagctgagagtacttgaggacttataatggactttggtcattctgaaggggtctttaagaaactgcctgctctgtatctaccaggataatcacaacacagcaccaacagttaaattttgtttagaatagcaaatacattttattaaacctagatatgaggcaagtcaacaaaatctcttaaaaaaaatcttaccgtgcatttatttcataatgtttaaagaataaaatgggaaaataaaggta

SEQ ID NO: 21609 - DNA, 600 bp, Bovine  MMBT13758
tttagttcagtcatactatgattgtggtggcattagatgatgctggttgagagatgcaaagaaaaattaagtagaatgaggttagcaatttatttttaccttctcccagttaaaaattcccaatacattcaaatcaacaataattgcaaaactgtctcctgaagtagaagtagattttactcccaagtcttagcacttgttgtatttcaaagtcagccactaagccttttaaagcttgttggtgactagctgttgcagcagaaatcagaatattaatcttgaggctttatttcagagttygtggccaataatgaggtgtcatcaggtcagaagactttcagctgtgccatttctcaaggttggggacggagggagggcaggggacacctctagaattaggaccacatgccctacattccttgataagaaggtcctgaggaacacagacattagttttcactgtgagattaaatataacataagttgaaattactcttgagttattttataactgaacttgctgtgaagtttaccgtctgaagtttccattggtactcacatcttaaaacagggttttcccagacagcttacatcattcct

SEQ ID NO: 21610 - DNA, 600 bp, Bovine  MMBT06430
taaaaccacaggatatggatagtaataaaactggaattattctactggcaaagtccataaaagtaaccaataatttcaaaatcaaacagaaaaacatatccagggtctgatactgaacaatattagcagtaatattttccccaagttcacattaatttcctctctccatttctgatatatggctcatatttgaaaacccgcgtgtcatttgcttactccccaggttgggaatgctgggaaactttctcacattatgctagagtcattgtcttaattctcctccctcttaattgattaatragtgaggagtgaaggaaacaatgttagagaaatttcattaggtataaattgcaagacatttgtttgaatgaatataatatctcagctctgtcttgatgggccttgtgggaatgctttaagtattactgtaagtgccagaccaagcactgaacaatttaatggtgccattcgagcatggccttgtattcggtttttgtttcaaaacgttcttggggaaaacttcactgcctgataatagggaaccaaagaattctttcaagtttatgtgttgccaataatatttctgaagggagtcattta

SEQ ID NO: 21611 - DNA, 600 bp, Bovine  MMBT07407
tttgtagatggaggactgggatgatttggaatacaaaccacagaagtacttcactgttgagtcctcagctggaggtagctatcctgagcgctggccacagggaacctcccccagtttctagctggattccaatggttcctccctgatgccggggttggatgactttcctgccactcagccaaagatatggcctgtccttttcatcatctgttgctcttaatttttctaactgacatctgtgcccatggaatggataatgagagatgtctatacatccatgtgtttatcaaagatcatccytcacccaccttgggaccttgtttaaattgtccatgtctcattcaagttaagcttctcagagacagaatgtgcagtgtctttgtcaagttttaccaacagaccaacgagggaaagccaatccatgactctctctgtaaagatagcttgctgttgtgctatgctcagtcctgtccgactctttgcaaccccaatggactgtagcttgccaggctcccctgcccatgcacttgtccaggcaagaatactggagtgggttgctatttctttctccaggggatcttcccacagcagggactgaac

SEQ ID NO: 21612 - DNA, 600 bp, Bovine  MMBT10056
acctgttagcataaccataagctcctagaacttaaaaaaaaaaatagaactttttcctttttctcacacattgcccaagttacccaacacacacccagacagtaaataattatcaacaaatagatttatgcacttgggtggagaatccagggaagaaagaatgatggaagggaggctctttaattgcgcgagtattttttatacacaggcttttttgtttggcttggttttcccaataaatcatttacattattgaaaattcaaatcagtcctttcaggacctgtttgctgggcaggaargggcatcaacggtcaaccctctggctggtggtgcagcagtcagtcacaatgaagccgcttggccgggaacacagtgtcccgtcctgagattcaaaagtgctccawctggattagggagggaagcgccgcagcggcggccgtgagcgggggctccctggaaccggtccactgagtgatgccgccatctagtgaccgccctcgggatcgcggctgggcagggccctgtccgcgcaggcgaaggagcctcagaattgcagtcctgtctttagaaactgtgggtgggactcggagtgaggggcg

SEQ ID NO: 21613 - DNA, 600 bp, Bovine  MMBT03676
aactctttgtgaccccatggactatatgaaccgcacagtccatggaattctccaggccagaatactggggtggataaactttcctttctcaagggaatcttcccaacccagggattgaacccaggtctcccacactgcaggccaattctttgccagctgagccaccagagaagcccaagaatactggagtgggtagcttatttcttctccagtgaatcttcccaacccaggaattgaaccagggtctaccagtgtcactggtctgtgaaaattctgaaattcagcagggcattttttcayaattccttgattgggagttaagttttggtaataattctctggctactgacttcaccctctgggctcacgtttttgccctctgaggcatcattcccttcccaaaaaggtttacagttcaatagctttctcagacttcttcctgcctataaagtttggggtccttttcttcattttatattatttttctctttttcagctcaagcaggagatggttttgccaatacagtactattctcttaaaactttttcaataatctataaatattattgatagtcattatattagtcaaaaccatgccc

SEQ ID NO: 21614 - DNA, 600 bp, Bovine  MMBT07901
gcagctggacatagatgcacggctagggggttgtccagaatttcatttagcgacgaagtttgggccaaggctgggaccgaggtccctgggtcttgcctgcactcttctgcctgcctcaggctccccatatgtccttcccccacactggaaccagcccgcacgcaccctacacgtgcttggaatctccgctttggatttgccttaagctccttttgctacaaggttgggatgttttagagcttcctaagtgtacatcagctcctcccattaccacccccaacgagctcctcggtgcccccygagcgcagcgtccagagctacatccatcacggacactgggctgtcagcgtggccacgtgcccctctcaaaggcccgaatccagaatgaatttatcccagggggaaccttgttatgcttttatgtcttcaattcattagattctctgtcagcagcataaatcagggccggaccctcttctcacacactcgggaatggggaagacacgcagagaagagagaaaatgcgcagggggcttgggtgtgctggacagtggcttccccacccccgtatttattcctttgtttttttttttttagcca

SEQ ID NO: 21615 - DNA, 598 bp, Bovine  MMBT10761
  misc_feature (1)..(66): n is any nucleotide
nnnnnnnnnnnnnnnnnnnnnnnnnnnnnnnnnnnnnnnnnnnnnnnnnnnnnnnnnnnnnnnnnntgccagttcagttgttagtcagcagtatgaccttgggcaactcccttccttctttcctggggccttactttttcatctattaaatggggcaatcaatatagtggaatagataacaataacaataataaaactttccactaaaaaatccctagaaaagctggataaaataaatgtttgcattgctgatctttcaagaaaacaaaacattatgaatatagggttcccaaatgaagmaaaacttggggaaaagagtgataaatggatagagaagccataattcccatggggacatttgccaatcacagtattcaagagccttgagcttttaaaacataatagaaatatgagatgaaaccttaggtgtatatagggtagggatttatctgggaccttcaaaggactacatcctcaataaaattataaactaaaaaatatatccacaggcaaagggaaacaataagaaaatatgtctgcctcacttttggtagaaaaaattaggaaaagcctccactaagaatgtataaccccaaac

SEQ ID NO: 21616 - DNA, 598 bp, Bovine  MMBT04497
  misc_feature (1)..(8): n is any nucleotide
nnnnnnnntaactcaagagagcatataagaaccaaacaagtggtcagatgtagattttgagttcaaaggagaaaacaagtcaaagttagtatttcttttcaagtgctttcttaagtgttttaccagtcctctctcatttaatccttaaaatgcaactctgtaaaatagttattattatgcccactttacagatgcaaacatgtcaatagttttgagtgatgtgcacaagataatacagctgcaaagtggtcaaacttaggcaatgactccaactattgtaccccagtgtgggaaggatarcaaaactttggttagaatatgagaggtgcactaggacataaagcatgcatagtatttccagttattagaaagagaaggagtatcatggacaaagagtgaacatattgtaggcatcaggaaaaacatgacattgcagcgacagcaacgtgatgagtccatgtaaagcagtgttagaaaattaagatggaacgttaggaagggatcaaaaccaaggtcaagtgctgggctttctattgtaggcagtgggagataatacaactgtctgggtacaggaggagtagatagaaaacagactttt

SEQ ID NO: 21617 - DNA, 600 bp, Bovine  MMBT05803
cagcactaagggccctcagcactctgaccccggcccgcccccacatcggcacccacaactccatttgtgacccccaaactaagtgcagcttcaccactcagtcttctctcagggccacagatagggtggtcactaggtgaaattctgaatattattgattcttcctttttcttcagattctaatatggctcacgacaataatggcattattactgatcctttatctaaaattttaatattttgtctatcatgaaatttttcactgtgatttttttaaagacactattaagatatcatttrtttctgaatttcatggcagctccttaaattgtacatctgaagtaggtgcctggctggcctcacccaagtcccagccctactcctcctgcctcatcttttctgtgcttccctttttactccacatgcacttgccaactctcccatttcccaggtctggtcctcttctccacaaagttctcaggctgtctccctagaaggggtcctctctcctatggcaccaagctggtcacgctttcctggcacaaactgaatgttgcctcagacacctgaccaaatgctcccactggacaccctgaagtt

SEQ ID NO: 21618 - DNA, 600 bp, Bovine  MMBT02995
aagccccaccagatcagagggctaacggaataccttacaacttcttattgcaccaagggaagccataacaacctaaggggttgctgagatataacacacttgacttcccaattctcttgtgatcacgactgattcagaagggagtagagagggcatgaccaaggacccaactaccaagcgatatacaattcatcaaaacacaccgtaccacatggcaggggcaaaaggaaagagaaacttcttaattttcttgaaataaaagctccactcagaaaagctccaggtttcagtcccaatccraagatgcagaaaggaagtgaccaggcagcaaaccaaaggagccagatttagtacccaaggaccagcaagaacgtgatcagagagggatgggccgggggctgccacaaaatgcrtccatcagcaagcagaagtcttgactgccactcgacctgtcaccctaaatgccaactagttggggccagcagaaacctagaatatcatttcttactccttgtgctttcaaatttattcctggccagatctgttgtatgacttttaataataacaataaaaaaaagcatccctggctctttaacccga

SEQ ID NO: 21619 - DNA, 600 bp, Bovine  MMBT05295
agttaataactgttgttggatcctgttgtgagattagagtttactgggagagtatttctagagaaaataggrtgctgaaaaaatagagaaaagaaagatacataaacacaaatctgagactctgtttaaagggatggactacagtgaagatgcccaggaccaggtgcagtgacactaggcaagaagactggacttaaatcgacttcctccggttcaaactctggctgcagacagcagggccgtcccatcttgggggctggcaaattcctgtcccctgtgttttcctatagtaagcaagcygagattgttttctacagtttttaaatggttgagggaaaaaactcaaaataggaataatatttcattgcatgtgaaattacttgaaattaaaatttcagtgtccatttttgttgttgttcagtcattaagtcatgtctgactctgcaaccccatggactgcagcatgccaggcttccctgtctaccaacagctcctggagtttgcccaaacccatgttcactgagtcggttcactgatgccatctaaccatctcctcctctgtcgcccccttctccttttgcattcagtctttcccagcat

SEQ ID NO: 21620 - DNA, 598 bp, Bovine  MMBT10506
  misc_feature (1)..(17): n is any nucleotide
nnnnnnnnnnnnnnnnnaaatgaatggtagaaggaaagcttcatggtatttagccggctccgatccctttaatgcctgtagcttttggatacagccctgcacccctctcccctgacctctctcccctagtttacactgcactcccctgtccactgactgctgcaaagtctgataaaagggctgaaattagaccttgtctcccagcacagccagcagggcccggctctgccaaaatggcagtggttgatagcaggcaaaaggcagaaaactgatttcccatctctcttctccattttctargatccaagtgagtcctagttcagagaagaatgactgtctcccggctgggagcagcaggtacgagctcctgcctacgctgtgtcacgtgggctgtgagacctccattccttctcgactcctgcctgcccactgaggtgagctcttyggggtttctctgactggtgggcaccggcctasagtcatttcttcgggaaggaggctctccctggaaaagctgatctgcaattcggctgggatcgatgccgtggagactgcataaattggtaagtcgtaagcagctagttttgtctcagctgac

SEQ ID NO: 21621 - DNA, 600 bp, Bovine  MMBT11568
gccaaggcctctctatgttgacttattagtgtcaccaaaaggaagtaaattgttggaaatacaaagaaaatagacttatagccctcatgtgaattattcatgctcagtagatatataacagtttctcttgaaatgtaaaaatctgtatatagagagatactcacatactgtcacactcaacactttaatattatttgcccataaaatatttcatactggtacaattatgaataattaagaaaatagaaactaggaatcttaagaaggaccaggctgtttctcactggtaagtaaaagaayttaaaagtaatctgtgcacttatctaatccatcactcacatcctcaacwgatatttctacaaggttttctcttrtgcttatttttctttctcatcctttaatatagaacagtcagtaaattaatagtaagaactgaaataaacattttcaatcaattaaaaaaatctttgttattaactaatttattattgatcatcttattccctcagttagaagacatttcaaagaaactttggaaaagacaatagcagtttttcatcaaactaacacaattcataagacctgatgattaaatcctgc

SEQ ID NO: 21622 - DNA, 600 bp, Bovine  MMBT11976
tttcaaacactttcaatgacaatgttacattgttgataccttatgtattttgaaaataatttttatctcttttcatttgaaacttctgtactgtatagtggggtccctagccctggtctggtttccagaaatttacttgcatgattctgggagtggctagtagggtgttctgtggaattggtatggctggatgcactgggatttgcagaagccacaccagagacacacagatcctcagcctggaagaaaccaagtttcagtttgatgaatttgccctggaccatctccagcacactttasgtactttatgtactattcctcagacactgtggtgatacaaataacatcttctgtatccaccctaaaatagctggagatactgcagctccttcttgggggctctgctggcaagtrgaggccaggtgccaagaccatcagctgcatcctagctgccccagctgggcctgagccctggrgtgctgtcacccagcctgtgcctggacwggagggagtcttcttcacccttctaggtctgaacaatcctttctggaaacagtgggactaaaccacagtaactgacaatttccctgggctctcttc

SEQ ID NO: 21623 - DNA, 600 bp, Bovine  MMBT10937
taaacaggataaattacaaagcagtagacgtttttttctttaaaggagtaatttagttaacattttgctgaacaatattgtaaagttaaataaaattaaaaacattttgctgaacaccaagactcatagatgaaaaattatttttgatctataaagcttttatggcaatatttacagaatctttggaaaggaaaaagaaagtctggcccccctcttaaccatcatcacagctttttttttttaacctagcattgtaatcagtgtactatattacttttgaattctacctttcccatctgytttgttctatgaattattcccagtagccacatagtcttcatacttaaaatttttcgtggccgtgtaacttacccatggtattttagatgctccaggtagttctgtgggcagaggggaaaagttgaattttgtttttagtggaaatttcatctgtcagctttttatcttgcaatcttgtacactacattttatcctgaagtaaaaaacattcttctaagctggctttgatcttttttttatgtggacagctatgtgaagacactgtgattaacacttccaattgctaatcatgagctatcc

SEQ ID NO: 21624 - DNA, 600 bp, Bovine  MMBT11592
gatgttctaagagatcaacgtataatactaggaaatggttgtagcaaagaagttaagacgttggagtttgagattgaatcttaactccactgtattctagcttcattgatcaagatctttcagccataagagatggcagttcaaggcaagctcgctgaagaaaaaaggggatatactatgttacataactggtaaggtcactgtgataatttacaggtcaatgaaccacagccccgggacccagaacttaagaccatccatctatttgtccatycttctctcatcactgtctctctgcaygttggcttcactcttactgtaacaaggtctctctatatatcaaggaatgtagccacagactgttycagctttgtaaacccagggttcacatagcccaggaagagccttgattggccccaccgggttcacgtactcagctgttgaccaatccctgtttccagggacgcagggtattataaacggccagcgtgggtaaggttcccagcctaccatcaaggatctctttccaagtggaggaagcaagttactgcagtcactacactcacccgtgaccttacaaacatgacttaacccccgctg

SEQ ID NO: 21625 - DNA, 600 bp, Bovine  MMBT13177
gtcacacttaaaattaaatctggggactgactttctgcagagtgccctgtactcagagatattaagagtctgcataaatgaagccatggaggccctctggctttcacagagtgcctcaagttggcaactggctgttctaagcctatcattttctctttcaaaacttccaatatcattaacaaaagccagcccaatccacagtccctataattatcattgtccccatatcgtataagcaatacagccactgcacatcctaaagtcttatcttccacctgcaccttatcccaattaaccacragggaaagycttagtaatcgtgatgtcatggcattcctgagctaatcaccatccctctcagcactagcaatgggatttttattgctgtgagaatggtcagtaatgcagttttcaatttatttccctaagggtccactttctggggccatttctgataccaactgttttagactaagttttttagaaacagagcctgaaacaaagtcttacgtgttaagactgtattcaagagtatgatcctagggagcaaaggtgagagcaaagggaagtaagacagagaaacagggaaagctgataagt

SEQ ID NO: 21626 - DNA, 600 bp, Bovine  MMBT10080
ctatcttttctttcttgctttatctctctctactttttgttactctcatgaaaacagtccacttcaagaaagcataggctgagaaaaaacagggtccagggagcatctggagaggtggagtctgtcactgtgatccttttctgctttctgaaaacacacgtgacgcagtgtttggatgaaaagcaggaaagagcttttcaccgtgcctgcgctgttacccttttcattctccagggtgttactttagcacttaactagagaaaatgtacacacatttatagaaagagcccagggctcctygcacccccatcaggcttcaccatttgatttacatttagtgaaataaattataaacttttatgaaagtcatccgagcaaagtaatggagagttctgaggaacagaaggaaaggaatcgatttcttaggtgggaaatacttgcctcctgggcctgtgaggaataagacacaaggccttccaggtgcagctggaaatgctgtggatgttttgggtgccagcctccagacaggtcttgtaaacgtccaaatctaggttacagttgatttccatttgtgaggacctcgttcatcatcatttcaag

SEQ ID NO: 21627 - DNA, 600 bp, Bovine  MMBT05105
tgttaccaatctcctttagtttaaatggtttaactttagaaatatttttggaaatgtactgttaccacaaaaatattggataggtcatcatgagtttgtttgaaataatgaaaaaactaacttatgccctgccactgcctggcatctggactgatttccagccctgtggccagtctccttgctggtgttaggaggtaaagggccttatccaggccacctgcagcgctctcagctgcagtgaccagcagctcgggggtcaggtgcacgccccgatgcatgaagctcttcttgaaaaggtarggtcggctgagatgtcaaactttgaaccttttctttgttttcggttttcatgtagtttttcatctctagcctctaaaaaatttgtgctaataaaagttttcatagatttatacaacattagagcagaaattaattttagagactcatctcaacactggatgttatagattataaatgtatgtataatcaccttaatatatttaatgttatacagtgatatttgatgaaagttttcattcatcttcctgtgaaaataaataatgagtataatcttttttcatcttattaatttgaacatcc

SEQ ID NO: 21628 - DNA, 600 bp, Bovine  MMBT10492
cctcatcacaaggctgctgagtgtcaaggctcagctccaggctgggctcgtgacaaccaaccaaggcctctttcaacaacactatgaaagatttatgaaaggctgggcaacactaaaatgagcttatgcaacacttcccccaatgcaaattaagaaactgatttgaggaacagaaacttggttaaggcttgcctacctgcaaacagcaccgcagagaaagttgaatacttaaaaaagaagaaaatggtctctcaggggactgggagcattatttctgctctgaataactgagaagttgcrtgtgaaagagcttctacccaaattgagaaacttcaaaatctgacgttaagtttctccagtgtcgttgtcattgttgtttagtcactaagtcatgtccgactcttagcgacccgtggactttagtcctctaatctcctctgtccttgggatttcctaggcagaaatactggagtggattgccatttctttctctaggggatcttcctgacccagggatcgtgtctcctgcattggcaggcaggttctttactgctgagccaccagggaagctcaagtttctcctgtagactacaaaataaa

SEQ ID NO: 21629 - DNA, 600 bp, Bovine  MMBT03382
ccagtaccggtgagtaattaggctctttctgctggtctggtagtaagggaaggggcaaagcttcattcaggggttggatttgctgtgcaacattaacttgtttgattactaagaagttttaaatattaaaaactgttaaaagtgcattttttctgtccagattacctgtctatggttccattcactaatttatcctacttgtaaagctagggctgagattagaagccagggagtgattccatttccaactctcttagtacaccctgttgtttattcttttccaagaagcacaacagagcmattaaaaatgatagcctttcaaggactgtgtcttggtctaagaggggtcactttacatcagtcttttgctagcacgtcaatcctatggaagaatatctgccctaaaactggcagtagaaattggggtaaagtgtaattgatttctcttttttcttccctttattcacaatacagaattaataggctttttctcctttttcgtgtttggtagtattgagtgaactggggagaaataaaaggaagctctgtaaagtaaataagtgagctcagaagcaattttctgacactatatagtaatga

SEQ ID NO: 21630 - DNA, 598 bp, Bovine  MMBT09407
  misc_feature (1)..(175): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagtaggaaagtgaaagggaaagatttctgttgaggaaggcaaagatggttcctttcacatgccagctgcaaatccttggtttcctagagcactgcatggaggacgatcctgaagatctgacygggacgggcgctgggattccttagcgatgtctgcacagtgcacagcctgagggcacagcatcacgggagtctgccttccgagtgcacgggctttactgacagatccagaaggaccaagacgtgggctttcccttctccttgtctacggcctttattttcacaagagaggcatttcacaagaaatttcttgcaagggcaagaaatatggagaagaaacattcaataaaatctcataggtcctaacaccaggctctaagtgctgttttgttttgctgatcaatagagtaaaatatggtct

SEQ ID NO: 21631 - DNA, 598 bp, Bovine  MMBT09908
  misc_feature (1)..(73): n is any nucleotide
nnnnnnnnnnnnnnnnnnnnnnnnnnnnnnnnnnnnnnnnnnnnnnnnnnnnnnnnnnnnnnnnnnnnnnnnnggtggaccgcggccctcgcgcagggcgtcaaagggtatgacccagagcagtgtctggctattatcacgtgaggtagcaccttaatttccagtgttaatcctaaagcttggccaacccaaaccagttagtgggactgtcacagatttcaaagaaccacaggtataacaagcaagcaaaggaaaagcacagaaggggaggcaggggcctgcctcctgacccctggggayggattagtagctagagctgaatctccatcgtcactgcaaagcaaggcaggcccagagagagagcacatggaatcaaaacgaaaaaaaacgggaagagacttttcataatcacttggaaatcagcaagaaagtggttttattggcattgggttttagaaggggaaaaactgaccccaagaatctgggtaatgaaggaaaacacatctaccaaggaagctgmaagtttctcacgatgagtctcgtgtttggcaaagataaggaatttgctttaatattattgccttgaaaagtcaaatgt

SEQ ID NO: 21632 - DNA, 598 bp, Bovine  MMBT05627
  misc_feature (1)..(34): n is any nucleotide
nnnnnnnnnnnnnnnnnnnnnnnnnnnnnnnnnnaaagcaactagatgctaatgtctatcccctccctccatggcaatgtatgatgaagcaaactttaaaatttaaaaataaatttaaacacattcttaaaatagagttccttaaaagtccatgaagtctaaggaagcaaacaaccaacaaaagacctttattgggaaaaaaaatttgcagtgccatttctctcccccactttctcctatgaaagaaaggagaaggcatcaagactaatgattgaatactggggagaagatgaaggtttygagaaagtgctgggttatataatcgcaccaatagtgcctaggatttttgtgtgatctgcacaacattgcatctttttacctgtgtaaagtgaagtaaaaatatttgaggcaggtcttttgggtgtgtttgcctggtaggagaaagaaaaatagaagatatattttgggttttccagaagtgaggacaaatctgtaaaackaaattgatttctctcaacacacaccaccgctttgataaygctggtctgaggaagagatggcatggtttttctctctcatctgttcctgtcagccttcc

SEQ ID NO: 21633 - DNA, 600 bp, Bovine  MMBT06971
aagtgctatttccttatttaactataaacattatatagttagacatgcttatttcttttgaaatttaacttgttattctgtaattaagatttaagagttttaactgactgactcactaataaagattatccccattctgccatacaaagaaaatcccagttcactaatcataaattctcattggcctctggctagagttgccctcattatttgcaagttttctagaaattaaaaaatgcttggcagttagtatggggattcccagagcttttctaaattgtgggggatatcaggaatgcyctgctaggtacagtaagacttgagactgcttacacaaagcaattaagcaagtgaagacactgaggtgaaaggaaaatrtatagtttttaaaacaaagtgagtcttttttttttttagccaagagggaaacaaggtgagccaggactactaaacgtaaaatggagtcttgcttggaatcctggatgagaaaaaggccattatataaaaaactaaggaagtctgaataaagtatgcacttttacggatgcattattactaatgcatcagtattagtccattaattgtagtgtaattaaatgt

SEQ ID NO: 21634 - DNA, 600 bp, Bovine  MMBT01612
tagattaaacatttgaggcaattaagatttgaaggtagtttcaatttatttttggctttggaagaacagttcacaggtaacaagaggtccatttacaagtgcaaaggatgagtttacagaatatagcaataaaagaaaaacaaatacattttgcttccagtaaattaagataagccctgtttcacattaaaagcatttttaaattctgaagctttgtttttcattaatcagtagaatataatgcacctgtttaaaccaaatgcttttgattcaagaagacttaggcttaaaggctattcrctagctgtgtagttctgatacattccttaatctcattgagtttctaagtataaggcataaataatagtgtgttcttaattggtttttcatgaatattaacatcttatttgtacaatatctaacaggtgtagaaatattataaggaaagaatgaatagcattcatctttaacttaattttcatcatgattaagtatttattaaatattcaactttagtgtccccataagaataatagaataactagaacattattatacactaaaacactctacagcatttttaaagattatatattgttt

SEQ ID NO: 21635 - DNA, 598 bp, Bovine  MMBT08921
  misc_feature (1)..(92): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcctaccttttttggaaatagtaacacaaggaaacatgataggctaagcaaaagaaattcacgattttactcttggtgactagagataatccctggttaactcatgctgtttttatttttccagatagtcatgataaaacatatatcaactcctatatttagaaataaaactatcaccaccaacacagtaggaacgtcatctcttyggggaaaagtttttttacaactttcatcagaaaaaggtgttgaggagaccaagcagacataagaaacctggagttgtgcacgcatgcatgctcaatcactcagtcctgtccaattctttgtgacccagtggacagcaggccactaggcttccctgtccatgggattctccaggcctgaatactggaatggrttgcaatgccctcctccaggggatcttcctgacccagggatcaaacccacatgtcttctgtctcctgcattggcaggcgggttctttatcacgtagtaccacctgcg

SEQ ID NO: 21636 - DNA, 598 bp, Bovine  MMBT02557
  misc_feature (1)..(102): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagcttgacaatgatgccaaatgacagattttatttattagtatttaattgaaagaaaaatgagatctctattaagaaggctttgtaatttgtcagatgctttcaagagccttttaaaacatacttgtgaaaatgaaagtctgtgaaaaagtaaatactataaaaatacgtagattcatataatatacgtttcttyttttaggtagcttctgctgctttttgatatgccctgattaagtttttttccttatataaactattaggaaagtttcattaattaaaattgctcatttttattaaggatattttatgtgctatttaaataaaaaattggctttctttaaatagttaaaattataaatattttactatttgatcatctattagctttttatttgtttttttttaactaaggttggatggtgtgtctattttttttacttattagtctatagaagatgttcttattggaaggtgtgcaaataaatcctact

SEQ ID NO: 21637 - DNA, 598 bp, Bovine  MMBT03470
  misc_feature (1)..(60): n is any nucleotide
nnnnnnnnnnnnnnnnnnnnnnnnnnnnnnnnnnnnnnnnnnnnnnnnnnnnnnnnnnnncacgactgagcgactgaacctgaacctgaacctgaaggcaatagtagtaataatgaaagtatataatattacataataataatgaaataagactaatggcagtgcggttggaggaaatgaagatgctcttattgagagagattgattttagccgtgagtgcagttattcctcgaacagcttggtccttctccccacctcccaggctgggagatcccctgaagacagcaaggactatattrtaaaggcatgtracccaatgcgggacatggagactgcttgataaataattattaagtgggggcgtgaacaaaggaatgcaagacgtaacagaaaacatacgtgcctcatgcataagaattattctacaggagctgtttcccattyaagacaaaataagaaacacttgttgagtggatggatgggcttcctccagggcagcagggggcgggcacccgtgtgggagctggcctctgcctgtggagatagagtccatcttctctgagtcagtgctctgggtgcatggtgggcagggctcca

SEQ ID NO: 21638 - DNA, 600 bp, Bovine  MMBT10045
cctcagcctctaattggctgagtcctttagggcccttccagctgccacgtgcctctgcccaaggtttgggaaatttagggcccaggagatgctgagacttgaggccctctgacgaacagcccttgttctgctgtgcaatcacttaggtgagaaggactcgcagaagcaaagtctaggctggtatggacaggggcgacggagcacttgcttctgtgccttcactttacagggcaggatgccaagaccggggggagggttcagtggctgtccagcatctcccgacttgtccctgccatcatygaaacagtaacattgattgtcaacagtttgctaagcatcttgctgagtggtttacattttctcgtgtaaggcttctagtcatcctctgtgattagacttttttttttaaccaattgctcatttatctaagtaaggaagctaaagcccagagaggttaagttacctgaggttgggcagctgaatttgtgcctggacctgctcttcatgattcttcattagaaaccagcgccgttggcttactcttcctggagtcctgctctgagtggtcctcaccacactcacctcgccttgtctttcctc

SEQ ID NO: 21639 - DNA, 600 bp, Bovine  MMBT07057
acctgtcattcgggcttcctgggtggctcagatggtaaagaatccacctgcaatgcaggagacctgcatttgattcctggggggaagatcccctggaggagggaatggcaaccaattccagtattcttgcctggagaattccatggacagaggagcctggcaggctacagtccatggggctgcaaagaatcggacacgactgagcgactaacacatatacacaacctgtcattcagttctctttaattggaaatgtcttctcattcctatattacagaatttacaagtttaggaaaaatkttgaaatggttcaaattcatcccattttcaggatgagactcttcttaaattatcttaaatttaaggatctattttattttgattttcttctgtaaaaaaggacattgaagaaaaatattcagtaatctgtttctttgccaaattattttcagaatattcttccttatagatagcaaaaaaattcctcatgccaatgactggtttttttttwaaattgtggtaaaatatatacaacatgaactttattcttttaaccacttttaagtgtacatcagtgacattaagtacattcccagtgct

SEQ ID NO: 21640 - DNA, 600 bp, Bovine  MMBT05958
tcccaatgcataaagtgaaaagtgaaagggaagtcgctcagtcgtgtccgactcttagcgaccccatggactgcaggcctaccaggctcctccatccatgggattttccaggcaagagtacactatacacacatattatatataatgtatatataatatataattaacatctctttacattatatacatatctttatatatgtgttataaggttcataattttcttaatgatgaaacacttttatctatgggaagtccygtgttagttggtccacatgtgaatcagaagtttcaaaatgygtgtgaattctccctgactctgccttcacctgatgggctaagtgaacygtcacaaagctaacagcattatttcagtcagcctggcaattgataccaatcatcrcagctgacttttccacctagcaatctgtgccaattgttaccgcgagcgaagtgagccaattgcttgagaccaggttttattaatttatattaaaatttagccttagacagattggggaattaaaagggcaagccgaaaatgccacaaggaatctagaatattttgaagccagtgctttcattttaaaacagaaacct

SEQ ID NO: 21641 - DNA, 600 bp, Bovine  MMBT09968
agccctaggaatagcaactgggaaaagccgcaaaaaacgtatataccagcactttgggtccaaaagaccacaggctcttagtgacagacagtgaggtcaattacgaaggtcatggggctccactctggtgtccctgatagaagctcattcagtctctgcttgtgtccccaggactggggaacgcctgcaccttctttatcattttttaaaacagttttattggggaataatttacactgcctgaaactcacctgctgtaagtatacagttcagtggtttttttgatgcgtttacacagtygtgcagccatgaccacagtccagttttggagcatttccatttgccacagagtttcctcgtgcctgtttgtatttatttcttgtttcttgtcaagcctcagactaccactgacatgctttctgtctctagatgtttgctttttctagacatttattgtaaacggaatcatatcaacatttgtgtctaacttcttgagtataatatagttaagtttcatccatggcatagcgtgtaatttgttccttttttgggctgaataacgttctgttgtatgcatataccacgttttttagtctgtct

SEQ ID NO: 21642 - DNA, 600 bp, Bovine  MMBT11382
tgaatctgccctttgggtccaagctgaaatgtttgttttcattgggaatttatgtatgttaacagagtttatattttctgtggtaatggaattttgagggattgttgcttcattatatttataatcttacgtaaaaagcctgcaggggcatctaactgaatttaagctagaaataacgataatgcagtaatttcaaatagtcatgtgttcaagatgaagattttaaagtgatgattccacagtgaattttaatggttattgtgtacaatggtacttacggaacatccgttcagtcactamatgaatataactagtatgttagattatggatttgtaatgtgagatgagaacttttaataagctttccctataatggtttgtgctacaaacacaaagtatgagacacaaccctaaatcatagcagggtttttgaaatcaataggctcatgtttcaaatcaagatgagtttcaaatttttaaaaacacagctaagaagttagggatttgggataagatgtttctttttataatgtaaagaaaattttacttttgaagggatcaagtataaaatggaattgaagttacactttgagaaaaact

SEQ ID NO: 21643 - DNA, 600 bp, Bovine  MMBT06300
aatttagctcacagagatttactcgctcctacagggaatagcatatgtacaaagttagtccccgaagtattatgtatattagcaaaggactggaaacaatggaaatgtctatacaggggactgattaaataaattgtggtggtcagtataggggatgctctgctggtgtaaagagaacagagacattttatgtattgatatctaggaaacactatataaaaaagtaaaatgaaaaaaaatgtgtatttttttatacaaaagaaaggggcaaagagaacacagaactattttcttacatayatatatcaattctctggaaagattacagcatttttttaacttacctggttgtggtaaagactccatacactacaggatttctttcatctctcgtggggagtaagtaaatgtcttctattaatgggaaaaaataacgattcactgtaatttgtatttctcaatatcacgtttgctttttccttaataatgcaatatttctgagactctaaatagtatgtaaaattaagataacagtgacagtcattaccttatgacaaaagaaattaaggggaaaggtccagttctcactagctatctggc

SEQ ID NO: 21644 - DNA, 598 bp, Bovine  MMBT09735
  misc_feature (1)..(108): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggattttccgaaagagtctggcatgtgttgcctttccttttccgggtatcctcccaatccagggatggaacctayatctaatgcattggcaggtggcttctttaccattgagcygcctgggaagcccaaaagatgctttaggataacttaaacctgaaggcagccagtgggggaatctctgctgggatgkggtcaagaatctgagcttgctttggggaaaccggaaagacttgtgttgagctcagcagagaaataaagacccaccaaatgtcaacaagggccttgtctgccctcataacctttttttttgagctgctgtttcttcttctccatttaaaaataaaagtcaagtgggaaataacaaagcatacagtaawataataataagcygaaagatgactcaataaaaagaagtgataaaataataaaagcaggctgatacagtaaaaaaaaaacaamaaacccaaaactcaaccaaacagaatcac

SEQ ID NO: 21645 - DNA, 600 bp, Bovine  MMBT05224
tggggtgagggaggcaaacattcaggccacagccatctagttgcaggcaacagtttgaaccttggctgtgtcataggaaatgtcctgctaaagatgtcagagcaccgggcttggaggagcccctggtgctgctctggtgatgggaccctaccccttgaccgtttgcagttgaagtgggaaccatctggtctgctgacggaaaggagtgatgctcggaggtcatttaaagaatctgagggagaacctcggatcccttagtttctgcagagcttgtgtcccctggagaggagtgctgacttmctttcctcagagcttcaggccccttcctgaggggaagcccagggaaggctgctgtgggtcccaggagaaagagggccccagggggctctgtgccaaggatgagggtggctgatgctggagttccctcacagctggagctgatgtgtgcatgactctctctgcagattgggaaaaaacaaaataacaagcgaaggaggaaagagtctcgctctggctgtgaagaacagcaaatccatctttgaagtggggtgagtagaggcgaatgcccgtgggtgtttgtatacgacctgctctgtgtac

SEQ ID NO: 21646 - DNA, 600 bp, Bovine  MMBT08550
tcgtagagagtttatgtgatttttatttcttaagataaaattactactggaaaaagaaaacatgaagatgatgagccagtatttgaacaaattgaaaatacagccaatccttctagatgtcctgtgaaaatgtttgaatgctacttgtctaagaggtgagtatttatgatacttgatttttttaaatggtagcaacagttaggtgctgtgaatttatcagaggtgactttttttcattgatcctttttaaaatttttctcttttcttatttcaattatgtttttagtcctgttataaagyacccagcttgtatctcttaagcatatgttaagaaattgctctctactaaggaagttattgctgttgtagagggtgagacagtaaacagtgtaaagtttgggggctgtgagtctctcttgcagccagtgaaatttttagagatcacaaattattttatgcttgttcattattttatatatgtaccctctaatttttaaaaggtaaacatgaactcagaatgtattttcttaggtaatcagttttataaactgtccccaggttagctgtcaagaaccataaaaacagtaatgtcacctctag

SEQ ID NO: 21647 - DNA, 600 bp, Bovine  MMBT08747
ttaggaggaaaattttgcaactgaataccaaggttacaccatactgattcctccagttctttccaaaaagaatctatggccattcacttggtttactttacaataaggaaaggagaataattttatattttgacaactaatgaacacagttttgagatggcatggattcccagagacctagtatatcagcatggacatcatggtggaggcagcttatggggaccaaataataaatatcatagttgaccatgggccctgcctgtgggggtaagagttaacactgcagaaattcacatcccygtctccgagtttcacaaagcaatattttctgtgctttggtagaaaaatgaatgaactaacctggaagcaaagagagaggaagatactgtgatccagccaaaaaaaatgtgacagaagtagactaaagataaattgagaattaaatttaaaaatatgctttaacaactgtgtctgcttcaaaggattagaggaacaacaagggaaattaaacattaaaggaagatcataagtatatctaattgttatggtaaaggaggtctcaagtaaagagtgtttatgcagtcactgatgttctgcaag

SEQ ID NO: 21648 - DNA, 600 bp, Bovine  MMBT05790
tctctctgaatttcaaaatatattgaataaaattatttaaaattttttgtgaacaataatgttgagacattaacaatagagcaaagagaatacactttatagattatctgataatattttgtcatttcctttttctatggtaaaaaaaatattaaaaccacacttagactcatataaaggtatgatatttgacagaaaaaaattagaactgctgataataaatcaattactttaaatatcctaaatgtaagtatgaatgtatataagtattgttatgtgctttaaatttagtttgattamtccagtccacatatgtttattttctactgtaatagataaatcacttattcgtgtgtcaaygttttgatcttctggaaggtatgtaccaartgcattgatatattaattcttaaatatgtaatttgttttgctgtagatcwacygatacctataaattaaaggtcttcttttgtctgaggaaaactaaaccttgaaatatacggagattgtatagaagatcttgagatgatacaaacatgaatatgatcatagtcttctcatgggaagggaggcagaaagatattggctccagattataac

SEQ ID NO: 21649 - DNA, 600 bp, Bovine  MMBT09687
aaaatatttatttaacacactaacattcacacttcacaagagcactaacctgcccacctcataatttccagatgatggaggcagaggtgctttttttgcttagaaatccccagtaagtcttttaattatctcctttgccacagggaattatagatagtctgtaaagcaggttattttgttttaaacttgtgaggccacttaacatatatgaagctgaattcagttactacacagcatcttccctccttgtgagtttggccaagttttccattttgggattaatgagaagaaaagtcattwggattattgatccagtgtgagtcatacagaatggggaagaatgggcaatcaccactattttgaatgtcctccatttactgtctctaaactttattttggaaggtgcagactttgattgtattatttctatagggaaaacaacctctgatctctctctcagaacaactggaaggcaaagtttcctgggtttgggtaatggctctgatctggttggttttctttccctactaaatcgtttgtgtcccctctgtatatcttcatctggttgattgggaacagggagcctgccaggacacacac

SEQ ID NO: 21650 - DNA, 600 bp, Bovine  MMBT05427
ctgtcttttttcccaccgcctctgcacagggggtttcctgactccagaacctgcttttcttgtgatgctaccatccactgcaaacagggggtctgcttgctagaaattcctggttttttttttaaaaaacaaattcctggtgacttaaggattctgctttcagacacctgccctggggcaggctcatgtcctctcagctgtgagaggacagctcggtctttgctcttcctgcacccatgaattttctagaatgtctgatgttagtcactccgtagccattgtgtgcatatcccgagactrcacagagctcctagggttacgtgaaccctgacaccatctgggaggatgggcgtggggccccgggtggtggcagggggcccgggccccacctctgaagcatgttaactagactgttgtctcgtaaggctctacaggcgccgcagggccccggctcttcaccatccacctgatcgacgccaacacggacaacctgcccaaggcccacacctggtaaggaccggcgccccacccggcggtccgtgtgcgggacagcccgcacgtcagggtcagcacgaggctctttcaggagcgcagttaagt

SEQ ID NO: 21651 - DNA, 550 bp, Bovine  MMBT07155
tactttcattgtacagagatgttcaacaatattaaatgtttgagtctcatcccttctctcaggagtgttttctagatgattccaattcaagacacgacagcgtctctaactaaggttgatcctgtgggttcttcacttcctgagtccaacccaagacccaggtcctgcccaggctgccttcccagactcctctgagcctgggtctcacccctctgtgtggacttcccaaccccaaatgtccccggctgtcccccagtgccctcttccagatgtaaccctgccgcatgtcctgcccctccyctggggcctccttccactgcttctgtccagaactccctgccttgagccctgcttgccatcccccacctggagcactgttgctccccacacctgccccccatctgctctctgtcccagtcctcagccccaggcccggagggtggacaggcaggccctctggactgctctggtaccctcccttggctcacagggccgccagggccaaaggcggagcaccgagccctcttggatgtgcacagggacgtttctg

SEQ ID NO: 21652 - DNA, 600 bp, Bovine  MMBT11381
aagaaatttagaaatgacaataattcaagtaatatgtcacatcaccagttttttttttaatggtcttatacctttactaagtaggttttaaaatgcataaacaattaaacattactattggtttttaagttaaaaggttagacaaagtaacacttgcattacaggaagacacagagtatatgaaaagcataagaaaaaaagcaactttaataaagactaagaagataaaaagtcttagaaccccttaaaaacgcttaataaagaatgaaaaatatataacacattaaaattattatttayttgcagcagagtgttctttgatgactgttaggaaggaaagttttaacaaggaaaaaatttggttacataaaatatttctcttttcaaagttttatttaataatagtgacaatcatcttaggaaagaaaggaagatttggcttgagaggtaaagaggtcaatatggctttgttatcattgcttgccttcattttctaagaaactaattgattttaaagttcttaataagccccagatttttcacaacagctcttcatgaacactgataatagaatacctgtaacagagttgaaggtaaata

SEQ ID NO: 21653 - DNA, 600 bp, Bovine  MMBT01695
tttaattgtgtgaattgtgtagatacaccataatatatctatccactctcctgttgaggacatgtggattttctctttttcttggctataataaataaagctgctataaatatttgtgttatgggtctttttctgggcatttattttttatttctctttgataaacaccttgaagtaaaatttctgggatagaatgttagatatttgtttaaattttattacagacagctttccagagttaatgtgcaattttacacttctatcagcaatataagaaagttctagtttctctacaacctyaccagcgtttgctgtcatttcatttaagttattctagtgagtatgaaatggtttggcttttatttccatttccctagtgtctaatggttgagcatcattagtgtctattggccattcatactacttcccttgtgaaatgtttgcttaactgcctgtttgaaaagttcttttttgtcttttcattatttgcagacattttccttatatatgttctgaatataagtatcatatatatatatatatgtgttgagaatttctgcagtctgtggcttgccttttcatttcataatggtgtatttt

SEQ ID NO: 21654 - DNA, 465 bp, Bovine  MMBT09727
attaaaaatgcaataaaaatttaaacttaaaagacatataaagaaggaacagttttagtgaatatttaacaaactgttcattagtagaaaactaaaataattatacagttaaaagtcttctatgagcaggaaagagaaatttatcttttgtacatcagaagttagaatctgacttagctaagtcaaaatcaacattagtttcaggataaaatcatgggggtctaacgcacaccagcagtactaacagagggagaggaaaagaaaaggagaaaagccaaagaaggctggaattcatttggygctacaaccaggtgatgagtccaataaaacagacagcaggactagagcgggcgtgagatacatccaggtactccaagtcaaactgcactggggcttcaactagaagaaaactgagaactgtctactaatacaaaggaagccattgtttgaattaagagacaaaca

SEQ ID NO: 21655 - DNA, 600 bp, Bovine  MMBT07216
aaatgagaaagatgatgaacaatggagcataatgcaatggttaactgggaaagaacatgagaaaaccagtaagactcactaattgtataatgttagctgaggtttcgaatccaggaaattatgttttcactggaaaaaaaacaaaacaaaacaaacagcaacaaaacatggttaattagtgaataagagctttgaggcatttgatttctaacagtcttacaactacctaaatttaaatgtttagaatcctattttaaatactcactgagacattcatttgaataaaccccttgttatctkcctccaacatcttagcaatatatggaaaagaatatatttagcatatatctgggaggtacctatcacttttatcttcttagttattaaaaacataaagataacccgtaagtttataaactcctggtgagagtttaccataaagtcatcataaagtttttataaaattagtttttccaaaagaaactcactcacatagttacactgctggggatgaagtattatcctaagatgttatctctcctttcagacaacataaaccaccatctctcggacactgaagagacttatgactatgaaaaa

SEQ ID NO: 21656 - DNA, 600 bp, Bovine  MMBT08918
tcaaatatttttacacattttgtacttccctagctagtctccatactttgattcttgatttttaagagcttcaaatttcacagaaatagcatccaagggaagggaggaaaaaaggtgagatatttatgtcaaaatcagtgtaatcttaaaccaagaagatatttaggtcttcccagtggctgctttacttgtgataggatcctctccatttaagtcagctcaagctgttcatgaatgcatcctctgcaatagcaaatggtttctccttttaccagctgtggctacccactaacttctgckttataaaaaatgctttraatctgaaataaaacacacaattagaagtttmtgtacatagagtacttttattcattgcatgaactttctgaagtattatatacaaaatggtatcttttctgaattcaagaaaatgtaaacatatgagggttagttaattactaacagggtaattaagtagctgtatatacccctttgcagatattcatgtaactcacagttgaaaattcaagcctgtatttccattaaacttaagagaattgttaaaaacttgattttccccttaacttcttttgcaaggaa

SEQ ID NO: 21657 - DNA, 600 bp, Bovine  MMBT10857
atcctcagaaattcagaaaaaaaataagtactagaattatcaagataggtttcaaggagaaaaatgtcccaaagattagtgatgggagtggatataaattgagatgggagaaataattctcttcttcagcctcacaaagttggaaaactttttattatataataggctagagaggactcagaacagtgttctatttctcagatatggaagaaagtgattgtgaggttaaactcaccatagaagatgaactttcagcctgaaaaaaatagtcctccataaataaactccagtagaatctargccaagggtagaaaaagcaaagcactatggggaaaaggagaaaagtggatgacatggatattgtcctagaacttagtatctagtactaaagttactggtttgtcactccttcccgsagtctatatctccctgtatcagttctgtgaaatcagtgcgcctagaaaaacgtaatgacaaacttcaattccaaaatttaaactgacaagctgctgattcagtgacatttctcagggcactaaaacattaggaaacaaccttacaaagtgcctttccagtaccatcatcattttatttagttat

SEQ ID NO: 21658 - DNA, 600 bp, Bovine  MMBT09796
gcctgcttgtggggatatcattaatctctgtagcgtttctgctggtcactgtacttgcatgctctaagaaccattttctatattttagaggtttaatgttgtggtttcttttgttttctaactcaccaagataaaaatttgatttgttgagatttctgcttcgtgtgtggtttttaaatggaggttcataatgtatagcttttattatrtaaatgtttacttaaaactcaactcctaattgtggacttaaaaagaaattaaagtagtaaatttcctcatcctcatgttcaacattaaagyccagaaattraatttcatctgtggtcttaaaacttggtcatttatttatttttttcctgattttataaaaactgggagcaatctttttgctttgtgtacattttagtacataaaggatttgtgtgtatgtatatataggcttaggaaattgaaactcaagaacataagattaattttaaagggctgtcctaggtttcagttccatttatgaagccagtactatgctgtggataagaggttcagagttggactaccaggctacaaatgctctgccacacatgagctatgggacttttggca

SEQ ID NO: 21659 - DNA, 600 bp, Bovine  MMBT09836
agtccatggcccggaggttggggacccctggtttaaatcactccagaaatacttgttccccactcttctctcttttcctcaggtggctttagtctttgccagagcctgaatccccacccagaagcatttcagacagcttcacatgcacctgggggctccccatagaccttgttctgcttgggggctcctgcctgcccaggggagggctgggggactccgggtggctctctgtgggcaggaggaaggcttgggactggggtcatctgcctctggcccccggccaatgctggttctggtagrgtgcgtgggagaaactcctttctttctgctcatttccatgcaataggccttcagcctttctacattccatctatgatgccctgagacccagcccctggtgcctgggcacagggcactgaatccaggctccaagcccagccggcactggtggggcgaaaaccggctcagctctggccacctggcctccgggacggctcgctgaatccatgaatgaacgggccactctccagagagtggtgtcaggccttctcacaacctcttcttgtcagatcagagatggcttgctcccaggtgtcctgg

SEQ ID NO: 21660 - DNA, 600 bp, Bovine  MMBT06021
taattttttaaattacaaaagcaaattataataaataatattttaaaaattaactcactttccatatatagctataatatatattttaaattttattttcatgccatactctttttatatataaattgatcaaataatacatgttattctatatcagaatttcttcwtatgatgttaaattataaacactgatccacactgtcaatagaatactgaagagaacattcattgaaaaaatatcctgcagtttacttagtcaactttgtttgtagacatttagataatgtttagattttctcygcctgtattattacctgtctgcttgatctttaagagactccatgcattttaaatattaaagttttcttaatgattctagaaataaactatgggcaacctctactagtgaacttattttctatgtctccatattttaacatggatcatcatctaaagcctcagctttatttggatgcatgaaacaacactccattatttttaaaacaatatttactattatttaaatagtatttaatatttgctattgctaagtcacttcagtcgtgtccaactctgtgcgaccccttagacagcagccca

SEQ ID NO: 21661 - DNA, 404 bp, Bovine  MMBT10333
gtcagcccaagcatcaggtgggtcacacacacatgcacacacacatacacggctcctgtctcatgaagggtctctgttaccatggcagaaatcactgttgcatgtgtatatggatttattacaatatgtctctactgagtaaatctcacaaaagtaggactgacatagattattatccctacacctcagtgtgagcagagaggactgaccagagggtagaggggacatggtccctgctccccacaggcctgcagacgcctgctctccacacagggctgctcaagggccctcagtcatgtygtaatagaacacggacaattaggtttcatagcaaacagctcagacggaagattaaaaagtacatttacaaagcggtttgccaggggttggatgaagtttagaaa

SEQ ID NO: 21662 - DNA, 600 bp, Bovine  MMBT11303
gatatacatgtttgcttgaaagctagggagaccagaatctactttttgctctaattttgaattacatagcacttggcatattggtacttgataaatggcagcaattaacatgtagtttttatttagctctgttaccctgggaaaattatagtctcactttacctcaatttgtgcataagttaggattaacctatatttcttcaagcattttctgtgttctgagcattattggagcacatctgattcctgaaggaacttaagagtttagttgcacaggtaaaaccaatgtataggaacaamtagagataaaaatgrgtgtaaattctcataagtgcataggggttcagaaaacagataaggtaaaccattgtagcaacaaaaggaatgacaagggaaaacaatggtacttactctaggcattgaaggttacttaagatttggatgaatgaggaaatggtggagaggcaaaagggctttttgagtggcagggggacagcctgagccagggtgtgaaggtaaaaatgaatgcatctggtgattgcatttctgagacatggagcttatgatctggtgtaacgtctgaggattgcacataagtat

SEQ ID NO: 21663 - DNA, 449 bp, Bovine  MMBT12529
gaccttcataacagctccagctgaatttccttcctcaatccccaaagagaatccaccatcttaaatttttgcacagttgtcctaaaaaactgaagaactgaagtttgtaaaatagacttattttcaaaaatattcaaatgtattttgcagagattaatatgaaatctactcagcagtattcttttggaaaagcaactcctttaaacagtgagatgttccagcaccagagagaatttttcaaagcctgtgcatgtctgcacaaccccatgccagcaaaattcacatagcaaagaagctatyaagttagcttttagggcttacctaaaaatccatatagtattatttaatatggtagaggaatgtacaatttagtttaagatggctcacaattcccaaaaatcaaagcataaatcaccttggtaccgtaatcatttagaccaaatcatcat

SEQ ID NO: 21664 - DNA, 600 bp, Bovine  MMBT04623
ttacaaaccagaagcagaagattgtctgaactgcctatttctggcaaattactataatgamagaatctgtaaagttgtgaaagactttggtcttgttataagggtctttggctttctttttctcttcatcmacattccaaatcacttatatttgaattagggattttttttcccaatatatagtgtatactgttgtgcatcttgccagttttatttatttattttwtttttttacaacaatgaatacagatgggagcaatcacaggatgaggcaggatcatcagtccttccatgttttakagagagaaaaaaatgtttgactcctaattagcctttcttaaagggtcttaggaaagaaatagagatcccatgaaataaatttcctacaactctggggtataatcagaatcaaagaaccagaaagcaactgaaaccacacatgttcaataacagtcactaccactctgcttcccactctcttggccaacattgttaattgatcacattagcccaatggacccagatatgagtgaagaattgttctcaacataaagctttaggtatctatttccaactgacagttgatttaagttgttgaat

SEQ ID NO: 21665 - DNA, 600 bp, Bovine  MMBT05599
gaaaacaagttagagctcttattagagttgaaatagagagtaacaaaggcctgctttaggtggggtggtgtggagaggcttcttggagaaggcggtattgaagttgagaccggaaggaataaaagagctggctctgtgagttgtggggtgggggagaatattctaggcagaggaaacagcacaagcgaggccctgacttgtttggttgtgtaaaagaccggtcttctcagagtgaaccaagcaggggagagagtggggccagacgagaggtggcgaggggaggtaagcagaggccgatcmtacagagccttgagatctgggccggaagctggtttaacgctgagtatcctgagaagcccctgaaggtttctatgcagaggagtgatttgatgtagattaaaggagcagcaaaggtgaaggagagggacagatctgggcttgctaaccaatgggaaggatgtggaaggggggaggatggacacggcccacaggggtaatgcgtgtgctgctgcctcaggtgggaagactagaggaggaatgggtttggggtgggagggaagcaagtgtttagtctgagatactaaggtgcccggatcccag

SEQ ID NO: 21666 - DNA, 598 bp, Bovine  MMBT06778
  misc_feature (1)..(20): n is any nucleotide
nnnnnnnnnnnnnnnnnnnntgactgctgaccagagccgtcctcttcctgcactcccagcatggctctgctatcgccagtgttggccacgtgaaggtcaacgccatccacgtgggccacgcaagctgtggccccagaaaatgccactcgaagcactaggtagttgaggaaagaattgggatcaccaacttgagcctccaaggagatgtcattatcaagcctcttgaaagcattaatcaaagcctccttaacatcaatatcagtcgactccccagtgttgaggtcaataagctcttgccartaagtcctcaagctgttgaaatataacttggatgcctccttactgaagtaatcgttggggtgcttgtgccactggagaatgggcagcagggctcgaccactctctacagcattttcgatctccagcaaagtctcgtggggtaacaaagagacagcaatataataaaagagtctttcactaactgcctgggagcaagcacagcctgcgtggccatcaaaaacccccaaaagcatccctctggtctgcaagcaggttgctgcactcctccggtcctcaatgggtgcgtttgccggcagct

SEQ ID NO: 21667 - DNA, 600 bp, Bovine  MMBT03168
gtactttctgctcagttttactgtaaatctataactgctctacaaaataaagtctctttttaaaaaattcaggtgaggtgatgacactcttctgtatgtagagttcagtccatcctggggacacagagacttggactggcgtctgagccccaccacgatcagctctgcaactttgggaaagtccttaacccctctgacctcagtttctctaactccacaggattgtgttgtcttcctcagagcatttggaagattaaaaaaccatatgtaaaatgtctaacagtacttagattatacaastaaatatatacaaacccctccccaattcctcatttaatgactctgattattaaacatcctgatggctactaatttcaaagtcaggccagtggaggaaagtcatctggggtgaaagtgaccttctcccaggaagtgcacctgtgtatgggactggacatgtgtgtgctcacatgctcggtcacagatgctgaccacagagtgccaggcatggacttgagccccgagaggcagcctcaagcccctcactcagctttctcctgtgaaaaggtcaggatgatggaagtctgtcatatttagctg

SEQ ID NO: 21668 - DNA, 598 bp, Bovine  MMBT13089
  misc_feature (1)..(170): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttagctataccatactgcttcctccaagctaaaatgatcaagttttgaaaaggatattgcatgaataatgtactaattatcattttaaactgtgaaatttaattacctaatgtaattaaaggcatayattaatttggccaattcttattcttgtaattaatggcaaattagatatttaatgtataattatctgaaaattattaacctcattcttcaatgtcttttcttttaggaaaatctctgaatattgattaaccaaacatatcagtaaaacctgcaacagaaaataaaaatacaataatattccttttataaaaaaccttttataataaatataaaatttatgtttagagatcttgaagctgctaaaaaggaatgcattcatcaggatagattaatatctataatatacaattgtaacttca

SEQ ID NO: 21669 - DNA, 600 bp, Bovine  MMBT09428
taggctttattacctccctctaaaattcttgggccttaatcagtgcagatttattatagatatcaccagactgtcatgtgtggattatctgtccccttccagcacattcctgtgtctctaacataaaacttgtgtggctcagagtgttgtttctcaggagctattaaatagtatttgggcaaaaacacacattccttccccatctccaccctcaaatttccctctgggtataaacacagtttctctgagtaactttctgatggtcacttctrtttttttaaggtaagtatgtggtgttayattaatatttgaaagwtctaaacctcggtaatgtgtaatgggcgatgagcttgccctgaagagatccctgtgtgtctttttttggaaatagggtgcagatggctagcagggagtgtaggccttgaaacagtgtgtacccaagcccgctgcccagaggtagacttagctcgatgtgacattaaaatcacaagagttcccttgaattgagtacaaatgtcgtttcaggttatgtgggtgtgcagcactgtcttacactactggttttcttagttttatagaaagattgaaaggacatgaaag

SEQ ID NO: 21670 - DNA, 600 bp, Bovine  MMBT02841
ggctcctgagacggggggcacagtaagaggaatagagttgggatccaaattaccaggacaatgctaaacaccataagcattcagtttaccacagaaagaaggccattatttctgaagattctgccagtgattttcatcaaagtaaaattctactgcttgatgccaagaagaaatttcattattaactttggaattgatatctgcagctagaatattacatttgcttttcctccagtctctctcattcacatgtggacagacatactaattcaagtagttagatcttcagtggtctccaakaattaaattcaggcattgtttggtcgaataaaagtggtttactcttatctgcatgaaacattctccatcagttttgaatgaatccctcctatctcagaagtctcccgtaaaaccacagcctcagcagttatttgggaggccttgaactgataaccccagtcctttctcactatgagaaaagctctcttcctccatctatgagggtgtgcaagaggtgaatacttccttcacactggccttgcatagttttacataactctcagcactgcccaaaaggacacactccaagtcaagcccaca

SEQ ID NO: 21671 - DNA, 506 bp, Bovine  MMBT06075
gggcgtggggggaaggatgagtcatgccaaatgctccccaagctcacgggttaaaaaagccaagaacattcaattcctttcatgtttgcagaggagtttggtcacatccaaggtgaaagccccgagaagcacatccttgcagggaggcacatctggctgctggagctgtgggaacagagggccgaccgacccaggcagacgtggccgcccacacagacctgatgcacagctgaagaaatgatctctgggcctttgtaaacagggctcagaaaagcctccctttcaaaatagtgtgtgaaygtgctttgcagatggaaatgtatggatacaaatataagctgcctccacctccgctttcacaatggccatactatcggtgaagtcctacagtccttgccacgtgggcaaaaatgcaatattctgatgtaacaacaaccctgaatgtaggggtgggatgtacgtctgaggagctcaacatttaaccatagctttttcaaaacatcatc

SEQ ID NO: 21672 - DNA, 598 bp, Bovine  MMBT06113
  misc_feature (1)..(99): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgttgacagtgggcagggcacagcccgtcctagcccaggcactttctgctcctccgggaggaagcagcccttccccttggggacccagcattgtgggggtgagggtgcagggtagggggcttctgactggcacaggcctacgagcgccacaagaccaggttggcaggaggcacgtcgaagcgcttgcgggtgtggtcsgtgtcccggcggtacaggtagccgcaggtgggcttctgcaaggtgtagaaggggttcagggagttggagtactgggaggtgtagaaattgaacctgagcttttccgggttctgccctctggggtccaccaccacgggcacgtaggctgccgccagagtctgctcacggtcctgcttccacgacagggacaggggacggtgtggagccttcaccttttggcctgagggtgtcttcggcccatgactgggtactgaggatttctgtgagtcctgggaggaggaaagaaggggagagctgg

SEQ ID NO: 21673 - DNA, 600 bp, Bovine  MMBT14262
atcttaatagatgattgtttttctatatcatcgtaaccaataacaattattgtctattcaatgatatttcctcaaaaattctattctcactgttttattgagctattacctggccagataaaacaggttgtctctttctttagatcaaatatttatacattgcctttgtgttaactactgtctcataggcttgcagggagagagagagagagagaaagaaagacagagaaagagagaggcagagaatcaatgtatctgatttaaaatgaatacatttgatgctgtggcttgaacccaggytgtgagttgtgttgatttttggcctggtgtatatcatcaggaggcatttgaagtccctgttatctgatcaacataaaccttcctcactgccttgcgcaatgaatttctgtaatcaccagaacttggctgaggagttgcctttgtccttcaagaggccacagtttcttgtctgaacttccttttgttgccaattggggagggcttcagagaggaggaacatgaaggcaggggtgcatgaggaggtgggtttatgtgggtgatgaatgcagtttcataaaatgagttttgctaggagaacaa

SEQ ID NO: 21674 - DNA, 600 bp, Bovine  MMBT07528; identical to SEQ ID NO: 4674

SEQ ID NO: 21675 - DNA, 600 bp, Bovine  MMBT20488
gtcaatttcaactgtaaaaacaactgacaaacactagttttttaggcttggttatttctaagacaggttcttgaaaatgaatgaagtgttctttgtaacacgaaggaaatgaactgaaaatacatgttgtaaatggtaaaatttgagctttaagttttcggagaacttgtatctaccatcttgacagcttccaaatacttaacaaattttctcaaaaagattagtgatgacattaacaaatatrcatttttatattttatagtgaaatatgtcagccctaaataaactaaggttttccartctcagcactgtagacttttggagctctataatcctttgctgtgcactgtaaaatgtttcacggtatctctagcttctatccagtagatgtcagtagcagccccaaagtttgacaaccgaatctctaaacattgccaaatatttcctggaggataaaatcatacccagctaggatctactgagttaggtaactcagtaaatagttattttccaaatggccaatgtgtgacattacaaagtcatacatgagttcaagatccattgggggaataagacagacaaatagattttggtggctca

SEQ ID NO: 21676 - DNA, 600 bp, Bovine  MMBT09733
tcccccaagactgatgttttccagggagaattccgggctcctttctgcttctgggtaaatggaagggagctttgaaagcactgcaggagtggccctcaaaggagccctgtggcgaagtcttttgtaaagtgaacagtccttttgtaaggtgaataattgtgctctgattatctgctttggaggttcagagtgttcagagattctcaggggaaagagggatttgtctgaaggccatctggcccaccccgcttccaatgcttgattctctcaagcacccgctctgagtgatgcgaagccccyatgtggacccctctgtgatgggaaactcaccatcccatggatcattccatctttggacagctcagctgattagaaatggaagcgtatcctgagcttaaaaagaaaagtctgtctctgaagttttatccattgtctctgcttacaggttacactaaatataccttttgcttatgttgactcacttgatagctgaccacagtgaacttgacctcccccagatcttctcttcatttgtttctcgaatgcaggattttgagttctcctatcgtcctgatggttctgttttgacttggcttgctt

SEQ ID NO: 21677 - DNA, 600 bp, Bovine  MMBT02057
agagcttaacccagggcattcagctgatgttttataaaagaggtagtgaaaaaataaataaataaaaataaaagaggtagtaagtcagagaaagactttaattttgttgttgaacgttttatttaccttattttaaatgaaatgatcacaaactttgcagcaaaaatcatattaaaattcataagtcagtcttcctcattcatcacctacctcaccacctctcctctccttcccttcctccaactacctccttttctcctaacctttgaccctagacccccaaattcaacgtgttagctyggttcatactgatgggtgtcatttccctcgtggaagattttccatgcaaactcccttctttctgtgcacaaaattaggaaacatgtagcctgctaaagtgttaagatgatatatccagtgaaaagaggtcatttttaaggtctcaaggcaagactcttttttgggaatgtgatataatattgctctcattcatccagacccctttgatctagaatttgtaaccttttaacaaagattgggctaaaggttgctattacatctatgaaaataatatcataaggagtttgatgacattattta

SEQ ID NO: 21678 - DNA, 600 bp, Bovine  MMBT10193
agcctgagcttgaaatgttttacaagggcaatagggagccatgggaggtgtttgagcaggggaggctcatgttcagatcaggtgttataagaatctccctggggcaggtgtggaggattgcactggaggggtgaggtgggaggtgagagcccagagtggaggcccaaggaggtcataagcagaggtcaagtgtcagaaccttgttttgaggcatcgtcacctcttctctccccacagctgccgttgcccccaaggatgaccttttctatggcttcctgaaaccttggctgggtgagctcrggactgggtaggctggagctggggcttcagggaagagggggtggggcatgaggtttcctggaaaggtccttaacctcgatctcctgggtrtaggagatgggctgctgctcagcagaggtgacaagtggagccggcaccgccgcctgctgacgcctgccttccatttcgacatcctgaagccctacatgaagatcttcaaccagtgcgctgataccatgcatgtgagtcccaaggtttcttggggagaggatatctggaagtggggctggtccagactccagcttgtgggcaagtcatgcg

SEQ ID NO: 21679 - DNA, 600 bp, Bovine  MMBT09711
aagtctaagaaagaaccaaaagaaatgctggaaataaaaaacaggaacagaagcgaagaatgcctgcaatgggctcattagtagaccagactcagttgaggaaagaatctctaagcttgaggatacagcaatagaaacttccaaaactgaaaagcaaagagaacaaagactgagaaccagaacagaatatccagatcgtgagacaactacaaaagctgtaagatacacatcatgggaataccagaaggagaggaaagagatgaaagggacagaagaaacgaatgagaaatgactgagaamttccsctgcattaatgtcagacgccaaaccacagatccaggaagctcttagaacatgccagataaattaaacacacacatagaaaacaaacaaacaaaaaactacacttaggcatatcattttaaysctgtagaaaatcaaaggtaaagaaaaaaatcctgaaaaaaagagagagaaaaaatattacctgcagaggaacaaagataaaaattacatccaactgctcctcagaaaccatgcaagcaaaaagagagcagagtgaaatatttaaagtgctgacagagaaaaagcaccaaacta

SEQ ID NO: 21680 - DNA, 600 bp, Bovine  MMBT07562
atttgaggggaagattcaggccctaacacttctcatattggtgtgtctgattttacaccttctatccatttgtattcagccctatctttatgggggtcttggtgaatgatcagcagagatcccaaaatggaatgaatgtcccaggggtgttggagagggggaagcagaggggcctacccatgaccaccctgacctttgccccatggtggacctgcttagtgaggatgggaggacccagtctgctcagaatgcacgtgtttggggccggcaagggagctggtagtccttctagggagcgtrgytgattaatataatcatattaactggccctcaaacagacatatttatagccatggtgacacattattaaggatctaatttggatcaggactctgggaatcttayttttaggtccagaggagagccctgcagtcaggtgaccaggaggtctccccggagygttgtgtttattctgtccagttggaaactctcagggttggaagaaatttacaaggtcccatcaacccacccttccacatgatgcctgtatcactgcatgtgtccccactgagggaccatccaacctcctctaaatgccac

SEQ ID NO: 21681 - DNA, 598 bp, Bovine  MMBT20200
  misc_feature (1)..(127): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggatgcgcgaaagccgcagcgaggacgtgatgcgcatcaccgtgggcgtggacggctccgtgtacaagctgcaccctaggtgagcccgcgcggccttctgccggtccaaccctggtccagcctgccccttgtgagtttgcatccttaggggagaacccgggcgttggtctcyatctatgatactcagagagggaagctctccgaggtcccgagaactcttaaactctccgaactcccttggcccccagacacaggaggagggttcccttgttttaccccctgccgtgcattcagcgcggtaccggcagccaagcttcccctctacgcagcttcaaggagcggttccacgccatcgtgcgcaggctgacgcccagctgtgaaatcaccttcattgagtcggaggagggcagcggccggggcgcggccttgatctccgcggtggcctgtaagaaggcctgcatgctgggcca

SEQ ID NO: 21682 - DNA, 600 bp, Bovine  MMBT10278
gcctgaaaattcatcagtggataagaatctggacttgtcctttacatcccagcagtcacctgccaggctgtgtgacacccacctcagctggagacttggagtgcccccctcccgttctgtcctcagcctctcactggggccaaaactcgtcctggtctgctggggcctccagcgtcaggtcccggtctctttcagcccaggctttcttgcatactgctttcttcccttcaagctctgttcagttgtggacatcagggaagaagggggttggtaacttgcccaactccaggagtgagggasctggcagtaacttgggggttgaggtgaattctgctggacctctgatttccatcagagcagggattctgtctggtcactccttatgtcagtagcagcaaacagcaccagacatagcaaatgctcagtaaaatccttgacaggattccactcctgctggggctttgtttctgttcatgtcctgatgcaatcctctctcctcagcactgccccccagatattgaataccagctctccagcacagcaggcagaaaatgaagccaaagccagctcttccatctcaatcgatgagtcacagcctac

SEQ ID NO: 21683 - DNA, 600 bp, Bovine  MMBT21351
tgatctcctttagaayggactggtttgatctccttgcagtccaagggactcacaagagtcttctccagcaccatagtgttggcttaaggagcgtgcagaagaatggaagaatcagagtgaggtgaagtcaatccagaaatattccaagcactactgagttcaaaatttggtcctgagaagaggtaacaaatgagtgagtaataggtcctttcttgccattcctagccatgtgtggttgcccttaaactgactgcccaaacacatcagtgatcagcttgagaagagtgatatcttgagacytcaatcaaaaatataatagagrcagtgcacaggggcagcctgttggtatttctatctttctctctgccacatccgatggagagttgctgtagttcagtggctaagtcatgtccgactctttgcgaccctgtggactgcagcacaccaaactccctcgtccttcactatttccctgagcttgctcagactcatgtccatccagtcagcgatgccatccaaccatctcatcctctgtcgtccccttctcctcccaccttcaatctttcccagcatcggggtcttttccaatgagtcagctct

SEQ ID NO: 21684 - DNA, 600 bp, Bovine  MMBT05196
agatcaaatggctccaataagcgtagtctgtcaaaattcttttcatttgctttcttggtaatttattttcacgggtgagtggtttcgttattgcagtgcattttgttggcgagtgttggaaagtaaaactgaggtagatttttctaactgctcctaagtcaccctatactcatgatttctagacttcagagtttgttttgttttttctttttttataactgaaaaaagaaaaaggcattaagcttagtatttttggaagcatttagaccatttcctttcatttgattatatttacatagyagaactctataaaaaggatctataccaagccaattaccattccaccttgacataacttggggatgttctagaaacctttgtgctttgtagaaataaaatggaaatttttagtgttttatacacttaaagtgatagaaataaattaatttatgcataaaagaaaaatacattcaagtaaaatcaaataaaaatagacaattcttttcttacgcctttaagtttaaaaagtagcagatgatcaggaaaagttctgtattaattaacatcatggctaattatagacataaattttagagctat

SEQ ID NO: 21685 - DNA, 600 bp, Bovine  MMBT06418
catacatgactactggaaaaaccatagctttgattagatggacctttgttggcaaagtaatgtctctgctttgtaatatgctgtctaggttggttataggttttcttccaaggagcaggcgtcttttaatttcatggctgcaatcaccatctgtagtgattttggagccccccaaataaagtcagccactgtttcctcattctacttggcaaacaatttatgcttatgaacaacctagagtctgtaatgcataggttgtcactgaggaactcctggctccagccaatctgaatccacacytccaaaggtgtacccagaacatgccaagggcagcccactgcacacccatgctggtactggcttccttacccaggaggccttttcacactcccatttgcagatcttaccccttcttcaaggtctagtttaggatctgcttttctcatgaaacttcctataaatatttgagcttttttaaggatcttgaccgtccaacatctcaataatgatatccagcgtgcgttctcagtcacttcagtcatgttgaactctttgcaatcctgtacactgccaagctcctctgtccatgggattctccag

SEQ ID NO: 21686 - DNA, 600 bp, Bovine  MMBT10917
ttgtccccttctactcttgccttcaatctttcccagcatcagggtcttttcaaatgagtcgttctttgtatcaggtggccaaagtatcggagtttcagcttcagcatcagtccttccaatgaatattcaggactgatttcctttaggatggacttgttggatctccttacagtccaagggactctcaagagtcttctccaacaccacagttcaaaagcatcaattcttcagtcattgcctttgagctcagaatccagtggcagaggcagcaaagtctgtatcactgcactacaatgaagsaagtgtcatagtagatacatatggaaaagttttgtttcatccagggtggaatggaggaagtgttaggtgggtagtggtgatcagggaagtttcatagaagggacaacatttgagctcagtgttcagggatatatagttaaatgtcaggtgaaaaagacaaggaactaacaacagtccaggcagaggaaatgggacaccaatgactggaaggtatgcaagattatacagtatgggaacaattgttaaatcctgaagtgatttccatcaccccattccacgaaacatttgaggcagttttta

SEQ ID NO: 21687 - DNA, 600 bp, Bovine  MMBT04878
aaatagcagatgtccttaggaaaaaagtgatcctaatcgccaagcttacctgtctaagtctcagcttcttctccaatcttggccttcaatcctttgttagttttttagtacattcaaatagtatttagctactttttctgatctttactcagcttttctagagtttttagcaggagtgttaggagttatttaatccactattaccagaaatagatgtctgaagtttatrctttgtaaataaccaaataaccaaacttcaaagatgtaaattgctataacacagtcacataaaataagtargaccataatactaaagttgtcctagaatgttgtacctttgctagaactacactaatatatagctgaatggggagccacttttcctgagagtgaagcaagattttcagtcttacctaatggtcagagtttctttctattgggttgtcagtttctatataagatattactaaaataaaagaaaaagaacacatattcaagagaggatacacactctcattcatagaatgtcaagcttttttatcagttccatatgatgagctatcatcatatatggaataatctgtgttgattttcttgatt

SEQ ID NO: 21688 - DNA, 600 bp, Bovine  MMBT03282
ataaggcagaatgactgcaacaacatcttttgattccatctatttacaatgaagactttagcactcatttctttaacctcttatcttgactccaattatttgttaagaggagaatttagtattagatctgtgtttttaaatgactagtttttatattatataaattttcttttgtgcatattgtttcttcacatttgcattcattttttggaaacaatacttccatatttggcttcttaacacaacatcagccagaagaattctagtgtggtgatgggctgggtgcaccaggagagccarttagtacccccttgggatattttaagagaaaagyctgtaacaaggtactggaagacatatctctgtaggcagtctcctagatttscccytaataatgtgtgtgcctaactgaagagaagttactatarcagatccttttatttcagtatttcagcatccctaattgtggtgtcagaaagaatcttagaagcacagagataaatgggagactaatgtgaagggaagctgattaaaaacattcagtgaattgagtttggaacgttttttatttgctacaaaagcacaaagtggcagactgac

SEQ ID NO: 21689 - DNA, 600 bp, Bovine  MMBT04511
ctgttacccagaagcctctttggacttctggaaattcctgtcaactacatttgaagaacgattctcttccagttgggaagggccttctcttaaactgagcatatgaaaccgagatttatcaaactcaacctggctaccattgtggtgacagatgtcccagctcaaactccctcagacaatcctggagtggctctttgcagttctacatgtgccaacagtcgttttcaaacactgcatttttttttgctcatgttctccttgcttttcatgtgaacttcatcaggtagctctttcccctgwatatgtgatttctgacttttaaaaccgggaagagcaattctttcctcttagatcactgaaagtctgacaagttgaatatcttggtgaacgtttatcagtatttgggagtactgaccctcctgctccaagtccagaggtcctagtgttgttcacctcctagccccaaagcaaaagaaccttcctttgtctcttttttgaatactttggagaattcctagccagtaacttcatttccctggaggaaatgcatgagagccagctgctaagtgccggtgtttgcatgcacctgtttgtttattt

SEQ ID NO: 21690 - DNA, 600 bp, Bovine  MMBT09493
ggtcaggggatcagtgtagtatggtggtcaggaacatgaactctggagtcagccttcctgtgttcaaaccccacactgacctttggcatttaacttcacttctctaggcttcaatttccatatttgtaaaataggacagtaatagtaatggtaacaatcttggaatgttctaggtcaggtagagatgaattgtgagaactagagcattgagggagcctctgtgactgttatgtgctaatgatgttgacccagatccttgcttcttgcagcctggcctttgttcatcatagtcctcaattrggggaatcagcttcccacctcattggccagtggaggtcttaccagtccccaacccataagatagaccattttaaccaggatccagtcaaaagtgtagaaatcacaccaggtcttccaaacagaatcaggtttattatggagaactggtgacaccggtaatgcaagagccaagaagccaaacaaaggacagtgaggtgagcmagaaatcagcatcggcaagaagtcactatcgtctgaggactggaaggacatgagaaaatacagctctacagatcccagaggccaggcttccaggtaggt

SEQ ID NO: 21691 - DNA, 598 bp, Bovine  MMBT09292
  misc_feature (1)..(150): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcatgaatactaaatttaacaattaatgaggttgatataatgttacagttggacatttgattaaggatttattgatttcaattttgcagtgttcttattttagagcaggtaatttttttccagctgtcaaatattcaaatgatgcccytgtgkaggctcttgtgggcaatatgtgagcaacctgggccaatacgtcttggccatcctccacctgaagcatacatccctttatacacacagacacagacacacagacacacacacacacacagagcctatgtatatggacacgtaattgttaggaattgtgttaagctactataacaaataaacttccaaatttcagtggcttaacacaatagattatttttcatttccaaaaacagtctgatttggttccaggacaatgatatcaaggatgagggtgtgttaaagagggggtagac

SEQ ID NO: 21692 - DNA, 600 bp, Bovine  MMBT10072
ccacacacacacacaaacaccctgtgggagtggaatggcctaagctcagatgccaacaaaaggcaagtgtgtgtgtgcgcgcgcctctatgtgtttttatatatgtgaatgtgaggaatggagataaaggaaaggtacgtgaatgactaaatagttacacttcagtgtgttgtaacattttttaaactgggggtataattacttcacagtgttgtgtgagtttctgccatccagtgaagtgaatcagttataacacacacatatcccctcttttttagatttccttcccacttaggtcaytggtgagcactgaatagagttccctgtgttatatagcaggttctcattagttatctatttgatacatattactgtatatattaacattttttttcagtgtaaagagcattctagggtggaaagtcaaaagaagtctattaacaaggcaaaaagggagatagatgtacttccagaaaaaggaaaaacagaagaaaaracaaagacagtaaaacaagtgaacactgttctcacatctttctcctcttccttatctgtaatttttgaatcattgggtaattgttcaggtctcctttgtctagt

SEQ ID NO: 21693 - DNA, 600 bp, Bovine  MMBT11562
ttcaagtttctaatctacccccatcttccctggttatgagtgtgacaatattatttctaagcaagccatgctcaatrgatctcatcttttgttcttctttttctttcaaatacctcagataagaagtaatggtctgctgctacagacgtaggcagtttcaatatcagtcactcagtaaatatttattgagtatttgctatgtgactggcagtgtgctaaggactgggtctatttccagagacatacaaggtacacagtccaaggcaccacaattttcctgatctcggaggacatgtagtrctaacatatatttattatgcagtcgctgcaatccaggaattgtgctagaaactgggaatacaacatgaattttaaaaagaaagatatctatctttatggagctcatagtctaacaagggagaaagacacatgttaaaaattatttacagttcattcaaatatgtacaaaatgctctgggaacagagaggagtgaaagggattagttctgcctcgggtaattgtggaaagcttcacagagatggtgatatttaacatggagtttaataaattagtgttaattaagcagagaattaataata

SEQ ID NO: 21694 - DNA, 600 bp, Bovine  MMBT15103
tgatttaatgagagactgtagtcaaatggagtctgagattttaagaagcctaggctatacttcatctgttgtgtgaccttgggaaaattatttaacctcattgggtctaaaaaaatggtaacaacagtgggttaattgtgatgattaaatgaagcctaaaatttttttgagagcagggactttctcttcagtaagtatcacatatgaacagtgtgttaactacagtatattcaataaaacaaatacttgttgaatgaatgaataatgtgtgtaaaatacctagaccagtacaggcaaccrataaatggtatctaaataacaattattagcaaattagctatatatctttatatatgtgttatatagaacacatagaaatttgagagcatatagtagatcctagttgactttaactgtttattttttcattggacaggattgaagatgtttgattgagtttactgatcagaatttttttttccctttttatcatttgttttttctttttgtttttggccatgcctcttggcatgtgggatcttagttccctgaccagagatggaaccatcacctccagcattggaagtgcatagtcctaat

SEQ ID NO: 21695 - DNA, 600 bp, Bovine  MMBT09885
agaggagatggttagaaaaaacgttttttaagaaccagtggaaagatgccggcaacccttcaccagtgacacaaccttcgctagtgtaacaacacacaaatgcagtgcatagggcaaaaactcctgtcttcccaacaatactggcagtaatttttaaccagcattctgcagcaaaaggtcatctattccacatacttttgcgtgaacttatcattttctctccgactcagagaagctaccgcctgatctgtatttttctgaggggaagccaggggtcctgtgcagggatttctgtgcccrtggatgcgcatgtactggctaggaaaaagaccctgctggtatcagtggtgacttctgccactaggaaatggatcacaggctcttccggagagtggggactycttcccagccagaccagtcatcacagaatccygtgcaggtcgccttcgtctcccagattaacttctaaagtgccctcccctgaaatcagaccactcaacaccccgggcagctaaaacagtccaggcctgattctcgccaagaaatgttttcttgaaggagaggaggaggaggagatgamataggggtgaaagatacaag

SEQ ID NO: 21696 - DNA, 600 bp, Bovine  MMBT12595
tatactcaaccagaacaacatatcactacagaattgaatgcaaaaagcatatatgagaataaagctgacttctgttaattcagacattaaagctttgcaaaaatgtaaatcattgccactcttctcaccaaatctttttgttttggaaagtagttatgttttcctaaaatgttatttatgttaacatgtaatggattttcttttttgttaagtgaattaatatttttaaatgtttgcagttttaatttcaaacatgataaatattgataggaataatcaactttggagtcctgagtaaayagtaggaatataaagcggtcctacttgtgagtagcatataaaagcccaaactagaagttctgacctgaaagaacagagttctagtactggctgccatgaacctgctgagtggccttaaataatgatttaacgtctcaacatgttctaattcatttagtcagtccatgtcatagggctatcagaaacaaattaaaggtaaatagtattcactaggatttttttttttttttttttacatcgctcagttgtgtctgactctttgcgaccccgtggactgtagcccaccaggctcctctgtcc

SEQ ID NO: 21697 - DNA, 600 bp, Bovine  MMBT22298
aggagcttctggacgctcggggattggcggagccctgtgtgagccccggggcatgctgggagccgcagtggcctgggaacagcagtagtgtctgagccccggagcccggcgctggggggggtaacccgagccctcggagcccttgaagctccgggggcggcttagcttcagtgttttggctgagaacatccttaaagcttaaaataaaacctgcctgcggggtgtgggggaggacagaggagtatgcaagtcagcgtcatcccactccctcagttctagtctgtaggacaggatgctgarggcttggaccaaaggagccgctgatttggggttgcccacgagcagattctccagatccccccaatctacagcccaggctagcccctagatgcaccccccctccccccaccaccgcgcaacatacttacaaaggaaatgcaggcggccaggagaaggatccgcaccaggaggtcttcaaactgctctaacaccagctcccacagggacttccctgagggcagaggcaaggggaggggagggaagtgccgggggggggggggggacggcggtgttaaggtctaacggatgaatgcagggact

SEQ ID NO: 21698 - DNA, 601 bp, Bovine  MMBT05362
  misc_feature (1)..(1): n is any nucleotide
ntagcttttcttccaaggagcaagcatcttttaattttgtagctgcaatcactgtccactttccasttgcaattttcttgataatattaagtcctttgaatcagaaaattttgtcaggaaaaaaaatttgatagcctcagtcctttagattaacagtttaaatgagttaatagataccttatatttatatttcacaaccatttgaaaacagatggtaaacatgaattttccatcagtgagatttcttgatggtagaaaggattttactggtatggaaataattggttttggtttagggaayactacttcctgacctgatgaattaatcactgatgaaagatagtactacaggatttttatctgaagcttatgttgttcgattatacttggctcctttttatcagggaactcactggctagagtgatattgacagatttgaggttttgtcttaggacaagccactcacaagcaccaggagcccactgaatatgagattacagacttctttgcagccagtaaaatgcaagatgaaatttgggccttgagacagaaaatgaagaaactaaagatgggaaatgagacacagaccaaataagaatt

SEQ ID NO: 21699 - DNA, 600 bp, Bovine  MMBT15293
tgcgaccccatagacggcagcccaccaggctcccctgtccctgggattctccaggcaagaaccctggactgggttgccatgtgcttctccaatgcatgaaagtgaacagtaaaagtgaagtcgctcagtcatgtccaactcttagcgaccccatggaccacagcctaccaggctcctccatccatgggattttccaggcaagagtactggagtggggtgccattgccttctccagggaagctagggaagagcaaagcacatatgtccaaggtaaccaaactagttgttatattgtttgamcttgaaaccagatcccctgcctctggttgtgatgcccattccagctgcctactcwccatctgtccctacaaaaaaacagctggaaaacacaagttgtttaaacttcagtcaattatattaatatctccatattaaaatgactaaaacaaagcaccattttatgctctttaccaaccccccccaaaaaaaaatatttccaagtttcttaaaattccctgatgtggcagagtaagatagccagggtgggtattagtatctccatattagatatgggaaaattgaggtttccaaaggtttagt

SEQ ID NO: 21700 - DNA, 600 bp, Bovine  MMBT03613
tgaatcactgaaataacattaaaaatggtctcctgagtgctaagatttccctttccaaatcattgtctggatttggaacactgctccaaatagctttgtgctttcctgccttctatgtcttctttaagatgttcagattgttctgatgcttagaaacctctttcccactcccatacctgttactcaaagtactgaatcatttcttgctgtctagctcaaattccatgaaccatacccaacttttactccttgcaattagtctcattccttagctgtttttcctctaaaacattgttgtayctctattattgttcttactcartctgttgcaagttatatatcatctttgattcacccaaaacatctatataagactttattcatagtagaggggcaataaatgctattttaaattttacctcaaatggcacaaagttggatcaaatcagaatatctgataataccaaaagtaagacttataagatgcttactttgcagccattgtaactcgtatatttccataattttattatttttaaatttatgtatcttacagccatttaaaatgggtcttaaacttcaagatcctacttattattt

SEQ ID NO: 21701 - DNA, 600 bp, Bovine  MMBT15977
cctcttgagtgcataccaaattgttactctactctggtactcttgacataaaaggtttgttcagtgcaccccttaaaatgagamtaattccctctaactacatttgcttaacattagacccaaaggagtgtttccttatgcctctgacagaatttttagggaaggcagcttcttctatttctatttgcagctcctctgctcaaaaatcagatatacagccatggatcttagtcactagtgattcaacaaaggtcaccatgttgcacttaaactttcctactttcattcattcagggttgyatctttccaaggagattaccaaacttttacctagaaagacctgtggtagagttccacacttacctgaactagtgattacagcagtgcttattgagagctagcttttcaacaggtagaaatttgcaccatttgratttatattgagatcttttattctgacctaagcacctgaattgtcaactatgctagaaaaggattctctggcctaattctgaatttaaatgtagaatttgccttttcccacatctcttatgtgttccctttcggttcttaattttcctgctgatcacttgttattcc

SEQ ID NO: 21702 - DNA, 600 bp, Bovine  MMBT11786
acactgacttgtgtccctgtatctttgaactgatgcattttatgttatgttagcttaactatttcctcctcagttagtaaaggctcttctcctgagaaagttagattttattttcttcccagaaagctaaccccatgaccttaatacctttctgattttaagaggcgggatctctttaagtgtcaatgcctgtaaagttttctttaagaagctcaaatagaattatctaccgacatttctgataattttctgaagcaataagaagaggacaaagatggacacatcctttaaaaaggggascctttatcgtagtagcattggttcatctctttctatagaacttgaaagcctgtgctcagtaatttatgttaatgctttattttcgaagttttctttcttccataagctcttcatactttcaccaagaaagtatgacctttcccctctttgaaatttaccctccaacctacccccactctccaggctagcttttcattagggaactggggagacataccctcacgttgctatgcattgcgctctggtggcaggccttcctgacaaaaatcaaagagctgctagtgccggaaggatgaactc

SEQ ID NO: 21703 - DNA, 600 bp, Bovine  MMBT13675
gaagcccccgttccttcacctgtcctcatttataaagacgagttattaaaataaatagaaagcttgcctggctttttaaacggtgaggctcgccaccctccataaaagacgttagaacacacatcaccgacagggtagaaggtgtttcaacttcatcaaaagccttgaaaaggaggacatcctttgtatccatgctttcggaagttttgcaggactggtatttattttaaatcagaactgctcacaaagcgaactccctttacaaaatgcataggatgaagccatcctagagatgacctytaccgttcgagcctggacagagatattatttttatagaaaaaaaaaaaagaggatatctttaatcagctttaaaaaaacattgtgaacagtcacttctcttatttaaaagtttaactttactttcatcaatttataatcagagttcctctggtatgtttgattcctgacaaacaaggataaaagtcttgtgcccccattgctaatgagatgataaaacagcagggatcaagtttttaattactacaggcaatgcactggagaggtagcgatgatattttctattgcatgtctaagttgta

SEQ ID NO: 21704 - DNA, 603 bp, Bovine  MMBT00818
  misc_feature (1)..(3): n is any nucleotide
nnngatattatctaatgagcacatggataaagaacacagatttgagtcatttaacctaggactttaaggtttttgcttcatttcttcatttgctcattcagtaaatgttgacaaattccatatctgaacaggcacygtgctagttgatagataggaaaggataaaatcatgaccacaaatgacacagagcctgtcctcagctacattataatttagtagggaaaacacattatggtaaatacccatttgtttkttttttttttaatttgtttgttgttttaaagaaagtggtaagtataatamgggtgattggagagagtgttttacaagtctaggaagaggagaaatccaatttattctgtgttcactgaacacctattctgtgtcaaacacagtgccagcrgctgtagatgcaaagataaataaaacatgattcttttcttataagagttcttagtttatcaggattacctcctcctggggtgcagagagtgtcaggaaaggatttctggaagaagtgacattttaagttgcatcttaaaatgtaggtaaattttgacaaggggaagaaggatagagctttccagggagaggcaaaagcaa

SEQ ID NO: 21705 - DNA, 600 bp, Bovine  MMBT03118
aacccaggtcttctgcattgcagtcagattctttaccacaagggaagctaatggatatgctaatggaacgccttaactatttgattatttggaaactaattggaagcagtatgtatgttctaaagtacattaaaaggatattgagaaacatgaacttttgaccattaagggactgttttcatctataaaataatgagggttagtctaaatgagcttaagctctgacatcgagagtctmtgattatccagcgtgtgtttctctgggccacttaccttttgttcacctattatagcaacttyatttgttggcagtacttctggaggctacaggcaatcattactaatgtcatagttacctcaaagtcccaaagctgcttactcgmattggaatacaacgtctgttgctgctgctgctgctaagtcgcttcagtcgtgtccractctgtgygaccccatagatggcagcccaataggctcctctgttcctgggatcctccaggcaagaatactggagtgggttgccatttccttctccaatgcatgaaagtaaaaagtgaaagtgaagttgctcrgtcgtgtccgactcttagcgaccccatg

SEQ ID NO: 21706 - DNA, 600 bp, Bovine  MMBT10902
atttatgggtttcttaggaaatgtgaattgtatgatatttcatgggggttcttagatggaaaatttcttagaagatagctgaaagagatacagttttgtgactaaggagaagtagtattagaaaagaaagaaaagggtctagtttagagacttgtttgaagttaaactgattctgtaccatactttgaaaattaagtcttgtagatgaatgtgtcacttcataaaattaatagttctcttttatttttgataacttttgcagttgctttgtattcccagtctgtttatgtttgtggtatrtcccctccaaaaatgaatactgtaggtgaattcaaacctttggagaaatgatttcagcataatggcagattttactattttgtaaactaaggtttcttttccctctttttcttcttctagtgagagtgagtagtagacagctgatcttaagaggactgtgcattttattttcatacttagctgttattttaatatttcattgaggaagttgtgtgttttcccccctagctagttcactttagaaaattttgttggtgtcagtatataaacaactgagaggttattaagtaggtctattca

SEQ ID NO: 21707 - DNA, 598 bp, Bovine  MMBT13402
  misc_feature (1)..(13): n is any nucleotide
nnnnnnnnnnnnntgaacctccctccacctccctccccataccatccctctgggtcatcccagtgcaccagccccaagcatcctgtatcctgcattgaacctggactggtgactcatttcacatatgataatatacatgtttcaatgccattctcccaaatcatcccaccctcgccctctcccacagagtccaaaagactgttctatacatctgtgtctcttttgctgtctcgcatacagggttatcgttactatctttaaaataagtttaggaaaggccagttcagtggtgttcaacargattttttactctaggcctttttacttcctggtcttgaagtgcatcatgtatctttatgaatctccaggaggctcaactactaagcccatgtgcctcagctactgaaggctgagtgtcctagaacctgtgctctgcaataagagaagccagcacgatgagaagccctcgaagtgcaaccagagatagcccctgctcgctgcaactagagaacgcctgcatgcagcagtgaagacccagcacagccaaaagttaaatacataggtaaaattatatatatatgtatgtatgtatgtatat

SEQ ID NO: 21708 - DNA, 600 bp, Bovine  MMBT10301
ccattgttgtgggctggctgcttcttattcaagtggtgtgtttgtaggaaataactagtgccataaagcttcctgacaaaaatcacatttctattttgcaaataagaggtttttatttttttaatgtcacagcaaatgagttcttctttggaattcgcctgtgcttttcttaatattatctgctggcagtggctttgtatacttcattgtttccacagaacatattttgctatatgtatctgaagctgtataattgcacctcctggttgtaaatcaagagttggcgttaattaacagttrgtgctgtaatgccccactgatraaacaaatgtacccatttcttctctgaagaatcagaagtggcaggctrtcacttcgcagaactttctcatttccctaaactcrtaataaagccagcctcgttgtctcttcaggctactcagtcagcatccagcagyttgtgtctgtgctcattccatatctactctcgctcttctgtttactgaagcgctatagctgatttcaggatcactttttaaaaataaacaattacagtactttcgaatttgggrttttacccaaaagaggatctaattatcc

SEQ ID NO: 21709 - DNA, 600 bp, Bovine  MMBT13522
actgttgcctcttgacctgcatacaggtttctgaggaaacaggtaaggtgatctgctattcccaactctttatgagttttccacagtttgttgtggtccacgcagtcaaagactttagtgtagtcaatgaagcagaacagatgtttctctggaattcccttgcttttctatgatccaatggatgttggcaaggtcttacaaaggatttacaaatcgcttcctaaaggcctactccaacttgaagatgcattttgttctgtttgtacartgacgtttaaaacttgtcattatttaaaataygaatttgacaactttcaggtcatgccatctcccctccaagctcaccacaggcctcaccattgtttatggtcaaacacgcctgctgtttcaagtgtttatattatctgctgagcccctagaaacatttgagttcacagcctgccttggtcttgcaaacagtccctctgcagtacactctggttaaccaacagatccccacaccacctctgcccagcacttactctctgcttctcatttaaaaaacacgtctcatcccaatagctccttcctttctctgtttttctgttctcttccctcaga

SEQ ID NO: 21710 - DNA, 598 bp, Bovine  MMBT16875
  misc_feature (1)..(50): n is any nucleotide
nnnnnnnnnnnnnnnnnnnnnnnnnnnnnnnnnnnnnnnnnnnnnnnnnnaacataaaactggatgaggagaagagggtttagaggctggtgctttagtgattacttgcacagggacttccctggcagtccagtggttaaaacatcgtgctcccactgcagggggcatgggttcaatctctgttcagggaactaagatcctatatgctgctcagcaaggcaaaaaagaaaacggacacagatgccatagactataactcactagagtcacaggaacagtcctcattggaatatactttcrgagagctattttattattcgtttattttcatatttatgtatttaaatatttatttatttgtctgtgtcgagtcttagttgtggcacatgggatcttcttgagtcatgtaggatctttctaggtggcacacagactctctaactgtggcacaggcttggttactctgtggcatgtgggatcttagttcccagaccaggaatcgaacccccatcctctgcattgcaaggcagattcttaaccacttgaccatcaggaaagtcccctcttagtagtattttaggcttttggctcagcttct

SEQ ID NO: 21711 - DNA, 600 bp, Bovine  MMBT14191
gtcttaggtaagtccttcatttgttttcagccgttatttgtctcctggacatccattagccttcatcagtccttgctattttgaaatcaattaagatctgatacataaaagtttactaaaggagaaaatttcagagactgacaaatcatattcttaactgcctctttcccaaacttacccccaatgcagctgtttcactgatagggttggggtccctttagacgggatgtcatggtgtctccagatccaggagatcttgttccaactcaaccactgtgtagccatgagtaagctcttccytctcattctccctcattctcctcrtctgacaatctttagttggtgggtctagaattatagagtcactttgtgtaaagtttcgtataaaccaagaggatctatcttaatgctttcccatcaaactctcaaatttacctgcgactctttctatcttccttcctttctccccatgagagtgagcagctttcttcatacctaagatcaactgtttgactgttgcttgggatcacagtctccatcttctaggaaatgggtcttaatcatgactgcacattaaatcactttgtgaacttttatttt

SEQ ID NO: 21712 - DNA, 600 bp, Bovine  MMBT06673
ttgacaaatacgtcatgaaattcttagtgaatgaaaacaagcctaagattagaagccaggcttactctatctatagtctcttaaatctgcatctgactcccaggcatcagcctgctgtattccactctgtatctgtatttgactggaagcgttcacaaatggggaagacataaaatatttagagcccatgaagcactcaggactgtcaaaaatgatctatttcacatacatggccatgtgctggcgcttttagggcgaatttgtccatttatgttgaatatacctacagtctttgttctyttggatttcattgagttctgtcataaaactaacaataagctttgagatgcacttgagttctgtttctttttcctttcttttyccccccccagcctttgagtcatgtatatgtgattgagagaggcagattgtgtcttcagaatgagtgagttttaagtatttaaatacggtaaggtttgtctatagtggctcagacrgtaaagcgtttgcctacaattrcgggagatctgggttcaatccctgggtggggaagatctcctggagaaggatatagcaccacactccagtattcttgcctgg

SEQ ID NO: 21713 - DNA, 605 bp, Bovine  MMBT10011
  misc_feature (1)..(5): n is any nucleotide
nnnnnaccttcccagattagaacaatgtcttttcaggataacccmatgagggatggcgggatgcccaggttcaggtcagggcagagraagtgggtgctaccctcctccagcaccagcacacacagaaccctttattccaaagggctgacctcytgcaggcaggctgagagcrgagatggggagccagaggagagatgagcaggagcagtctgaagaagacccatcccagcccttcccaaccctgagtttgtgctggtatcacctgcatagcttttgaaaaacaccataacaaaaatatggatgcmtggaccaatttctgtctcaggggctgrctgggaacatctgtgttttgaaaccccccaggtaaattttatagcagccagggctgagaactagcatcttgcaagatccaagactcctgctgttacccttggaaggctgtgctttaagcggttcttcaggggcaggacttgggctctgtctgggcagggactccagggagcaaaagagggaattttcttccaagctgcctccygagcctgacatggggaggggtcagaggctggggtcttctgccagggtattcaagcagtgtcatccccacc

SEQ ID NO: 21714 - DNA, 600 bp, Bovine  MMBT03068
agtgactgatctgatctgatctgatgcattagtactagataatcataagttaataaacatcagggaactcactgtaccccccagagctaggcaccttaaactctttggggaaacagcttccataaatctaacagtcaatgggtcagcctctctggcagaagtctaagaggttatttatcacttcctagatcccataaggactaaggggtcaaactcccttttagtgatgtcactgttggagaaatgtgtcctttcttaggttaaaaaaaatagtcttcctcagcagccatacagcccaayactgtacctgcagtataagyatttcatacagccactctgagatccttcttacattaaatggctcattcacaaccatagccaggctaaaaaggatgcaggtcagatttcatccagtggaattaacactgggacaagaaaatgtctatataaggctaagttgtccctggggtcctaatagaaaactatttcaggattgttttcagggattctcccctacccccaccccagtctgggcagtaagatacatttaatcacccctttccccaacaagttttattaattcatccattcttgagttat

SEQ ID NO: 21715 - DNA, 600 bp, Bovine  MMBT01363
acagagttgtcagacttttcttaacctcttcaaaaaaaaaaaaaattctaactctatctataattaacaagagacttaaagatcacagtgttactttcaccaggcaagcactgggatcaacagagcaacagaaaggtattaaagtaaacttggcttctatttcttctgacaggatcccataaatgggaatgaatcatggccttttttctgtcctgttttcactcatttaacttattttactgaggacttactctataatgaaaatacataatgaataagacacgatctctgtcgttacgkatattaatgttacggaataataacagctaatatctactaagctcctattatgtgcccagcatcatgttaagaatttcatatgcataattccatttaatcccgacagcaatctcagtacrgtgttacctttccctttttacagagragaaaactggatcagaaagggtaacttgcctgagaacacataacaaaaacacagatctagggcttccctggtgactcagtggaaagaatctgcctgccagtgcaggagacatggrtttgatccctgatctgggaagatccctcctgcctcggagc

SEQ ID NO: 21716 - DNA, 600 bp, Bovine  MMBT11890
tgtcaagtgagctcaaaagtcccttatgagctgcaaaaaggacaagcacttattacctttgaaaaagaagaaggtatgactaatgttcaaaaacttgaccgtgttacctttagaaagcactgggacttccaaagagtttttgtagatatttggccattgctttagaatttttatatcatttcgtctcatcctcacaggggtgccctgaggtagatatgattatccctgttttacagaccagaaaacaagactctgagatgttgagtgatttgaacatgatcactagcgcagaatatgagygctctagaaagcaaacccgtgttgtgatgtccaatagcagcatttttatactmctcctgctacctgcaaatgataatactagtaataatgtttcaaggtagcaaagcagagagttctgacagacatgatctcattttatactcacatgactctgtaaaagtaataagatagagatactatttacatcattaagaaaccagattcacagatgtttaagtgatttacctaagtgcacaaggcatgagggagaaggcaatggcaccccactccagtactcttgcctggaaaatcccatggatg

SEQ ID NO: 21717 - DNA, 600 bp, Bovine  MMBT04856
atcagagttttcaatatttatgtcagtgcatttatttatttttcttaacaatttataacagtataacttaatgtatccaatgacaatattaccaagaaaggagtgtatgaaatcaaaccacattttcacttagattcccatcctgaccaatgcttcatcactaatgaagcattagcgatgcttcatctttttctttttttggccccrtcatggagcatgtgggatctcagttccctgactagggataaaacccatgcctctgcagtggaagttcagtgatgcttaatcttaatttttaayagattttagttggaagtggctcctcacatgtcacttctggtccctgtcactttgcttttagtcatggcttttattattgtttcacaatgaactgtttatacccctcattatttttattacaagtaatcagtgaatcaccatcaacagtacaaaccataccatagaaatataaaggaraatctacattttcacagtattttacaaatttcaataaagacatctttagattattgttttatctgtgaaatccaatcaaagtagtattattgttcaaacacaacttcaagttgccctctctgt

SEQ ID NO: 21718 - DNA, 600 bp, Bovine  MMBT22916
ttttagctgacacaataaaaaaaatgccattaaaaaataaataatgcatagtatttgaatccttctttcaagaaaaataaaaacatcctgtttcagttatttcagcagctcttctaactgctgaatgcttgcttctccaacttgyctcttctccctcctcccagaaatttgtctggttcatgaaattctttcctggtccatgttcacactgctattgtgttctattaaatgtgggatatcattacagcacgtgtcagtcatcagaaaaaacccaactccgaggctctgtatgtgtgtacrctagctcaataaattttagacaacagatgtagccgcaggttccaccttctgccactttcccagttcaataagaggtccagatggttygctttgccctggtgtcttgaatcttggtatgaagatgctgactctggtgatctttctctggaaccttcctttgacccataggtccatggcaagctaagtgtcaatggagactgccttgcacgtatctggccatttggaatcctgggtcccttaacagttaaaaagcatcttgaagtctctcttagcattctgcatggagaaactgtcgaatta

SEQ ID NO: 21719 - DNA, 600 bp, Bovine  MMBT01700
tataaaagaatctcccttggtgcttcaaaagctaaaatgttccagtccatacacatgtagctattatttttcaaattcttttcccattgaggttattacagagtattgagcagagttccctgtgctctacagtaggtcctcgttgattttctgttttaaatatagcgtgtaatgcagtgacttttaatggagtttggcagcaaacttaccaatatcagcatacctgtaacaggagacttggtggtactaaactcatttgtgcaaacatctcagcctctggctatggagacgtgtgctgaragacacttggctatgcagaatacagaaaacatttaaactaatcacagtacctctgaggattttgtcctttgtaacgcttttactcatggcacaatcaaaacacaaaattgatatttcttgtggtggtttgtgctcttagcaaagtcctctgtttatcttccttatggttgatatttcatccccctacccaaatacttacgctctcttagccaaaccccagttctttacacactcaaagcagtgaattacttgttaaaacatttcagataaacagatataatcacatctctgtttggactt

SEQ ID NO: 21720 - DNA, 600 bp, Bovine  MMBT01884
aattttaagcacccccagctctttcgcaaaagagacagcagaatttgtttctgtatttcttgtgttttgaaaatatttattgaggattttttgcatcctagtttttattccaagaatgctgaatcatgatcactgtaataggccagagcaagctgtcagcccccacacaagctgttatcaagacactcttgaaaatatgttctatttctaaacagttgagaaacaatttttaaaaattatttatcataaagcgctttccaattgaattgccctattcaatatagtgcatacttaataacygccactttcgcttcaagagagactacaagggaaatgcctgtttagttagccaattacttaattctttgttgcctagcatagggttccattgtacrtgaaagacacagaagcagcactcccatcctgaatgatgtgtgcagtgtttttatttttctattttaaattttattatttatttatttrtggtatcaaaacgttttattgaggggctttagaggaggatctatgagcttgggagaacaacgagatcacacatcctcgcccagcctgtatattccaagctccagggtgcaaaaagtg

SEQ ID NO: 21721 - DNA, 600 bp, Bovine  MMBT12808
taatgttgacaataatttcccttgttctttttggcaggcacaatcagggtctgatattcaggttatactgccagcagcatttttcaattagcatttaatactccccgacaaaatgctcaacctttcgctggcactgaacccagtgtttcagtgaaaaattgctcagaagcaaaggccttttctttcattgatctccttgttcccctacagtttctgtacttggaatactctcagctttcagggacactgtagatctcaaaaatgttattttctagtttgtgcttgctttatttgtagtgyttactgcyctgattttaaaagttgacaggcattgccttgcaagtcctggaaaaatccattatgaaggtgttaggaatagacattcacacagactcactgtaccatcattaatgcatcctccatgaagagctccatgtttttcacctatcttactgtgattagtgagtcagactctaacagaagccaggactttttgcaaagatgttattaaaatttctaaattttcaaagcttgtattcagaggacaccactcttacgagttattttttctaattcaagtaaactattctgctgagtaaa

SEQ ID NO: 21722 - DNA, 600 bp, Bovine  MMBT19603
atcgttttcaagtgttttcaattaaatcataacagcatattctaaaaccaatcttcctaaaaggtctgcttttattgtatagtttatttaacaataggcaccgggtttgtgttacatatttatattttttattttatttttataatatagacatcacctagatgaaacacctttaccctgtcctgtaaaatactaaagttacatttttcaccaacttaattggaaagaaggggagtgagaaagcaaacagcctttaatgtgctgtggatctaatctagcaatgtatccttgtgccaacaygtaatcattaacgacggatgaaaaagcaagaaaacagccactcattataaaattccagcactaaacattcgtaaaatgcttttcaccatagcaagcctgtcagagagtatatgtgattagaatgttgtgggtttcacactgaatcgaacctcactggaaaaagagttcactcgttttgaacaaatcttgcctatgtaagctgtcacttgtacgaatttttaatatgctcattcttgccaaatatgacttttaatgtgtacattccttcagaactcaatgaaaatcctctccggttcatgt

SEQ ID NO: 21723 - DNA, 598 bp, Bovine  MMBT03310
  misc_feature (1)..(28): n is any nucleotide
nnnnnnnnnnnnnnnnnnnnnnnnnnnnttttgcacatagtataatccccagtgctttgtacacggcagatctcaataaattttggttgactgagtgggggcaaaggtaacagaagaagttaaggggatttatgttaacatggttcccatagattagtttatataataacatgagaggctgtttagcacaggaatttcctgtctttagcttttccatatgctgtagattgagcaagtcatttttactgacttcagtttgcatgtctattattagcctttcttaactggagctcctcatawgaactacagaacacagaaaataatttcagtgactattttcttgattcttcccgggatgatatataagtagtgtcattcttaatacatagggggaaaatattggttgaatgaatcatttcataggagtaaaagaagatgggaatgaagaaatatgaaagcaccttgaagttggaaatgggtgaggtcggtccagaccaagagaaaaagcattagcaaagatgggaaagtaaccgggggtaagtaggctggatgcatgcagaatgggcacaaagacttcaatgaagacatttggaggaga

SEQ ID NO: 21724 - DNA, 600 bp, Bovine  MMBT11629
accttttctgctctcttaagttagaatatgaattagaataatsagctagaatgacttattaataacaattagaatataaattcttccataagaaacatatttctatgatgataaacaagggaaagatcactaagatggagcatattcatatttttgtatgactgatcctctttacaatttttatttaaaccctcggcaatagaatgagttgcaatttcataaataagatatataataataaatgtttaaaaaaagtgctagtagattcttttgaacgaaggtacagaggagctacaggaytatctattttgtaggggttttttttttttttttcagttgagtttgtcaaactgttatttttcttcctgttttgagtagtggcagcttgaatagatctaggctggcatagcttctgctcacgtcacatcatttgagcctaacatgcatttgacagcatgaactctcgggccagactccttgtgtttgaattctgggtttaccattaccttagaagaggcttattattttaatttgtgaggaggtcaaaggaagcatgaatctgttctgcaatcaaaaaatggtagcagtctggtgtctgta

SEQ ID NO: 21725 - DNA, 600 bp, Bovine  MMBT05819
aggtttacattcgccccaggagatctggcaaaatcttctcccagtgagcatgtaatggggcagtagttcttatctttagtaggaatcacaaaaaaatgaagatttgttttgttttatagttttattctaattcttctcaaaagttggctttcyctctaattgaaaacactgctttcaccctgtctgatatacatgatctaattagaaccttttcccccagtgcactgagttatataactactttcagtaaacttggaccttggaactagttctcaaaactaaaactccaacatttgtaamagttctttggtagtaacacagcctgtctaaacaaacaataactggttaatccacattaattgctggcatctgccttatcctggatctgccttcttctgcctcctcaccatttcaaactcttgcccacagtgaaaaaatggaaataagtttgagcaaactcgaggagatagcaaaggacacggaagcctggcacgctgcaatctatggggttgcaaaaagtcagatatgacctagtgactgaacaacaacaaaatgtggatgaaagttttctgaggaatgatgtgtttcacaattttaatg

SEQ ID NO: 21726 - DNA, 600 bp, Bovine  MMBT12110
attttttgctgtttgatgtaaaggtccaaactataaattgacaagaagccagctggtacagtgatgaaattcaagacaatgcaactaatgaaaaaagcccctgctctgttagctgaacgttttgattagccactttgtgtgttttgtttctctaaactgtaatgcatactaattttacctaggaattaattaaagtctatcacagcctccatgctatggatgttatataactctttgttgatacaaagtttatgtatatatgagaataaggtgcagttttaatgagaattaaaaaaaaamaaacacttttgctcctactcctcttgatggtaccaaaaactaactctttaaaggaagtatctattttaamatcaaatgctttgacctttctcaaggccatcaagtcaccaggaggttgttgttcagatgctaagtcgtgtccaactctttgtgacccatgaactgcagtgtgacaggtttccctgtccttcaccatctcccttaggttggtcaaactcatgtccattgaatcagtgatgccatccaaccatctcatcctctgctgcccccttctcctcttgccctcaatctttcccagaa

SEQ ID NO: 21727 - DNA, 600 bp, Bovine  MMBT11290
cggcccctggttgtttgcagtaagtggtctggtctttgtgttagcaaatgtggccacagatccaccatgtttcagggtgtcctgggcatttggtgtccaaggggtgaattaaaccaacagcttaatcctcgaagagtttactgtcctggggggaggaatctggacagatatgaaaactatggcagaaataggtaacatgaaagcagtaaagagtgggggtgcgggctcaaggcaggatggacgaggtgagaacacatgagacagtatggagtcttccagatctaacagctgcactttgtkttgaaccctaattcaaaatgcttactttccccccagatgtgttgacctattcactagccaacaatataatcttattaaaaggctgctccccttggaaatcaaaggaaattactaaaaattattaaaaattaagaatttaattactctctattctcagctatagagtattatgcaaaggcctttcttctggctttcaggaaaagtcgagcttttgagcgcctactttgtgctaattagtgttgtctttttgctgagagctggggaaggaatggttaccgtgactcctgtagctgaaggaag

SEQ ID NO: 21728 - DNA, 600 bp, Bovine  MMBT12726
acaggtggaaaatctaaattctgaaaatgaattgaccttcattttctgatctgtttatctccaacagtgttagcatcgcccatgyaacaagtggtccaggcatttgagaacccctgttatttacttactcagccttgggtcatcattccttcaggggagactccctggctccccagacctcgtgtagcccctctggtcacacatttcagtggatccctctactcttccatggccatgcttctcacctttgcaatgaaatayttgctgcatgtaatgrtttgtttaatgtctgcccccttyactaggctctagacttcatgaaggacagaactaatgtctagcttcttgtgaagaagaaataccttgaaatatttttttcaacatagggtacctgacacrtgctcggtgtttgatgaatattggaaggaaggaatgcatcaatggaaggagtttgtgyaaaaytgtgtttgtaaagttgtgcagtgtctggcacacagctgacacacgtaacagaagcagtaactattgttgataccttgatcagaatcatgcagtggccattgataaactagcttatgtgatttcacggtacttaaatct

SEQ ID NO: 21729 - DNA, 600 bp, Bovine  MMBT05283
tcaccgaaggcaggtgtgagtgaagctctagaattatttttcttttttatatttttaagaaagaactttattcaggcaatttaaaaataagattgcagagcaacacacattccaaacataggtaatgagcgcttgtcaatacttgactgtgttaatattttaatactactgatctttctcatttgctttgtaggttagtatttatttaccagtcctgaagactatgaagagcgttgtggagaagatgaaaaacatcagcaatcaccttgtaagttctgacttctttgaaaagagctcccwagtgtgcagttttggctgcatgtcctyggaggagccttgtctggtggggacttgatgccctccattcatcatgtagtgtctgcgtggggtgtccctcagctcccggctctgggggcttggcttgttgttgatagcctacggttttacaggtgaaacctgctctggatcttctcaactctcctctctgatatttggcgtagtctctcatatttatgrtatttacagtatattaacaatacattcagtggttttaactttctttccatatgttttggacagcatattatgtattttatccga

SEQ ID NO: 21730 - DNA, 600 bp, Bovine  MMBT12880
ctagaattatttttcttttttatatttttaagaaagaactttattcaggcaatttaaaaataagattgcagagcaacacacattccaaacataggtaatgagcgcttgtcaatacttgactgtgttaatattttaatactactgatctttctcatttgctttgtaggttagtatttatttaccagtcctgaagactatgaagagcgttgtggagaagatgaaaaacatcagcaatcaccttgtaagttctgacttctttgaaaagagctcccwagtgtgcagttttggctgcatgtcctyggaggagccttgtctggtggggacttgatgccctccattcatcatgtagtgtctgcgtggggtgtccctcagctcccggctctgggggcttggcttgttgttgatagcctacggttttacaggtgaaacctgctctggatcttctcaactctcctctctgatatttggcgtagtctctcatatttatgrtatttacagtatattaacaatacattcagtggttttaactttctttccatatgttttggacagcatattatgtattttatccgatagtgtacattttttttttatgatcac

SEQ ID NO: 21731 - DNA, 600 bp, Bovine  MMBT05533
agaggtagactggaataaatttgagcacacaagcaatgccattggaaggcaggtgaaatttggaagaggggagatgtgcagatgagcctaggaaccagttattttattgcaagaaaaagtcttcaatgtgcacactactatctgtgatttggggttttaggaaagagagcaggagttggaaaaggaagaggcaagacagatcaagaactttgagatgtgccaggaatttgaacagaatgccagtgccttccttaattggatcttggagacaaggtttgctgtgatacccccaaactcacratccttatgccgcacattccactctggggatggaatatatagctgagggaagaggataattcttacagtacttatgctgtcctaaaatcaccatatcctgcctgtgctttgtatctgaaattgactgtattctaaatcagtcactgcaaaattgagaaatgagaatttcatctcattgcccattctttattcactatytgaaagtctcactttttttcctcttgcctataattacagccccaaaataataacattcacttacgtttgccttcccctttgcactttacactgtaattttat

SEQ ID NO: 21732 - DNA, 600 bp, Bovine  MMBT00950
gtgcaaaacactgggactgtttaaaggtcactgggtgggygtgcctactttctgctggctccaggrttgggctctgtcttcccacctactctcccctggccccattccaggggagaatggaaaataaaatcggtttaaaagcaaacatttacaaataatggtggtgggggcggaacacagcagagagcagcatggttttccacctcctactggctcctgtccaaaaggaaacactagtatttactgccgcagctttgttctctttcaatctcgttccaggaagtcaagagtaaagatacrttsgggagggagaaagaaagaaatgaaaacccaagaagacgagtatgcaatgagcattagaaaatacattcccacccaacactgtaaagcaactatattccaataaaagaaaaaaaaaggaaagaaaatacattcacaggtgtggaatcagaagacagctgttcaggtttaaaaacaacacacatcatcagaaagtgcttttctacctcattccacagccaggctcttcacaggctcatgttcaaatgtcaggatggcagcttgttcctggacaccaaagtagaagtatatccatgttgt

SEQ ID NO: 21733 - DNA, 600 bp, Bovine  MMBT02939
acttgaatttcaaatcagtacagttcaaatcaatgtgagttttctatgagtgtgtgacagtatgtgtatttttagttacaatgtataagatgagatgagctaaaggtattcagtggcatagtccagagcccccactgaacaacaaatggatttcatttgccgtgtctgttagatcaattatcccaatctccttccttccatgactattcacgctttaaaaaccttaaagcttctcttttaagtacagctgggactcattagcttctttctgccaatctaactatcattctgtcacttttycttctttctctttatgtcctcaatcaaataagtgtcattttcctgctttcattttggctggaaattcaactgaatctgctttccaaccaatctggtgtataaaattccaatcttccctattacttttggctcacaaatcaaaacaatgaagccaacttctagtggtgctctgactctgctgtttatttgggttctgcattcagagttggaacaggtgccattttttcctggggcctaaacatcaaaatatttgtgaaatgggctttgcactctgctgatctgtatcaagtcggttacagt

SEQ ID NO: 21734 - DNA, 600 bp, Bovine  MMBT03429
tctggcgtgctgcagtccatgggatcgcaaagatttgttcatgactgagtgactgaactaacttgaaaatttgaatttctgtagcccaacctgactcagaaggactgtctgcaagtgaagttaatttaacctaatggagttatgttaggaagaaggataaagtgtatatatcagatagtctgtcatagtagccattagatacagatttttgtcatcgtgctcaaaattccacttcaggatactccctttttaatttttttttttttttaacatctggaaacattgatcttggtttgtcgytagttcatttaaaggttggtggtttatatcatttatcttaattcaccctgctggtctcagtaaccactcttgaacattatttatcttcatttgattcacatttgctcagcagtcgctttctgacatggctcttccttatacacttttcatttattaagcggcagatgtatgacatggtttggtttagtctttccaatccaattcagcagtagttgcctcaaatcatctttcttcattgatgcatctttgtcctatggcattctccttctctcacttgtgtactttagcaatgatcatata

SEQ ID NO: 21735 - DNA, 601 bp, Bovine  MMBT04638
  misc_feature (1)..(1): n is any nucleotide
naaatacaccactgttgacctcccaaatttcttccttaattgtttttctgagcattgatgtttccaaatcaatgaagagagggattgatgatggaacaattctactctggctaccacaaaaaataacagttatgtattttagggacagagtttaatgttttggtgagtaccttcttaagagtgtgatgaagagttatttctgtgtactttcagatgcactgactttttctgtttgtggtgacatagcatggatgctgccttcattgacctttcaatacagtttctgaaacttcaaatttartggcagttaatccaaaattcgtagacagttgrctcttagttctacttaaaaacatgagaatggaaatagtgctatgcctgggttgagccattcatgccttataatattttaagtgttttaaattgccaggtaatatttattattttaatagttatactcaaggcacaatttatttgctctggctctaatataaaattcatttagattgtgttagagacaaattcagtagaatttgctatgtgatagaaactatcattcattctctttttcattcattttgaatgattgaagaacatagat

SEQ ID NO: 21736 - DNA, 600 bp, Bovine  MMBT10130
gtgctctctcttttcatttcataaattctgaaagggaaattacttttccttaaaatttagcctactctagaggtaaaccgtagtgactcaggggtttacatggtcatcagcaacaygattaattagttggacttccattatgccgaaacatgtaattcaagaggcagtctgtaatagagaaactaattatactttgaatcccaataaacttgaaaaggcaattgcaatactgtaaaatgtatccatcaaaatgatctttggagaacttgaataaaatattcatttgttctgaaaattatyatttttaaagcaaatggatcttaggataaagccgtctaatctcttttttagaaatgcaaatccctaagagttgtgatgaaaggaaaagtgagccccctagcagcccagtattcatttgcaaggcctggcacacattatctgttattatataattatccgttctatgtcaattttccttttaaactgttaatattaaaaaaggcctatgatgttgactggcttactttatgatgagctatcatttgttacaataaaaattgttatcacattttaaactttgtgaacatcatgctgcagcaa

SEQ ID NO: 21737 - DNA, 600 bp, Bovine  MMBT15336
ttggagtgttcagcgccacacatggctaccatattgcccagtacaggcctaaagagtgacaagggaactttggctactgacgccttccaccatcagcatttcgtatctacttactgttaaggttttccaggtattaacatggataacttagcaagtactattacagcgggtcctactggtcacatcctcactactgtagctttctttctctaggccagtgccaacatctgtgaaaaaggaatcttcaaagactacacagaattgctatcaagtacctgacacgtggaatgtgctcagaaratggaaccsacgcacgcacggaataatgcacttgctgcggactattttgtatctattttcctgtggttcagctgtttattacactctatgtacaatgaaytttttaaaagttacctattttcaattatttatttattagaggcattataatgttaaaagcttcagctctggagtcagactaagaggattcaaatcctggttctatcattgattagatgtatgatcttggggaaatgcccagtttctcttgtgtctcagttctctcctgtgtaaaacagtgtacacacttccttggggagc

SEQ ID NO: 21738 - DNA, 600 bp, Bovine  MMBT23139
tgagaactatctgatccaccaaggtataaaatcaggcatccccagcagcacaccaccatcaagcagaatcggaatgaatagcactaaacccaaacacgtcacaagcaggttccaggagcaagtctcccacgctacccgatagccttccccttctgttctgctcctctgcccttgaccacacacattcatggcctcacgagtcctctgttcctagttccctgggaagtgggaaatgagaaacaggctatcaagtgtctctaaccagcatgttggcacagccaaaattgaagttctatagcrttactgctccactcaagggttcaaggccctrtctatatttcttcctttactctgatccaaccacatggggctttttgctgtccttcaagcacccccagccccacaagtttgtatccatctcagcatgtcacactccctgttyattcatttcaccacaaatagtcttggggttgtatacagcagactcttggtcggctaaaccaacactcattcctaagtcctttctcccttgcctgcctccactacagaaactggaaaactatcaccgcaccccccccaccccaccccagagtaccttag

SEQ ID NO: 21739 - DNA, 600 bp, Bovine  MMBT23137
tcaggcatccccagcagcacaccaccatcaagcagaatcggaatgaatagcactaaacccaaacacgtcacaagcaggttccaggagcaagtctcccacgctacccgatagccttccccttctgttctgctcctctgcccttgaccacacacattcatggcctcacgagtcctctgttcctagttccctgggaagtgggaaatgagaaacaggctatcaagtgtctctaaccagcatgttggcacagccaaaattgaagttctatagcrttactgctccactcaagggttcaaggccctrtctatatttcttcctttactctgatccaaccacatggggctttttgctgtccttcaagcacccccagccccacaagtttgtatccatctcagcatgtcacactccctgttyattcatttcaccacaaatagtcttggggttgtatacagcagactcttggtcggctaaaccaacactcattcctaagtcctttctcccttgcctgcctccactacagaaactggaaaactatcaccgcaccccccccaccccaccccagagtaccttagagcaagaagtattggccatgaaagaaaggca

SEQ ID NO: 21740 - DNA, 600 bp, Bovine  MMBT07312
agctccaggcccacagccgccgctgaccctgagctgtgtaagggttgcagcacgygtcactcagctccccaccttgtccagaccyagcgactcacctcaatatacgcagtgtcattatttgcatcyttaatgtgcgggaaccaatctcgaggaggtttagagagatgttttgactctgtgacaaaccataatagttttggccaaccttggaaataaagaacaagttcctttcaggcaagcatcactcagaagacaggtgtgacaccaccttcctgctaatggcaagatccacagcagcamaggccagatcaagtctctgtgtttccaagtctaagggcatggtcaaggtgctgtgagcctccaggagccgaagtctgccacatgcaggctaggagacctcctgtgtggacagcgtgttagcacaggccatggggcacaccctccccacccagcccgggctcacctttgaactgcgggatctccccmgtcgggctctttggcagccccttgtggcaagcatcgctcgtcaaggctacagtcaccccacagcttccaagcaagaacccaatctgctggcttcctgcatcctggagacagcag

SEQ ID NO: 21741 - DNA, 600 bp, Bovine  MMBT00614
cattttggcaccgtggtggccatgtgatcttatccatgcgggtttatttctggtctgtytactctactccattggtctatatgtctgtctttatgccagtaccactcttttttgattactaaacctttgtagtaagtttcaaattcaggaagtctgagtcctccagttttgttctttttctcaagattgttttggccacttggggtcccatgagattatgatggctttttctatgtcttcaaaaacatcatttggaatttgatttggattacatggaatctgtagattactttggctggyatcaacatcttaacaagattaggtcttccaatccatgaacacagtgtaagagacagcctctttccttacaccctsttgtcaattctaaacaaaaaaacaaacagaaaacttttgcccaccttataggtgacacttcatacctgtttttcattggaaagtcttcgatcagtattaaactggaacataggcttaattcttaatgggcattcatatttcttttgtgagttgtcattatgttctttgcttatttctctattggaatagttatctttttttgtattgtaggagcctatatatata

SEQ ID NO: 21742 - DNA, 600 bp, Bovine  MMBT20064
atgcagtaaagactgggtcagaagcattagtatattttcaagaaaagtctatgcaaagagggtccaaggaaacaggaakgtgaaatctggaggggttgtgaagaktcttgagaatttaggaaaatggaagcttctgccattaaaagtcctagacaaaacaaaaagtatgatggtgcattattacatattatggttatatattatatttaatacatgctatatgtgtgtatattcagcattccaaaataactatatgaatctatattttaacatctttcttgcttttcacaactttgcatsacatcaaagtytgggaatcagtggaatttcatttcactttcaaaattctaatgactctttcataatcctcacagtggaatagtaggaaatgtgctgcttaaatgtaaaagaaaataatatrcaatattcttaataatgtatgtagttataaataaagtgtttttttagaccaatgacatgctaacaaagagattacctactctgctatttgagatgtgaatttaatattcagtgttcttttatttattttttgtttcattttctttaaaacattctcctgttatttattcttgagtttat

SEQ ID NO: 21743 - DNA, 600 bp, Bovine  MMBT09066
aactgccaatgaatttgcaaatgacattgttgagctctgctagggagagcattaccatctaatgggtatatttagaaaatatttattcaggacctgatactttccacagtgaaatgacagtgttggcaaataatcatccaaagacattcttaggtttggttatacaaggtatcaccttgaactttaaagccattgctcaaccaaggccattttgtaaagaagtctttcacrtggctactctgtagagagacgtttgagtcttgatcttttaaaatgctacttttaaaaattcaacgaaargacaagtgcagtgtgatttcacttatctgaaatwcttaagagtagtcagactcatagagacagrgagtaggatgatgattggcargtcataaaagggactggatgggggaatcagatcagatcagatcagtcgctcagtcatgtccgattctttgagaccccatgaatcacagcatgccaggcctccctgtccatcaccaactcccggagttcactcagaatcatgtccatcgagtcagtgatgccatccagccatatcatcctctgtcgtccccttctcctcttgcccccaatccctcc

SEQ ID NO: 21744 - DNA, 600 bp, Bovine  MMBT06541
cagaataactgatcaaatgcaacacattttttgggactattgtgatgcttggagatttttatctgaatctaaatctagtcttttctctacttgtgccttagattcccttgaaacctcccctcttcatgaaggttttgggttgaagcaacagcatggcagttcttctcaagatgaaataaaaagttggattcaagttttgaagaggccctaccaagggtcactcatttgggggctgccccattgatgggacctcatgaggttttatgtaagctgtgccggtggcctgagccgagtatgtcyagtgagggcaacagtgcatagtttatggaagcaattactgagccaagttcttaagtagccatgatgccttcagttatgggcaaaattgggaggggtttcaatagaatgagtgtttgtattttcagggccctgggaatccataaagatcactgtagtatattatttcactcctactctgccttcctagtcctctcatctgatttaaaacgttctcagcaccggggtataaaattaaacactcatgaccaagctggtgctagcacacagaataaaagggaaaaaagaaaaccttaaagatac

SEQ ID NO: 21745 - DNA, 600 bp, Bovine  MMBT01671
taagtgcaccataatggtgaatacattaaatatcctaaagtagatggaatagttaggtagctaatttactatatcatgaatggttagggataattcatcttctactgtttctgttaaccatccttttgcctttttgcaggtctcaggtgtcaaagagtgaactaggacacaaggcagttaagaaggcacaatggtttagcagggagaactttgtctgagcccaartttgccagtatgtttcaaggttttgaccttggaaaatcaatttaaatccccctgagctctgttttcttacttgtwaaagagggaaattggactaaagtatcttgtttccaccttgatcttttcatgtattgataatgcactaactcatcaacaagacaatcattgataattgcatttttcagatgaagttgttattaaattcttagaaaacagccaaaaaacagctgtgccctaagttctgtttactttattatcctcaatgtcactaagagttaccattaatgatgcacctacagtgttcagtgcatttgtgctggcagtgataatgttacttcccattaggaacaaatttacattatgataccaaggcagtcc

SEQ ID NO: 21746 - DNA, 600 bp, Bovine  MMBT07111
tagaggaacctagcaggctatagtccacaggtttgcagagtcggacacgactgagcatgcacacaggcactgtatgttgtagcacgtaccaataccttacttattttcatggcagaataacattttatggcatagatatgtcccactctgaatatccattcagcagttagtggacattgggctgtttccactgtttggctactatgaagaatgctactatgaatgtttgtgtacaagattttgtgtagacgtgttttcatttctctttggtctatacccagaagtgaaattgctggatcytgttgtaactctatgcttaagcttttgaaaattgcagttttctaaagtggcagaatcatttttcacccccaccagcagtgtaggagagttccaatttctccacttcctcacctacatttgttgttatctgactttctgatgatagccatcacagtaggtgtgaaatagtatctcattttggtttctatttgcatttccctgatggttaatcctaggctttcgttgaagtgcatcttaaaatatttattacagttattcaattcaatgttaaagcccttgctcttaaagcaattaaaatat

SEQ ID NO: 21747 - DNA, 600 bp, Bovine  MMBT01398
tagagacaactactgaacatgttgtgtatttgtatgtttacattttgtgtaggagagttacatattagaactcaccttcaaggcattttggacattaatttaaatgagagagagagatgcaattgagaagggacaattaaggcgatgtctccagttgcttaatagtctgtagccactttttttcaaatctattgaacaatgtgttaatttcattggacattttatctgatgtgtaggctcctgtctgatttagtgaaggtcacataaatcctgatttactgtgaggmaacaacctataargtccttcatagcccaggcaggtggttggtgacaggatgctgagtgatttgaagcctagaattgtaactggttgctgattgtgcatgcaaggctcaagttctggattttatatttcctgtttgggaatgattgtacaaaaatgagaaatatcagaaaactccatagtacttttgagcaattctttttcttttacttgagtgcatgtgtatggtggtatgccctaaattaaacatcaacagctcttattattttgttgaaaaacagtactgacaactatccactgaaatgtaataacagctc

SEQ ID NO: 21748 - DNA, 600 bp, Bovine  MMBT10093
aaggatttccagtaagacattctgaacctgtagtatataaatcacttggtaacttttagtccctttccttctcccaacacctgtttttgaattttatttaataaaggattgtgagtatttaggatcagcctcccatttttatataatcaggtaaagaatatgattctctcgctatagactgaatgggaaccagaaactcatgggttttccttgcacaggccaagcctggatggggctctctgacttccttctcggtaagataacttcaggggcaaagagttccagtgagaagcttagcaracttagattagtatttgtgtgtgtgtgtgtgtgtgtgtgtttaaaattttgcctgcgctgggtcacggtggagctcgggctctttagttggggtgcgtgggcttagctgccctgaagcatgtgggatcttagtttccagaccagaaattaaatctgagtccccatcatgggcttccctggtggctcagatggtaaagaatctgcctataatgcctgccggggagacctgggttgggaagatcccctggaggagggaacagcaacccactgcagtgttcttgcctggagaatcccatggac

SEQ ID NO: 21749 - DNA, 600 bp, Bovine  MMBT08947
cccacctcgttccttctgactactgggaatctttcggggaatacatctccactaccaggtcacaggtagcatttcaggacttggcttatctcctatgccccacaaaaatacatatcagggccattcttttctgagcacatgggttaagccaaagctcaacgtagtggggccttggagaaatgaagcatggggaatgttggccacagagagaagtatttcagcaagaagctgcaagctcccagctcgctggcttggtagggaccccagtaaatcaggataagccatggaggctggcactgratctcagcggcagaatgtggtcaggggctgcggacccctcaaaacaacagcagcagcagcagcaacaaaccaagttcaagctaagaaagcagactgtgtgtgcagaagggggctgaaagcatgagggaatgagggggaggaaggaacagacaggaccaaagggacctggaacaaaaggggagagaggattctagtcacatctcccagagactgggaaagggctccagtgtgccctgaaatggaaggagagggaaagaagtaagcagctcacagtaagctagaggaggaagtgggagatgc

SEQ ID NO: 21750 - DNA, 600 bp, Bovine  MMBT07902
agagccttccagggaagcctggtttccatagaaacagatggactgcagagcagtccccttcctgaagactgtgcccccacaagggctggcttaggaacctaaccggcaggggagggggcccaaaacacccaccagctgccaagcctctggtgattcagtggggagtcactgctgctgagtatcagagccaagagctgcttcctttgcaaacatgaccctctgcaagagggccagtgcacctgtaaggagaaacgccccccgatcatccatgccaggaaaggaggcagtgaacaagtactyccagaccaggaactccgcrctcacccccagagcccaatgagaacggttgtattacagataaggaaactaaggcccaagtgacttatgcacatgtgtatctcgggctaagtgacaaagccgaaattccaaccaagttaatggtgcctaatggatattcagagaggagctcatatgtgtgtgtgtgtgtgtgtgtgtgtgcgtccacatgcccatgtgtgggctgggggtgtggtgtgctgaacatgacatccaacaagaaccgagctctaagctttcttccccatcacatctccccttgaa

SEQ ID NO: 21751 - DNA, 600 bp, Bovine  MMBT18144
gagatctggatttatgttcagggtaatgatgtaagatttctttctgaagcagaaacacttaagtatatttctcattttagaatgagctgacttaaatacaactactaagtccataataaaggctcacaatccaccacggtagaggaggggtcttctagcctgggtgagtgagcagcacagcagtaggctccccattgtcccccaggagtcctttgaactcaatagggaaaagtggcctccctaggagccacctgggacccttcaacaggctgccttcatctcgcacgcatgctggggggragctgagtctccactctcttgatttgaaccgtgaaggagacacttgggctcgtgagggcttgtccccacggctttcctcgtctctccctctgcccttgggtttcccagagctatacagctccctctggactcaggctttcaaactatcaccttcattcccgcggcagcaatgaagttaaagaacaaacagtacctgtttactcacctcggggttctgatgtactttgctccattaataatttagtgaggtggactgaattggattgattccccccccaaatcaatatacaaaatgattac

SEQ ID NO: 21752 - DNA, 600 bp, Bovine  MMBT06460
attagcttgagacaaagttcagaattcttaactataattcacaatttatagtaagttacctaaaattgacttcagtgattatcttagaattaacacctttgttttccttaaatgtttcttttgactttcagatgataaagttttattttttagaaattgtttttagtaggacctgcccttagcgaagcagtctagagcagtgggaagcacagtttggagtcagacctgggcttaggcagacctaggttttacagtgatcagcactgacttctgtgagttcgtgcgtcctctgctgggtcrcagggacgaggagcccttggcacagttcctggcacatagtaggcaggcaataaatggagctgttggttctggagtgaaagcctctgtcacagcataagccatcgcatctgcgtctcagcttcatcacttgcgtgcgcaagcataggaattacgccttttatgcttgcctcattttctgtgtgcttggtaattatgttttcccctgagcttatacgccactgtatttttgtcttttatttttaattcatttcataataagcatttatttgttatccattaattcttaaggaatcctttgaa

SEQ ID NO: 21753 - DNA, 598 bp, Bovine  MMBT05300
  misc_feature (1)..(182): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtataataggattccccaaaagcaaaaggataggggcagaaataatatttgaagaaataacagctaaaaactccccaaatttgatggaaaacattaactgaaacattgaagaagccygataaacttcatgtagaataaattagagagacccataccaagagaaaaaatgaagatgaaatcaagacattgccagataataaaacctgagcaaattcattgttaaaggacttgcccaatatgaaactaaaacaaatcctttgggataaaataaaataatgctagatagtaattcaaatatacattaaaaaaatatgcaccggtaaaggtagtcacatagtcaaatataaaaggcagtgtaaatgaatttctgtttataaatcttttcttcccatatctgatgtaaaaataactgcat

SEQ ID NO: 21754 - DNA, 600 bp, Bovine  MMBT03416
atttgtataaacctccatggggttgcccctctgctctctatattgaggtattgcagtttttttcactttgtttctatagtgaattttctcttccttttgtccctttaaaatagacaagataatttagcctaaataaccactttagaaaatagtcaagtttaacgactacatttatttctattaatagctctctcaactttgggagaattgtgcttaaagatcttccctcctcttcacccactctctggcccttgaatgatcatctggcagtttgagtctctttcacatggttccttcctycttaaagtgaagttgcttagtcatgttctatctgcaaacctgtggactgtgtccaggtattttccaggcaagagtactggagtgggctgccatttccttctctaggacatcttcccgacccagggatcgaacccgggtctcctgcattgcaggcagacgccttaccatctgagccaccagggaagtccttccctttatgttacacacaattttgatgatgtgatgactgacatgcaggcagaggaaaccttgcttttatcatggattggtttcttgtggctattctctggtctcttaggt

SEQ ID NO: 21755 - DNA, 600 bp, Bovine  MMBT02933
tattttgatttctaagtaaatgacatggaacttaaggagcaagtgagagagagagagaatctgtgatgacagcacattggcccctggaattattaaaatgtttaatcagatagaagatttggggcccctaaataaaggccaggagcataggtaatcagcacagtcttagcagcaggagaaaaccaaatcaaaccaaaccccacttcattctcccatccccatgcccatacacacttgcacagttggaagcgagaggcaatttactggcacccmgtacaagtcctttctggaagtgattaytgtcacaaatccacttttagtcaaaggtgttaaaaaatgagatggagaccatccaattcttacttactttttgtgaggaactgttaaagagtgatacaagtggatagaaaagaaggtgggaagggaaagagacagaatagactacaggagaccaaataaaaagttcaaagtggaragcaaaagtaayacttcatcattcccaatttcctcttgggctctgttgactaactggagtttcatcattacctgatgagaggccagctttgaagagctcagaggattcctttaaagtctttggat

SEQ ID NO: 21756 - DNA, 600 bp, Bovine  MMBT17780
gtagcattttagtgatgagaggaaatttagaattcagcctgcatagtggataaaacaatggactaagatttgaaggcctgagtcctaattacagctctgacattagtcagattacttttgaaaattatagtattyttatatgcaaaatttaaaagttgggatgacttgaagtggagggaatagactgtttctatattggtcttattccaagatacatagctagcaaatacatggaaatagaacattaattaacatatagaaaaatcctcaaataattggggctacaaaaatgaatttacktacatttaaggcatttcaggctttgtctggttactcatttgctatgacgggtatggttagaggaggacagattcaataagggctactcaacagagatgcatgtcaaaatcatcattgaggcttataaatcaggtaccatggatctggggcctacagacacttctagagtttcatgtatgattctggtacccactccagatagaaaatgaaggcgttaattatctccaatattttcttcagttataaaattatttcctaccactgtatagagttatctcttaaaaatagtgttaaagcaat

SEQ ID NO: 21757 - DNA, 600 bp, Bovine  MMBT01912
aaaaaagttactgagctctgatagcactttcatttttgtgaaggttactcagctatagttaattcccattttctccttctgaagagtatgacaaagggacttttaagagctaatcaaataaacaacgagtgttcaaaaataacttaattatcatatttcattgaatagtacattttgtcaagttttttgtttgcttgttgccaagtcagatgttcaggcctgtgttctgtttatagaatgtgtgatctgaaagcccaaacagcactggtcattttgacagccttaatgagtcatttagaytggcaattactaaaataattacatgaagacaagctcactgtggtcatcacaaacggtttcacctttttcaatagactctcctctatctcctgttgttaaactaccatttgggtgtttaacataaagaactgactcgcttccctacttttatatgtcaggagagggagttatgctgaaattgaataaggaaaagtgactattctcacatttagcagcacaattaaaggaacttctgatgatctgggtccattaattctgctattctcagaggcagacattcccaccaaaatccaattgcaa

SEQ ID NO: 21758 - DNA, 600 bp, Bovine  MMBT08054
tacctakcaccatactatctcatttaaacttttctttaatgattttgaatagtttctagccctattgttcattacattatatgtgtatgttcatttgtgaatttgagaagtctctgcataataagctatcaactgacatactgtaaatgtttcctaaaattttccactcrtctttcaaatttatttatattatggcayaccaaatatatacaataatggagtcaactctaattccatttaaaataatttttcaaattatgtgtttgaaactgattgtttagaatgcctctaagttaaaastcttttccatctctacagaaatatatacataggttctttcctgaatttaacagcttcttgtttcrtttaacacctcaatatatatggaatttattttaatatatagatagtatataatgtatatgaatattaatctatagatatgtatgttcaaattactattcatttgttagatatatatatagacatatagatattatatattttcaaattattactccattttttaaaacattggttgactccttttatctcctaattacttgcagtttattatttaataaagtcaaacatatgcac

SEQ ID NO: 21759 - DNA, 600 bp, Bovine  MMBT02266
acttccctcccatagcatatttgttgctccataagtaatttagctagaaaattcttctagcaaaaggcctgttaagtttcaytaytgttttcactcattaagttgagacagtkaaggaataaaaattccataacaaaactgaatagcttatactctgtaaaagccrttgttcattgcatattgaaaattttatattgaagtcttagaaaaattctagttttgaatgctattgtaaggtaattttccattgtaaaatacagacttagagctatatatgtgtggatacatgtgcatttcttygtcctcaaactcatatagacgtttccaatcttcaatggccatagtaccggttatactttcatcacacagagatgggaaccagcccactcttccatgtgatatgtgttaaacagtgataattttcattccatgaaataaactattgcagaggtgagtacaccctaaaattacactgagtcaggaaaaaagattacataaaaacattaccttaatgagtaactgttcaataaatatttctcatggaatcagataaatccagggtttcttttgcactcttattaggtagtttggaagagatga

SEQ ID NO: 21760 - DNA, 600 bp, Bovine  MMBT03939; identical to SEQ ID NO: 4685

SEQ ID NO: 21761 - DNA, 600 bp, Bovine  MMBT11938
ttagctaatggtgaacaaaatytagcactattttatgaaatacaacaaaattcagtgcccccaaacacaaaattcatccaataagaattgctgaggttgtaagaaacaagaaaatattaccctgaattatatttctattgctgtataacaaactacccccaaaacttcgtggcttcaaaccatgatcatttatcctttcktatcatttctctgagccaggaattctgacagaggccatagagaatgcttctttcygcttcacagtgcttgaggcctaaactgcaagatttgaaatctggrggctggaattttctgaaatctcattcagctacatatttgrcagttatggtattagccaccttttgtaaaggaagagttaacagagcaggtctggtggcttattccttgcgtatatccaagagaacctggagtcatgaatgacacttggacaaccactgggaatatgtcccttggatgtcagagattactgatttggttatgtacacctagagcaatgagctgtgctatatcagctgtcaagttgctctgcatagatatcaagatgaacgaggtgcacctggtttcattgttagggtcccg

SEQ ID NO: 21762 - DNA, 600 bp, Bovine  MMBT04963
gagatgtgtctccctgaggcatcagcagacaagagttggagaacaaggtgtcctgaaatgatgcagggcccaacagagttagtcttgagttccattcatttttgaccactgacgatgcacaagacatttcgaatataaagcttcatgttgacttttataattctttaaaagcaatgtctgtccttgtacgttacagtggttaaagatgttggttaatgaatcagacagaattggattcagattctagctgtgtgtccttgggcagcttaattggtgtccttaaatcacagtttcttcatstcaaaattttggccagtcttagtatctaccctctagggtggtaggattttaaggattaaatggaatttggtagataaaaagtagaacatagaaccaggtggggacatattattaaaggtattatattcattgtttccataataattcaatgttcttttaacctgtcactaccatgatttatttctttttattatttagtgattccttagcttaactctccttaggctaattcttgatatcatatcttaacaatctaatcatccaaaaggaataaagataaaaatttgctaagatctgagg

SEQ ID NO: 21763 - DNA, 600 bp, Bovine  MMBT14019
ttcaacatcaactctttttttttagaaaatattcttactaagctaggaacaatagtttattgatgtgattgttaaaaatctgtctcaagtgaataaccagcaccgtacttgacagtacaaggcactcccttattgtgctaagtgccactgtattttgacatcgttctaaaaggtgtagctcttacactagtaacacatggaaagagaaggacatttggcccttgaayaacaactcttacacatgcagtgcttgggggagcctgtttcctgagtgagaggctaagagtatttaagaaagargatgtwctaggtacatacactagaatattatccaaaaattaaattttaaaatatatatttgtgtatatacatatatgtacgtgagcacacacacacgtatatatgtgcatcattctcagaagcacactgaatgggaaaaaaagttgcccaaaaagcccagaatatactgttcatattttaaacttagaaaacatcaccatatgtatatatgtatgtgtgtgtgtgtatgcacatacacgtatgtactatgtatagtaaaatataaaaacattaatatgaaatgcatatggttgccttggg

SEQ ID NO: 21764 - DNA, 600 bp, Bovine  MMBT07086
cctaaaaataaataagaaaatggggctattaaagataatccaataaacaaacccaagaaaagctatcttccactgttatttgttgatatttttacaggggacagaagatcaaataaaatgcagtgctgaaattaattttcaaggttgataaacaaagacaaaacatgtgatttttaagatgtcttttaaatcttatactggctaagaaatcaatgggctataatcagatgaagcatttgttttattctttgagcaagtttagccaaagacggttgtgatttaatgaacaaagaatatgcrtactaggtgttagaacaaggctaagagaatgtcactgagaaccagtagcttctgactttaatcactagaagacaaagaagccccaaaacacattatatactggacaagatcctgggtattttatgattacctaataaaaatgagagttaagatggttccaaatatgaaaggaggcagatggttagttcagattgaagggaatgttgaagaataaaaatcttaacctgggctgatgcctggacatccaagtcacaacatgttcaggtaaaactcttcacatttgggcttcagggaaaagta

SEQ ID NO: 21765 - DNA, 600 bp, Bovine  MMBT08817
tcttttgaatatagccattaagaaatagaaatcactggcatccatttttgtataagaagtaactaaagttgtctatgtttaaaaacataccattacttcctggttcaattagagcgattagcacttggccttccaaatcaagtttcactgtaatgacaataacaactgactgaatctatatatttccaccagaaagcaaaatgatttttttctgaactgtagtaattatttgtatccagccatttgccatattctaagtacttgaggaagctggttttacctggatctatttttccgtayatctgcctttctggaaggactsttgtttcyattcttggatcatccagatctttatgaaagacacttttttcccttaaagaaatgggtacagaagagagttcccaaaccagctaattcctcatagaattgttaagccagcagttagttaagctttctgaatatctttgaggttgtcaatataagaagcaagtggtcctagagcagatgtctgttttatgctgtgattcatcagtgagataaactcctgactttagttctgttcaaatatcctctctgctgttcctctctgccctctgctga

SEQ ID NO: 21766 - DNA, 600 bp, Bovine  MMBT01887
taaaagagctggacatgaccgatggactgagcaacattaaagacttataaagtgccaaacttctgcgtgtatataaggactgaagggagtgtggtaactggttttaaaattaagaacagagaatattaaattatctgagcaacactataaatttacagttgagttttttattatggccggttaaggactggtggtatacaataagaatacagagaaagcagtagaagaaaacaaggtaggagagggaaaaacaaacctggaacccaaaagaaatggctgtatcaggaagcagaaagtgaracaaattgaaaagaaacagtcagagagaaaaaaaaaaaagggaggggggttcccagggaaatgagttgtcccaaagtcacagcttaattttcctttgaggtatgttactctggaagattagtgattatcattttctactcacaattgatctgttttttcttactgtctaactcataatgctagaatattttctcctaatgggctaactagtgaagattatgacagagaaattgttccctgggttgcagtagtagttatcagggcagctgtctttccaaaggctgcaaataaattcagctg

SEQ ID NO: 21767 - DNA, 600 bp, Bovine  MMBT01515
aacctcattttcttgacacctactctctcccattcccggcagccttgccctgtaattcaggggtttcttgggccttgcctagtaaaaggtgacagacacagatcttggaggaagcatcgccaccctctggtttctttgctgctgctccttgcatgatccattatccagcgctgtccccgctgtgtttttgaaggtcagataaggcagatccaggtgctggttacccttcagcacctaatacaatactcaacacatagttcatgctccatagatatttgctaagtaaataagtgtcaagaygtgataagagatcctacatatcgtaaagtgggtgacagtagaaggatattgaacacttggaatgtgttaggcagagtcacaggtgttgttttattgaactcttgctaaaatatgtgcctcagtattaccattgtcaccctgaagataagataattcagtgcctgagtaactaatcagtaagtgttaaacccacacttctaattcagatctgcttgacaccaaagccacatcacaccatctcccaggaatttgcccaacagctagaatgaaatgcaggaactgaccaattttccataatga

SEQ ID NO: 21768 - DNA, 600 bp, Bovine  MMBT08003
gaaaaaaaaaaaaaggatgatgatggtggcagataaaggcccaagagcctccagaagatcttgtcattgccttccgagacataatatctgcaaagattaatggaaatgttttgcacagtgatacttaatctctgagtttggggagttaaatttaaatattcaagcaaaatttctcatcaaagatgggatcctgggtcacagatcctggttcacagagaatgtgcagatgggagaaattcggatagcacrgcaaggtattcagacaaccacgcctcatcttacctaatcactgattctggraagactttctctcagggaggatgggccaggttaacaccctgaataatattctcaccttacaggacaatgcaacaaccatggattggatggctccaaactggggctttgcgtttcgagggaacaatattctcttctactggaagagggatattgtcaggtatcgttacaaattttctcaatcattttcatacaaaagaagcataactctgcttrggaaccatgtgtctatctgaaagccggggagactcaaagctcccaccaagttagcaagcagacagccctcttcctgcctcctgcaaa

SEQ ID NO: 21769 - DNA, 596 bp, Bovine  MMBT06632
ggaaattagcatacaaattcaagtcttaaatttgtggattttgtataaaggaccacattctttcactgccagaattctatccattagcagtagcgtattatgcatctaagctacaagattatttaaaaacaactatttcaaacattcatttgatttgtgtattaatattttattgttgccctaacacagatatatatctctgttgttatatattcttgtttcttggggaaaaaataactgtcaaaatgatggaactatatttgcttatgcttttcatttgttcaatgcatcaagctttcygactacccagtcagtaattttgcaatgtctcattattattcaaaattgtgaatctttggttctgcaaaatttcacatttttcttagtctaaaattactcaaaaaaatactgctactgctaagttgcttcagtgtccaactgtttgccaccttatgaaccatatgtccatgggattctccaggcaagaatactagactggattgccatttgttcctccaggggatcttcgtgacctaggggttgaatagaaaaaatgctctaccataccaatttaatgctttcttgaccatcttcaa

SEQ ID NO: 21770 - DNA, 600 bp, Bovine  MMBT02232
attatttttttccctgtttcaattcagtgtgtgtgtgtgtgtgtgtttttactttacaatattttattggttttgccatacatgaacatgaatctgccacgggtgtacacgtgttcccaatcctgaacccccctcccacttccctccccataccatccctctgggttattattaaatcagttttaatgtctgattcaacagtactcatcctaaagcacaaggcattcttcatttctcctttctccctaattcaagttgaaatagacatagccaaaatggcctgccagctgttcacagaaygctccacctttcagtccccacccacctagttccctctgcttagatggagagtgtgtcatatgacaaaaaatgtggctcataattacttttacagttcatttgtcctgtgtcctctagcattaagcctaatgactttgacaagaaaaccatcacctggctccatttcctattctgttggatgtcaatttaacatgaccatggggactgttcattagcctctgaaatttccaggaagaggcatttttttttttcctcttgctttcactttaaatcacttaaactattttaaaacaacttgaa

SEQ ID NO: 21771 - DNA, 600 bp, Bovine  MMBT02874
tattcgttttctcctttccatgatacaaactatttccgatttagtattcccagatattcccagatattccttattatctgttaatatataaatgttattttatatgtattagtatttatatctcctactgtgatattctttatctaacttgctagatcaaacytttctggaaggaagagaggtatcaataaaacaacatgaaaacatacttgcaacatgaatctctgcatgaactgacatgaacatacccccaaattaatcacataaaactttagatcacatccctttgaagtgggatcrtctaatcagctctgtctggmacaccaarcagaacagtactctgtggagaggacttgcccaaaggcagaaacccagaggaagcagaggagatgccagtgtacaagtcagcaccacttcccaactaaggccctgcctggaaatccaaatgactctactcaatttaggttaccaacctcctcgccactggctattcggtgagccagatcttttaagtttctcatcattctttcatcccgaaaatcataaggaaatgtttctgtccattctgtcaggagctgaagaattttcggtgcaattttt

SEQ ID NO: 21772 - DNA, 600 bp, Bovine  MMBT08969
gaactacttaataagttacaggagactgaaacgcaatcacacctgtaacacagcagcagacacccagggtgaaacctgatgaccaggaagagaaaacgtgctcggcaactggaaatcccagcacagcagaggcccaggtacctcacggctcccgtccctacttcccgatctctcatcccgtggatgagctgatactcactggccacggcaaacagctcatttcagtttaccacttagctccgagaccatgacatggccttcctctaggtgcagactccgcaggttccagctcaaacgtcrctactacggtgagaccaccccctgtggctggcttctcctccttttgtgaattttttcatactatgttttaaattgagagatgatccacamcccataaaatgcaccyttttaaacaagcaaacaatgtagtagtttttggtaaacgcacaaatttgtgcaaacaccagcaccatctaattctacattttcatcacccaaagggagagctggttttcaccggtcagtcctcagagggacccaggtcccaaatcactcagatccccaagcctgaaaggcccacagaagctggagcctyggtgt

SEQ ID NO: 21773 - DNA, 536 bp, Bovine  MMBT10051
gaactacttaataagttacaggagactgaaacgcaatcacacctgtaacacagcagcagacacccagggtgaaacctgatgaccaggaagagaaaacgtgctcggcaactggaaatcccagcacagcagaggcccaggtacctcacggctcccgtccctacttcccgatctctcatcccgtggatgagctgatactcactggccacggcaaacagctcatttcagtttaccacttagctccgagaccatgacatggccttcctctaggtgcagactccgcaggttccagctcaaacgtcytcttttactttttccctgaataatgagaataattcctttatagctttcaaaagaccataacctatttctaccaataagtgaataattgtcatactgttaaatataaattaaatttagagagagcagccagcttacttttgacattctgctgaaagttttagttctttgggttctagaaaggaagaccttaattagtgcaccaaggtttcctgttcgaggattattttcaactgcaa

SEQ ID NO: 21774 - DNA, 600 bp, Bovine  MMBT07236
cttgactacatctttcccttctcctcccccaccccaagcccttaggttgcctttcaaacagccagaattcctttaaagagtaatctaggtatgcttcagctgacattcaaaagtgcattgtaattcaaatggaaatgcagaaattcattcccttggacagtcttgggaaattataatagagataaaacatcttttaaaggtggcgacaggcatttatctgtggggacatctctatgcgatagactctcctgatgcaaactcaagagcggtccaaccttcacacggagtatgtcctttcgkcagggtcaccgagtctctaaatttgggaaagacattaattgcatccatcttcgcttctccactttgtccctccatttgtctttgtggattttggtttccccgtgtctgtccctcttcatttttctgtctcctcctatctccctcagtctttgtcactctctctcacacacagaatggacaattcctttacatgcatacatcctttaccttccatagttactttctcccatgcaaaagaagcaactgtgaattcaggaaacctaccagattggttatttctgcatgcattgccatcccttc

SEQ ID NO: 21775 - DNA, 600 bp, Bovine  MMBT03528
tttttccactatcttcaaaactctgctctaataaatgaggaccgtggagctttggagtccagaatactttcattcaattccaaaacaacttaatttattaacaattgcttaagcttgaatcatattttccctactgcaaaaataaagaatacaaggtctaactagtaggatatgcagattaaattaatcaacctgtgtttgagttcttttccatgtaaaatcacagatctccatgtctttggagtcagttattggaagattaatgtgctcctttggcactgtcacagttgcttggttttmgcgttcctttcatgtttagtgttgacccaggatcyggtcaaagacttttcattacatttaaatgttatatctctcaagtatctttgttccaggacattcctcttttttttctttatgacactgttctgttgaagtcagctgttttacagaatatttctcattttggatccacctgcttacaggtgtccttgtggctgggttcgggtraagcatctttggtgtcaaaatgcaaaggcgcagctctgtcccagtgcccctgtgcacacgaggggctcagggttcactttgcccagtaactgg

SEQ ID NO: 21776 - DNA, 600 bp, Bovine  MMBT06988
cagggaaggcccaggctgaatccgctcgagttcgtgcagccctcaacaccatcaggatctctcttgccccggaatgaggagttcattgtgctccaagacattatgttgaagcccttaactgtgaactctcaktcaagatgctagacttgccagttagttacacagaaactattctgtctgggctggaatgtggcagttaaggaagggaactttgatcttcaagataaagtggatacagacactagcgcactgtggccatttcaccacagctttaatttgtatagtttttttctcactttwatctaagttcattaaacctgtatctagtgaatggtgggatggcacaaatcaatgagtattttgttaggaaacattaaggacagccaatgcagttcatcccccaagacctgcccacccccacccccgaccccagtcaagaattacagggatatttagtcatgtcagttagttttcttttagaatgtgtgccagactttaatctctggatttgatatttatgcggttatttatttaatcttttaaccctgtcaaagttgttttagccagctctaagatggyggtaaccataacaaagtcaca

SEQ ID NO: 21777 - DNA, 600 bp, Bovine  MMBT15694
tataaaatcatatcatataagaacaaaagataaaatcaaataaaatggcttgaatatctactatccaaatagggtgcactttcccttccatgagccatcccaagacagatataaactgagtgttcgggatgctgacagatgtgctgtattatgcagggagacattttacgactgaggctactgccctctggagatgcagcggactccatggaccacttcacctgagaccacagatcacactcaagtcgccggccccagaggccttatcatcccagggaaccactaaagtccatttttggyaagatctcaattcttttcctttccttgaggtcaatagagtcaagggcacggaggtggcccacccagacctacgcacattcacttttggggggaattcaccttagtaaaatctatctaccttaggtcaatttaaattccaccatggaacatgaaatatcagtaagtatccattacttacagaatctttgaatccttagagaattctctacctttaaaataataataaaaatgataagataaaaacactatgaattttccctaaagagcatcttaagcagagttcctgccactgcttttttt

SEQ ID NO: 21778 - DNA, 600 bp, Bovine  MMBT02963
ctggggtttgatccctgggttgggatgatcccctggcgaaaggaatggcaatcccaatccagtatttcttgcttggaaaagtccatggacagagaagcgtgaaagctatagtccgtgggatcacaaaaagtccgacacgactgaacaactaacacaaacacagtatcaggctgtgatctcagtccttgacacactaacctgaaaatgattattcatccactagatccatataacatttatataattttgtggggaaaaaaagtaattttctgatactgtcaattgtatcccctccagtawacatagtttacaatggcacaatgaaactctaaatatattctgcagtgggtaacaaatagtgcctgccaaagtgtratgctagtgtctcccttcartgaacaagtttcattaatttgctttaaatttggcagagggctggcttttgggaacaggatggcagatacttcmttatgagtccagctggtactcataaatagttgaattcaacctagtatatatacaccagacatttgtccttataagactgtatgtcaagtatagacatgcaatctaatagacacatccagaggccaaatagga

SEQ ID NO: 21779 - DNA, 600 bp, Bovine  MMBT04342
tcagggcccctccagctcatttgaaagagaatctttgccttggcctgatgaccggctgaaggtagaaaaaaagaccagttggaatacacacacacgggaggcttagaatccacagtaaaagaggttgcctccccgacagctgggatttctccacttcaataactagggtggagtacttagtgtttttctgcactgctcaaagttacaggagcatgctggaaaggcagaaaattagactttgaggggagctgctctctggttttgctcaatacagatcctcttgtgaaatggaggcaggtkcagagtaattcttctagctggggttaacactgccatgattcacaatcctaatgagaatggagtcagcacagcagkgtagagatgacctagacacagagggggacagagaaaggaatactttccccaagcctacctgagctgcggagaacttactttcatgctcctctgagcagacacacagactttcttcacttaacagttctgtttgactactaactagggcaactcatctgcagatctagtgcccctcattcaaatggaagtatgtgtctccaggaaagaagatacaggacacagtta

SEQ ID NO: 21780 - DNA, 597 bp, Bovine  MMBT13357
tcccagagctccggtcctcctgcatcggagacagaggggaaccctgcgccagttaagccaccgagagctgcaggctgtgctccagctgggaggtgggtcaccagcaaaagggctcagagagagattatctcccagctctctcctcacaagcctaccctgggggcacggctgctttgtttcgaggtaaaacacgactgtgtctcttcagggtggcaggaagagggaagggatttacagggattccatcaagctagtgacttatgatgtcagttacaatctgagggtggaaacaggcacaasggttgaatgatcacaagtttgaggaagtgctgaccaccgaccactgtgagcgggagatcccacgccagggttcacaatgtcacaatgcccrgacaaaaattgcctgctactgcatgtgcggtgtatcagaaccttgtccaggtgtcgacatcaaaaaaataaagcgcttcctgcttgtacatattttttctgctttaacatttcactctcccatccatgctgcaagggaagctaatttctactttgtatgctctagaaattaaccaatagatgcatgcacatccattatcccatctt

SEQ ID NO: 21781 - DNA, 600 bp, Bovine  MMBT06486
tcagtgcgctgataggatgctcttggctgtagataatagaagagctgactaaaagccaaacgtttttagggaaatgttgtttcatgcaatgaaagggcagagccatggagattccaggtttaattaagaagctgagggctctggtgtgtgcctttctctctgctttgctctctgagtaatgatcacatacccctcaggtcacaagatgctaccataccatcacgttcaatgctcaaggaagaaacactgcatgtcttcctgagaaatggcaggaattgtctagaaactcctagatgctcyccttaagaccacctgagctagatgtccatgctcaagatactgagcagctggaggaaagaaccatctggaagtcagagaaagggccagtggttgttggtgacaagtcatgtctaccacacacagataagcaagaggtcgagggaagagttttcagttatcaccagattcctcttttgcttttgaaatgtttcaygtcccattatcttcctgttccactggacaccagtgggctaagattaattaaaactcatgaaattttttccttggtattttgaagttgattttaaaacctggccaagc

SEQ ID NO: 21782 - DNA, 588 bp, Bovine  MMBT07295
ggaatgtgtttaaataaatgtattgctagattttgcctttttttttaaagaagtttacatttatgaggacagaagagatgaatgtataattttttctaatattatccttttctgattaaaggaacaagttttacatgagaccatacaagcgatcagggagcttttgctcttatagtgttccctggatatgatatggatgatctgattcatgaatatttggtgtaactcataaaatggtcagtcaagagagttcttggtgtgttcgtgtgtgtgtgtgtgtggtgaggtgtgtgttattcragtgtattacttattcttgagtcagttttgacaagttatgctttttccaggaaactatttttcacacttagagattcattaacagatattgatagtattttttattttctatcaagcttgcatttgtaaatatacttcaccttttttttttaacttccaacattgtttgttatttcttttctcctctttattcttgagaagtctcaccaaagatttgtttatttttattagtattcaaagaataagctattaatttggttggttttctctaaggcattcaagtaatct

SEQ ID NO: 21783 - DNA, 598 bp, Bovine  MMBT08044
  misc_feature (1)..(18): n is any nucleotide
nnnnnnnnnnnnnnnnnnattagatgctaactagatgcttggatgtgagtcttaactatggaactaaaagcttctaaatgtaatttatgaatgttttttcttggtgattaaaggaaagagatccaaaaccagaaagaaagagagagacagagaatagagaactaaacagctgtgaatttctccagaaagtactattcagtcctccctaattttccctgagcaacaatcagcaaacttctcattagaaggaattttaaaaggtttgctgatttgcaaaacatgacatgagtgatgtatatrcactacttgtataattggttttgtgcatacatatggcacgtgctattttggaaatgtatcccctctgtggtccttatagctattgctcactctattccctgataattatttatagttacttgtcacrgttttattattaggaaagtaatgaatcagcagttttatgcactctcctttaacaacctagtcttagaagtttccaaaccacagtgtatatatagtaatagaaagcaagcagattgcccaaagttatttatagatattaggcagaacatttttcaaagatcatctaagcttt

SEQ ID NO: 21784 - DNA, 600 bp, Bovine  MMBT00549
ccccaccccccaccccccacctccggactagggcaggggagaagatgcagagaggagagcaggttgcttttgccctgagtctcagctgagctcatggatgtggggaacagccaggcttatttatactgagcctggttatattgtttcatttatttttgtctatttgtctggctctgccaggtcttggttgggacacgcaggatcttttagttgcagtgtgcgaactcttacttgcagcatgtgggatctagtttcctgaccagggatcgaacccaggccccctgcaccagcagcatggcrtcttagccactggaccaccggggaagtgcctggttattttgcttccggagagatggaagctgccactggggttcagctttgcggtcctgccgggctgcgtgagaggagtagggctgaccctcctgtttccgctttccatcctcttttctccctccccaactcttctggggaacccgaaggaggcagagatyagctcaggcctggatttgatttgaagcagtgggaggaaaagggcttccctggtggctcaggtggtaaagaatccgcctgcaatgcaagaggcctgggttcgatccccrg

SEQ ID NO: 21785 - DNA, 600 bp, Bovine  MMBT00649
agacttgtcttctaaatagcttcacttctttttgtacagcaatcagcagctccagatgtccttacacgatttgtaaagagctgaagacctctttagaaaactcaaaatagatatgtagacgttataatccataatatatgtataaacctttcctctactttttcaagatgttgattaaaaactttaccagaagtacttggatagttaagtggcttaattttttttcctgattggggtttaattttctaactgggcagtctcctttgttgtttcatgtggtgacatcattatctagtgttwttcttttctcattcctatgtaaatccgtgtctcaccacaccagaaaaacctgatcacaaatgctggttttctgaataaaacccatcaggggcctttcatatatgctggtaaagtccagtcttttcatgtggcttacagaagactccatgatttatccctcacattcatattccaggcctgtcaaacacaacagcttattcacacctctctgccttagctccagttgctctctctgcaacccttcccccaaggtcagcaggtgagcgtgtaatcctctttgaggactcagctgagctgtat

SEQ ID NO: 21786 - DNA, 600 bp, Bovine  MMBT01549
tatttaagcactcactgtgaaaactgatttcttctttataaaaaagaggatctcttttttcagtctgttctttgctcttataaatcttacttggccaagtcactaatgaaaaagaaaattgggtaaggtccatctgaatattctgagtccttcacaaaaactaatctaaaaggaagtcatctttgcagggaagaaggtgaaagagaacaaagatgtgaaggcaaaatagagtatttttattaatgcaaaggagagagatggtgcagagatagttattgtgttttctgcatggaatggacmaaagtgttatggacgagaaaaagaagcagagagagaaattggaagaaaagaaaagggagaacagggaagttgtgaggcagatactgctgagggcaggaagaagggaagaaaaggcactggcaagagctgagaaatgattgagattcacagcacaacacgacggatcccgtctcctaccgcccagctaggcctggaagactagaaatggcagtccacgcgtgaattcatccctggctctgtatttcctccccttcacagcctgtcttgcaaaaaccatcagggagccctaaacatccctgc

SEQ ID NO: 21787 - DNA, 573 bp, Bovine  MMBT22114
ttggtggtttagtctggggaacaacaggatcctggtttctagcactcctctgaccaagcacaggtctgacctctccacacctcagcgttcttacctgtgtattgggatagcaagaaaatcttgctttgcagagttcttttaagaatcatgggactgtgtttgtaaagcaaacaaaggttattgtaagttcagttggaatgtcagtaacgtgcattcccttgaggctccttttcccacaraagctcttttataatgagggttcagttccctttgatgcctagtaaacccccatgtaccaasactagtgatcacagcactgaagctgtgctgacagctgtgtccagcattgtttctagggctcgttaggccccgccccctgcaggggagctttgggtccctaagcccaggcccatctgagatgcttccagaaggcaggcactgactctccagcctgccttctaacagtcactgttcacagcaaaggcagtgggcagaacacagtgccctgcttaagtcttttctcagacttgcagataccagggggcactgtgtacttaattaactcaccaactc

SEQ ID NO: 21788 - DNA, 600 bp, Bovine  MMBT01882
tgcaatgcttctttcctttgaccacaccccccaatcaattatattctatctgatacagtcttggtcacacctaccctttttgatatgattatttaagcctactttaaaagcagttactcagctgccctgcagatgtcagactttctggcaccagaggtgtggcagacctgctgcccccaggatgttggggcagagaggaacccagcactatgctcagtgctcagaatagtgggcaccaagaatggtttgtagctggacatcaccaggaaaaaagaaaagctgcctcagttcccagtatgygttcataactaacacttaccccaaaattaacaaagacacatgtgtccaaaatagtgtctgaaagaaggaaaaacaaaatgcaaaatataattgcatttctttttagggtgagagagagggaggagcaagcagaagagctggaaagagggaacaatgtagagagagagattaaggttgattgatgtgacaggtacaaatctcttcccaaaactcacatatggaagacatataatttcttttttttttttttttgcaacaaactgaagctatcttaacctaaagttaagtttcattttgagc

SEQ ID NO: 21789 - DNA, 600 bp, Bovine  MMBT13515
aagctctataggccaaagcacataggtatgttaaagtacctgagaagtctggctggaaagaagcagctttaactgcctgtaagtatttaatcatggaactttaggttgagtcaatattcattaatacctgtaaaacrcatttcgggaaactgctgtaaagttgtgagagtgactgttttttccctaaatgttccataacgtaaacccgagtgctgtcttgtagaagagttctcttaggaagttgtrtgctaatttcagtgatgctgcgttagctcaaaatatttttaaaacttagatctytagaatctccttcaaagccttttgtaaaccacatcattaatccaaaaagaataattttacctgttattctatactagtataatttaataatgtgattattatatataatatacaattattaaatattttataaattatattataaataagatttgtagattataataaatatatattatttataataattgtaattgtcactatttgtggagtgcttttatgtgctagccacttatatatagtacctcctaaaagtcctgtgaatttgatcccacatatctagggtctaaagctttatag

SEQ ID NO: 21790 - DNA, 600 bp, Bovine  MMBT05416
gtgtctgtggatttgtttctgttttgtagacaggttcctttgtgccatactttaggttccacatgaagtggtatcatacggcatttgtcgttctctttctgaccgacttcactgggtgtgatcatctcggcgatgatgagtgtgatcaacacgtgaggccacacgtgttgctgcagatggcggtgtttcactcttttcagtgatggagcaggagtcattgtgtgtgtggatcacatcttctctctccattcctctggtgatggatgtttagttgttcccatgtcttggctatttgaatarcgctrctctgaacataggggtgcatgcatctttttgaattatagttttgcccaaatattttcccaggagtgggattgctggatcatgtggtgaattctatttgtagttttctgaggaacctccttattgttttccatggcggctgcacctacttacatttccaccaacagggtaggaatggaatctgggactcttagttcccaactaaatgcctttctgctatatcgtgtgtctttcctattatctcaatccaacaaatagcttatttttaattctctggtttgttgtggtggtgtagaa

SEQ ID NO: 21791 - DNA, 600 bp, Bovine  MMBT09726
ctgtgctcctggcggctacgagcattcggcactggctgcctctggtcctcgagcggttttgtacattttgctctctgggacagtgtccatttggactcacagcagaggggtagaatgtgccacaggtccaaggccaccgatgagatcatgccctgcacaaaggcaggaagggaggcaaaatccagcccattcyccttctcaaggcttgtgccacaccagggytcccttagccagaagcagattgtctatttctacctggtctgtccagggggtgaatctttttgcaatttatactaagastctgtacaccctgtggtcctgcaaggacctgaaacgagtgagcttctcggccaagaagaccataaaaccccaccagcygatgtgttgctatttcagaagcagaggaacccacaccttggtctctggggccagagcgagggcggctgaccttgttcctaatactcaggcactttgttttctagaatgcatcagaatcagccctcaagagataatgaaaataaccttacctgggggtgagatggttttcccatcggccataaattcctgtctctcatacttagctcgaatccactgttcttt

SEQ ID NO: 21792 - DNA, 600 bp, Bovine  MMBT02215
tgacacacggcgctgcatggtttactcggtaattaaaacatgttctgttaattagatgatgaccactttatttcagggctcttgtgtttgggttttctagtgtgctctgtttgtatcatgagccaccagacgctcttctaatgagtccttgttttgtttcaattaccacctgctgttcaaaagcaaagcttgttttaactaaacaaaattaatgcttgtctcttcctttgtaagaacttaaatgttagacaaattaatatgcttattatcgaagtgctaagctctggttttaaagactgstaaggcaattagaagaaagttataaaatgttgtagagtgtggcataaatattgtttagcgtattaagaggcattacaaacaatgaaatatttgctggggttgaaagggagcagagagacttagcctccccaccyccaaattaaattagctcttgcaatttgcacagggatatccagaaactaaagatactagtgacttcctaagagaaggaactgaatgaagtcagacatgaaagtatgtggcacggctataaataaacccatgaatgatgttggattgccctgaatggttttcaaaact

SEQ ID NO: 21793 - DNA, 600 bp, Bovine  MMBT02161
aatctcttttctacattagagtgctacaatccatggactcgtgaatatatttttgtaagactggctatgcttctgttgaataaactctgtaagttaaattgctacactgaaggacagtctgcacagaattaggaattatcagaatatccactaagtagggtataatatttacatacttagaaattgtattgtcagctccatctgatataactaaataccaaatattgagtggcttaaacaacattaatttattttctcctagttacagaggctggaaagtttaaaatcaaggtctggcargacttagtttctgatgaaaattctcttccttgcttgcacatagccactttctggtctgcacattatggccttttctccctatgcttatgcagaaagagaaagagggcaagctctctcatgtcttctgttatcagggcatagtaccaccacaagagtcctaccttcctgacctcatctaactgtaattatatattatatatggccataataatatctcccaccagtcccatcttcaaataccatcacactgtggattaagggcttcaaaatatgaattaagtggaggacacaaacattcag

SEQ ID NO: 21794 - DNA, 600 bp, Bovine  MMBT03199
ctgtatcattgccaggtggcgctagtggtaaagaacccgcttgctaatgcaggagacataagagacttggattcaatccctgggtcaggaaaatcgcctggagaaggaaatggcaacccactccagtattcttgcctggagaatcccatggacagaggagcctgacrggctgcagtccayggggtcatgaagagtgggacacgactgaagcgacttagcaygcacgmgtgtgtcattgccagtaggaygtcctttcagtcatccttgtgttattattcccattttcctaatgagaaaacsaaaacgcagagaagtggagaaacktgccccgtgagataagatttgaatcatggaccgtccaacttcaagtccataccttttctaccgtatcgttctttttacaaaagatgacacattttttgaaataaaatgaatagttgctcttgttgatctctaagcccatcttgttgaatagctgaaaaggctcccattcccataatttggaatttttccccagagactccccgtgggagttaattcatttgatggatggccctctgcacccctgtgtactcatgtgtgcctgctgctaaatgctgc

SEQ ID NO: 21795 - DNA, 600 bp, Bovine  MMBT03096
gttggtgtgaaagtcgccccacatgaacccatcagtcatcaggcaggatcttttagcctcaccgtcagggctgagattcagtaaacatcttaaattctcccctggaattatgagagtttctgtaaaagaaccacacacacacacacacctatatgaaagatacacacaacaatatgaaaaccaagcccatactttgctctgcttatctagcaagggcaataggtctgcaaaatattgtaaaaaattaagaatatgacatttccaacattatttcatgatcatctatataataataaataycagatatcttctggatagactacaccatgcaagtggttgtgttrataacattaaataattcttacctgtatcctatatcttctctcaaaaatcacttgtgctcatcatctaactacattacaggcctgctcaaaagkcatttaaatcatgtttctctcttccttaaagctcttcaggggtgcttataacatataggttacaagataaagtctgaatgtcttagcatggtgccagggctccttgtcttacttctttataaatattgcttatattttctcctttttaagaygttcatttcac

SEQ ID NO: 21796 - DNA, 583 bp, Bovine  MMBT19004
gtctccaatgatgaggatgataatgaggaagaaacagtaacgtaaagctttccagggctctgaaaaggtgtggggttatctgattggccatcagtgcagccttgttacagctttcctgtctgctttttatagccttctcctacctgatggtggaatctggccggtcacgttgtgctgctagttggggatgtgccttttcgacccttgacaaattgtccactctcagatgctttggatgaggaaagctaagagccagaagtgctccagaagaacaaataatctctgatgtggggcaggagrggccaygttttgatagaaatkaaggcaattaggactatgaattgtataggacctattttgactgcttagagaatttgtttcctgtttgggtcaaaggtcctgcctggtgtttgaggttactgagaggacagggtggtgatgttgagtttatgtttagaaccctcagtgcttccaaggttctggtcttccccggaccctgtgagagcccccgggatggagggggatggcaaagcgcaccgcagaggagggccagggccagctgcagagcccctccggtgacgca

SEQ ID NO: 21797 - DNA, 577 bp, Bovine  MMBT19005
aatgatgaggatgataatgaggaagaaacagtaacgtaaagctttccagggctctgaaaaggtgtggggttatctgattggccatcagtgcagccttgttacagctttcctgtctgctttttatagccttctcctacctgatggtggaatctggccggtcacgttgtgctgctagttggggatgtgccttttcgacccttgacaaattgtccactctcagatgctttggatgaggaaagctaagagccagaagtgctccagaagaacaaataatctctgatgtggggcaggagrggccaygttttgatagaaatkaaggcaattaggactatgaattgtataggacctattttgactgcttagagaatttgtttcctgtttgggtcaaaggtcctgcctggtgtttgaggttactgagaggacagggtggtgatgttgagtttatgtttagaaccctcagtgcttccaaggttctggtcttccccggaccctgtgagagcccccgggatggagggggatggcaaagcgcaccgcagaggagggccagggccagctgcagagcccctccggtgacgca

SEQ ID NO: 21798 - DNA, 600 bp, Bovine  MMBT23226
agcacgctgtggttttgtccctttgtgtttaacatcctccccatcccagatgatatcatcttcccaatgcagctgtgtcaccatcaggaagttttcatcagccagaagatcggtgccactgctttcctcaggtatcctgtattcctacagaagtaggggaagaacaacaaatccctgaatggtcactggtcagagttcccatttcaaatcccacagcagataaatcagatacatcaaatgtggtcctgacttgagagacacacacctgataatgaaggaatacctgcctcctcccactcytagtctggcacaacactcatttcacaaacaagaatccttgcaatagggccaagttgccagggcgatataccacaccaaacaaaaggtttagacacctcaatctcccaccaaagaaaccctactcagtgtctccccaattgaaaagtaaagtaatactgatagggctctgggcacagtgattcctttcttacataccgtgttgcttacatccgccattctacatttcatcacaggttcctgttccatctttcttagtttgaagccatagtcaaacccactgccatcttcagggacacccag

SEQ ID NO: 21799 - DNA, 446 bp, Bovine  MMBT12044
tgaggggaacaccgctcacttcacacactcccatactatttgaatggttttataatttgaaaagtatataaaccttttacaagtctggcaacactgagcatgtactgttttaacccaaataaaacgtatacggatctttaactgggaatataaataaaacctgacatttaaactcaactgctgagagggagggttccatctacgcccctgccaggagggaaacgggggcggattcgaggcgccctctcccgcctcctccccgttgacactaaacttcccagtgagttggttccctctttscattcccgagattgggattcagatctcttttacctcaatccattttttgaaagaatctgctagaaacattcagccctgaatgtgggaaaactttcagaagagtccattcaaagcctttaaaaaaggaaggcaaagaatacggcccg

SEQ ID NO: 21800 - DNA, 600 bp, Bovine  MMBT08674
ttttggcaaccatagatttagtaatttgctctactcacatgaaaaccaaaaggtgaactcattttgcaccctttgcttttttttctagtttcctttatagtgataatgcttttcattgtatgaattacaagtgcaagtaaattaagaatgatgtgattgacatttgagctatgaatgagcattgttcaagttaggatacatgtcttaattaaaatgttggtgaatggtaaaggtagacctctcagtgactttcttttcttttttgttctgaatcattgtagagatactttcatttttgcyaatctgtttatgtactttgcctaaagtgtagatatcgaattagattatattagtttagattcagtctgcaatgacttgaaactgtaatgaaaacacacacacactttgtgtgtgtgtgtgtgtgtgtgtgtgtgtgtgtgtctcctttacagagatgaatggttgaaagcagcccatgtgtatctcctatgcaaggtgacacccctctctcctaccgaatctcttttaggattgttttgtatagattcctgtccaagggctgaaggatgaattacatgacctttcgacatcaattccatc

SEQ ID NO: 21801 - DNA, 600 bp, Bovine  MMBT03597
gtgccatttcccagaaagtagtgaatcatagttttgaaactgacagtgctccatacataacaaaaaaatattgtgtttagaatgttttcaggtcctgggttgaggggagaagcagactgcagggtattaaaaatctttttttctaggctgttagctttcgttatgctattgtattttttagattatgaactaaaaaagtgcttctgacagagatgttttatagctatatatttaaatatgagggatacctctttaagaagtgggcatgaaaagtggaaacaacaatgaatctgcttcagyttgcctctatatccattgagacaatgtcaaggaaggtttcactaatccgtccagttttgtagtgagtagattggcgattgcttgtagacttaattcaaaatatggttctccttggtcagaaaaacagattgaaaagactaggacaaatggcttttatgtaatgtcctatacttctgatagtttaaaattttaaactattgtcttcaatttatgaggttagttactttaaaaattcttcaaacaagcatttctggtaaccatttcaatgccacagaattacaaagatgtaagagttattgt

SEQ ID NO: 21802 - DNA, 600 bp, Bovine  MMBT19473
ttatagctggaataaactttaaattgctgctttaaaagagaaaataaggggaagaatgactcctgaatttctgacatgagcaaccaggtagatggagttagcatatattaagacatcacaggcccaaacgggcagatgaaagaggatgagcaagttccaaacatgtagcatttaagatgcctgtgaggtacctgggtgaggtgatcagtttggcagttgtatgtggggaactgatgtttagaagaaagatccaagctagaaacagaaaaaaaggttacattgttggatcataaattatakgcaaaactttgttaggagataagatttctcaacaaaataagtgtaaagtgaactgaaaagaaggtacaggactgaaagggagacaaacagtagaaccaggactgtaatgccatgaaatccaagaagaaaacaatttgttccctatttacttttaagaactagatctggttctcagcagtcagagctcactcaccccacatttggcatacactcaaccccacatctgggtacaaatacacatcactcatcccacatctgggtacaaacacttctctactctctgctctcctataaatcttc

SEQ ID NO: 21803 - DNA, 600 bp, Bovine  MMBT04258
atgattagtgtatgtagtatttatgactcagagatactgagtttccaacaactacacactttctctttttgtaaaatctgcsccacactgatagtgttggcctggacctctggaatgaatccaatcaatgcatttgatcttctaaagagtgaaaatttggtcttgtttccccaccagactttgcactttagaaagtatattgtgggattctcccacaatttcttctccctccactatagaagtttctttttcatcactctacttaaagggcctaatattattgcagtcttagcccttttkgggggatgcagatttccaggttcagcaactatagattagatttgagagaggagattcaaatgcaatagtgctgcaagaagatagctcctatgctgatttagaatcagtaaaatgcaggacaggaaagactatgtgttggcaatagggcttgatacatgtttcaagagcaaaatggaaactgtcttcccatggtttgcaactatcaatcactaaaaagatcttataagcgaaaggctgcaggaggagaaggcctgcctcctccttcctcttctcccagggtggagacataggtttcaaaat

SEQ ID NO: 21804 - DNA, 600 bp, Bovine  MMBT07838
ggatatctgtatttgcgtatcattgattgggtgacctctttatctagcatagcttttcttcacattctccagatcaacaaattcaccctcaatatttagaagtccacaagatttatggcaagaaaattagatrtgtcacattatcacctgctctaaggtcagtattgtgcaggatccttatttattaggcagaacagcctgctggttaaaaaaaaaaaaagaaaakaaaactgcttaccatctctgcaaagtctgacatgaggcacgactgcttctttttttaaaaaagtactacagtawcaagaaggttttgtatgaagtgacctcttcatgttgtttgatgcagtagagccagaatgatgtttctagaaatctgttctctgggtcaaataatagcagaacacaattagtctagaaaaaattaatccaccttatgtgaaartytcaaagctcgcaatagtgacacacatagtaactattgggaaaagggcaaaggaggtttacataaatccctgaaaaagtryatgtttaatttgaaaatcctggcataattttctctttgctctaggacttgatttacacatttttcttttcttacca

SEQ ID NO: 21805 - DNA, 600 bp, Bovine  MMBT09179
aagaaggaattatctattaaagaagctcttaattataaattcaatgaccaggacattgaagaggtaagaaacctcgtatcccagagtctggagactcatcaagagccaagtgttagagaagatcatgcctgtcttttctttcctgtattttgacatttttggctctaccactattgcatgaggaagagggaattctgttattactaccttagaatttatagttcatcaggattttcttgtacactgtcacttgaaatcacagcctaacaaagtagattcagggctcagggatctctgttyttctgctaggcttggtccttcaagagtttcctttctccaagacattttggtaaaatggtttgatctctgttctcttggacagaggatagccttacagtacaaggcccttgggctgctgctgtttattggtgcatgttcctttgcgctagccrggaagactctctgggaccctggaagcagcatagtaccccttggaatgaactcgttctgggtgtggggcatggcactgccataggaagagcagccctcttttaactatctgcttacctccacaatgggctcacctgtcctgcctacaaa

SEQ ID NO: 21806 - DNA, 600 bp, Bovine  MMBT05209
aagaaataaatgcttccattctgctggagggactgtgaattaccgtcctccttctttgcaatacagaagatatgacacataattataagttaatgaaactgatttttacatgtgaccagagaattatgaaattatagagctgaaagggtcctcaaagttagatcattcagctataagttactgcttgtttacaaatgcaaacacttttactagcagccatggcttcaaacttaaaaacagaaactcagtgatcttgatgcccttggatacagtcctgtccattgtctgatcctcggcttyctgaatgatgagaagtgggyacagtaatagccaagcggctccctggtccctgggtcacagctagggcgctgtgttcctgaagtcaggygttcctgtcacagtycagtggtcaccttcctgatggtggcacacaaggcagctctccagcaggccagtttggaactgtgttccctaaaccattcctgcagccaggagcctactgctctagcctttcattgatttctatgttcctaatttcatgcatcaaattccttttctgcttcagatactcagagtggttcttatttcctgacaaragct

SEQ ID NO: 21807 - DNA, 600 bp, Bovine  MMBT01889
aatcccctacaaatataaatcatatttataattattttatatttattttgaatttaactaaatttataatttaatttttgtggtattcagttaatagtgctttgttaaatcaactataatgttaatttaataaaatatcttgaatatttactgaattaatttttctggttaaaatgcaataagaatgtttccatctgaacttagcaccattgctgatagaacaccttaaacaagaggaaatctaattattttgccattgaaaaggtaacagtaagatcatttgtaatgatgtagaataaytgcaagatgatcctgagcataaaaataattcctgaataaaaaacaacttgatttcaaaggactgacaaagacaagagggcaagttctatggaaattggacagtatgaaatgaacagtggtgaaagaatgataagtcaagaagatggaaagttaaacataaaatatcttattatcatatctattcagaatatataattctaacattaatgaatttgaggtaacgtcaaaaaaaagctagaaatagtatatttaaattgctaactcatgtggaaatgttgcattttctgcaacaaaaacaaa

SEQ ID NO: 21808 - DNA, 600 bp, Bovine  MMBT13624
tgcttaaattcaacaaccctaaacatcgtcatattactcatttatgttgtattttgctcaattatttcaaagtgtgttttagaagacctgacttaatcactaagtacttratcatgcatctcttcaaaaaaatactctcctacataagcacagtatcattatcacaattaacaaattgaaaatacagtcagttctgttataatgcttctcatgaaatgtgaatttgttccaatgcaattaatacattaggaacaatttgagcataacaggactttgaatttgcttatgactatgatgttktcagaaagctataaatactttcagcttttctattatttggaacaggatccaatcaaatatcagattgmatttggttatgtctcttaaacaccttttttttttyctaatgacactgattttttgttttgttttgtttttttgattgggccaactgtcttaatagactatcttagattgtttctgggcttatctaattgtatcctcaaaatttaatttgtttctcccttacattttctgtaaaatgttatttagaaccaaagttttaattacagtcagttatatatttgggaagagcaactc

SEQ ID NO: 21809 - DNA, 600 bp, Bovine  MMBT07163
ttttaatatgctgtctaggttggtcataactttccttccaaggagtaagcatcttttaattttatggctgtaatcaccatctgcatttagtcacttagaaattgtgaatctaaccactggacaagaatgacagcaaaattactaggagctcaaaacacacaccacattatggcaactgctattattgatataaaaaaaccataatgtgatcatgattgcacaaaagaaccaacatttgcacatgcaaagcacatataatttgaaaaatataatttctctggaatttgcaaaataaccaawcttgttttttttgaatgaccgttacatgtagaattttttatagataccactaagattaactatcctaataggcctttaaattatgctgataatagtacataatctgtgctaaaagaagcctacatgttattcccctaacaaaccacctggcttgctctgtgctaaaagcacgtcatggctccaatgacatggagtctcttgcatcatgtcttatcaagtttccacaattttgtgactgcgggattttctcctataagacttctgttttccatcatttgcttgtgtggcctctggccactt

SEQ ID NO: 21810 - DNA, 600 bp, Bovine  MMBT00639
atcttgtttcagtcatttatttaaaaacaattgtttatcaggagtcatgttggacaccaagcttggtcctgggaatgtaactggattatgtgacattggcatcattttatatagttgaaagcttctattatgcataattttaaattaaacttgttttcaaagtataattacagatagtcccagtgactgcctctcccaaggttaacattatcctaacttctaataacaagattagaagtgttagaagattagaagtaaaagtattgcatgtttttatgtttatagcagtgacatcctacyrtgtcttttcccttttttttccttacttatttcattttgtttttccagttcggatatttttgyaatgyagacatcttgttacctagttcttcactcttgctgctgcatggtatttcattgtgtgaaaatactaccattggttaatgcattcatctatcgatgggcctttgggttgtttctggtttgagctattttagaactgttatgaacagtatgtatcctcagataacattgtatacattttatttgggtatgttgccaccactgtattgctcagtcataaactgtataaacattaag

SEQ ID NO: 21811 - DNA, 602 bp, Bovine  MMBT11367
  misc_feature (1)..(2): n is any nucleotide
nnttttttttttttttttttgcattttaagtcgtaactcttgacttcttttcttttcatggagtcattggaacaggaacgaaactcacagtatttgatatattggttcactggagatttaattttctatgggtctctgcttttacatttggttaaggtttgagagctcaaagtattattcctgacaacatgctaaatgtttgaggtgtggatgtataatgaaataaagcaataaatgtcttgtgcccatatttattttgtagatgaatctgctttgaaaaatctggcacccagtagtccaawatcatttaactggtaaccttttattttttaaaagagtgtggcatctctatagccaggtataagccccagcagaatcttggtgacagaargagaattgttccttatcctctcatgctataaggtcatttcaaggaatctggctctcaagagccacacttctaagaaagctaggcagtaccaatgagcagaaacaggatctgatattttctacaatatctgtttttattttcaagaagaagtgttcctcaagaattaaggaaatactgtggcatgtggctttaagatgtgatgaataggaag

SEQ ID NO: 21812 - DNA, 600 bp, Bovine  MMBT01979
gcaataacatatcaagcccagaaacaaataataatcacagacaaaatattgggtgaaaaatttgttgaaatgagtagtgatatttccccctcatttattcatatattttgtacttaccaaatattcatgcatcttgaaataagagactatattttgcataattgaagtgatatcggtggagatttaccaaagacagatagtgtgaagatattttattaagccatttacttcatgcagattgtatcattctgccttagatgctattttctccctttctagcccaaggacagtacataagtsactcagttttacacaaaataatcagtgaaagctagtaactaagaacattctatgcattttgtaattgctttgtgataaaagagtaaattctacaagcactctgtgtggcatttctaatgtttaggtaataataaagtttgatatgtacagcacaggcacattataaaaattaattagccagggacccatgaaactcttggagctcaaaaatgaaaaagagctgtgtgaactagtgccaaaaccgtgacagaagtgccagtgttgtagagatttttcctgtttaaaatcatttctaaattc

SEQ ID NO: 21813 - DNA, 600 bp, Bovine  MMBT13900
gctagagccctttcctaggatgtgggtttatcagtgcccaaacagggaaagtccgtggtgagctggattggtgggccaccctaccatctagtggggatacagataattaagaggccatcccaggctgtccagcagaaaagtttgggggtcatggaagcactgagttgggggtgagtgaagcttgggatcagggagggcttccgaaaggagaagggcatttaagctgagacctggaggatgagagaggatgagctgagtgaaggagaggtgcgggagaggggagtgcacaagcagacaaaygcatgtgggcagagctggaaggcagtgaggttgtggcccccaggtgggtgctcggggaggatgtaaggggcagtgtggcagagatgaacatgcatatatttgcttatatacaacggttgtcttttggggmaagcattgggggagggggtgctggagaaaagggttagaaatcctatggagcttttgaactgtgggaatgtaatacctataccaaaagataaaataatctaaaccaacaaccacgcatgcctgtgctcacccctcccctacgcccagctcattccagccgggggcctgcag

SEQ ID NO: 21814 - DNA, 600 bp, Bovine  MMBT10248
ctttacagtattgtgttggtttctaccaaacgtcaacatgaatcagccacagtgtgttcattttaaatatgttactctgcatgttcacagggtgtcaccccttcagacatgatatatttcacttagaaaaggaaaaaaggctttgggtggtgaagacagcaacccaaagagaaggaaagtcaggtaagaaccaggcagatgggggtccttagagaagccctcccatgtgtttttgcttctctccaaccctttggctggcatctcgtccaaactgccagacctcttctttaacacaccttwgtactggttgccctgccccgcctatagtctgttttccaggtagcagccaagagtgatgcttaggcaagactgccattgctctcttccaaatcttttatagcttcttatttttcttamagtggctctgcagtcctccaggatctgctcgtggtcccccactgtctctctgattcctttcctctcgctccttgtctcctacccatgctgtacaccacaccaggctcagactcgccagggatgctgtatcacccgcggctgcctgaacaaatcactgcacacaccatagcttaacacaacaca

SEQ ID NO: 21815 - DNA, 602 bp, Bovine  MMBT23121
  misc_feature (1)..(2): n is any nucleotide
nnttcacatcctgtttcttatgattgcccagccagaactttgaaaacaactttacttctttcttcatgaacactgttctcaaactgatgtccttactctgaaatcttctgcactcctccccaattaatctgaccgtrtgactctccatttcataaaccgggaatgattcttcattyccaaccaaataaaatctaggctttgtagcttcccttttctatgatctgaccctgaacctccctctttttttttttctctttcctctacaatgccttctccaccatttctccccacaatatggcccmaaaggtcatctctccacttcagaactcttccagaactttatctttacccaacacacttctgtgcaaacagtaaccatccaataaccaactgaatgaatgaatgaccttcagtcttgaattctaattctgaagggtctgggggctaactctcgtgaatgtccctacaactggtgttctcaaccatagcattttggttcttgtgagttatgttataattaatttgtttctagtaacaaaacacaacatttccaaatgatttatttttctcataactagagtagattcaagatgatccctata

SEQ ID NO: 21816 - DNA, 600 bp, Bovine  MMBT17480
tgtaaatagctagatcattatgttgggacatatagttattgttcagaattcatgtggcaactcattatcttaaaagtggcttcataaattaccctgatttcagtaattactgtgtgccatgttaacttgtactgaagcagagttaaagcataaaaatctatcaatgacaaaaatattttaaaaaaattttttctattgacataacacaactgaaatatcatgtagaaacagcattaaaaattccaaagaaagaaaatgtcatgttttgaatgtcttgatcagttcaatgaatacagttargagttcaatcaatgttcttcaataaacacatgaattagtattttataktatgtttcattgagaactgacatattatctatatcctgtatctgaaaaagttaccatttttgtaaaataagaaatttgctgcttttgaaaaataatcctctgtatctttaatatagcttcgagtgttaaatgttcactttgattatgagttgatgcatgtgaaacaaacaatttatcatgaggaaagtaacttaaattttatgttgaaattattttcttatgcaaggccaactcttaaataattcaaagcaa

SEQ ID NO: 21817 - DNA, 600 bp, Bovine  MMBT22052
acagtctgggtctttttttgctcctttattgcttgtccaagygaatctagggtatagacaccccatgattcccaggtttggtcatttgcatgcagaacttaatttgactgcatcaactcctattcccaaaatgtgggtgaaagtctatgtgtccatatttacactgtgtttcctggtgtttaaatgtgtggttataatttttatgtagggtctmaaaaatgattattcctaaagataaaatttttggaaatttgaaaacatagctttgctatatccctggtcttcagctttcactgctgktctttctcctggcacactcagctccctcctgccccttcaagcagctttcctctgatcctcacatctgatttaattgccctctgctttttcccctcctgtctggaactttgttctcgtcagctctgtgctgtgggctttttgaatctcttctgtcagcctttcagagaatwgccagcagagcgtgttgctggctctgtataaaatcttggggtacttgggcggagggtgagggtgccgtccggggcctgtccctcccgtctgccagcgtgcacatcccctgctcatccgcgtgcccccgtg

SEQ ID NO: 21818 - DNA, 600 bp, Bovine  MMBT14395
gttggaggctgacgcatatttagaaaggaatatgacaatttgccaaggtacagaagatgcttgctccatattgcacattacacagaagtctagcacagtttaaactacttctgatgtttttcacaaagaaataaaaacactttaattctcaatatttctaatgtttaaattatattctactaaagaaatattagttttacaatgttttcattttcctccttataactggcagtaagagggttttcaatgttttgacaaacatttttagcrtatggaacaatgttcatcttcctattgatkactaactttgcatgatttcagtttactcagtcatgtttagggwcctgcataaccattcagagtgagcactgtcygcagtctttaaagcagggttacaaactcaaatgacttctagagccaggaaggtcaggaaaatgagggaagcaggaaggtaatagataaattccccagcctttgtgggaaatggtggagactgtgccctagagagctttatcctgtctaagaaaggcagcctctactcaactctatggagagctgagccaggagaaatgctggccagggttgccagatctgattcct

SEQ ID NO: 21819 - DNA, 600 bp, Bovine  MMBT14742
cctcaatttcattgcctctacactaggaggttagtaaaggttttcagtctctcactcttgtgtgtattaagatgtgcaagtagagaaagagagaaaaatactacttttcccaaaacttacaagaaaaattaaggcctaaaccttgggttgcatctaactttgttctttatctttaatatagcagatgcttaataaaatttagctgcagttctctttataattatcagtattatttttagtagtaataggatccaggatttggaagcaggttgtctttataacaaagcaagtgtggggaayatattgccctggacctaccttctcaataggaagtggagattgtatatattagctggagttcacccaagctacttttgggacaaacagatcatgtgttctgaacagaggtcaacagctgtttctcctctgtggcttccagaaatggggacagatgtattcagactgaccttccttattcactgagtgtgggaacggttggaaagggtaggggggagggagataaaacaagagggagggtgggaagattcccatgggggcccagtaatatgagagagcattgaaagcaatgttcaagttaac

SEQ ID NO: 21820 - DNA, 600 bp, Bovine  MMBT04849
aacagaaatactcagtgtataccttaaactaacacaacattgcaaatacctgtacttcaatttttaatggtttaaaaaaatactcagaaaatatagggaataaagtatatcaataaagcataccaaacacatttataatgattcaatgcagtgaaaaaataattttaagaaactcagaagacagagatagaaactaacctctaaaggctgtgcatggtaatgatctgtgggatctttcaattctgctgcttctttcatcaaacgtttaacagctaaaacaaaattcacaagatagagacwtttcaaataaactttttccatgtgattagcagatttacagacctaatgaataagttcctacttcaacaaaaaacgtgcagaggacttattcaatacagcatatgatttaattatgcgataatagtaataatgggggaagaaaaggcagctaggcactagaagagttacatattaaattaaatatatagggaagtttcaaagagacactatttttctctactaagtactattatacactccttattaggtagcactaaaatattaactcatgtaatcctcaaaacagctgagataggtgct

SEQ ID NO: 21821 - DNA, 600 bp, Bovine  MMBT02425
cagaagataaagaaattaagggtttcccagggagctcagtggtaaagaatccacctgccaatgcaagagaagcaagctcaattcctgagtcaggaagaacccctggagaaagaaatggcaacccactccagtgttcttgcctggaaaatcccatggacagagaagcctagaagtttacagtccataaagtcacaaagagttggacatgacttagtgactaaacaacaaagaaactgaaggaaatttgactcatagtacattaaatgtttcattaacttaaaaattaaggttaaagaaaawttttaaatgttatgagaaccatggcaagttgtagttacattttttaactagaattttaaatagtattgactaacttgctgcttcaagtagcatggaggtgataatactctcatacttcctcccactcctctacccttcaatgtctactgattaggctggttcattttgccagagttataatagtagcattctatgctgcaaccacactttgctgagaaaaaaaatagttttttattcaaatgaattcattgctcaccactaacccttttttatagctttgtcaaacctgatctcattgcc

SEQ ID NO: 21822 - DNA, 600 bp, Bovine  MMBT06232
ttaaatcatgttggctagtgacagaatgaaacgaattggaaactgcttccctggcattcctagcctagtttcattttaattatagacttttaaacatttgtgttgtgtttgataatgttctttgtgctttcacagacctcatctcctttgattctctcatttgatctgtttcattccaggcatttcaaaactagttctgaatcaaagccatgatcatttattttgctgcattgatttatcctgatgaagggtcaagtcagtgtccaggcagatcaaagtctcttcattgctgtgctttgwtgagtatatttgcttcctaaaatctcccttattagcctatttaattctttgaaaattcctcactaaaagaaaaaaaaaaaaacaaacaacaaaaaaagtcacacatgcactcaatctccaaatatttactcaagtctagtttgacacaattcactccatttctggtcatggactagctaaggtattcagtccaactcttagtacttgtcactatagaacatgttgtgggttccctttttctctgcaagcaaaagtaacaaacccaaacccatctttttcttaaacaagaaaatacattac

SEQ ID NO: 21823 - DNA, 600 bp, Bovine  MMBT08392
ttaacggtttctagtatagctacgaagagcactcacatcctggcagccaatttctcccatcctgaaagaggtctaacctatcatcagttctgccagcataaagtagtggctggtacccggggcacaaccaaacagatcaattagcttttcagccaaagaggcttgactacatagaattcattctccttctttataaagcccactttcctcctgagaagagagccttctgtaagagaagccaaatgagacattcaacaagtagagactatcactgacttcttgatctttgtccttccactyacycacttttttattacccaaatctacaggagctgagatctagaaagctgattcrtctaagttctaatgaaaagtcctaacaatgttatttagataactgtgatgaattttaatctgatgacagcttgtgacccacaaattgctgtttaaattaagatgcattcaaaatgaaactggcaagacaaccacaatattaaacttgcaatctgctrtgaaaaaaacacctatcaaaagcactacattaaaaatatgaatgtaattaatttctatatggcatcttgcaacttaaatctggagaca

SEQ ID NO: 21824 - DNA, 600 bp, Bovine  MMBT05617
acaaggcttctagattcagttttaccagtgaaagatactcatgagaattctagcaagtagaagacaagaagaagcctctgttgcaagaagcagcagcaggcataagggctttgcagaccaaagacaagggtttccccagcacattctgattacctgagtcagctttctctggccttcactctgcagcccttcctattctcccatatttaatgattttctacatgaactacttggaactattaacagtttttgtttctctgatggatactgaattctacaaatgtcccagaagaagcagaytttgaaatctataatgattttatcatatgaataattgacaaatcttcaccttgtttctgatgagtactcaaaggcaaaagatcaaagttgtgatatcacaaaaggtgctgaattaggcaatttttatttattttttacctaataggagtctaaggaaaattctaatcctgtatatatctttttcatgtagaacttcatcaatatgtttaagtattaattcttgttatgatttactgaaacaagatatgaagaaaaactgaaaacaatatggatatcgggaatatataattcagtcctatt

SEQ ID NO: 21825 - DNA, 600 bp, Bovine  MMBT08532
tctgagcattgccagggaagttagataggaaattcagcgaatggcacactatactaatctttgctagaactctggagaatacaatcacaagatcagcccatcatgtctaaatgctcacaggcagctggattggatccacaggggccagtgcccctgtcatttattctttaaatgtcccgcctcactgttcagaggcaacttggggcagatctaaatagctggggctctatctgccagaaggctaatttgcaaagatcgctgcaagatgaaagtgatatgaaacatgacaactgaattttmcagcagcaaagagaatagccaaaggcacgaacagccatcttaagctacaaacagagaaagggaggggaaagcttctctyaggaaaagattaaagccaggtgagatcaagtaagtttagcgtgcttgtaagctccctttgtatttgacacatataagggtatcatattgggaaaaagaactccagtttcaaacactacaaagaccaaacaggtcacacagtgagggggcacaatgagctaaaggaaaacagtagtggtagagactgttgacaactggaggaggttctgaaaaaaaatgcag

SEQ ID NO: 21826 - DNA, 600 bp, Bovine  MMBT00581
ggcacctgctatgtccagaaactctactctactgctctactgcattcggctcattaatgcccaagacaactctacgcgatagatattgttaayccccactacacacataaaacagaagttgaaagaagttaaagaactagcgtgaagtcacaaaaaattagagaacagtagaactgagattagacctcaagtcaattacttgaaagcttgagctatattatactatcaagaagtctattgcctcttttcgtcaacatcactaccttctcacattcttagctacggatcccccaaaacttmctttctatagtttcaaaaacaaaaacacactgaaagattagggtacagaatcacaaactgatttattgctatctcaatgaaggcaatgcaggttaaaaaaaaaaagtttcaaatgctgttactcagggaatacacccttcatttttcagagttcccacacagggacttctcacttcatataaactgcctggtccctgatggacagggaccatataagttgtaatgcaaccctgacacagaagtcaataaagacaagacagaaagaaaacaagttctagtttatctttcacttaggtggta

SEQ ID NO: 21827 - DNA, 600 bp, Bovine  MMBT04034
tttgaatgcatataaacacttctaaagtacgataggcttggaatttttcaaactactttcttttttaaaactgtatagtaatttatgtgaaaaaaatagatcagatgttctttataacagtataaaagtatataacatgcaagtactaaatgtgaagacatttgctttcaaaatgtggtagatatatttttccttttctgccttctattctaaatatttaataatgccatgaaaaaatttaaattgccaaaaacacagtaaaaagcccttttaaaatgacatatttggagttagttactratcatcatttcaaaaatctggtttaatatccctttaaatataatatttaattaatgaagtaatgtagaaattctcccctgctctctcttcattcatattatatacataatatatgcatagcacgtgtgtgtgtgtgtgtataatatacacagatatacatgtattttgggacatagtcagcctgaggctttattgtgtgatattatgataattaaaatataaaattgctctttggaacaaaatagataaataatttgtctctgtcaatcagaatgcacatgttttgctgttcacttgaag

SEQ ID NO: 21828 - DNA, 600 bp, Bovine  MMBT05424
tctgcacagaaccttcttgtgaaagattgaggttatttttctgatatgactgttctctctgtggcaaataactgtaatgccaaggcatggttccaaattagtcattcgctacaatttaaaaatacttcactccaatattttgccccgacacagatttcactgcatttcctcagggttcttacagtgtcttcatatgaggagtcacagaaaaatagagatttgaatcgaaaaaccacctcagatagagtagtctgttttctaccaggaatgcttgtccagcttctcctttctataatatcyctttccccatgtctgagtaatacataaaaatttccgagtgaagcaacactagaagcctgcaaacacacatgattttaagagtgagtgagtgagagagaaaaagcaagtctgtcacattcatctctccgaatgacattttctaaggggaaacctcagccctgggctggtccgagcacagcccgggtgaacctgctgccttcacggatgctttctgcgagtgtacaatttttgtttgggatcaaaccaacttagatcacccgcggttcctttaaataagttaaaaccagcagtcgttcacat

SEQ ID NO: 21829 - DNA, 600 bp, Bovine  MMBT11814
gaggattaaggatcactgaaagcagtgactaatccatggctgggactagttagccgcctgcctggtatgtggctgtggctgacatagagaactgagcctgagagctggtgctttcctcctgctttaatgagagcagtgctgagaatagacaacagtgtgggtgatgcatagttaatcaagactttgggtgaacactatattcccaattaaatatgatttaattctgcttatagtggcagaaaaagattcttacagttcttttgtctgattacatcacttgctacattaagttcattaggratattaggcaatgaataaaggccaaaggaaatgaaccatttttaatgaatgaagaatagtatggaggccatttactagccaagatgaatagtagcaataaactggagattcatttctttgacactctgtttaaatgcattcctgttgcctcttccattcagaagcatagattgagcaggccrtaaaatttacaatgttatttggaacaatttttttttttttttaggaaatgctatagctgaaatagctgaagartcttaaatgatagactgtggataacatcttgagagctaggtcytc

SEQ ID NO: 21830 - DNA, 600 bp, Bovine  MMBT07288
cccaggcaccttccccagacgggtggccctggcgtgtacttactgccgacggcggagcctgcggcggcacctgcggaaagagggggggtcacagaagagtaaggagggggtggcagggctggggacaggaaaccaggggggctggggcacctcaccatgcagggactgggtcggattctccacttacaccctcactggtgcctgagagggaagggctgctctgagcccattgtgcagatggggaaactgagtcttggagctgtgacttaccccatcaggggacctgctgataagcctctrctgggggcctcacatgcacccttctcatttgactttagactctcaggtcctccagtgcaaggcaaggaggccggaggtcatcctctggcgggtaatggggtgtcggagaacatgagggtcctaggcacagggacagactggtttactggaggctctgatggaagctgccacagggggaagccgctgtgcctgtgcccatctgggaaacacagggatgcctgtggggtagacgggaaggcgatcacagcggctgtcacgtgctgagggctttctgcatgtgggcccatgctgagtgccgcc

SEQ ID NO: 21831 - DNA, 600 bp, Bovine  MMBT12205
gaaatggaacgatccagatctgtccttggagttgttttcctctgacctctgcccctatcccaacatatatcctgagcctttcctacaagagggaacagttttcttagacatactattggaggacaggaaagagcagctttgtgtcatatcatagaatggcccctagaaggtagcacatttcctgaggaggtaaactttttatggtttaatttttaattgctcactcaacatctccacctcaatgcccacaggagcctcaatgtctctatgccccaactgaaaacgcccaccttctccatytctatggtacctcccttctcccagctactcacttcaaaacttcaatgagtgagagcttcccaggtagcaaagtggtaaagaatctgtctgtcaatgcaggagacacaagaaacatgggttcaatcccagggtcaggaagatcccctggaggaggtcatggcagctcmcaccagtattcttgcctgggaaatcccrtggacagaggagcctggagggctgcagtccatggggtcacagagtaggatatgacttgactgagtgactgagcatacacacacacacacacacatacacagtgga

SEQ ID NO: 21832 - DNA, 600 bp, Bovine  MMBT12934
attctgcctgccgtcagagcacaaaaatatacattcacatcgtctgtttgttgtatcgtattcttggatcatacagatttagttacaatacacacacaggtcagccagtgtaaaaagactgaaaagaatgaaaactacaaatgaggacagatgagctatgcattatgtaatgataaaacaggtgtttggggagataaacaatgttcaaaagcaaaggagatttaaatactgctgcatctgtaattgctttattctggttattagacaaaaagaaaatagctttcaaatgaaatccaaacktgctgtgctataattgaaatatatgaacgttgggtagttctgacttcatttacttttgttagaaaagcaaactttatgcatgggagggaaactttttaaagaaactgttcctagtgacattaaaaaacaatgttaattctgtcatgatgcttttgacagtatcatagggttgtttagcattagttgtgaattattggcwtgtgcttctcagaatcatacatacaaaactgagcaatctagggggtgaggatgctaacatactatctatttttgtttataggacggtgaactttgacataa

SEQ ID NO: 21833 - DNA, 600 bp, Bovine  MMBT21061
gattccatttcactaaagtaattggcttggcctgttgtaaaaaataatcagccccctctccggaacaaatgctagcacatgctaatgagggagtgagttcgttacattgatggcgtggactgacagttattaatgattgttatgataaacagacgagtgcgaattgggatgagttgggcaaaagtgacagtttaaaaataacgtatattggaaagtactaacgaagtaatatactgttaggaaaacaatcatgcaagttgtcaaggaaagaagtgtaattatacagccgcatgggctgcytaggaggacagggaccggcctgataatggacacattttttgttggcaagagggaaatatgttatggcagaaagaggtgcagattgataaattaattggtccttctcgcagctccgagagcaaacttggctggcagtcaccatgcagatgagggagatggaggttgcccagcgcttcttctctccagagtctccctggtccttgttgccaggcttttctgaagcctctcttgtgtcctctcctcacttttcttcatgagctgcaacaagttatagaaagtgcatcctgaggygcaatggac

SEQ ID NO: 21834 - DNA, 600 bp, Bovine  MMBT04803
atgcctcttgaaaatctcatgtaatgtttattaattgcaaattaaaatgtgttttcgttaggtggttgtaatctgaagaataaatctactcagtcattggaatattgtgctgaattactgggtctggatcaagatgatcttcgtgtaagtttaactacaagagtcatgctgacaacagcagggggcaccaaaggaacagtgataaagtaagttccctgctcactgctccttgcaagtcctgccttgtgagggaaaagccagatcctgtctctgttccttgctgagtaaggcaaaggagtktatcaaaccatttyaataaatttaaaaagtaaggataaaaaaagcccttttagctrcacagaaaatcctgtaacttactttcagaaatrttagcaaggtatgtttagcctggttctctgctaagctaattcccaattattgtcatgatgaagaaaatctgtgcctgcagtagcatggtccttcagagacatttctggaggccacggaaaggctggtagaagccctgggtgtggtcctctgctccatttcccctgtgtgctaaagcagttctatgttttatggatggagtgtccacataag

SEQ ID NO: 21835 - DNA, 600 bp, Bovine  MMBT16552
gtattaatgtagacacatgatacagacctaaaccaatcagaataccagtttgtcctatccacatggttggttttgatatgtccatgtgatgcccttggagacctgagactgcgttgaaatggcaaacagactgtattctagtcaaagagggaatgattatctagggatggaaaagggggtcaagaagtggagagagtcaaacagggccttagtgactatgtttgaccttgtatacagtcatgtcaggtcagagtccacaattttcagatccctaagctgatgaacttctctgtgattaargctaatttgggtcaagtttcctgtcacttgcaatgtaattaacaaatacaatcaatattaacgatttatgccctctccctgttactagcaagaaaaaaagtgtatcttattttttgcttactgctttccgggctacccttcctggtctgaatttctctgacatgtctatacttggctcataccaacctatacacccttcatctctaagtcacacactgtcagagacttactttgtaagggatgggttatgcttatccatactaagtagtctcttatgtgacctgatgttcatagttactc

SEQ ID NO: 21836 - DNA, 600 bp, Bovine  MMBT08902
tggtgactgtctgtaaaaacaaaggaaagaggaacagtgtaattttaaatgtgttttcaagaagataagtcataatacagactctgtgaacccttaaacagtggatatccatctcagctgcagctttcagaggagttcatgtgagaaaagatgtgccagataagtaaatgttctaatgttagtcttcatatctgttatgggctaaatgattgttcaccacttctgcccaccaatttgtgtgttgaagttttcaccctgaatgtgatagtattaggaaatgtggctcttgggaagctattytgtcatgagttagagccctcatgaatgagattaggggctttataaaggagatgccagacttctggcctccagactgtgaaaaaaaaaaagtttctatcgtgaacaaaccacccaccctttagtgcttcatatcatctcaaatcagagaaggcaatggcaccctactccagcactcttgcctggaaaattccatggacagaggagcctggtaggctgcagtccatggggtcgctaggagtcgtacacgactsagcgacttccttttcacttttcactttcatgcattggagaaggaaatgg

SEQ ID NO: 21837 - DNA, 598 bp, Bovine  MMBT09922
  misc_feature (1)..(79): n is any nucleotide
nnnnnnnnnnnnnnnnnnnnnnnnnnnnnnnnnnnnnnnnnnnnnnnnnnnnnnnnnnnnnnnnnnnnnnnnnnnnnnncgaggaagagatggctggatggcatcactgacttgatggacatgagtttgagtgaactccgggagttggtgatggacagggaggcctggtgtgccgcagttcatggggtcacaaagagtcggacacgactgagtgactgaactgaactgaactgagctgtttgggtattttaattggaaattaatcccttgtcaatcatatggtttgcaaatattttcttmcagtctgtaggttctagattttgttaacgtggggttaattaactatgactgttttgcagcctaagaggtcaagatgtttatttctatctttattttcacttaaaaaaaaaatctctcctccaattaaaaataaataaattkttataaagtaaattaaaaaattctctaaaaggtacatcacttttttttttwaactggttagtccagcatttatacctcacctcccatatgtttgcagtacacatttgctatgatttgtgacaatgacatttgttgtaacacagcatttaacagttgt

SEQ ID NO: 21838 - DNA, 600 bp, Bovine  MMBT21363
gaggggactccaggtggctgacacagagaagttggagagggacaggacaaggggtggggtgatgaagatggatctggagaggggaagatgtgggcagagaargggagggaatgggcagtgctatcccaactttgccattttctgctctgtgaccttgggcaagtcactcarcctttctgggccttccgtctgaaagatggaagcttgacttacaggctggtgagaatcacatgcaaggcaaagtaccttgtcactccattsattcattccttcatttatccatccattttcccgagttcyttaggcacaacagatgtattgtacatggtgggcttcttcccctatcccagacttagggttggctcaaatcccaactcagaaaggatggagctgggaggctgaagttaataatactgattctatcatcagggcctgaaaagctccatagactgagagatgsagagggggtccaaggtcaccccctgtccctcactatacacctggcttgtgctatagatgggacagtggctgaaaagtcagagatcagaaaagttccacttctttggattagcccttraaagcttcctggaggaggggatt

SEQ ID NO: 21839 - DNA, 600 bp, Bovine  MMBT05787
tatgcttacttattttgagcatgggttttgaaatctgacsatccagaacttgaacccagggtcaactaattactatttaggtgactttaggcaatttcttatctgctccacacctcyactcccttgtatgtaatgtgaggttaataatatctaamtttcagagaggtttgtggaattcagttagataatgtatracatgtggttaaaaaatattggtcatttattaagtgcttcatcagttggaacttacttttagttggcatactaatgtatacttagctgtgaatggtaaatgagttytcaatttgctcttagtcctagggtatctataaagctcaccttgggtctcataaattaaacacatttgccttagtctttacaaataaatcagaaatactgaaattataggtacttagagtattttggaactcagtgaccttggagaaacatcaccccatgaatgtcatcaacgtttcttgaggctgccaatagcattaatatacccaccaacaaatatttccagagtccctaccacaccagtgtaggtggagctgagaggaggggacagatggacaccaagctgagggcagcatgatttgc

SEQ ID NO: 21840 - DNA, 600 bp, Bovine  MMBT07454
caggctagaagtacttccaggtcgtttggcattcacatcattcattccagctcgactctctcctccttcaaattggaaatgtaatcgaatctcacctcccttagcagaggaccgcttcctcaactcagtgtcagcttctcttggttggaaccttgaaggtttatttgctgtttgagcagaactgctatcttcctgttcatcaaaacctggacttgtctcttcatctgcttctgaatcctgacaactatttttggaattatctacatccattggtgactcaggttcactttctttctcaamtggaggagaatttcctagactactttcttgtctattcaatctgttggcatttttcagtccagtaccaacatcctcagagccagtgtccgacaaggggctctcggrcaccacgtctgtctcctcctgctgacaccctgcacaggcttctgcaggatggcaagccttgccacacttctggtggcttctggcttctctgccctgttcatcttccatcgtctgctttgcattcgcaagctttacatgtgtcaaaaactgctgattatctctactctcctcactatttgtgtcactgtgatcatc

SEQ ID NO: 21841 - DNA, 600 bp, Bovine  MMBT01178
atgataactgatcagtggcaactaatacttttatttctctttcttgaggtgtgagaagcatgaacagtactgacattcagtggtcagccatcctgagctggggatatgctgataacatttttgaggttgaagagtaaacaaagtgagcctccaataaactttatacaaagttcacagcaatatcaggtaaacatttttatgaagtactttataataataattgaacataatgctttaaaagggagtcagactgatgacagctaggctttaatatcctgtagttagttgagaagctgatgrcgctagacatatgccttgtttacagtgctgacagccttcctaactgctgctgtactgactgtgtccccaragtttgttctctaccccagcagtccccagcctttttggcaccagrgattggctttacagaagactcttgtcccacagagcagggaatagggggatggtttcaggatgattctcctaaggagcccacaacctagatcccttgcatatgtagttcacagtagcattygtgttcctatgagaatcaagtgccactgatctgacaggaggcggagctcaggcagtaatatgagt

SEQ ID NO: 21842 - DNA, 600 bp, Bovine  MMBT09339
agttagatctcttgggttcattcacaagtaatcctcactcccaacctcagcctyaggcaaccactagtcttcttgtctacgtagagttgcctcttctggacatttcacgggaaatggtatcatataaaacgaggtctttcacgtcctgcttcttttactacttagcatactgtttccagtgttcattcatgtaacacataccagcacttcatccctttctattattgagtagtgttccatcgtttgcttatcccatatttcatttatcatcggctgatacacatctgggttgttcctacwttggggctattttgaaaaatgcygctatgaacattcatgtacaagttgtgtgggcatgtctgtgtgtgtgttttttaaccatgtgaataggttatctgtttaaaaaaatctttgatatcacaaaagattaaacagcacatgaaacaatcttataaggaaggaagtagcaaagcaatgggcgtgtgtgtgcatgtgcctgtagaatgatttgattctgttaaataattaaataagaacataaaaaagattagaaaggcagaaagctaaaatgttaacagtgttgtctctgagtgatgggat

SEQ ID NO: 21843 - DNA, 598 bp, Bovine  MMBT05511
  misc_feature (1)..(48): n is any nucleotide
nnnnnnnnnnnnnnnnnnnnnnnnnnnnnnnnnnnnnnnnnnnnnnnngaaaatataagtatataaatgcagaaaaagtaggtgcctttctcaaacccactttataagtaaatggaaggccaaacctagctcctggcatctcttctccttaatagtggtttcaaaacttataatggatgtgtcttcctacgatgatgaccttgagtttttgaaagttgatgaaactcgggtttgaatctcagcttttctttttactagctatgtggctacaagcaaacaatttaaactctttacaatatyattttctgacatgtaaactggggtgataactgggtatttaggcttatgaaagattaaatgagataatatttgcacaacactcaacactaatcagaacctgaatattaactctagtaattgtcataagaaaacttgtgttcttttttataaataattctctacataagaaatattcagcatgtgataccaacagagatggttctaagaattaaaaaaaaaaaaactttactatttgtaaaaatgaaataaatttcttttcctggggtgcacaaaaaatgaaacacttatcaagttgcac

SEQ ID NO: 21844 - DNA, 600 bp, Bovine  MMBT12344
gcccacagctcactctttctcaatgacagtgagaccagtgaaaaagaagacaaaatcttagttcactatgaacacggaataccagtaataaaagtgactgtggtaactgtgatgatagtggcagaaactgggaactgattctcggaaaggtctactgggcttgatttattttaagcagccaggagagatctagaatttggatgcagtgtttggatctatccttttatttttctccattgcccactgactttaaaaacctaagatcataccaaacttctattagcatgtccaccatgaatrcacaattaaataactcaaataaataatgggtagctaaagaatactttaaaggtagtaaaaagatagcacctcagtgatttcttagcataatgctaatctttcaaatgtgggtaaaatcccatttagtgggaaggtttggaatcttacataaaaatataacatgcattatatatttcttgaatataaaaaattcaagcgactgtatccttactgatattaatgtaacacaaataaaattataatgaacattttaacacaaaatgcagttcatttctagttaacatattgaaataactgata

SEQ ID NO: 21845 - DNA, 601 bp, Bovine  MMBT01263
  misc_feature (1)..(1): n is any nucleotide
ncttggaaaatcagataataattctcttctgggcttgaacctgcagagtatactgattctctgccaagtttttttttcagaatgatcaggagaagttgaaaacagatcaatttattcattttaagatcaaaagggtatgctatgacatgatttcattaagaattaaataatgcacatgatttcaaggttaagagcaaaaaataactactccatataatggcttaaaactcccagaaggagtctgaatgaggaatgatggcctttaactaagagcaggcccgtctaggtttaataacaagtratttctcttaattgcaattgccttgaagaaaggtattcaaggtctcagaatctaacaagttgtagctagaattcactccaggatttaactgggggaaaaaaataatttttaaaaatactcaaccagctctaggatctcctgacagaactgaatgattttactcttcttagtgtagagcctcaggaatatcaagtcaaactgaggaagaataatatgtgggaattactgaattcattgcttgcaatgctttttcccattagtagagggcgccagtggtaaagaaaccacctgccaatacag

SEQ ID NO: 21846 - DNA, 600 bp, Bovine  MMBT09771
attgtgtttcctttcatgacttctaagccaactgggagtaaggaatgctttctcacacttctgacatttgtaaggtaaatctccgtgtgtattaacatgtgattctggtaagttattctccacaagaaggctttcccacatttcttacattcatagggtttctcccctgtgtgagttcttttgtgttgttgcaaagagtttcgatatgaaaaaacttttccacattgtaaacattcacagcatttctctccagtgtgattcctttcatgtgatatgagagcactgggagaaaagaatgcyttcccacattctttgaatttacataccttctcagcgtacttttcgatgttctcttgatttgtcttcaatgtgacatttcatgtatctagtaagggatgaaccactcatgayggtattttcatatgcactgcattcccatggttttaaatcaggagtttcccccctcattttgagagttttaataagattgaagttttctccaaaggaactaatgtctttactttcagagagtttctctatcattggcgttctgtaaataataagaacaacattctaaatacctttattattttacatttt

SEQ ID NO: 21847 - DNA, 598 bp, Bovine  MMBT02200
  misc_feature (1)..(6): n is any nucleotide
nnnnnnaatcatccctgcgcagtgaaagattctccttgtccactgaagcttcctgatgctcaggctcaacaggacctcacctaacattcaaattccactctttatcttatttaaaaacaaaaactcctatctcatgtgaacaaagtttgttagggcaataatcctgtgaaactgttcattgccggcggatgtcattaatcaatttgtttacacttggtctagggtaatttggcagttataaaatctgttgattggtttctaacagataccaagggcttatcccataaattctgcagctgkggaactaaggacattagggctgtcccttcatattttggagtatataccaccacagtggcaccccacccctccacttcagaatagatrtattacagatacagcatacgttccataaagcaaagcatcrtcttttcttgactcagcagttcttagctgcaaagaccatgattcatctggtcaggtgaatgccagcttccaaatgaraagaaaaaaaaaagaaacagcattagggagattcacctgtaggctctctctcaccatttctcctctaagcctactcttataaagccactgggtt

SEQ ID NO: 21848 - DNA, 600 bp, Bovine  MMBT15364
agtggggtgccattgccttctccgtaacttctccaggtagtgataaaagtgatgacagctgtttgtaatccttaagatatcagtgttctgttgcctgtaataggaacctaactgcagcagcttgagttgttttcctcatctacaaggagttaggaagtccagggctagtgatgtgctcctgcagtgccctcagggacacaggttccgtctgttgttctgtcctgtcatcattagggcgtgggtcttctctttgtgtttgccaaatgactgctgtacatctcggtccaatgtctacagtaycagcaggcaaagatccttatctaataaagaaacttgtaacttkcctggaagtctcacaggacatcccttcaccatcttcttggctagaactgggtctcatatctttgtctgagaataaaattgttctagtttatagagatactaattytataagtttgcccatacacaggaaaggccatgtcttttggcctttaatactgtcctaaattctcttcattttcttttctacttcttagtccttgttttctctccttgttttcaccctgatcttgtctttctctccattaatcctccttttca

SEQ ID NO: 21849 - DNA, 600 bp, Bovine  MMBT16566
aatttctggctaaataaaaaaattttgaatacgtttgaaatatgtgtagattcatggtgacacagcacaaataactgattttgtgagttgtacctggtcttcaaagtcttctgtttatagtatttttatatacttattttttttttggcatgatcatttctcttcacttggcattgggcttttccttttttgctaaaatttgtcccttcgttaagagaggcatcagtctccaaatcctaggatgtatatttgtaactgagtcctgtattgcattgtgaaagtcttctacagtgttgtatrttcttggcatagtgtcacatgtttgttgatagactttctgaagttctatggaaaatgtgggttcaactctgcgccactgaggtcctcagcctcctctcctccagtgtastgtgtttcaaaataagaaaccatcttgaagcaaatcattgtcatctctcagctcagtaaagctatcaatatcatctctagctgaaagaaatgctaacacatttcacttcgttgaaagcatattgtcaggccccgaattgtcaaccattcgtttatctttcattgcaaaactggmatacagtcagtcagtta

SEQ ID NO: 21850 - DNA, 600 bp, Bovine  MMBT21577
tttaacaaattggaagtgactggtgactttattaagaatccatttagtagaaagtggggccagagaccagaattgaatgtactgaagactcgggagttaggggtttgtgggaggcaaaaatgacgatattcaccaagacacagaaatgtaccaacacctcactaaagaatacagcatcttttaatacttggtgccactctggactctgtttcataaacaggaggatgtgtgacattattttcgttttctaagggctgaagatgtcagagactgtacctccttactagattgccrgaaagmgggattttggaaactctagcatttcaaattggattggaccactgttgtcttagacttcatttgttttaggcctaaagaaatgtaactgttcccaaagtcgaaatatcttgtttgatcctacttaaggatgaattgctggtcctgtaggggcgtgaacacgtctattttcatgagcttaattgatgtcctatcaaactttgtgacacagaacactgggaatttccccctgggactgcaatacactcttaaattttctgtgtgccgtttctccacagatcgcaagacaacagcagcagcttc

SEQ ID NO: 21851 - DNA, 600 bp, Bovine  MMBT10063
ttaataaaagagctgctttaaacagaagaggcaacacctgggaaatgagtacaaagtccctgggctaaatagttcattggcacctctagcagaggtcaagtgagggccgggttatgcaacctgaagggagcattttgttgctacctgacaagagattttggtagagagagataaccaaccggctgtgccttagaagctagggaacagggtgacaagaaaacatcctgtccttattcccattcttctctctcctgtgtgttcctcaccttgctttaaccttagaagtctgagagaaagacygtctgttgagaccatccataaaggtcagcttcctggagcacagagcagacatggtcagatccactctgaagaggtaaagaaggaatactcagctcagtggccatcttctctctttacatgaagagttctcttaacctttgaaattgtaatgtcttccaaagccaaaaacacagtaatgtaggccatgaattggaaggcttttctgtgaaagcagttgaagtgaatgagctatgagtgaacacttgtgcagagagcatcaaatgtgtctgttaatgactgctgttgtatcttgttctatta

SEQ ID NO: 21852 - DNA, 600 bp, Bovine  MMBT21512
tttctggatcttcaactctaccatgctgaatgggttcaggagcgccacagtccacggctacatgaggaagacaggagagagatggtcaggatagacacttcttcccaggaagagtccctgggccagtccatcctcccagctctgatcctcactccttccctgcctcccccatccataagcacatctggggtgaatcccccacatcagcttctgtggccatgatcatctccccagcctactgagtcctgccacttcaaatggcccttagaacackgcaagaactaacctgcttcccagtgrttggtgaggcctctgtagaaatggacccatagaatgctattaactctactaatctcatagcccctttctttctaagaaagctgctagtctggcaggcctggggtcagatcaggactaggattctacgactgatttcccttcaaaacccaatccactatctcacaagcctaagaagaaaccatgcatttgtatctcagtgccttaatctttccatttcctttgggagaggggaaattattcccttctttattcttaagggaaagaaggtttattcagtagacagactgtgggccatctcag

SEQ ID NO: 21853 - DNA, 600 bp, Bovine  MMBT14991
tatacaaacttataactgagagacactgttgcagggtataaataagagatcatggatcatcgtcactttcagatgtcatgtattctgctttttaaagaagccytsgaagtcttattctaaaagcatgactatgtgaaaactgggcagaagacatcctattgtgtaccgctaaccatcctacatagtagccctgggttcccgaggctgtgagaaccatactgatgacagagaggctagtttcaaatagggacctcggaatgtacactcagaagccatcagaacatcttgcttgaagttccygacaggtagattagaatatcgtggcactcagccacagccccagtgttcggaagagagagaaaaagagctcctgaaacagcctcccttgtgatgctaatggcccacctccaacgacacatcatttattgaattgaaaggaggtctgatatgggcaaggtgtgatgacctggcaatttattttacttctccgtgtcacagacctgtttctgtgggcccagcagggtcaaagagcttaaaacgttatctagaataagacaaacgtgttattttcctcttgctttattcttctatttttttycc

SEQ ID NO: 21854 - DNA, 600 bp, Bovine  MMBT19834
cgaaagaatttttactaagcctatgtaccgccacctccttcccaaatcttttctgtaccgtatcatcctctcaggcataaattttccaccagagaaggatttagccttctctgtaaagtcttttaggatgatgtgtcttctggctggcagtgtttgaaagtcaagcaaacaagccttccagggctcacattgagttaagaaaacattttctgcatgacatttagggccaaattagggaccaaagtcctcattcttttactcaagactaggtttatgtctccacaggcaatgtgaaatggrgtgtggagaaatgatctcatgaaataaattaatttagacaggatgcctattttgttcataccccacagagagagagwgtgtgtgtgtgcgtgcctgtgggcttaacagcaggttagggaaacagtaacaacgaagagatgaagggaaagagctctaagtagtggtaagatcaggcttttcctctaggcattactgtttaccaatcatatgacctggggcgagacttctagagcctctgttttctcgacttttagatgattttatgaaacccatttgactacttcccagggttgtaaggaa

SEQ ID NO: 21855 - DNA, 600 bp, Bovine  MMBT06675
ttggcaaccacaaacctgctctccatcagtctgcttctgtctcatagataggttcgtttgtgccacactttggatttcacatgtaagtgatatcttacggcgttcgtccttctcttcctgacctacttcacttagcgtgataatctctagttacatcaactaccctgttcactgctgacctcccacacttttcagctgaaggtggcatcagctacaagctgcaggaaacaagagaacaagtttctgctttgatagatgatgcgtgtcattatgccagatgaatatggaatgccttcaacygtgaaggaagcaggaatctgcaagatcaaactaaacccaaaataaaatcgttgtgcaggaaacaatttaagaggtcggtgcgggttctcccctcaggtatgcaaacatggcacagttgatccagctggcatcagtcagcctgcctgattgttctttaaaaagcccttgttttgggttccattgtaacctgcgcagtgatgccatatcccttgtaccagcaacagactagaggaaaagccaatcttctgcactaaattgttaggggcagggcatgcgtgaaccctggctttgaagcttcat

SEQ ID NO: 21856 - DNA, 598 bp, Bovine  MMBT05183
  misc_feature (1)..(41): n is any nucleotide
nnnnnnnnnnnnnnnnnnnnnnnnnnnnnnnnnnnnnnnnnattcaagttccactgcctggaacgaaaagcatgttgaatcatgtatccacccttgaaagatcacccattccctgccttagccatcatcctgccatagtcttcaccataggttacaggcactatagacaggatcataagaaaaaaacgctggttctcactgccaagatggcaggcggactttaagtgcccagctctactccagtgaagctctagtctattccaagccaaactccaaatgcctttataataatagaaataktattatatatgttgtgtgggccccatgatgattttagagaagaaactgtacaatatggtttaaataggcttttgtgggttggcctggaaacctaacattgtttctatggaaaaatgctttaaactmcaaatgactctgttcgaactgaactttggaatgcaacctgttttaaattgggagattgtgtacgtgtttacaattaaaatacacaggaatgaaagtgagttatcaactgcaaaaatcacatttggactgtggatttaaattgatcaataacccattgtcattttggataaaa

SEQ ID NO: 21857 - DNA, 600 bp, Bovine  MMBT13741
ttggagaattccacacatcagtgcctgtaaagatgggtgatttggaacacacagaggagacacaaccaagggaacaatggagtaagtgcctacagtctcgtccctctgaccatgacagctgagcccgcagctttagagaacccaggagcatcaaggtaggcagcacacatgactctggcccccgaccctctgtggcacccacagccacagataactagggcagcagtggcaatsgggtctgggatcccatccgctcagatgttgagatgcccacccccaggctcctgaactccatccacrgtagcggagccttcaaaccttaaaacaacaggtacagtagaggtttctgaacagyaccggctcccctccaaagatcctccttaccccacaatcagtggcagactgtgcctgcaactcaggggattccagagkcaagggaatatagcccaccatcctggtgtttgacagtggctctggcagaagcaacacagccagaaccccagagggcaagaagtgatggcaaagacacggagtcatacctcttacaaagacagtagtggatgcaaagtgtccctctccaaccaaagacagcacagctaa

SEQ ID NO: 21858 - DNA, 600 bp, Bovine  MMBT09265
tactctagctcaccctggcacactagatcacattatacagaaaagtagatagaacacacatataataggcaatggccaggctccgttatgaccttattttcactgataaagacaaatctcataattcactcgtagcaatgtcagtcttttatctttccctggactcatgaggatacaagtcacatccactgagcctgctctctgtgtgacaaggaaactcaggcagccaatcatcgcaaaggtgattcattcatctgcattcagaaatcctgttggttaaaaagcaataaaagtgttagrgacttttttttccccctttcactctataaaaagtggctcactgttaaaatatatgtcttcactcatctctcagagctgctgtaaaaataacatttggcagtgggaagtggaacttttgctyaaagaactggcgtgtgtatatagtatttgtatatttcttagatgtccacggacacttctcagtgctttcgtgttctagagacttgcrtggataaaatttactatggcatgggttcttgatttttaaagtgtttgtgmggctttgtagagtgtggggttgcagaatgaagtgataagaga

SEQ ID NO: 21859 - DNA, 600 bp, Bovine  MMBT00904
acaacacccatcttgttgagatggcatcaaagcccacagaaaggaccctggggccggagtcatggttggttcctttcttgaaggctgtagagttgaacaatgttaggcagacaacagggctgcccaaccagggaattagctatgcagcctgatgcagggatcttttcctctctgaggcgttattcccaagagctttccctgactcccctggctggagaagaatagcaaacttactgatgcttcagagtaatagaagcaaatggctgaaactggtgttaatttcagctgaacgctgttagyctccagcagcttatagttctgtgagctatgatcacatctaggggtcctctagcccaacctctctcccatactgaagacactagcatatatgccagcctcagtttcaacactaggaagcgttcttgctctctttctccagtttctggaacttatttgacttttagggcctcagaggttttagttattctgttaagcagtgtaatcggtatgtaccagaagatcaaagaatttaatctatactaccacaggccaattaaaacttttagaaatttaagtcttatcttccatcaagcataaaag

SEQ ID NO: 21860 - DNA, 600 bp, Bovine  MMBT13628
ttctagtggaggaaccaggtattagaaaagcaaataaatggacacttcagataattttaggtgttgagaggaaaataaraataagttaatggatagagagtgacttgagaagagaggacttgggaaaggatgctcgggaatgaagagatgacattttagcaagatcagaagaagaagggactagttgttcaaagacctggtggatatcatgttacatttagaaggaatagcaaaaggaaaagctctaggtgagaatgaccttggtatggttgaggagcaggaggagtgcccacgtggccrgagtggacagaagaaatatgcaagacaaggtgagaaagatggctgagggcagattatagctgacaccatgctcasgtgtctggatagttccctaagtatagtgggaagcctctggataactttaaagccaaagagtaatgtgatattggtggggaggaggttaaaaattctggcagccatgtggatggtagaaaggcaagttacagggtctgtttgcatagtgcagagaggtgatggtggcttagaccagagtggtagcagtgtaggtgataagaactaaatgaattggggaaacagtcg

SEQ ID NO: 21861 - DNA, 600 bp, Bovine  MMBT04236
cctgtcattacaaagtaccatragctgagcagttyaaaacaayaggaataaattgtctcacagttctgaaggctagaagtctgaaatcaagggccatgctccctctgaaggtggtatggaaggaactgttcttttatagcttgtagtagcctcagaagtcccttggcttatagatatgtcactctaatggttcctctccatatggtattgccatatgatcacagcatgttccctttgtcatgcttgtctctgggatcacatgcctgatcacagcatgttccctttgtcatgcctgtctcygggctcacatttccccttcttgcaaggacactaattgctctgatttaggaaagatagtgagggacagggacacctagcgtgctgcagtccatgggactgcaaagagctacttagtgactgaacaacaacaaaggaaggaccacatcctgagagtcaagactccacaatatcttttattattattatttgcatgtgtgtgtggtgtggggatggagacacaagtcaacacaagtcaacacaagtaattaagttaaaatgaaatcattacagtgcatcctaatccacatgattagtgtcctt

SEQ ID NO: 21862 - DNA, 598 bp, Bovine  MMBT11365
  misc_feature (1)..(7): n is any nucleotide
nnnnnnnagaaaaacacaaaaaatggaataaggccttcaagacatcagcttcgcgctgatgggtctgtcagtacctcagttccctgttcgtttgcctttctgaactgtttatttaggcactcttgagtgttcctgcacattgactacattagctgaagttgatggaaatgaggttattctgtagtaagctgacagtctgggtccttgatgtccaacaattgaaaaaccagaaatgatgccctgttagaagaaagtatattaaggaagtaaagtgagaaaacaagttagagacggaaaacrttgtttccattgcagggtcagtcgtttgtaattgtggagtggttttgaaagctagttttgtctatgatgcaggtaaagccagttttgactgcagaacaaattagtagagactagatgtccttactaattgactgtgatcacatgacccagatggaaaagtcccaggccaagtttcttagtggacaaatgtcccctttaccaatggctgtctcctcagccagggaaacaactgaataagccaggaaatgacttccacgataatgtcttagcaatcagtgtttaactaccaacaccataa

SEQ ID NO: 21863 - DNA, 600 bp, Bovine  MMBT09160
atgggatttgactatgctgcttttgactcaaagaatccattttcaagtcttcttttaaaattcatgtgagaaaataaaatatagcatttcttacattctcttgcattaatgacagttaagttcttatttttgaatacccatgtggaatttttgaagatatcgaggcttcatgattttttctattcacttgttatgttttttaaagtaggtctctggatcagatattgtcccccacattttttgatttatattgtatcacatcatattgtcattaaagaaaatatctttcttcatattttrtgggaaagatctcrgagaagttagtttttttttttttttttaatggaattctttgtttcctggattagtttgagaggctaargcccagaaatataattggaagggaattttaactattttggttgagtgtctaatttatgtacacatttagtggttattagtagaggatttagaaaattttcaataaattcagaaaagcagtcatccactatgagatagaataaatcctttcttctttggttggatatctctttgcatatctctgggtcatagacttccattcaacaagggccaagtttc

SEQ ID NO: 21864 - DNA, 600 bp, Bovine  MMBT12768
ttatgaattaaagcattaaattaaaacagaatttaagaaaagtaaacaaaacatctgataagtaatagggaaatattatggtgaggctttctatttcttcttatattctaatccagggatcagcaaactagagcctgaaatccagatatggctgctgcttgtcttttgtaaacaaagttttattggagcaaagctatgcccattccrtcatgcgtgcctacaaccgccttcccgctgtaacggtagagttgagtagacrtggaaaagacyttattaccaactcttcttctaaactatacrtagctatcttaccagtcaaaactggcagccaaaattttttttttagtgattttgcactagctttgtttactctctactaaacagtccaggctttgtaccatacatagagaataccaattatgtgattctgaaaacacacaaagtaaatataatatcatactgaagatacaagatatatttgtatcttccaggaaaagcaatgttaaaataaatttctaaaaatttaaaaatgaacaataaaaagatgccaagtacaataacaattaacagtaccaataacagttgtacttatgccaagta

SEQ ID NO: 21865 - DNA, 598 bp, Bovine  MMBT11617
  misc_feature (1)..(158): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacactcttccagaggccagcccatccacttggccgctcccaccgccccaggcttctggagcgggaggtctgagatcagctgggccaccccaggatgggaggaagggaaaagggaggagagaacgctgcatcagayccaaaatcaagtctttaaatatacactgctgaatagctgggctaagcatcagccagggtgacatgacaacactctccaaatatttagaatgtgtgagtcctcaggaaggggaattgtttttttttgtctgaaatgaggaggtggggctgggggagcggctgctgacgagcaatggcacaggattcagaaggagaaggaactcgaatgtcggcccagaacccttttctctggctctgcctcagtttctccctcgtaaagtcggggctgaatgttctctgaggtcagcccaactctggaa

SEQ ID NO: 21866 - DNA, 601 bp, Bovine  MMBT02596
  misc_feature (1)..(1): n is any nucleotide
ngtattcctagttaggcaactgacaacccctagaatgtacaccaaaactaaacacacatacacacacactgctatgtgacattctttatgggttcctcccaatttcctagatcttcaaatgctggagtgttttagactgcactttagtactcaaactattccttcctaactgttcttattacttttagttattaatccagtctctttgctttaattattaactcttgggtaaatgaaattgccagtatggcacagttttgactgaaaaaaaaaaaattgacaattactgtggttcaacctratattctgactaaccccaaaatttatattttctacccaaattctccatgagttccaccttcatgtacccaactgctaagtttcatattcatttaaaggtttgattggctgtagtgtcaaatatgttgacaaaataagggcaaaaaggactggaaaagggaacttttgattgacttccaggttattcataaggaagtagcaataggagagttgagagagagtaatcagattacaaagttttttgtatacatatcaggttcagttcagttcagtcgctcagtcatgtccaaccctttgcaac

SEQ ID NO: 21867 - DNA, 600 bp, Bovine  MMBT08049
acaccagaaacattttcccagctgtccatttttggaaaattctctggaaaaaacgctgaggttcagcatttcaaatttgagtatgcagacacatgcagctcgcctgagaacatttatgtactggccatctactgtatcagttcagcccgagcagcttgcaagtgctggtttctattatgtaggtcgcaacgacgatgtcaagtgcttttgttgtgatggtggcttaaggtgttgggaatctggagatgacccatgggtagaacacgccaaatggtttccaaggtgtgagttcttgatacraatgaaagggcaggagtttgttagtgagrttcaagccagatatcctcatcttcttgaacagctcttgtcaactgcaaatacttctggagatgaaaatgctgatccaccaattgttcattttggacctggagaaagttcttcagacgatgcagtcatgatgaatacacctgtggttaaagctgccttggaaatgggctttagtagaagcctggtaaagcggacagttcagagtaaaatcctaacaactggagagaattacaaaacagttaatgatattgtgtcggcacttcttaatgctga

SEQ ID NO: 21868 - DNA, 600 bp, Bovine  MMBT08439
gataagattttaattatggcatgtggtagtaaacttagaaagctccagatgtaggtaactttaaacttaaacatttcaggcattttatcattggttactatgtgattgctggcagaaatgcttaagtaacaaaatatataatgtaaattttttggcatctatttaagagtctgtaagcatatgtacatttctcgtttgtgtggtctcacatgatgttctacattatggttataacttattgggaggaatttatggtgtttggaatgacaacacacaggaggagagatgattgggtatttmgctctttcgggactgtatttcttcatcgcctcatctctatttcctagcacagcattctcaaatctggtacagtttcaaaatgtagcgtcactattgtcttattttctctgggtgggcacagacatacacaccaaggtgaatgtttagatctttatgtttctgtaagaaattggattcccgcccccccgcccccacacacaccaaattgctttagaatgttaacagttatgtgtgcacttcaacatagcaaaagcccaggatggtgcagccatggaaatgcagcctctgaagagtgaagaa

SEQ ID NO: 21869 - DNA, 600 bp, Bovine  MMBT08284
aacagctgcatctggttggatgaattgcttaacttctgttctcactttcttcttttattaaattaagagttttgtagagatttaatgagtcaatgtatacacagtgttttgtgcctacatgtagtgcctttgttcccartcgtgtctgactctcygcraccccatagactgtagcccgccaggctcttctgtccatgggattatcccaggcaagaaaactggagtgggttgctatttccttctccatgggatcttcctgacccaagagtcgaagcttcatctcctgcatcttgtgcattkgcagacagattcttcaccactgagccatctgggaagcccttgtgtctacctgataaataataaataatatctattgaatttttctccaaatgatggtactcattttcctaattttcagtggactgcaagcttcttgggacagggaccatattttatttattcctagagcctagcacagcatctggcataggttggtacttaataaataaatatgtgttgaattaataaggaaaataaatatttaaacaactatttggtgactattgtgcatggtacatcatataacttgtaactgaagta

SEQ ID NO: 21870 - DNA, 600 bp, Bovine  MMBT08584
tagctgatatttgtgtgcttctactgtgctctctgctgtcttagctcctcgacgtacttacccagtactcctgtgtgagagaaaatatataattagaaagataattgatgacagaattttataaactgctgaggaaagcttagcttggggggaaagatacgagttgatggtacaaaggcagagattcagctttctttgaaatattggagaacatagacgtggctgagtgttgagattttttttctaaacttattttcctgtatgaaaaggttatgtccgtcatgggtaatgacttttagrtgcttctctttgcttattactagtctgaacgtgtgtaccttgtgaccatagaactggagaaattgctttctcctaaagggctcccaaacaaataatcgtaatcagaactccactatttctaacttctttcatctgtgttaattaatttcacaggtgtttatttagctctttgctatttgaaggacatttattattaggtattgtgtcaatataatgtgtgacccttgtctttagagagttcctgtatgattggaagggagccatacacctacccggtttaactgcagtgaaaccagggag

SEQ ID NO: 21871 - DNA, 600 bp, Bovine  MMBT03996
ttctacataggaagtaagtttagagagaacaggtccacgggctgagcccagatgcctcccacaagtgcagaagtctaggagtagagcaggaacccaagcaaaagaaggagataagccagaagtgtaggtcagtgtcatttctcaggtgccaagagaagcccgtgtctcttgtcgtttcccacaactttatgaggtcagtgtgattttcacctccattgcacaggtttgaaaactgaggcgcatcgtcaatgataaatcccttacccagagtcaccttggctggaagtgacagggatgcartttgaacctccatcactatcactttgaatccagcagctctatagtcttcaatacacatgatatatggtggtggttgttcatttgctaagtcttgtctgactctttgcaaccctgtggactgcagcacatcaggcttccctgtccttcactgtctcccagagtttgcacaaactcagggccattgagtcrgtgacgccatccaaccatctcatcctctatcctgcctcccttctcctcctgccctcaatcttccccaggattagggccttttacaatgagttagctcttcacatcgggtgg

SEQ ID NO: 21872 - DNA, 600 bp, Bovine  MMBT09073
caggccgcaacacaaacattgaaacgctgtgccagtgcaataatcccatcgcaggctgaagacactgtgtgactccattcctgtgagagacccggagcagccaaactcagacagacggacggccgggcggcgtgagcagaggctgrggaggcggaagggaagtcggcgttcagcggggacggcttcagaagccgagaaacccctggaggcggacggtgccgatggctgcacagtgtgaatactctcrgtgmcactgaactccacactttagaagtgtcagtatggtacaatttatatctrtatgtaaccatgtaaccacaatatttttttttaaagatgaggagaggaaggaggaagaagagactgaggagaaagatacaggatttgggaagaaaagctcaaagcatttttgactgagatgactggcggtccttttcttttttccacagcagagggaatttctgatattgcagtctggcccacctccccagttctcctctcagagaacccctgtgctctagaaatccgtggacaagtgggcctgtgggtctgtacgctggcatgggaactagttttttcttacttcccagtttaatttag

SEQ ID NO: 21873 - DNA, 600 bp, Bovine  MMBT12981
tgaagagaggattgagaaaggagyagagaggaatcttgtrtgcctttccttagaagtcagcaaatctcttccttactggttcattatagatattcaatggcataatgcagggaaagtacagataacaatgctgaaaatagacctagctacgataagtaggagacggcagaaatatttgttgaatcgactttatcattttctcaaattgtctatcctgctttctttcctttgtcttcactgcaggaaattgagttttgggctgcaccatgactttgtaggagatggctgcattttaacctytttagaagcatttcccatagagcttcgtgcaatcaggacataaaggtaaaacgatctgtatyattgctttgaaaagctcaggaccattctaattgcttagcaggagagaaagactgtgcagaggtctgaagcactaagatgagctgttatgaaaagggttacatgtatcttagctctgttggttctttgaaaatcaaaacgtctgacaatacaccctggggaagcagctgtgcctgttcttttcaggcagatgagcttaatacttgctatagcagtgatttcagacatactgcctttctg

SEQ ID NO: 21874 - DNA, 600 bp, Bovine  MMBT11009
gacagaggagcctggtgggctacagcccatagrgtcgcaaagagacagacaccactgaagcgactgaacatgcacacacacactaaactaatcatctgagctactagaggtctgtaaatcaggaggctggtgcaaagctctgaggcactgtggggtcatcgaaaattagcttcataacttcctgcatcccttcctttacaaaggcatccccatatttcagatgtctttgcatcccagtgcaaaggtatccggaagtactggagggaaaagctaagtattgtaacttagagaccaaggcarttcttcctaaacccatatggtattggtgtgtgtggtaaaagggagggtggatttaagtagttttaaagtttacctaaaggatgaactgatgagaattactaagaaatttttgaaaaataggagaggtgaaagaaaacttgtctttccagatattaagctcttagcattgcataaaaatagaactaaagataatgtaggccaatgttatctgatttaaggatgaaagaaggacttaataaacccaaaataatgaagggaagctacaaaagaaaagtagattttaaagttatataaatcaaa

SEQ ID NO: 21875 - DNA, 472 bp, Bovine  MMBT03559
aatgccagcgagctggtttcccatgatggcagcaagcacctctgagacagcaagttaggatacaacacgtactttctgaaaaaaaagaaagaaaaaaaaagaagcaatgaaacatcattttttatctatccttctacaaggtagatacatcatatttctcttccatcccacaggactgtacttaacaacttcttggcagcctctaaatttcagacatatttatcttaaaagatattattttgtcgtcctttccgggatattaaaggaaaataggccccatcaatattaaattgaaatgtyacaatgtgtattttctgatacttgaaaaatttaacaaatctttactacgtgttcagtattgtgcttggggctgaaagaggcaccaaagtgctatgtgacacagttatctgtccaagaagaatgtgtaatctgaatacgaaacccaagcacatcttaaatctaactgctgctg

SEQ ID NO: 21876 - DNA, 548 bp, Bovine  MMBT01611; identical to SEQ ID NO: 4501

SEQ ID NO: 21877 - DNA, 600 bp, Bovine  MMBT09016
ctcgcctcagctggagaaagcccatatgctgcaacaaagaccaacgcaggcaaaaataaattaaaaaaataaccccgtccaaggcagtgctgccaaagcagctccagttatactgcttaaggaccactgagaccaggggcgggtgacaacttcctgctacaagttgcctccagttccacaggccgcccagttggtgacccaagagaccaaaggaggtaccttttaacacagcagacaccccttatctgacacagagcagagctgtggctgtttgtttcactggaaaagttggttaggagrgaatcatgaaaaagtgatacatgcataccttaaccacttcaaatgaatggagaatataccaaggaatattcattcaagagccttttgaggtaggaccaaagattctctttgattttcggtccccataatttgagtttctttcttaaataaaccacacttgaaataaaccacccagttttgacctccttaaagtacatcaagaatttaaaaaatacttttaaagcaactgtatgttgacctctttcatatttttattctttttttcatggttttttttttcaattatcttacccataccaa

SEQ ID NO: 21878 - DNA, 598 bp, Bovine  MMBT09991
  misc_feature (1)..(158): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccaggaggtggtgaaggacagggaagcctggcgttggcatgctgcactccatgggatcgcagagttgaacacgactaagtgactgaacaataacaaatcaggttttatttgttaatatttgttacctctctgtctagctkagatgacgatgtggtgatcacgcctgtagttggatgcatagaaaagagggtgggtaatgctggaaactgctcaatgatggagtacttcagacgcgtgtggagtgtgtcaggctcatcttggtctgttgcacaaacctgtcccacggtagtacctacatacacaaaaatccyctttactttccaaaacctttacagtttcaactttccctttgactcctatctatcacaaaaaagtttcrcacgacaaaattaataataagaatagcrtttgtacattttcaggattccatataaagta

SEQ ID NO: 21879 - DNA, 600 bp, Bovine  MMBT08876
gctattttgaatactttacctatattcatttaatgcgcataatagctttatgagttagggaatgtttttatctccacttcacagacgtgaaaacttagtcactcgccaaaggtcacaaagtaaaatggctgaggaagaacccaatcatgttagctgggctccagcatctgtgttctcactcactgttctgtatctccaggtttgcctcaagactccagtgattcagtgacagctattattgtgaccatggacgcgcaatttcactccccattcaccaccgtaaatcaagttctacccagytgtatcttctattcaaaagctttcacttgttaatatgcatatcttggcagttttcatcttgactccagagcatatcacaaaaggtaattgtaattctaacagacaatttgttcttagttgatctcaacatgcagcttaaagtctgagaagtggctcaatcagataatgtacaactttaagacaataaagctcctgctgctgcatttgtaacagtgtgtttaacatttgtgattagacctcaactyccaaaattcttctgacttattctcctagtgagttcagctaacctccctttctact
